United States Patent 9,328,346 (POLYCOMB-ASSOCIATED NON-CODING RNAS) - sequence listing, part 152

SEQ ID NO: 192578 - RNA, 24030 nt, Homo sapiens
gggaagauacacgguuuuuaagaaagaacuucuaaccccacuccaccgcccaacggucacgugacgcgccugcguccucgccucaagguuuuuucuggucgcauauuggcuguuaacucggcuacgggguguagcgaggugcauuccggaaguagguccuuugacuuuugcuuccucuacggaggcaaguaacaacccggcggucgacgcuuagcggaaguucgucaagucgcaguugcccccgcacagcggaugugggucgccucuuaggugacgcugggaagugccugcagccuucgccgcugccuucugguugaagcacuauggagggagagaggaagaacaacaacaaacggugguauuucacucgagaacagcuggaaaauagcccaucccgucguuuuggcguggacccagauaaagaacuuucuuaucgccagcaggcggccaaucugcuucaggacauggggcagcgucuuaacguguauccuuguggccuaggccuucggccuuggaguuggucccgccaugcucuggcguccgggucucaggcucugugggggggacgaaaguggggaagaaggugggcagaagcuggaugucuaguugggagagcccacgauggggcgggcugaaacucaguuagcgcuagggaagcgaggcagaguugauuucccgcucgcucacccgugccgccagccuugcugggaauucguauccuucccggcuuuguguuuuaaccagcccuuccaacucugucuucauuguguucugaucugcucuggugacguuaagauucucauuuuccgcugugcccuaggggucuaggucuggcagagguuucucuguugacggcugccucccaaaccuaguguguaaauuucgagaaauucaguaccugaaaguguuauaaaggguggacuagaauuaaugccucagccuugguccaaaauccauuccucaucuacuagcuguuuaagugaccucucaaauuuuuggccgucuugucuauaaaaugggauaauaccucuuguguuugauucuguguccagcacagugcuuugcauucagaugcucaguuaguagcuacuguuuuauagaauuucagaggaaagauguuaguuuacguuuguaggggauacccacgaaucuaauguuuuaaauaguuuacaaaauaccggguccuuaacuuacuuagagugaugauauguauuucauuuucaaaaaugagguaacggcuggaugcgguggcucacgccuguaaucucugcacuuugggaggccgaggcggguggaucaccugaggucaggaguucgagaccagccuggccaacaugauuaaaccccugucucuacuaaaaauacaaaaaauuaccccggcguaguggcgggcagcuguaaucccagcuagucaggaggccgacgcaggaaaaucgcuugaacccgggaggcggagguugcaguuagccgagauggcgccacugcacuccagcuugggcaacaauagugaaacuccgucucagaaaaaaaaaauuaaaaaaaaaaugagguaaccucucccacauauuuuuguuuguuaggaaauacacuuauuuuaugguggagaaaacuaguauaguuuuaaauuucuuuccacucugcgugugaaaauuuucuugggugcagcuucuauuuaaauguguggcugacaguaauguguguaucuuaaggguguguucaucucaaaaugggugucuguuuuaucgccaguuuguuuccugcugauguccagguuuguuuccuaagcauccugucaguauggaguuaaaucuuuuuguucgaaauucuauuucagugcauccuuaaaaugcuuuccuuuuuguauguguguugucauuaagguugucagccaggcgcgguggcucgcgccuguaauaccagcacuuucggaggccaaggcaggucgaucaguugaggccaggaguucaagaccagccuggccaacauggugaaaccaugucucuacuaaaaauacaaaaaguagccaggucuguuggugggcgccuguaaucucagcuacuggggaagcugaggcaggagaaucgcuugaauuugggagguagagguuucagugggccaagauggugccaccgcacuccagugugggcgacagagugugagccaccgcgccuggccgccuuauauaguuuuuaaaaaaaucugucuagauucauacauccugagauguuuguuuauucauucaguacauuuauauuaaauauuuguuauguguaaggcauugugcuaagugucaguuggcgauuaauaauuuggugaaagaaaacagacauauucuuugauuuggagagauaaguaugauuuucauuuaguaguaucuacuugcuuggccauuucauccuuuugggagggagauagagguuaucuuuuccagaauuauaccugccuguuuuuggaucuuaacuugaacacuucagcucacaauugacuaucaacacugcuauaguauacaugcaucgauucuacaugauucaguccuucacacaguucccuggaaauguaaguauaauuuuuuuauaugauauaauccuuuugugauugauuccaccuaccuauuccauuugugguuggucuuugcuacugaacuguaacuugaacuuuagaauuuaggguugaucacuuccauuaugugcuguguugcuguucugaauccagcuuuucaguuuuccuguuaagugucuacuugucuaguggauuuaguauauccaugucgauucucuaaagaaguagauuaggccgggugcaguggcucacaacuguaaucccagcacuuugagagacugagaugggaggaucacuugagcccaggaguucaaaaccagccugggcaacauaaugagaccucauuucuacaaaauaucaaaaacaaaaacaaaaagcaaguagcuggguguugugguaugcaucuguggucucagcuacuccagcagcuggcaagaggauugcuugaacucagggaguugaggaugcagugagccaagauugagucgcuucacuccagccugggcaucagagugagacccugucuucaaaaaaaaccccaaaaaacagauuaucagacaucuaaagucaacauuuugggguuggaggaguaacauuaaaggggaaaucauguggaauuuagguauagcuuucuuuuucuugcugggguagggagacaggcagggucuugcccuguuguccaugguggaaugcagugauuugauuauggcucauugcagccuuaaccuucugggcucaagcaguccuccugccguagccucccaaguaacugggaccacaggcuugccaacauaucugguaauuuuuaaaauuuuuuuugugaagauggggucucccuguguuguccagccuggucucaaacuccaggguucaagggauccuuccgccuccgccuucuaaaauguugggauuacagucaugagccgccauuccuggcauuaauuuugaaguaguuuauaaaauauggucacagcaaaagaaguaaauguaaguuacuuagauuuuccaaaagccuuugauaaaauuccagucagcaguuggaggggaaagcacauuauguaauaauaacugggaaaaugacuuuuaagaacaugaaaaauaggcuaugcaugguggcucauucuuauguauaaucacagcaccuugggagguucaggugggaggacugauugagcccaggaguuggagaccagccugggcaacacggugagaccccguuucuacaaaaaaaaaaaaaaagguaaaaaaaauuuuacaaagaacaggaagaauaaaauuauacuaauaaagaaauuuuauuuuuuuguacagaauuauaaauagugaucuuuucaguguagcuauuugaaaugguccuauuuaacauuauuauaaaugacuuggaauugaaugcauagugauaucccaguucuaggaaggacuguauuuacuuaauaaaacgccaagguaauagggauaaacuugaugaguacuucauauggauugauuuuuuuuuuuuugagauggaguuucgcucuuguugcccaggauggagugcaauggcacgaucuuggcccuuugcaaccuccgccucgcagauucaagcaauccucuuuccucagccucccaaguagcugggauuacaugcaugugccaccacaccuggcuaauuuuuguauuuuuaguagagacgagguuucaccacguuggccaggcugguuuugaacuccugaccucaggugaucugcccgccucagccucccaaaguguugggauuacaggugugagccacugcaccggcuguauacuucaaauggauuugugagucaaguauuucccugcuuuuuuuuuuuuuuuuuuuuuuuauuuuuuuuuuuuuuuaaggaaaagauuauccugcugggcacgguggcuuaagccuauaaucccacaacuuuaggaggcugaggcgggcggaucaccugaggucgggaguuugagaccaacauggagaaaccccaucucuacuaauacaaaaauuagccaggcguggaguuucaugccuguaaucccagcuacucaggaggcugaggcaaucacuugaacuggggaggccgagguuguggugagccgagaucgcuauugcacuucagccuaggcaacaagagcgaaacuccaucucaaaaagaaaaagauuaugcuuuugaggaugcuuauuucguauccuuagaaugguggguuuucagauuuauuauuacuuuuuuaaugcuguagaaagagaguuuaugaagcuagacauagcuccugaaauguaagaaacuggcagaaacaguauugggaguaacugcacaggaaacuuuuuggauuugugaauuaagauuuuugugggccaggugccguggcucaacgccuguaaucccagcacuuugggaggccaagaugggcggaucacgaggucagcagaucaagaccauccuggcuaacauggugaaaccccgucucuacuaaaaauacaaaaaaaauuagccgggcguggcggugggcgccuguagucccagcuacucgggaggcugagacaggagaauggcaugaacccaggagguggagcuugcagugagccgagaucgugccacugcacuccagccugggcgacagaaugagacuccgucucaaaacaaaaagaaaaagauuuuugcugaugauccacccagguuggcuuucuucugcccuuagccccuguaccucuagucaugcccuggagcuuugcucuggcucugauugcaaggaguauauccuucuuauuaaaagagagagaagccuguuagcauuuaacgaggcuaucugauagcaccagaauagaagguagugaguaguuaaaaagugaaauuugaagaggaaauuccuagccauuuugccaguucugaagguuuucuauaauucuucccuuuuauuaugauaaagacuugaaauuuggggugaagugaaucucaaaucaaaaaaagaaacucucaaaucaguuuguccacucuucauguauagguuaauauauauuuuccccuccuuuuaacuuuuauuuauuuauauauuuauuuauuuauuuuugagauggagucucacucugucacccaggcuggagugcaauggcgccaucugagcucacugcaaccuccaccucccagguucaagcgauucuccugucucaaccucccaaguagcugggacuacaggcacccgccaccacacccagcuaauuuuuguauuuuuaguauagacaggguuucacuauguuggccaggcuuggcuucaacuguugaccuuaugaucugcccgccucauccuuccagagugcugggauuacaggugugagccaccgcguccagccuuaucuuuuaaguuauaucuuuuuuuauuuuuuugagaccuggaaucucucucuuucccccaggcuggagugcaguggcugcgcgaucucagcucacugcaaccuccgccuccuggguuccagcaauucuccugucucagccucccgaguagcugggauuacaggcgccugccaccacacccagcugauuuuuguauuuuuaguagagacgggguuucaccaucuuggccagccuggucuugaauuccugaccucacgauccacccgccuuggccuaccaagugcuggaauuauagccaugagccacugugccaggccauaucuuuuuauuucuuaucuguuaagcuuaacaaggacagagauucccuuuucuguauauucucuaaagcaguuucaguaaacuuauugaaugaauggaugaucugguaguuauccaauauagagauauucuuucaaacauuuuuauauauauuuauuuuuuagagacgggagaucucgcucuguugcccaggcuggucucaaacuccuggccucaagcugucuucccaccucagucucccaaagugcugggauugcaggcaugggccacugcaccuggcuaguauagggauauucuuuuggaugucaugaccuuuuucaaaauccacugauuaauuugaaguuguugauccuuuuuagaggauugauuuuaggcacauuuuggaaucaacagauuccagauuuaauaucaccuuuuaacauacuaauucuaaguuuagcugugaugaauccaaauuuaaaugugagaggacuuaauacauuaaauguggccuaauaaucaauguggcauugauauguuauauauccugucaaguccucaggcauuuuuguauguguguguguguuuuucuuauuacaaagguauuagaggcugggcguguugacucaggccuguaauccuagcacuuugggaggccgaguuggguggaucauuugaggucaggaguucgaaaacauccuggccaacauggugaaaccccgucucuauuaaaaacacaaaaaucagccgggcaugguggcgugcaccuguagucccagcuacucacuugggaggcugaggcagaauugcuugaacccgggagguggagguugcagugagcugagaucgugccguugcacuccagcuugggugacagagugagacuccaucucaaaaaaaaaaaaaugaagaaacccaaagauauuauaauaaauucccaugguaaaaauuaagacaguacagaaauguauguggaaagugaaaacuacucuguaaucccacccagagauaaccauugauaaauguuugguuuauagugacccagacauuuuucugugcacauaaacuagcauugagguauuuuuauuuaaaaaaucauaucuugcuaugcuacuguugcacagcuugccuuuaucauguaacaguauguauuggacaucuuuccauacuucccuuuauuauuuuuuggauuucuuauuauuuuaauuugccacaugguauuuguguaguuacuguaguuuauuuaaccagcuuuuuauugauagcuauuuggguuguuguucuaguuuauuauauuguacauuauguuucaugggauagucuuguacauauauagugcacuuauauaagcauuuuaauacaaguuccuauagguggaauugcugugcccagaguauacaauguauaaaaauuuuuguagugucaguuugcccuacugaaagauuauacauuguuuccagcacuguaggugaggguccuuuucuuuccacccuaacaaacaacaaauauuaauuaccucaagaaacauuuaucuaguucuuuguuuuugaaacggaguccccucuguugcccaggagugcaguggugccauaauuuaguuuaguuuuauuuugguuuuauuaguuuaugccauacuuuuaguuucuaauaggcuuaaaaccuuagucuuugacuuguccuuuuccccuuuguucaguuaguuauagucccccccaaccccaagauagguuuuuacucugucaccuaggcuaggcuggagugcagugguacaaucauagcucacugcagccuccauguccugggcucaagugauccuuccaccuuaccaagacuacagugccaccacgcccagugaauuuuccuuuugauuuuuuguagagaugaggucuugcuauguugcucaggcuugagcucaagggauccuccugccuuggccucccaaagugcuaggauuauaggcaagagucugcacccagccuauaaagucuugcuaauuuuauaauguuaccauuuuuucccucuccuuauaaauauguacuuuuuaaauuaucaaaaaauuggaagaggacggacaggaaauaaagagauaauccuguuaacauuuuagaguauaucccauuagaauuuuuucuuuguaugcaaguacauguacauauauuuagugcagcccuauuaguuuuacaaagugaugccuguguuucuuuuuuccuuuauuucuacugcuagugucuaaacuuuuuuuuuuuucuuuuuuugagacagagucucgcucuguggcccagguuggagugcaauggcgugaucuuggcucacugcaacccccaccuccuggguucaagcgauucuccugccucagccucccaaguagcugggaccaaaggcgugugccaccacuccuggcuaauuuuuguauuuuuaguagauauggaguuuuaccacguuguccaggcuguucuugaacuccugaccucaggugaucugccugccuuggccucccaaagugcugggauuacaggcgugagccaccacgcccggccuacucuaaacuuuuuaaaauucuuuuuucuauauuuuaaaauaauuuuuaaaaaacagagacagggucucauuguguuacgcaggcugaucuugaacuuugggcucaagugauucuccugcuuuggccucccaaagugcucuaaacuuuauguccuaaugccuaaauuauuauuuaaguuaacuuuuauuuuauuuuuugagacaguauggcucuguugcccaggcuggaguacaguggcaugaucuuggcucacuucaaccccugccuucuggguucaggcaauucucccgaguaggugggacuacccuacuacaagacuccugagugguggugugugccaccacgcccggcuaauuuuuguguuuuuaguagagacgggguuucaccauguuggccgggcuggucuugaauuccugacuucaagugauccgcuaccucggccucccaaagugcugggauuacaggcgugagccacaacacccagccugaauuaacuuuuaauguaucccauccuuuucuccuaguuuuaccuaccaucagauuacuccuucuaaauauuacuuuguuuuaaaaauuuauuuuuauuaauuaucauggguacauaauaguuauauacauuuaucauaaacauuucuuaaacgauauuuuucaaaaucuuuagugucacucuuguuaagaaucuuggcugggugaggugacucacaccuguaauccuaggacuuugggaggcagagacagaauuacuugagcccaggaguuugagcagccuggacaauguagggagaccccaucucuauuaaaaauaaaaauaaauuaacugggugugguggcgugugccugugaucccagcuacuucgaaggcugagaugggaauaucuccugagcccaggagguugaguggaacugugauuuugacgccacugcacugcagcugggugacagagugagaugcugucucaaaaaaaaaaaaaaaagaaagaaaaaaaaucuaguguuccacauccgauuaucuaauguauuuaacuacucaguuuaguauugaaaaugugcuuuacgccuagaucaccauaccuuuguucauauccauuuuucucugauccuguuuuguuuauccuaaagucugaggaauauauauguaguaugcuucauauucaucugaaacaaaugugaaggaaaagaaucacuguguuuacuuaaaacaguuuuuuccguauguguauggagauggagucucucucacuauguugcccaggcuggucucggacuccugggcucaagugaucccccgccucugcuucccaaagugcugagauuauaggcuugaaccacugugucuggccuaaaaaaauuuuguuuuaaauuauuuuugucuccuauggucuugucugaaaucaauacuaugaguugaauuuguggagaaaaacuuacucuagaaaaguauagcauaggugacaucaggguuacaaauaaguauuagaauaucaguucuagucaguaaaaugaaauauauauuuaaauucuguaaaauuauuuauguauuucuuugacuccuggugaaauacagcucuuagcauuacuaucuuugagucacugaaauguucuuaauauucaagaaaaguucuauuuccugaaguuuccaagaucaccaggcuacauuuaugucauauugcuuuaaucuuuuauaaaguuuguuaucuacuuuuauauugacuucaauuuuucccucuuaaugcuuucuauaaauaaugucuugcauauaaugccaugcuuuguauuuuugaaagguucgauauguauaaguaauugagauauaauucacguacaaugaaauucguuuguuuaaauuauauaguucacugguuuuuaguauaugcgcaaaauugugcaaccaucagcacagucuaauugcagaacauuuacaucaccccagaaaacuccucaccuauuagcaguuauuccuauacuccucuccccgcagcuccuggcaaccacuaaacuuuuucucuauauggauuugcguauucuggacauuucaguuuacuccuuaaaaaauguauugagugauuugauacaaacuuaauaaagaaucucacuuuaaauagaaaacugucugcuuacaucuaguagcuucucccauagacagcuuuuaaugacaguuugucaaagaauugguauuuggaaguggagauggauuaauggguaggagaggggaagaugguagaagcgggggggcgggaaaggguaaagaggugacaaaguugaggcaagcaaauaacuugauuugagacuuagcuccucuuuagaucuaccuuacucuaugaaugaauaaauugauaauaaauaugauuuauuuucucuccauucagucuguggcuccagcagccuuguuucuagcagcuaaaguggaggagcagcccaaaaaauuggaacaugucaucaagguagcacauacuugucuccauccucaggaaucccuuccugauacuagaagugagguaggagauuaauuacacaucuguuuuucuuaauuuuuuuccuuucuuuuuuuuucccuacucccaagcaugccuggaucuuuauguauuucaaugcaacuuaauuuuauaacuucgauuuauugaaguuuagauugguguuguuaaaagaauauuuuaguguuuguguuuuucuuaacaguaagaaaaucaggccagguaugguggcucaccauaccuguaauccuagcacuuugggaggguaaggugggagaaucacuuuaggccagaaguuuaagaccaaccuggacaacauagcaagacccugucucuauauuuaaaaaaaagaaaaaaaaaagccagaugugguggcucaugccuguaaucccagcacuuugggaggcugaggcaggagaauugcuugaguccaguucgagacaagcucuggcaacaaagugagaccccauuucuacaaaaaaagaaaaacaacaacaacaacaacaacaaaaaacaacugggcaugcuggcucacaucuuuagucccagcuacuugggagacugaggugggaggguugcuugagcaugggauguugaggcugcagugagccaugaucacaccacugcaggcaacagugccaggacucugucugaaaaacaaaacacauaaauuuuauggcgaaaguuuuguauuuguugcaguaaaauuugaaaauacagaaaaauucaagaauaaaauaucucucagauauauucuagaccaauggucccagaccuuuuuuggcaccugggacugguuucaugggagacaguuuuuacauggacagggggugggguuggagaugguuuugggaugauucaagcacauuacauuuauuguucacuuuauuucuauuauuguuacauuguuauacauaaugaaauaauuacguaacucaccauaacguagaaucagugggagcccugagcaucucuuuuuuuuugagacggaaucuugcucuugucgccaggcuggagugcaguggcgcaaucucggcucacugcaaccuccaccugccgguuucaagcgauucuccugccucagccuccuaaguagcugggacuacaggugugcaccaccacacacagcuaauuuuuguauuuuuagcagagacaggguuucaccauguuagccagaauggucucgaucucuugaccuugugaucugcccgccuuggccucccacaguggugggauuacaggcaugagccacugugcccggccaccuugaggugcuuuuccugcaacuagauggucccaucugggggugaugggagacagugacagaucaucaggcauuagauucucauaaagagcagcaaauuagaucccuugcaugggcaguucaccacaggguucaagugcuccuauaagaaucuaaugccacugcugaucagacaagaggcagugcucagguggcaauauguaugguggggagaggcuauaaauacagaugaagcuucacucacucguaccugcugcucaacuccugcuguguggccuaguucauaacaggccauggacccccuguuauauagacaacugaagcacagguauacuaaugaaccacuguuauuuguggcuucuuuucuauagauagcuaugugugcauguauuuugucucugguuuguuuucauuugcuuacuauaucccaaauauuuucccaucugauggauucucuacuuuuuaaaaaugucuggcuaguauuuaaugauauauaugugaauguauguauuuuuaacaauucuccaugaagaagucuagauaauuucuagcuuuuaaaaucacuauaaauguuaugaaaaauauucuuuuuuuuuuuuuuggagacagggucucauucuguugcccuggcuggaguccaguagugugaucauggcucaccgcggccuugaccuuccgggcucagugaucccccugaccucagcaucccgaguagcugggacuauaggugugcgccaccaugcccagcuaguuuuuguagagaugggguuucaccauguugcccaggcugcucucgaccuccugagcucaaguaauucgcccaccuuggccucccaagugcugggauuacaggcgugagccacugcaccuggcugaaaaauauuauuauacauuuuuauuauggauccuuaaaugaguaguuucacuauuuuuuuuuuuuuuaacuuuuuuuucgaguuggaguuuugcucuuguugcccaggauugagugcaauggugcaaucucagccaaccgcaaccucccccuccuggguucaagcgauuugccugccucagccucccgaguagcugggauuacaggcaugugccacuacacccggcuaauuuuguauuuuuaguugaaacgggguuucuccauguuggucaggcuggucucgaacuccugaccugagguuauccaccugccucagccucccaaagugcugggauuauaggcgugagccaccauguccagccagcuuuguuuuuuuugagacagaaucucguuuuguugcccaggauagagugcaguggcaagauuguagccaggauggucucgaucucuugaccuugugauccgcccgccuuggccucccaaagugcugggauuacaggugugagccacugcacccggccacccugagcuucuuuuccugcaacuagauggucccaucuacgggugaugggagacagugacagaucaucaggcauuagauucucauaaagagcaggugaucauuucaccucagccucccaaguugcuaggacuauagcugcgugccaccacucccaguuaauuuuuauuuuuuuguagagauaggggucuuaccauguuacccaggcuggucuugaacucuuggccuucaaagaauccucccauacuggccucccaaaguguuagaauuccaggugugagcaaccaugccuagcuacauuuuuuuuuucuuuuuuugagauggagucucgcucugucacccaggccggagugccguggugcgaucucagcucacugcaaccuccaccucccagguucaagaaauucucugccucagccuccugaauagcugggauuacuaccugcauucacucuauggaacaagccaagguucacgcccaccaucacacccagcuaauuuuuuaguauuuuuaauagagacaggguuucaccauauuggccaggcugaucuugaacuccugaccucgugauacaccugcuuuggccucccuaagugcugggauuacuggcgugagccaccgcacccggcccauucuuuauuuuuuaacugucuaaaaaauccaguguauuuuaugguuauagcacguuucaauuuagcuacauuucaagugaugaauggcuacauguggcuaguggcuauagcuuuggcuggcacaaaucugagugaauuuucuuauuaccuuuuccuuugaacucuucuguuacuuuuuagaaaccuaacauggccccaaaggggaaguucuaauaggagccaaauguuugguauuaaaugcuuacaguacuguaggaagguucugcaaauguauuuuggugauguugaaaaauauauacuuuauggccaggcgcgguggcucaugccuguaauccuagcaauuugggaggcugaggcggguggaucaccugaggucagggguucaagaccagcuuugccaauauggugaaaccccgucucuacuaaauauacaaaaacuagccgggcgugguggugggcuccuguaaucccaccuacucgggaggcugaggcaggagaaucgcuugaaccugggaggcagagguugcagugaggcgaggucgcgccacugcacuccagccugagcagcagagcgagacucccucucaaaaaaaaaggccgggugcgguggcucacgccuguaaucccagcacuuugggaggccgaggugggcggaucaucugagguuggggguuugagaccagccugaccaacauggagaaaccucgucucuacuaaaaauacaaaauuagcugggugugguggugcaugccuguaaucccagcuacucgggaggcugaggcaggagaauuguuugaaccgggaggcagagguuguggugagccgagauugugccauugcacuccagccugggcaacaagagcgaaacuccaacucaaaaaaaaaagaaaaaagaaaagcaaaaaauacauacuuuuaauuuucuuuucucuaaaucacaugaaccauaaaacuuaaauauuaaccugaaaaugaaccaaauauauggugcuuuuucuguagccauauauaaacuguuaccucucagcauacuacuuauuuauuuauuuuuuaaagaaaauguguacugaaugggcauaagggauaaagauuguauuucacaaaaaaauuagccgggcgugguguugcgcgccuggaaucuuagcuacuugggaggcugaggcaggggaauugcuugaaccagggagguggagguugcagugagucgagaucacaccacugcacuccagccugggugacagagggagacucugucuaaaaaaaaaaaaaaaaaaaaaaaaaaagauuguauuucaguucuuaacucuaccuccuaacuccacucaugccuuuuauuguuuugguuucccuggaagggauuguuagaauuguuuauacuuuauauauugugccuuuguagggaauaauuucugucuucucacuuuuaggcuuauuugcaacaaguucaagaucuggucauuuuagaaagcauaauuuugcagacuuuagguaaguuuauuuuccuuugaaacauuuuuuuaaauuaugcaauaaaaugauuugauucuaaaaauuugcuauauaggaagaauauuucuugggaaaguuuuuguagugucccucuguuuccagaugauagagguuguagaccugaguuuagcuuugaccuguuccauagagugaaugcagguaguacagcugaccuuugaaacagcagccaguggguuauuauuuuuuucauucuaggguuauuugcuuuuuaaguuuuggugauuuuuacccccaaaaauuauaaaaacuaucuaaagaauguuuuuccuuccguggauuguuauggccuguaacagcauuuguuuuuaaaauugguaacuaguguuuagaacagcagagugaaagugggggaacuuaagcuuuagugguugcaugggcaacucugaugauauuguguuauuaucuguuauuuucaucacacaggcugccuuuagaaguuuagaaaauaugaaaauacagauuuuuuuuuuccugguucuuuugggcuaucauuuuucucuucuagguaggguaagauuucaugaguuguacgucaaaguuauuggcguagacacaauuuuuuuuguacauauauauauaugaugaguucuucaaaguuuaucucucaauuuauucuaguuaacuuuuuucuuuuucuuuuuuuuuuuuuuuugagacggagucuugcuuugucgcccaggcuggagugcaguggcacaaucuuggcucauugcaaccuccgccuccugggugcacgccauucuccugccucagccuccagaguagcugggacuacaggcgcccgccaccacgcccagcuaaauuuuuguauuuuuaguagagauaggguuucaccguguuagccaggauggucuugaucuccugaccuugugauccgcucgccucggccucccaaagugcugggauuacaggcuugauccaccgcgcccagccucuaguuaacuuuuuucuuaaaauaucuucaaauuauauuucaugggacaaugauguuuuucugguggaauaaauuucuauuaauauuuuaguguggaaaccaguaagguguaauuuacaaucaguuauccuuuuacaauaauuuguaaaauguaaacuucuuaauaguuuuuuaauccauuacuuuuucuuuuaaggcuuugaacuaacaauugaucacccacauacucauguaguaaagugcacucaacuuguucgagguaaggaaucccagcuuaugaagacuaucucaagcuguuuucccauuuagagguugugguuugugguggacaauacauaauaguucugcuuuggcuaaauuuaaaggccuacuuggcuuaaaucaaaaugaguuguucugacuugauguuuuucuguuggguucuuacaaguaauauuuuuagaugaucucuaguuaaagagaacuaaccucuugagaauguuugucaaaguugggcaguuugugaaguuauuuaacagaaauuuuaugaaaguugugaggagugggugaucuuauuuuaauucugggguugauuaaaggccaccuagaggaucauacagaauuuauuuggacuuuccaugauauacaaucccuuggcagaacuuuucuuuuuaauucuaauuuaacaauauuagguauaauugaaugaaacucucuuauuuaguuuaguaucaagaauaucugaacacuauugugccuuuaagugccuuuuaugauuuuuaggccaaacugauaauuggucuuauuuuacauuuuacuaauauguguuuccugugaaaauucccaaauuuuccugaguucuuuauauuugaaaguauuaaaauguuauauugcacaaggauaagacuagagauggguguauguuaauauugagaagacuauguccugaggaagauaaaaauuugcuuugucacccagaacaguuuguuuuggaagaaguuaaauuuuuucauuguaauauauuacauuauuugaugauuuggggauuaauuaauuaaaucuuaauuagggcuacuuaauuaaaaacuuuuuuuuuuuuuugagacggaguuuugcucuuguugcccaggguggagugcaguagcacgaucucagcucaccacaaccuccgccucccggguucaagcgauucuccugccucagucuuccgaguagcugggauuacaggcaugcgccaccaccccagcuaauuuuuuauuuuuaguagagacgggguuucuccauguuggucaggcuggucuugaacucuggaccucaggugauccgcccaccucggcgucccaaagugcugggauuacaggcgugagccaccgugcccagccuuaauuaaaaacuuucuuaacagcaaaagucacuuuucccaaauaugucaaagucuucuagauucugaucuugcuucuagaucaucuuaguucauccuguaguuuagugauucucagugaauccuuacaucagaaucucuggguuacuuguuaaaaaaugcuugcacccuucuccaaacauuuaauuaaauuuuagggagcagguccaagaauugcauuuaaacaaguaccucagauauguggugugcagaauaaagcuugaguaccuagaucuggaagcagcauaguuauuaauguuaaaauuaaaaaucauugaucugucuacuuuggcagaauguaaacgucagguuuacagggaccaugugugucucauuugccacuauauucacaguaccuugcaaauauuaaaugcuuacuaaauauuuguugagaaugaauggaacuaauaacuuuuuuccucccccaccccugacuuuuuuuuuuuuucuuuagcaagcaaggacuuagcacagacuucuuacuucauggcaaccaacagguuuauauuuuaauuuuuuuuucucuucgauuuuugguauaggacuuuacuugaguuugauacagugugcuauagauaauucucuggugaauguugauuuuucugcacaguuuucauguuguacuuuaaauuuccaugguacuuuuuaauuuucuaagguuauguaauuauuuaguacugauuuuuuugauaaccuacucaguucugcaugauagugacugaaaaucuaauuuggaguauucugcaauaauuauauguguauauauauauauauauauauauuuuuuuuuuuuuuuuuaaauuauuauuauuauuuuuugagacagagucuugcucuguugcccaggcuggagugcaguggcacaauaucagcucacugcaagcuccaccuuccagguuuacaccauucuccugccucagccucccgaguagcuaggacuacagguacccgccaccacgcccagcuaauuuuuguguuuuuaguagagaugggguuuuaccuuguuaaccaggauggucucgaucuccugaccucgugaucugcccaccucagccucccaaagugcugggauuacaggcauauauauauauauauauauauauuuuuuuuuuuuuaagacagagucucacucugucuaccaggcuggacugaaguggugcgaucuuggcucacugcaaccucugccucccggguucaagugauucuccggccucagccucuucacuaagcugggauuauagacuggcgccaccaugccccgcuaauuuuuuuguauuuucaguagagaugggguuucgcuauguugacuaggcuggucucaaacuccuggccucaagugauccgccugccuuggcuucccaaagugcugggauuacagguguaaaccacugugccuggccaauaauuauauuuuaaaauauuccuuuuucuucccccucuaucaaucaaugggcacuuauggauguuaagaguuucagucuuuuuccuucuucccuuuuuaaaaaaaguaaaugagacugggcacaguggcucauaccuguaaucccaggcugaggcugguggaucacuugaggcuaggaguucgagaccaaccuggccaacauggugaaaccacaucuuuacuaaaaaauacgaaaauuggcagggcaagguggcacaugcauguaguaccagcuacucgggaggcugaggcacgagaauugcuugaacccaggaggcagagggugcugugagccgagauugccccacugcacugcagccugggugacagagagagagacucugucuaaaaaaaguaaaugauuaguacauaacuuguauuaccaaaugacuugcccaacauuguuaguuaauggaaaccaaugauaucccuaguaacugucagggcuaagaaguucauuuuuauagccuguuacgaaaaaguuuugaaauaaaccaacauauuuauacuugagagaguaguugucuguuuauuauuuuaaauagaccagaacuaugauuggugagagacaaauuauuuuuaagauauuuccuuaaguuuuugauuuacggauuacacagaccaaaaagcuuacaauuuuccuuaggaucugagcuuagucucaggauaauagguaauaaauauugacuucuaggcuugaauacuggcccagaagucaauguuuuaaagaacuugaauucccagccuuuuuccuuuuuuccuuuuuuuuuuuuuuggcucuggucaauguguagauuaagugauguguaauucaagaguuuuuaaaauguuguuaccugaacagguggguuaauaggaaauuauauugagugcuagaucagagcauugcauauuucuuacccuucuuacucuccugucuauuuuuaagccuuuuuuuuuuuuuuuuuuuuuuuuuuuaaauaauggagaguuuuagcuuugggcugagaauugagagcucaugacacucucuguuuucuucccucugaugucagccugcauuugaccacauuuagccugcaguacacaccuccugugguggccugugucugcauucaccuggcuugcaagugguccaauugggagaucccagucucaacugacgggaagcacuggugggaguauguugacgccacugugaccuuggaacuuuuagaugguaaguuuuagaguaagggaccuugaaaagcacuugcuguugaucugucacauagcuggccaaaggugacuugauucagaugaaaauaguuaguuaguaguucagguuauucuuguuucauuacuucuguuucucucagucuuucuugaauguucuguuuuacuuguagaacugacacaugaguuucuacagauuuuggagaaaacucccaacaggcucaaacgcauuuggaauuggaggguaagaaucauuacugucagcuuguggaacaaaaucaauuucuuuugacugcaccagugaauauaccaguauugaauauguacccuagguuuggaauugcccuuuuuauaguuacacaguaaucaugacuucuacuucauaccuuggauacuguuguaaaagucagugucucuaugggauagcaggauuugcuuuucauuguguaacuccugugauaugaucauuugagcaguaacacugguucaguauuuucuguguggaaacugguagggaaaaaacauggcuucucggaguuagaguauuggcuucugguagaggcaagauagagaauuacaagguuagagccgguaucacaguuuuguguuugacauuaccuacuuuuaaaauggauuuuagaauuuuguuuuuauauaggcuguagucugaaguuguauuucaaauacuugucaaagccuuauucaggaauaauggaaucauuccuuuuuuuucugucagauauaaaacuuguuuuaaaauguuuccauuguuuucuccuaaauccagacagaaaaaguuaauuucauucuccugaguugagugaguggcagagagugaguuugccucuuagaagccugagauuagaaguaggcuugagaggccgggcaugguggcucaugccuguagucccagcacuuugggaggccaaggcaggcggaucaacugaggucaggaguucgagaccagccuggccaacauggugaaaccucgucucuacuaaaaauacaaaaauuagccaggcauggugaugcacaccuguaguuccagcuacuugggaggcugagacaggagaaucgcuugaacucgggacguuagguugcagugagccgagauugugccacugcacuccagccuggaugacaaagugagacucugucucaaacaaacaaacaaacaaaaaacaacaguaacaacaaaaaagaaguaggcuugagagcacaucuuuuacuuuagcauaaaaccucaccaaaauuucuagaacucaguuauggacuaacuauaaucauaagcgaaggcauggauguucauguaugaauuuuagauaagcauagauucuuuguuguuauuauugcuuuguaacguuuggauagauugcugugacucuuaauugaagguuuuaaaaucuucucuugaugguaauauuuauuggauuacauguuaggauagccuccugccuguggccuauccagaacuuccaguguugcugcaaguacaaucuacucaucucaguguuuuuuuauuuaguaaauuaccuaaguaaagagaugcuauuugcuucauugcaggcaugcgaggcugccaagaaaacaaaagcagaugaccgaggaacagaugaaaagacuucagagcagacaauccucaauaugauuucccagagcucuucagacacaaccauugcagguuuaaugagcaugucaacuucuaccacaagugcagugccuucccugccagucuccgaagagucauccagcaacuuaaccaguguggagauguugccgggcaagcguuggcuguccucccaaccuucuuucaaacuagaaccuacucagggucaucggacuagugagaauuuagcacuuacaggaguugaucauuccuuaccacaggaugguucaaaugcauuuauuucccagaagcagaauaguaagagugugccaucagcuaaagugucacugaaagaauaccgcgcgaagcaugcagaagaauuggcugcccagaagaggcaacuggagaacauggaagccaaugugaagucacaauaugcauaugcugcccagaaucuccuuucucaucaugauagccauucuucagucauucuaaaaaugcccauagaggguucagaaaaccccgagcggccuuuucuggaaaaggcugacaaaacagcucucaaaaugagaaucccaguggcagguggagauaaagcugcgucuucaaaaccagaggagauaaaaaugcgcauaaaaguccaugcugcagcugauaagcacaauucuguagaggacaguguuacaaagagccgagagcacaaagaaaagcacaagacucacccaucuaaucaucaucaucaucauaaucaccacucacacaagcacucucauucccaacuuccaguugguacugggaacaaacguccuggugauccaaaacauaguagccagacaagcaacuuagcacauaaaaccuauagcuugucuaguucuuuuuccucuuccaguucuacucguaaaaggggacccucugaagagacuggaggggcuguguuugaucauccagccaagauugccaagaguacuaaauccucuucccuaaauuucuccuucccuucacuuccuacaaugggucagaugccugggcauagcucagacacaaguggccuuuccuuuucacagcccagcuguaaaacucgugucccucauucgaaacuggauaaagggcccacuggggccaauggucacaacacgacccagacaauagacuaucaagacacugugaauaugcuucacucccugcucagugcccaggguguucagcccacucagcccacugcauuugaauuuguucguccuuauagugacuaucugaauccucggucugguggaaucuccucgagaucuggcaauacagacaaaccccggccaccaccucugccaucagaaccuccuccaccacuuccaccccuuccuaaguaaaaaaagaaaaagaagaggagaaaaaaacuucuuuaaaaaaacacauaauuuuucuuuuuuuuuu

SEQ ID NO: 192579 - RNA, 24030 nt, Homo sapiens
aaaaaaaaaagaaaaauuauguguuuuuuuaaagaaguuuuuuucuccucuucuuuuucuuuuuuuacuuaggaagggguggaagugguggaggagguucugauggcagaggugguggccgggguuugucuguauugccagaucucgaggagauuccaccagaccgaggauucagauagucacuauaaggacgaacaaauucaaaugcagugggcugagugggcugaacacccugggcacugagcagggagugaagcauauucacagugucuugauagucuauugucugggucguguugugaccauuggccccagugggcccuuuauccaguuucgaaugagggacacgaguuuuacagcugggcugugaaaaggaaaggccacuugugucugagcuaugcccaggcaucugacccauuguaggaagugaagggaaggagaaauuuagggaagaggauuuaguacucuuggcaaucuuggcuggaugaucaaacacagccccuccagucucuucagaggguccccuuuuacgaguagaacuggaagaggaaaaagaacuagacaagcuauagguuuuaugugcuaaguugcuugucuggcuacuauguuuuggaucaccaggacguuuguucccaguaccaacuggaaguugggaaugagagugcuugugugaguggugauuaugaugaugaugaugauuagaugggugagucuugugcuuuucuuugugcucucggcucuuuguaacacuguccucuacagaauugugcuuaucagcugcagcauggacuuuuaugcgcauuuuuaucuccucugguuuugaagacgcagcuuuaucuccaccugccacugggauucucauuuugagagcuguuuugucagccuuuuccagaaaaggccgcucgggguuuucugaacccucuaugggcauuuuuagaaugacugaagaauggcuaucaugaugagaaaggagauucugggcagcauaugcauauugugacuucacauuggcuuccauguucuccaguugccucuucugggcagccaauucuucugcaugcuucgcgcgguauucuuucagugacacuuuagcugauggcacacucuuacuauucugcuucugggaaauaaaugcauuugaaccauccugugguaaggaaugaucaacuccuguaagugcuaaauucucacuaguccgaugacccugaguagguucuaguuugaaagaagguugggaggacagccaacgcuugcccggcaacaucuccacacugguuaaguugcuggaugacucuucggagacuggcagggaaggcacugcacuugugguagaaguugacaugcucauuaaaccugcaaugguugugucugaagagcucugggaaaucauauugaggauugucugcucugaagucuuuucaucuguuccucggucaucugcuuuuguuuucuuggcagccucgcaugccugcaaugaagcaaauagcaucucuuuacuuagguaauuuacuaaauaaaaaaacacugagaugaguagauuguacuugcagcaacacuggaaguucuggauaggccacaggcaggaggcuauccuaacauguaauccaauaaauauuaccaucaagagaagauuuuaaaaccuucaauuaagagucacagcaaucuauccaaacguuacaaagcaauaauaacaacaaagaaucuaugcuuaucuaaaauucauacaugaacauccaugccuucgcuuaugauuauaguuaguccauaacugaguucuagaaauuuuggugagguuuuaugcuaaaguaaaagaugugcucucaagccuacuucuuuuuuguuguuacuguuguuuuuuguuuguuuguuuguuugagacagagucucacuuugucauccaggcuggagugcaguggcacaaucucggcucacugcaaccuaacgucccgaguucaagcgauucuccugucucagccucccaaguagcuggaacuacaggugugcaucaccaugccuggcuaauuuuuguauuuuuaguagagacgagguuucaccauguuggccaggcuggucucgaacuccugaccucaguugauccgccugccuuggccucccaaagugcugggacuacaggcaugagccaccaugcccggccucucaagccuacuucuaaucucaggcuucuaagaggcaaacucacucucugccacucacucaacucaggagaaugaaauuaacuuuuucugucuggauuuaggagaaaacaauggaaacauuuuaaaacaaguuuuauaucugacagaaaaaaaaggaaugauuccauuauuccugaauaaggcuuugacaaguauuugaaauacaacuucagacuacagccuauauaaaaacaaaauucuaaaauccauuuuaaaaguagguaaugucaaacacaaaacugugauaccggcucuaaccuuguaauucucuaucuugccucuaccagaagccaauacucuaacuccgagaagccauguuuuuucccuaccaguuuccacacagaaaauacugaaccaguguuacugcucaaaugaucauaucacaggaguuacacaaugaaaagcaaauccugcuaucccauagagacacugacuuuuacaacaguauccaagguaugaaguagaagucaugauuacuguguaacuauaaaaagggcaauuccaaaccuaggguacauauucaauacugguauauucacuggugcagucaaaagaaauugauuuuguuccacaagcugacaguaaugauucuuacccuccaauuccaaaugcguuugagccuguugggaguuuucuccaaaaucuguagaaacucaugugucaguucuacaaguaaaacagaacauucaagaaagacugagagaaacagaaguaaugaaacaagaauaaccugaacuacuaacuaacuauuuucaucugaaucaagucaccuuuggccagcuaugugacagaucaacagcaagugcuuuucaaggucccuuacucuaaaacuuaccaucuaaaaguuccaaggucacaguggcgucaacauacucccaccagugcuucccgucaguugagacugggaucucccaauuggaccacuugcaagccaggugaaugcagacacaggccaccacaggagguguguacugcaggcuaaauguggucaaaugcaggcugacaucagagggaagaaaacagagagugucaugagcucucaauucucagcccaaagcuaaaacucuccauuauuuaaaaaaaaaaaaaaaaaaaaaaaaaaaggcuuaaaaauagacaggagaguaagaaggguaagaaauaugcaaugcucugaucuagcacucaauauaauuuccuauuaacccaccuguucagguaacaacauuuuaaaaacucuugaauuacacaucacuuaaucuacacauugaccagagccaaaaaaaaaaaaaaggaaaaaaggaaaaaggcugggaauucaaguucuuuaaaacauugacuucugggccaguauucaagccuagaagucaauauuuauuaccuauuauccugagacuaagcucagauccuaaggaaaauuguaagcuuuuuggucuguguaauccguaaaucaaaaacuuaaggaaauaucuuaaaaauaauuugucucucaccaaucauaguucuggucuauuuaaaauaauaaacagacaacuacucucucaaguauaaauauguugguuuauuucaaaacuuuuucguaacaggcuauaaaaaugaacuucuuagcccugacaguuacuagggauaucauugguuuccauuaacuaacaauguugggcaagucauuugguaauacaaguuauguacuaaucauuuacuuuuuuuagacagagucucucucucugucacccaggcugcagugcaguggggcaaucucggcucacagcacccucugccuccuggguucaagcaauucucgugccucagccucccgaguagcugguacuacaugcaugugccaccuugcccugccaauuuucguauuuuuuaguaaagaugugguuucaccauguuggccagguuggucucgaacuccuagccucaagugauccaccagccucagccugggauuacagguaugagccacugugcccagucucauuuacuuuuuuuaaaaagggaagaaggaaaaagacugaaacucuuaacauccauaagugcccauugauugauagagggggaagaaaaaggaauauuuuaaaauauaauuauuggccaggcacagugguuuacaccuguaaucccagcacuuugggaagccaaggcaggcggaucacuugaggccaggaguuugagaccagccuagucaacauagcgaaaccccaucucuacugaaaauacaaaaaaauuagcggggcaugguggcgccagucuauaaucccagcuuagugaagaggcugaggccggagaaucacuugaacccgggaggcagagguugcagugagccaagaucgcaccacuucaguccagccugguagacagagugagacucugucuuaaaaaaaaaaaaauauauauauauauauauauauaugccuguaaucccagcacuuugggaggcugaggugggcagaucacgaggucaggagaucgagaccauccugguuaacaagguaaaaccccaucucuacuaaaaacacaaaaauuagcugggcgugguggcggguaccuguaguccuagcuacucgggaggcugaggcaggagaaugguguaaaccuggaagguggagcuugcagugagcugauauugugccacugcacuccagccugggcaacagagcaagacucugucucaaaaaauaauaauaauaauuuaaaaaaaaaaaaaaaaauauauauauauauauauauauacacauauaauuauugcagaauacuccaaauuagauuuucagucacuaucaugcagaacugaguagguuaucaaaaaaaucaguacuaaauaauuacauaaccuuagaaaauuaaaaaguaccauggaaauuuaaaguacaacaugaaaacugugcagaaaaaucaacauucaccagagaauuaucuauagcacacuguaucaaacucaaguaaaguccuauaccaaaaaucgaagagaaaaaaaaauuaaaauauaaaccuguugguugccaugaaguaagaagucugugcuaaguccuugcuugcuaaagaaaaaaaaaaaaagucaggggugggggaggaaaaaaguuauuaguuccauucauucucaacaaauauuuaguaagcauuuaauauuugcaagguacugugaauauaguggcaaaugagacacacauggucccuguaaaccugacguuuacauucugccaaaguagacagaucaaugauuuuuaauuuuaacauuaauaacuaugcugcuuccagaucuagguacucaagcuuuauucugcacaccacauaucugagguacuuguuuaaaugcaauucuuggaccugcucccuaaaauuuaauuaaauguuuggagaagggugcaagcauuuuuuaacaaguaacccagagauucugauguaaggauucacugagaaucacuaaacuacaggaugaacuaagaugaucuagaagcaagaucagaaucuagaagacuuugacauauuugggaaaagugacuuuugcuguuaagaaaguuuuuaauuaaggcugggcacgguggcucacgccuguaaucccagcacuuugggacgccgaggugggcggaucaccugagguccagaguucaagaccagccugaccaacauggagaaaccccgucucuacuaaaaauaaaaaauuagcuggggugguggcgcaugccuguaaucccagcuacucggaagacugaggcaggagaaucgcuugaacccgggaggcggagguuguggugagcugagaucgugcuacugcacuccacccugggcaacaagagcaaaacuccgucucaaaaaaaaaaaaaaguuuuuaauuaaguagcccuaauuaagauuuaauuaauuaauccccaaaucaucaaauaauguaauauauuacaaugaaaaaauuuaacuucuuccaaaacaaacuguucugggugacaaagcaaauuuuuaucuuccucaggacauagucuucucaauauuaacauacacccaucucuagucuuauccuugugcaauauaacauuuuaauacuuucaaauauaaagaacucaggaaaauuugggaauuuucacaggaaacacauauuaguaaaauguaaaauaagaccaauuaucaguuuggccuaaaaaucauaaaaggcacuuaaaggcacaauaguguucagauauucuugauacuaaacuaaauaagagaguuucauucaauuauaccuaauauuguuaaauuagaauuaaaaagaaaaguucugccaagggauuguauaucauggaaaguccaaauaaauucuguaugauccucuagguggccuuuaaucaaccccagaauuaaaauaagaucacccacuccucacaacuuucauaaaauuucuguuaaauaacuucacaaacugcccaacuuugacaaacauucucaagagguuaguucucuuuaacuagagaucaucuaaaaauauuacuuguaagaacccaacagaaaaacaucaagucagaacaacucauuuugauuuaagccaaguaggccuuuaaauuuagccaaagcagaacuauuauguauuguccaccacaaaccacaaccucuaaaugggaaaacagcuugagauagucuucauaagcugggauuccuuaccucgaacaaguugagugcacuuuacuacaugaguaugugggugaucaauuguuaguucaaagccuuaaaagaaaaaguaauggauuaaaaaacuauuaagaaguuuacauuuuacaaauuauuguaaaaggauaacugauuguaaauuacaccuuacugguuuccacacuaaaauauuaauagaaauuuauuccaccagaaaaacaucauugucccaugaaauauaauuugaagauauuuuaagaaaaaaguuaacuagaggcugggcgcgguggaucaagccuguaaucccagcacuuugggaggccgaggcgagcggaucacaaggucaggagaucaagaccauccuggcuaacacggugaaacccuaucucuacuaaaaauacaaaaauuuagcugggcgugguggcgggcgccuguagucccagcuacucuggaggcugaggcaggagaauggcgugcacccaggaggcggagguugcaaugagccaagauugugccacugcacuccagccugggcgacaaagcaagacuccgucucaaaaaaaaaaaaaaaagaaaaagaaaaaaguuaacuagaauaaauugagagauaaacuuugaagaacucaucauauauauauauguacaaaaaaaauugugucuacgccaauaacuuugacguacaacucaugaaaucuuacccuaccuagaagagaaaaaugauagcccaaaagaaccaggaaaaaaaaaaucuguauuuucauauuuucuaaacuucuaaaggcagccugugugaugaaaauaacagauaauaacacaauaucaucagaguugcccaugcaaccacuaaagcuuaaguucccccacuuucacucugcuguucuaaacacuaguuaccaauuuuaaaaacaaaugcuguuacaggccauaacaauccacggaaggaaaaacauucuuuagauaguuuuuauaauuuuuggggguaaaaaucaccaaaacuuaaaaagcaaauaacccuagaaugaaaaaaauaauaacccacuggcugcuguuucaaaggucagcuguacuaccugcauucacucuauggaacaggucaaagcuaaacucaggucuacaaccucuaucaucuggaaacagagggacacuacaaaaacuuucccaagaaauauucuuccuauauagcaaauuuuuagaaucaaaucauuuuauugcauaauuuaaaaaaauguuucaaaggaaaauaaacuuaccuaaagucugcaaaauuaugcuuucuaaaaugaccagaucuugaacuuguugcaaauaagccuaaaagugagaagacagaaauuauucccuacaaaggcacaauauauaaaguauaaacaauucuaacaaucccuuccagggaaaccaaaacaauaaaaggcaugaguggaguuaggagguagaguuaagaacugaaauacaaucuuuuuuuuuuuuuuuuuuuuuuuuuuuagacagagucucccucugucacccaggcuggagugcaguggugugaucucgacucacugcaaccuccaccucccugguucaagcaauuccccugccucagccucccaaguagcuaagauuccaggcgcgcaacaccacgcccggcuaauuuuuuugugaaauacaaucuuuaucccuuaugcccauucaguacacauuuucuuuaaaaaauaaauaaauaaguaguaugcugagagguaacaguuuauauauggcuacagaaaaagcaccauauauuugguucauuuucagguuaauauuuaaguuuuaugguucaugugauuuagagaaaagaaaauuaaaaguauguauuuuuugcuuuucuuuuuucuuuuuuuuuugaguuggaguuucgcucuuguugcccaggcuggagugcaauggcacaaucucggcucaccacaaccucugccucccgguucaaacaauucuccugccucagccucccgaguagcugggauuacaggcaugcaccaccacacccagcuaauuuuguauuuuuaguagagacgagguuucuccauguuggucaggcuggucucaaacccccaaccucagaugauccgcccaccucggccucccaaagugcugggauuacaggcgugagccaccgcacccggccuuuuuuuuugagagggagucucgcucugcugcucaggcuggagugcaguggcgcgaccucgccucacugcaaccucugccucccagguucaagcgauucuccugccucagccucccgaguaggugggauuacaggagcccaccaccacgcccggcuaguuuuuguauauuuaguagagacgggguuucaccauauuggcaaagcuggucuugaaccccugaccucaggugauccacccgccucagccucccaaauugcuaggauuacaggcaugagccaccgcgccuggccauaaaguauauauuuuucaacaucaccaaaauacauuugcagaaccuuccuacaguacuguaagcauuuaauaccaaacauuuggcuccuauuagaacuuccccuuuggggccauguuagguuucuaaaaaguaacagaagaguucaaaggaaaagguaauaagaaaauucacucagauuugugccagccaaagcuauagccacuagccacauguagccauucaucacuugaaauguagcuaaauugaaacgugcuauaaccauaaaauacacuggauuuuuuagacaguuaaaaaauaaagaaugggccgggugcgguggcucacgccaguaaucccagcacuuagggaggccaaagcagguguaucacgaggucaggaguucaagaucagccuggccaauauggugaaacccugucucuauuaaaaauacuaaaaaauuagcugggugugauggugggcgugaaccuuggcuuguuccauagagugaaugcagguaguaaucccagcuauucaggaggcugaggcagagaauuucuugaaccugggagguggagguugcagugagcugagaucgcaccacggcacuccggccugggugacagagcgagacuccaucucaaaaaaagaaaaaaaaaauguagcuaggcaugguugcucacaccuggaauucuaacacuuugggaggccaguaugggaggauucuuugaaggccaagaguucaagaccagccuggguaacaugguaagaccccuaucucuacaaaaaaauaaaaauuaacugggagugguggcacgcagcuauaguccuagcaacuugggaggcugaggugaaaugaucaccugcucuuuaugagaaucuaaugccugaugaucugucacugucucccaucacccguagaugggaccaucuaguugcaggaaaagaagcucaggguggccgggugcaguggcucacaccuguaaucccagcacuuugggaggccaaggcgggcggaucacaaggucaagagaucgagaccauccuggcuacaaucuugccacugcacucuauccugggcaacaaaacgagauucugucucaaaaaaaacaaagcuggcuggacaugguggcucacgccuauaaucccagcacuuugggaggcugaggcagguggauaaccucaggucaggaguucgagaccagccugaccaacauggagaaaccccguuucaacuaaaaauacaaaauuagccggguguaguggcacaugccuguaaucccagcuacucgggaggcugaggcaggcaaaucgcuugaacccaggagggggagguugcgguuggcugagauugcaccauugcacucaauccugggcaacaagagcaaaacuccaacucgaaaaaaaaguuaaaaaaaaaaaaaauagugaaacuacucauuuaaggauccauaauaaaaauguauaauaauauuuuucagccaggugcaguggcucacgccuguaaucccagcacuugggaggccaaggugggcgaauuacuugagcucaggaggucgagagcagccugggcaacauggugaaaccccaucucuacaaaaacuagcugggcaugguggcgcacaccuauagucccagcuacucgggaugcugaggucagggggaucacugagcccggaaggucaaggccgcggugagccaugaucacacuacuggacuccagccagggcaacagaaugagacccugucuccaaaaaaaaaaaaaagaauauuuuucauaacauuuauagugauuuuaaaagcuagaaauuaucuagacuucuucauggagaauuguuaaaaauacauacauucacauauauaucauuaaauacuagccagacauuuuuaaaaaguagagaauccaucagaugggaaaauauuugggauauaguaagcaaaugaaaacaaaccagagacaaaauacaugcacacauagcuaucuauagaaaagaagccacaaauaacagugguucauuaguauaccugugcuucaguugucuauauaacaggggguccauggccuguuaugaacuaggccacacagcaggaguugagcagcagguacgagugagugaagcuucaucuguauuuauagccucuccccaccauacauauugccaccugagcacugccucuugucugaucagcaguggcauuagauucuuauaggagcacuugaacccuguggugaacugcccaugcaagggaucuaauuugcugcucuuuaugagaaucuaaugccugaugaucugucacugucucccaucacccccagaugggaccaucuaguugcaggaaaagcaccucaagguggccgggcacaguggcucaugccuguaaucccaccacugugggaggccaaggcgggcagaucacaaggucaagagaucgagaccauucuggcuaacauggugaaacccugucucugcuaaaaauacaaaaauuagcugugugugguggugcacaccuguagucccagcuacuuaggaggcugaggcaggagaaucgcuugaaaccggcagguggagguugcagugagccgagauugcgccacugcacuccagccuggcgacaagagcaagauuccgucucaaaaaaaaagagaugcucagggcucccacugauucuacguuauggugaguuacguaauuauuucauuauguauaacaauguaacaauaauagaaauaaagugaacaauaaauguaaugugcuugaaucaucccaaaaccaucuccaaccccacccccuguccauguaaaaacugucucccaugaaaccagucccaggugccaaaaaaggucugggaccauuggucuagaauauaucugagagauauuuuauucuugaauuuuucuguauuuucaaauuuuacugcaacaaauacaaaacuuucgccauaaaauuuauguguuuuguuuuucagacagaguccuggcacuguugccugcaguggugugaucauggcucacugcagccucaacaucccaugcucaagcaacccucccaccucagucucccaaguagcugggacuaaagaugugagccagcaugcccaguuguuuuuuguuguuguuguuguuguuguuuuucuuuuuuuguagaaauggggucucacuuuguugccagagcuugucucgaacuggacucaagcaauucuccugccucagccucccaaagugcugggauuacaggcaugagccaccacaucuggcuuuuuuuuuucuuuuuuuuaaauauagagacagggucuugcuauguuguccagguuggucuuaaacuucuggccuaaagugauucucccaccuuacccucccaaagugcuaggauuacagguauggugagccaccauaccuggccugauuuucuuacuguuaagaaaaacacaaacacuaaaauauucuuuuaacaacaccaaucuaaacuucaauaaaucgaaguuauaaaauuaaguugcauugaaauacauaaagauccaggcaugcuugggaguagggaaaaaaaaagaaaggaaaaaaauuaagaaaaacagauguguaauuaaucuccuaccucacuucuaguaucaggaagggauuccugaggauggagacaaguaugugcuaccuugaugacauguuccaauuuuuugggcugcuccuccacuuuagcugcuagaaacaaggcugcuggagccacagacugaauggagagaaaauaaaucauauuuauuaucaauuuauucauucauagaguaagguagaucuaaagaggagcuaagucucaaaucaaguuauuugcuugccucaacuuugucaccucuuuacccuuucccgcccccccgcuucuaccaucuuccccucuccuacccauuaauccaucuccacuuccaaauaccaauucuuugacaaacugucauuaaaagcugucuaugggagaagcuacuagauguaagcagacaguuuucuauuuaaagugagauucuuuauuaaguuuguaucaaaucacucaauacauuuuuuaaggaguaaacugaaauguccagaauacgcaaauccauauagagaaaaaguuuagugguugccaggagcugcggggagaggaguauaggaauaacugcuaauaggugaggaguuuucuggggugauguaaauguucugcaauuagacugugcugaugguugcacaauuuugcgcauauacuaaaaaccagugaacuauauaauuuaaacaaacgaauuucauuguacgugaauuauaucucaauuacuuauacauaucgaaccuuucaaaaauacaaagcauggcauuauaugcaagacauuauuuauagaaagcauuaagagggaaaaauugaagucaauauaaaaguagauaacaaacuuuauaaaagauuaaagcaauaugacauaaauguagccuggugaucuuggaaacuucaggaaauagaacuuuucuugaauauuaagaacauuucagugacucaaagauaguaaugcuaagagcuguauuucaccaggagucaaagaaauacauaaauaauuuuacagaauuuaaauauauauuucauuuuacugacuagaacugauauucuaauacuuauuuguaacccugaugucaccuaugcuauacuuuucuagaguaaguuuuucuccacaaauucaacucauaguauugauuucagacaagaccauaggagacaaaaauaauuuaaaacaaaauuuuuuuaggccagacacagugguucaagccuauaaucucagcacuuugggaagcagaggcgggggaucacuugagcccaggaguccgagaccagccugggcaacauagugagagagacuccaucuccauacacauacggaaaaaacuguuuuaaguaaacacagugauucuuuuccuucacauuuguuucagaugaauaugaagcauacuacauauauauuccucagacuuuaggauaaacaaaacaggaucagagaaaaauggauaugaacaaagguauggugaucuaggcguaaagcacauuuucaauacuaaacugaguaguuaaauacauuagauaaucggauguggaacacuagauuuuuuuucuuucuuuuuuuuuuuuuuuugagacagcaucucacucugucacccagcugcagugcaguggcgucaaaaucacaguuccacucaaccuccugggcucaggagauauucccaucucagccuucgaaguagcugggaucacaggcacacgccaccacacccaguuaauuuauuuuuauuuuuaauagagauggggucucccuacauuguccaggcugcucaaacuccugggcucaaguaauucugucucugccucccaaaguccuaggauuacaggugugagucaccucacccagccaagauucuuaacaagagugacacuaaagauuuugaaaaauaucguuuaagaaauguuuaugauaaauguauauaacuauuauguacccaugauaauuaauaaaaauaaauuuuuaaaacaaaguaauauuuagaaggaguaaucugaugguagguaaaacuaggagaaaaggaugggauacauuaaaaguuaauucaggcuggguguuguggcucacgccuguaaucccagcacuuugggaggccgagguagcggaucacuugaagucaggaauucaagaccagcccggccaacauggugaaaccccgucucuacuaaaaacacaaaaauuagccgggcgugguggcacacaccaccacucaggagucuuguaguaggguagucccaccuacucgggagaauugccugaacccagaaggcagggguugaagugagccaagaucaugccacuguacuccagccugggcaacagagccauacugucucaaaaaauaaaauaaaaguuaacuuaaauaauaauuuaggcauuaggacauaaaguuuagagcacuuugggaggccaaagcaggagaaucacuugagcccaaaguucaagaucagccugcguaacacaaugagacccugucucuguuuuuuaaaaauuauuuuaaaauauagaaaaaagaauuuuaaaaaguuuagaguaggccgggcgugguggcucacgccuguaaucccagcacuuugggaggccaaggcaggcagaucaccugaggucaggaguucaagaacagccuggacaacgugguaaaacuccauaucuacuaaaaauacaaaaauuagccaggagugguggcacacgccuuuggucccagcuacuugggaggcugaggcaggagaaucgcuugaacccaggagguggggguugcagugagccaagaucacgccauugcacuccaaccugggccacagagcgagacucugucucaaaaaaagaaaaaaaaaaaaguuuagacacuagcaguagaaauaaaggaaaaaagaaacacaggcaucacuuuguaaaacuaauagggcugcacuaaauauauguacauguacuugcauacaaagaaaaaauucuaaugggauauacucuaaaauguuaacaggauuaucucuuuauuuccuguccguccucuuccaauuuuuugauaauuuaaaaaguacauauuuauaaggagagggaaaaaaugguaacauuauaaaauuagcaagacuuuauaggcugggugcagacucuugccuauaauccuagcacuuugggaggccaaggcaggaggaucccuugagcucaagccugagcaacauagcaagaccucaucucuacaaaaaaucaaaaggaaaauucacugggcgugguggcacuguagucuugguaagguggaaggaucacuugagcccaggacauggaggcugcagugagcuaugauuguaccacugcacuccagccuagccuaggugacagaguaaaaaccuaucuugggguugggggggacuauaacuaacugaacaaaggggaaaaggacaagucaaagacuaagguuuuaagccuauuagaaacuaaaaguauggcauaaacuaauaaaaccaaaauaaaacuaaacuaaauuauggcaccacugcacuccugggcaacagaggggacuccguuucaaaaacaaagaacuagauaaauguuucuugagguaauuaauauuuguuguuuguuaggguggaaagaaaaggacccucaccuacagugcuggaaacaauguauaaucuuucaguagggcaaacugacacuacaaaaauuuuuauacauuguauacucugggcacagcaauuccaccuauaggaacuuguauuaaaaugcuuauauaagugcacuauauauguacaagacuaucccaugaaacauaauguacaauauaauaaacuagaacaacaacccaaauagcuaucaauaaaaagcugguuaaauaaacuacaguaacuacacaaauaccauguggcaaauuaaaauaauaagaaauccaaaaaauaauaaagggaaguauggaaagauguccaauacauacuguuacaugauaaaggcaagcugugcaacaguagcauagcaagauaugauuuuuuaaauaaaaauaccucaaugcuaguuuaugugcacagaaaaaugucugggucacuauaaaccaaacauuuaucaaugguuaucucugggugggauuacagaguaguuuucacuuuccacauacauuucuguacugucuuaauuuuuaccaugggaauuuauuauaauaucuuuggguuucuucauuuuuuuuuuuuugagauggagucucacucugucacccaagcuggagugcaacggcacgaucucagcucacugcaaccuccaccucccggguucaagcaauucugccucagccucccaagugaguagcugggacuacaggugcacgccaccaugcccggcugauuuuuguguuuuuaauagagacgggguuucaccauguuggccaggauguuuucgaacuccugaccucaaaugauccacccaacucggccucccaaagugcuaggauuacaggccugagucaacacgcccagccucuaauaccuuuguaauaagaaaaacacacacacacauacaaaaaugccugaggacuugacaggauauauaacauaucaaugccacauugauuauuaggccacauuuaauguauuaaguccucucacauuuaaauuuggauucaucacagcuaaacuuagaauuaguauguuaaaaggugauauuaaaucuggaaucuguugauuccaaaaugugccuaaaaucaauccucuaaaaaggaucaacaacuucaaauuaaucaguggauuuugaaaaaggucaugacauccaaaagaauaucccuauacuagccaggugcaguggcccaugccugcaaucccagcacuuugggagacugaggugggaagacagcuugaggccaggaguuugagaccagccugggcaacagagcgagaucucccgucucuaaaaaauaaauauauauaaaaauguuugaaagaauaucucuauauuggauaacuaccagaucauccauucauucaauaaguuuacugaaacugcuuuagagaauauacagaaaagggaaucucuguccuuguuaagcuuaacagauaagaaauaaaaagauauggccuggcacaguggcucauggcuauaauuccagcacuugguaggccaaggcggguggaucgugaggucaggaauucaagaccaggcuggccaagauggugaaaccccgucucuacuaaaaauacaaaaaucagcugggugugguggcaggcgccuguaaucccagcuacucgggaggcugagacaggagaauugcuggaacccaggaggcggagguugcagugagcugagaucgcgcagccacugcacuccagccugggggaaagagagagauuccaggucucaaaaaaauaaaaaaagauauaacuuaaaagauaaggcuggacgcgguggcucacaccuguaaucccagcacucuggaaggaugaggcgggcagaucauaaggucaacaguugaagccaagccuggccaacauagugaaacccugucuauacuaaaaauacaaaaauuagcugggugugguggcgggugccuguagucccagcuacuugggagguugagacaggagaaucgcuugaaccugggagguggagguugcagugagcucagauggcgccauugcacuccagccugggugacagagugagacuccaucucaaaaauaaauaaauaaauauauaaauaaauaaaaguuaaaaggaggggaaaauauauauuaaccuauacaugaagaguggacaaacugauuugagaguuucuuuuuuugauuugagauucacuucaccccaaauuucaagucuuuaucauaauaaaagggaagaauuauagaaaaccuucagaacuggcaaaauggcuaggaauuuccucuucaaauuucacuuuuuaacuacucacuaccuucuauucuggugcuaucagauagccucguuaaaugcuaacaggcuucucucucuuuuaauaagaaggauauacuccuugcaaucagagccagagcaaagcuccagggcaugacuagagguacaggggcuaagggcagaagaaagccaaccuggguggaucaucagcaaaaaucuuuuucuuuuuguuuugagacggagucucauucugucgcccaggcuggagugcaguggcacgaucucggcucacugcaagcuccaccuccuggguucaugccauucuccugucucagccucccgaguagcugggacuacaggcgcccaccgccacgcccggcuaauuuuuuuuguauuuuuaguagagacgggguuucaccauguuagccaggauggucuugaucugcugaccucgugauccgcccaucuuggccucccaaagugcugggauuacaggcguugagccacggcaccuggcccacaaaaaucuuaauucacaaauccaaaaaguuuccugugcaguuacucccaauacuguuucugccaguuucuuacauuucaggagcuaugucuagcuucauaaacucucuuucuacagcauuaaaaaaguaauaauaaaucugaaaacccaccauucuaaggauacgaaauaagcauccucaaaagcauaaucuuuuucuuuuugagauggaguuucgcucuuguugccuaggcugaagugcaauagcgaucucggcucaccacaaccucggccuccccaguucaagugauugccucagccuccugaguagcugggauuacaggcaugaaacuccacgccuggcuaauuuuuguauuaguagagaugggguuucuccauguuggucucaaacucccgaccucaggugauccgcccgccucagccuccuaaaguugugggauuauaggcuuaagccaccgugcccagcaggauaaucuuuuccuuaaaaaaaaaaaaaaauaaaaaaaaaaaaaaaaaaaaaaagcagggaaauacuugacucacaaauccauuugaaguauacagccggugcaguggcucacaccuguaaucccaacacuuugggaggcugaggcgggcagaucaccugaggucaggaguucaaaaccagccuggccaacguggugaaaccucgucucuacuaaaaauacaaaaauuagccaggugugguggcacaugcauguaaucccagcuacuugggaggcugaggaaagaggauugcuugaaucugcgaggcggagguugcaaagggccaagaucgugccauugcacuccauccugggcaacaagagcgaaacuccaucucaaaaaaaaaaaaaucaauccauaugaaguacucaucaaguuuaucccuauuaccuuggcguuuuauuaaguaaauacaguccuuccuagaacugggauaucacuaugcauucaauuccaagucauuuauaauaauguuaaauaggaccauuucaaauagcuacacugaaaagaucacuauuuauaauucuguacaaaaaaauaaaauuucuuuauuaguauaauuuuauucuuccuguucuuuguaaaauuuuuuuuaccuuuuuuuuuuuuuuuguagaaacggggucucaccguguugcccaggcuggucuccaacuccugggcucaaucaguccucccaccugaaccucccaaggugcugugauuauacauaagaaugagccaccaugcauagccuauuuuucauguucuuaaaagucauuuucccaguuauuauuacauaaugugcuuuccccuccaacugcugacuggaauuuuaucaaaggcuuuuggaaaaucuaaguaacuuacauuuacuucuuuugcugugaccauauuuuauaaacuacuucaaaauuaaugccaggaauggcggcucaugacuguaaucccaacauuuuagaaggcggaggcggaaggaucccuugaacccuggaguuugagaccaggcuggacaacacagggagaccccaucuucacaaaaaaaauuuuaaaaauuaccagauauguuggcaagccuguggucccaguuacuugggaggcuacggcaggaggacugcuugagcccagaagguuaaggcugcaaugagccauaaucaaaucacugcauuccaccauggacaacagggcaagacccugccugucucccuaccccagcaagaaaaagaaagcuauaccuaaauuccacaugauuuccccuuuaauguuacuccuccaaccccaaaauguugacuuuagaugucugauaaucuguuuuuugggguuuuuuuugaagacagggucucacucugaugcccaggcuggagugaagcgacucaaucuuggcucacugcauccucaacucccugaguucaagcaauccucuugccagcugcuggaguagcugagaccacagaugcauaccacaacacccagcuacuugcuuuuuguuuuuguuuuugauauuuuguagaaaugaggucucauuauguugcccaggcugguuuugaacuccugggcucaagugauccucccaucucagucucucaaagugcugggauuacaguugugagccacugcacccggccuaaucuacuucuuuagagaaucgacauggauauacuaaauccacuagacaaguagacacuuaacaggaaaacugaaaagcuggauucagaacagcaacacagcacauaauggaagugaucaacccuaaauucuaaaguucaaguuacaguucaguagcaaagaccaaccacaaauggaauagguagguggaaucaaucacaaaaggauuauaucauauaaaaaaauuauacuuacauuuccagggaacugugugaaggacugaaucauguagaaucgaugcauguauacuauagcaguguugauagucaauugugagcugaaguguucaaguuaagauccaaaaacaggcagguauaauucuggaaaagauaaccucuaucucccucccaaaaggaugaaauggccaagcaaguagauacuacuaaaugaaaaucauacuuaucucuccaaaucaaagaauaugucuguuuucuuucaccaaauuauuaaucgccaacugacacuuagcacaaugccuuacacauaacaaauauuuaauauaaauguacugaaugaauaaacaaacaucucaggauguaugaaucuagacagauuuuuuuaaaaacuauauaaggcggccaggcgcgguggcucacacucugucgcccacacuggagugcgguggcaccaucuuggcccacugaaaccucuaccucccaaauucaagcgauucuccugccucagcuuccccaguagcugagauuacaggcgcccaccaacagaccuggcuacuuuuuguauuuuuaguagagacaugguuucaccauguuggccaggcuggucuugaacuccuggccucaacugaucgaccugccuuggccuccgaaagugcugguauuacaggcgcgagccaccgcgccuggcugacaaccuuaaugacaacacacauacaaaaaggaaagcauuuuaaggaugcacugaaauagaauuucgaacaaaaagauuuaacuccauacugacaggaugcuuaggaaacaaaccuggacaucagcaggaaacaaacuggcgauaaaacagacacccauuuugagaugaacacacccuuaagauacacacauuacugucagccacacauuuaaauagaagcugcacccaagaaaauuuucacacgcagaguggaaagaaauuuaaaacuauacuaguuuucuccaccauaaaauaaguguauuuccuaacaaacaaaaauaugugggagagguuaccucauuuuuuuuuuaauuuuuuuuuucugagacggaguuucacuauuguugcccaagcuggagugcaguggcgccaucucggcuaacugcaaccuccgccucccggguucaagcgauuuuccugcgucggccuccugacuagcugggauuacagcugcccgccacuacgccgggguaauuuuuuguauuuuuaguagagacagggguuuaaucauguuggccaggcuggucucgaacuccugaccucaggugauccacccgccucggccucccaaagugcagagauuacaggcgugagccaccgcauccagccguuaccucauuuuugaaaaugaaauacauaucaucacucuaaguaaguuaaggacccgguauuuuguaaacuauuuaaaacauuagauucguggguauccccuacaaacguaaacuaacaucuuuccucugaaauucuauaaaacaguagcuacuaacugagcaucugaaugcaaagcacugugcuggacacagaaucaaacacaagagguauuaucccauuuuauagacaagacggccaaaaauuugagaggucacuuaaacagcuaguagaugaggaauggauuuuggaccaaggcugaggcauuaauucuaguccacccuuuauaacacuuucagguacugaauuucucgaaauuuacacacuagguuugggaggcagccgucaacagagaaaccucugccagaccuagaccccuagggcacagcggaaaaugagaaucuuaacgucaccagagcagaucagaacacaaugaagacagaguuggaagggcugguuaaaacacaaagccgggaaggauacgaauucccagcaaggcuggcggcacgggugagcgagcgggaaaucaacucugccucgcuucccuagcgcuaacugaguuucagcccgccccaucgugggcucucccaacuagacauccagcuucugcccaccuucuuccccacuuucgucccccccacagagccugagacccggacgccagagcauggcgggaccaacuccaaggccgaaggccuaggccacaaggauacacguuaagacgcugccccauguccugaagcagauuggccgccugcuggcgauaagaaaguucuuuaucuggguccacgccaaaacgacgggaugggcuauuuuccagcuguucucgagugaaauaccaccguuuguuguuguucuuccucucucccuccauagugcuucaaccagaaggcagcggcgaaggcugcaggcacuucccagcgucaccuaagaggcgacccacauccgcugugcgggggcaacugcgacuugacgaacuuccgcuaagcgucgaccgccggguuguuacuugccuccguagaggaagcaaaagucaaaggaccuacuuccggaaugcaccucgcuacaccccguagccgaguuaacagccaauaugcgaccagaaaaaaccuugaggcgaggacgcaggcgcgucacgugaccguugggcgguggagugggguuagaaguucuuucuuaaaaaccguguaucuuccc

SEQ ID NO: 192580 - RNA, 21261 nt, Homo sapiens
ucgcggcuuccggugcuagguggagggaaggaaggagggagccggggagugggccagggcagcagccgggcugaagucggcuuggggagccagagggagcggagcggaaccugcggggcagaggcggcggccgcagcggcgcagcugauagcaggaacaggugagaggcugggaagggaaggcgggucccgguagagaagaggcucggucagggugagggcugaggagauagagcgccucccgggccccgcccggcacugcuuggcguggggcggugggauucuucccacccgagagcucagagagggugcgucgggccagcuucacgccugcccccgcauuugaaggacgcagagcugggguggggguggggggcgcacacggauuuguccuccgccucgcucaagggggcgaccugggcugcaguuagguugucgccugcaggaggugugcuguugagggagaggaaaaccguccgaggagaggugaugagggggcggugauggcuguuuguaucuuuucuguuaaagggcuagggaaugcugcuuucuucuacucccucucccucccccaccuuagcaauaggagacgggagagaagccuugcugugguuacacccccucccccaucauagggcaggggugcguagggggguuggggguuagccaacagggcaggcugcuggggcaccacaugggcgcuauugugguagagguugcgcuuucgagucuagggaaccgcagguugggaagagggcagcaaguggggagaggguggagaggaggcaggagaaggaggagggggaucugaucuuccugggagaagagagguggggccuuccuccccaggcggagcgggggcggucucacaggaggagggagcaucuugucacuggcccucaguuugugucuuccaauccgcuuucuuucuuuaggaaguaccaggauucccggaacagaaaauggagccauugcuuacgcgaaucguuugagggaaggggcgggaguuggggagguggaguucccuguuaaaacgggccacuugauuagcaaagugguagcuguuauuuugggggaauucccgucuugauugcauuaaggcgggucuccaucuuuccaggccaggaggaauguggugguggagguggaggauugugguauguggucaggagugagaagaaauaguaaggccgucccggugagggagaaauguaaccuaaaaccugucucugcuguuguuggauugggucaccccuggucuauggcaugaaaguuuuauugggaggagaucugcugcaagagucugauugcuugggucagugcaacaggacagaaucuagucgcugcauaccuccuucccuguccucaaucagguagguaguaacagucuuugcugcuauuuugucuugggcuuguuguugggguagguguuuccacuugccgugacuugggacaugggacaguguuaugggacaguggauuaucauagcccauuggacuugaguuugaaaaacaugucuguaaaaguucauucuaagaaagaaacuaauccauuaagguucagcuuuucaccgaaugaaugauugaccuuggauucagccaggaaaggcucccauguaucacauauucacaugcguccuguuucccagcauagaauuauuaccuugcauaguuagaauuuuuauaguugucuaucuugcuuuuccaaagagacuagacgcuuuucgacugcaggaacuggauuucgucuccucuuccacaaugcccaugcaaacaguagguacccaugaugaauuuagaauguaaauagauagaacucaacaagcuuucuaacuguaguuuaaggaaagggcaagagauggcuuggcugucagcagaagugccuggaaauagcuuagcaaggguacaaagacccuuagccuuuguaauuaagaaguuuuugugucucugccuuccuaagaggcacagaauaggcauagauaauggaaacuuaagacccaaaaagaaaaauauuacuagaacacagagucauuaucugcagucccagauuuccugcuuccccauugugggcaaaggggucucuccaucagaccuaagucuuucaaaguguuauauaugaauugggauccuggagaguuuggaggagggaccaauauauguauauguguggugucagguacagaauugguaccagugaaugguagcugcuauuauuauacugaaugcaaguauaaaggagagcagacuggaaagaguggaagugagugaaauacuaagugcacaaagagucauauuguaguguguguucacccuacucuuuuacacuagagucauaauaagaggaaguggacucaggauagagggugggauuuauugguuagaaggaggaacuucuuuaaaaccagguugguuaaaguugaguauguaacugaaggaaauuguagaaucugcuucccuauauaccuuuauuuuuauccacccaggcuggagggcaguggugugaucauaacucacugcagccucgagcuggccucaagccauccuguacuucagcuucucaaguagcugggaccacaugcgugugccaccaugcccagcgaauuuuuuuuuuuacuuuuuguagagaucucacuguguugcuagggcuggucucaaacuccuggcuccaauauauccucccaccuuggccucccaaagugcugagauuacaggcaugaaccaccaugccugaacucuccucaccauuuuuguugagguaaauuuagaggcagaaugguauaguaauuaagaguggaucuuggaaucagacaaaauuagauucaaauccugcuucugcuaauuaccaguugcauguuucuuguaaaauugcuugucuucucucuuuauuuucuucaucuguaaagaagguaaugacauaugguuuucaagagaauuauuauuuuuuugguugucaguagaauuaaaugagauaaauguaaagcaccugguauuguacaaagcauauaguaaguaccaaauaacuguuagcugcuauuaauaauccauuaucauaauccuaauaauaugaacacucagggcugccuuagaggaaaagagguuuacagaagaacaacuugcugccugaggugcuuguguagagggaugauuguuaccaugaguuucugugcuggucguaggcuuaugagcagcgaaaucuuuuuucagcuucagcaucagcaucgcagagacagcuccugcugccugagugggaggugaagcuggagcaaggcaggggcccugaaccaucaauuuggauguagggugaagauaugggggcacaagaauaguauucauauuagaaaagucagugugacucugagauaaugguucacucuuccagaaaagagcacccugaugaccuaggucagggauuuagauuccuagaugcccuuauuuuaggucucagucaguauauggggaucuucauuuaguccacucuuuucauuuaguccaaucuuaauaaaaaaugucugcuuuugaguaucuguuucagaauaucauggccuagaaauugugauaucuguagaauuaucugucuaccguaccuucuucacuugaacaucuguugcaaauauagauagagugcuaauaaaacuauuugauaaugaaaagacaugaggagcguuuggaaagggucccacagauguuugaagguuucauauuauagucugguaaagaacugacuaaaguagggauuucaugaauguguuagagcuuuaccauggacuuaugcaaaggaucugccacaccauguggaccagaaaggaaauggcucagaauguuagagauccaccauuauuaccauauuccugaagaaaguugagaugacuggguguggcaggucucuugguaccuuuuaguucucccauuacugcugaaagccuggcauaauccuuccuuuauuagcuuaugcacaggagugucaagcgugaaugcuuaaacuucagcaugagcuuaagauguaggagagcauuugcucucuguugcaaugguuuauguccuuuuuuuaaaaaaaaaauagucaaaccuuaaauaaaauuuuauuugaauucuaauacauaaaauggacaaaaguggaguuacucucuacuggugguggaaaaugggggugggguauaauuacagccccucacaugaucucuccucucuucaagcagaaccugugggcucugaggacauggaaaccauuucuucaguuugucagauacagggaaaaggaucagagaccaccuauagaauacagucuucuucaaccccacaaguguuuugccacccucaguagaaccguucucaacacgccugucagucacuagcuauaggucagucauuggugcuggaugcuggagacgugaaauaugaauaaggcauagucugugcuggcaaagagcucacagucuagugagguacuuuccagccuuuuucucaucaugguauacacaaaaaaugguaauagugagacuugaaaucugagauggcuggcccaagggcuguagccaccccaagcccugcccagccauccaguggcugauaggaucaguaucuccagcugaccuguaaugcacuagaggcacauugggcaguugcagcucuggaaagcaaaacagacaaacgugaauacugcagcaaguccuagaguagaaguguguuugggaugccgagggaucgcagguaacucuuauucccuaaguaggcaguucucuguuccucuguguccuuaggcugcucuguauaaugguuggccuuguccacaucaugucuuccuguuuaagcaguuuacugucagcuccaucuugacuugcacaaugggaccagauuaggggcagaagauuauuaggagucuaggcuauugauggacuuucagugauuuugugauuaggaauuuauaguguucuggauauccaagacuguagaggugggcauuggauugguacagccauagaauaucaggagcuguagugguuguaagcuggucagauucuaagaacaaggcaagcuguaauuuuugggcagagggcaguaccacagaauguuccaaagaaacaaaugagucuaguuuuuaucuugucacuguuuuaucugacuaggauucuaaaacagaccuugucaucuuuucugacucacuugcuaaggguugucugugguaaaagccagacccuucccaggcguuuugggucuccaucagacagggcgguucgggauccuucuucacuucacagcuguggcguccuucagguuugcguguccuggagucuuuuccaggauuguucuuugccuagaugggaagcuggcauaacaauucuggccugagccuaaacaccacuaauugagcuaauaggaacuuauuuaguuagguacguuuuaguuuacaccaaaacucuagcuuuggauccucccucuuuucuuuuguauguucuauccccauuggugucuaugaugucuugcucucuugauuucccuucugccucucugguugcuucuuauucuuuccuggccugcuuuucugcccgcuauuuuauuuauuuauuuauuuauuuuaauuaguuuuuuuuuuugagacggaguuucgcucuuguugcccagccuggagugcaauggcacgaucuuggcucacagcagccuccaccucgcagguucaaaccauucuccugccucagcuuauggaguagcugggauuacaggcgugcgccaccacgccuggcuaauuuaguacuuuuaguagagacaggguuucuccauguugguuaggcuggucucgaacucccgaucucaggugacccgcccgccuuggccuuccaaugugcugggauuauaggcaugagccaccgcgcccggccuauuuauuauuuauuuauuuauuuauuuauuuuugugauggaguugcguucuugucaccgaggcuggagugcaauggugcaaucucagcucgcugcaaccuucguccaccaccuggcuucaagcaguccuccagucuugccuccugaguagccgggauuacaggaaugccccaccaugcccagcuaauuuuguauuuuuaguagagauggggucucaccauguuggccaggcuggucucaaaccccugaccucaggugauccgcccaccuuggccucccaaagugcugggauuauagcuaugagccaccgcgccuggcucccacuacuuuaaauguugaaaugucaggcagguuucugccuuugcccuuuucuucuaucccacuguguacacuaucccuagauauaucaguuaggauguauuaguugcaaaaauagaaaacacacgugucuaaaacgcugagaggauuuauuaaaucauauagcaagacaucuaguagaaaggcagacauaggccgggugcaguggcucacgccuguaaucccagcacuuugagaggcugaggcagguggaucacuugaggucaggaguucgagaccagccugaccaacauggugagacccugucucuacuaaauacaaaaaauuagccgggcgugguggcaggugccuguaaucgcccagcuacuugagaggcugaggcaggagaaucgguugaacccaggagauggagguugcagugagccgagauugcgccauugcacucuagccugggcaacaagagcaaaaacuccgucucaaaaaaaaaacaaaaaggcagacacagaagaacacauauuguacaauuuuacuucuaugaaguaccuagaguaacagauucauagagacaggagaauggugguugccaggggcuggagggacagggggauuggggauccucuguuuaacagguacaguuucaguuugggaagauuaaaaaguugaggugaugaauaguugugauaguuacacuacagugugaauguacuuaacgcuacugaauuguauacuuaaaaaaaugguuagaaugguaaauuuuguguauauuuuacuaugauuuaaaaaaaaagaagccagucggguacaguggcucaugccuguaaucccagaacuuugggaagccgaggugggcggaucacuugagcccaggaguuugagacuagccugggcaacauggcgaaacuucaguuaaacaaaaauuagccaggcgugguggugcaugccuguagucccagcuacuccagaggcugaagugggaggauugcucgagccugggagguggaggcugcagugagccacuaucacgccacugcacuccagcuugggugacagagcaagacccaucucagaaaacgaaagaugccaggcgugguggugcaugccuauagucccaguuacucaggauugcgugagcccaagaauuugaggcuguagcgcaccaugagggcaccugugaauagccauuguauuucaucgugggcaacauagugggaccccaucucuaaaaaagaaaaaguuuaguuuaccagcuugauacuguaauuaaggacccaacugaguuuuucccauuuuucugcucugacauccuggaguuuuuaaugucugucucccucucuuuauggucuccagauuauucuagcuucucauccuucuacaucaucaacauccaaaggcuggacaagagaacauugccauagguccuuuucuaagauugaggggccaggcacaauggcucaugccugucaucucaguacuuugggaggcugaggugggaggacugcuugaggucaggaguucgagaccagccuggguaacauagcaagaccuugucucuacaaaaaaacuuuaaaaauuagccaggcauggugaugcacaccuguaguucuagcuacuugggagguugaggugggaggaucucuugagcccaggagauggaggcugcagugagccaugaucaugccacugcacucuagucugagugguagagugagacucuguuucuaaaaacaacaguaauaauaaaaacaaacauguucaggccaggugcaguggcucaugccuguaaucccagcacuuugggaggccgagguggguggaucaugaggucaagagaucgagaccauucuggccaacauggugaaaccccgucucuacuaaaaauacaaaaaauuagcuggguguaguggcgggcgccuguagucccagcuacucgggaggcugaggcaggagaauggugugaacccgggaggcagagcuugcagugagccgagaucgcgccacugcacugcaacccgggcgacagagcgagacucugucucagacaacaacaacaacaaacaaacaaacauacauauucaccuucagaucuguuccucuuguauuuucuuucugaagaaaugccacccagcccuaggccagaaaccugggaaucaucuuugauuauucuacucuucugcguacauuuaagcacucauuaaauccuguggauucuaccauuuugauguuucaaaucuguccucuucucucuaucuccacuuguaguugacaacuugcgauuucucaccuguauuacuauaccuccuaagcagugucugugccuccagucuuuccccuuucuaauuuacuccugaaacuucuaaagcacauaccugaucacguuacucagcauggccuuuaaagcccuucaugauccagucccugcuuaucucuccagccccaucccucaucauuuucuuucuuucuuuuuuuuuugagaccgagucucacucugucaccuaagcuggagugcagugaugugaucuuggcucacugcaaccccugcuuccuggguucaagcaauucuccugccucagcacccugaguagcugggauugcaggcccacaccaucacacccggcuaauuuuucuauuuuuaguagagacgggguuuuaccauguuggccaggcugaucuugaucuucugaccuugugauccgcccaccucggccucccaaagugcugggauuacaggcgugagcuaccacaccuugccuguacucuucacuuuaggaggcugagacuggaggaucguuugaagucagaaguucgagaccaaccuggucaacaaagugagacucuaucucuaccaaaaauaaaaauaaaaaaguuagcugcgucacgaugauuugggcccguaggucuuuuuagcuacuggggaagcugaggcaguaggauuguuugagcccaggauuuggaugcugcagugagccugggugacagagugagaccucaucucuuuaaaaaaaaaaaaaagauuauauaaauuuuuuuaaagugcuaucugaaacuuaggucuuuuuuucuuuuucuuuuuuuugagacauauucucucacucugucaccugggcuggagugcaguggcgugaucauggcucacugcagccacaacuuccugggcucaggugauucucuugucucagccuccugaguaguugggacuacaggcgugcaccaccacacccagcuuuuuuuuuuuuuuuuguagcgaugggcuuuugccauguugcccaggcuggccuugaacuccuggccucaggcaaucuucuugcaucagccucccaaagugcugggauuacagguguguccugcugugccuggcucagucuuuaugccuuugcacacacuuccccugcccaacucccucuuuauugucugauuacuuccucgucuuccuuuaggagccagcucagguaugaccugagaauuagguuucagaaucacccuuuacccuucaguguugauuuacugcuccagcuuucuguucacauaauacuaugugcuuuacucuuacucucacacuguuuuguaguccugucuucacuagucuuuuccauuaaagacugaguuucaugaaggcagaaacugucucccucucuguaucccuaguucaguaugcccaauaaauguuugaugaaugaggccaggcacgguggcccacgccuguaaucccagcacuuuggggggcagaggugggcagaucacaaggucaggagaucaagaccauccugguuaacauggugaaauccugucucuacuaaaaaugcaaaaaauuagccaggugugguggcaugcgccuguagucccaucuacucgggaggcugaggcaggagaaucgcuugaacuugggaggcggagguugcagugagccgagauugcgccacugcaccccagccugggcgagagagcgagauugucucaaaaaaaaaaaaaaaaaaaaaguuugaugaauggaugaaagcugguaucagaagcuauuucuuaacuuugggaaaucuuuaagucuagucgaaauaguucagauaucaucuaggaguucuuauguucugauuucagugcucuugagacaaaaacuuggaguuuacacaggucacgagccagcugcaccaagaaaacucaguacgggcguacucugcuuuuguuucuuuaaauuguauuggucuguuugguuagcugugcuaaaaauagcaucucuuagugauauuucaauuugaaaauuaucuaagaacaaagcuguuuuuacugcacucugccuggcagcagaggguuugggagacccuggucuuccuuccccuggacgcugaagaggaggagguagugccagaucaggaguccccucagaggugucucauagcacauucuuggaucauucacuggaaucagguagagggaguauguguggccgacugggaugugugacucucaaaagcaccuggagauugaggcaggcacguuccugcaacauauguaaggaaagauggcugaguagccaguuacagcaacagccugcuucuccuggggggaugaggugggagcagugaguuguccucaagugaggauauccuuagaugaggcuuaaaucaacugaugugcuuaacugaauuccuacagugucccacacagauuguacuagagcacauauuuggguuccuauuguuauuuuuaccugugauaauaaaguuucugacuguaaaacagaaccugcagauaucuuuuuaacagagauguuaguauauuccauuuuucaucuugagccacucacuuucagucuuaacugcuuauucuugguauccaacagccaauggaacccuggcauuuugcccuauaaacacaggaguaccaucuguggugaaagagaguaacuauaggcuauauaauacauggagaaacaauucaugguuuguuugcuuugccauucugcuuccuagugcuuuuuuaggaauguauugugaaagugagaauaggcuguauagccagagauuuguauucauggcacaaagcagaaagcugcuaccaucuuggugguagggcagcaugcucucugguauuagcaagggacagggaaaaccaagacaagaaagccagcauccccuuugaaaugcucauuuaagucaagcuccagauuauacuuaaagaaaagucauggccagacguggugggucgugccuguaaucccagcacuucaggaggccaaggcagguggauugcuugaggccaggaguuugagaccagccuggccagcauggcaaaaccccgucucuacuaaaaauauaaaaauuagcaaggcaugguggcacaugccuguaaucccagcuacucgggaggcugaggcacaagaaucacuugaacuugggaggcagaaguugcagugagcaaccucugccucugcacuccagccugggugacagagcgagacugucucaaaaaaaauaaauaaauaaagaggaggagucauaacauccauuaguuucaagguccugggcugugccagggagauacaugauagcuacuggauauuuauuuuuugagauggagucucaguguuacacaggcuggagugcaguggcgugaucucggcucacugcaaccucugcuuccuggguucaagcgauucuccugccugagccucuggaguagcuggugcuacaagcauguaccaccacgcccagcuaauuuuuuuuuuugagacagagucuugcuguugucugcccgggcuggagugugauggcaugauaucgacucgcugcaaccuccaccucccagguuccagcaauucuccugccucagccucccgaguagccaccacacccggcuaauuuuuuuguauuuuuagcagagacaggguuucacuguauuagccaggauggucucgaucuccugaccucguguuccgcccgccuuggccucccagagugcugggauuacaggugugagccaccgcacccggccaauuuuuggguuuuuaauagagacgggguuucaccauguuggccaggcuggucucgaacuccugaccucaggugauccacccaccucagccucccaaagugcugggauuacaggcgugagccacugugcccggccuuuuuuuuuuuuuuuuuuuuuuaagacagagucuuccucugucaaccaggcuggagugccagcggcaugaucucagcucacuguaaccucugccuccuggauuccagcgguucuccugccucggcuuccugaguacaggcgcgcaccaccaugcccagcuaauuuuuauauuuuuaauagagauggggcuucaccauguuggccaggcuggugucaaacucccagccucaggugauacgcccaccucagccucccaaagugcugggauuacaggcaugagccaccaugccuggccagcuauuuagauauuuuaucaguuauucaucagucccacuguauauuaaauggcaagagagaaucccaccaauucuagucuucuaguccuuuuauguuguucccaaaccaguccugcgucaaauauguguggaaaauggcugagaauggacaggauagcuaagcaacucgcugugcauuacacagagauaccaaauccuacuggacagaagaaauaauauaaggacauccucagaugaggcuuaaaucagccaaugugcuuaauugaacucccacaaucuacuuggcacuagagggaggacagauucaaaauaaguagacauagucuuugcacauagggaauacacagcuuaacgugggaagcaguaaauacacagacuuauaaaagaagaaaaacucgacaagguaguaagugccacauugagugguuaaggucauucaaaguaaggccuugauguggcaugccaggaaauaauagguguaacacugggaucagcuuuugaaccaggacuucagcaugacagccgagcaaagaagcaaaucaaaggacaguguaccuguguucuggggcaaggcauauuggcuaguuauaucuuuuucagccaccacuauacucacaguugguaagcauuuaaucagcaauaguuucagucauaaaggacagcaagauaaauguguggcauaaauuuaauucagaaucugggccaaagccugauaccaaaccuuuaaagcaaagugucaucuggagcugaaggaaaggcugccugagcaagaggcagaauaaaggcuagaagacuaggaagacuugggaaagguuuaaauuucaugagguguuaguaguaugaccaaaagucacuacuacaaauugccaagguuggugagagcuguucuuagcuggguaggucgcucagggguccucaggagucuguccaccuggguggguugaggcaggaagaguagggaggaaggcuagcggguggcuugacugaaguugaacccuaagguugagcuagcccuucuuccuggugugugaacccucuaggucagggguagggcucaucuggggaaccuacugagagugccacgccuggcucauuaguggcugucuggggaggccuuuugaagaugaaacacuucauaagcacucauuguuucuguuuuuucggacaaacuaguacuuuggucuucagggacuguugaucuggcucaguugcacuagucuggaauuugcugcaaacugagaaggguggugggggaaaugucagaaguuuuuguaaaaacaaccaaacucccaccaaacccccaugcguuagcuuguaaauaggauuccuccccguccaccuuucacauucuuggguuugggcgcacuuugucuugaccugucccuuuggcugcugaguuuggggugugugugugucucugguucccagacucuagagaaugccagcagcuggcauauggugauugcugaauaagcugcccgcugacacaugccuccugcaggcacagagaacugguuuguaugggugauucugaauccucauuuuauuauuguuucaaagaugcauuucuguggcuauccugugccauagagaagagagggaagaagaaagggaaugaaugaaugaaucugauucugucuguuggggcaauggcuggggugagcagauagacauuuuauaccuucauaaugauucuuuugguccuguucauccuuucagcagguauuuguuguuguuauuacuauuauuauuauuauuuugagauggauucucgcccugucacccaggcuggagcgcaguggcgugaucucggcucacugcaaccuccaccuuccagguucaagugauucuccugccucaacguuccgaguagcugggacuacaggagugugccaccaugcccggcuaguuuuuguauuuuuaguagagaugggguuuuaccauguuggcuaggcuguucucaaacuccugaccucaggugauccacccgccugggccucccaaagugcugggauuacaggcgugagccacugcgcucggccucagcagguauuuguuaugugccuaccauaugccaggcauagcauccagucugagugagcuuucaguaaagucaguagagacccuggggauuaguucaguuuuugaaguacugugugcuaggcacuauucuugguacuggagacagagcagugaacaaaacacauaaggagcugauaucuuaggcagaauaaaacaaucagcaagaaauaaauauauaauguaucagauggugauaaauguugugaagaaaaguaaagugggauaaaugggguagggaguggugugugucuguguguguguguuauacaugugguugugggaggccucuuugguaggugacauugaaacagacaacuaacugaaggaggugaaggaguaaucuaugaugguuaucuggaagagaagcauuccaggcagaggugauagcaaauaugaaagcuuugggccaggcaugguggcucaugcuuguaaucccagugcccugggaggcuaaggcaggaggauugcuugaacccaggaguuugggaccagccugggcaacacgguaagaccucgccucuuuaaaaaaaaaaaaaaaaagcuuugaggcaggaaaggaaaguguuggggaauuggaguggaguaagcaaagagagaguaguagaucucaugagagaaguaggggaguguaggucuuguaggaccuuguaagccaugguuugggccuuggguuuuacugaaaaggagcuaugaagccacgaguggguuuugaacaaaggacucauaugaccugaguuugguuuuaaaaccacccuagaugcuauauggagaauaggccgaaaggcuuagggaagaagcagagaaccaaugagaugacugccucauugcagcgaccaugugggacagcccccuccuuggaugggccacaguaagccaaggaugcaccuagcugaggaguaaagggguagccccgccauaccccaccucucuacugccagugcacuguuguuugaacagggcacaacauuagcagcuggcauuccacagaguguaaaggaucggcuucuuuuaagagugcggcuuucuuauuccuccuuuauuuugguguggaagaaagauggaguugcaaaaauauaggaagggaagaggcagagucucuugauuaaaggagaaagcauaaaccuugggaaacuggcaagccugaaccuugucaggagucacagagagccacuccuuauuccgcucccuccucucccacccuugccagaagucucaggguaaguaagguuaggggagggaggggcauuaaugaucuuacaaugccuuuggguauaggguagaaugucagaacugaagggacuucagaaaucaucuaguucaaucccccuuccauuuacaggugcagauauggaaaagugaaguaacuugcccagagucacaugguuagauuacuggcagagcagggauccuuaguguuuacugcuuugucucuguucccaaagacucaguauguaucugagugggccuugguauuuauaguccccucaggcucuccguuugucaugaaugaacucuagccaugaccuugggaaauucuauuuacuuggaaguccugacaagcaaaugaugguaugauuuuacauuuccuuugucuaggaucaagucuuccauaccagggaccaggccaaaaccagacugccacugccccuacuugggccccacuguccccagaaagcagcugcugugaucaugggcaauaucuuuggaaaccuucucaagagccugauugggaagaaggagaugcgcauccugauggugggccuggaugccgcaggaaagaccaccauccuauacaagcugaaacucggggagaucgucaccaccaucccuaccauugguaagagcacagcuuggaugugggcuuucacgccggcagcugaggcagggcagggaccuauuccugguuccccaaccuggccucuucuccccaggcaaguccauacaauuugugggguucagaaaagagggugguguuguuuagcuuacuaccaggugcugaggcugcuguuugcccaccuaaccuggcucucccugaugcgggaacuuccauggccuggcacucaacagcugcccucaggcacggaguugguuucuucucuguguuguuuggaaagcagguaaaaggcuuugauguuccugccaaaggcuuggaauuacuuggguuuagaucuuugguggccaaucuugguuacaguuugcugaagggaggucucccuacauuugcuauguagaugggggcuccagucagcauugucagcuggcucugccuuuggggcuccaggaugccagcuuacuucccuuucuucacucugccucucaggccccacaucuuagcugaggccgacucugguagccaaaguaccagagcagggcugagucauuuuguaggagggagcaccaaagacugaguggaaaagucaggaaaguuggcccacguuacccaggcaacugugaaccucucaaccaacuuccucauccucuuugacuucucuuagguuuucauuuuggccuucaggcugcuagcuuaacgauuaucaggucugaggaagccuuagcuuuuguuccauuguugguguuauggccaccacugggggaaagcagaaccaaacucauuguggugguguuugcggggcuaguguuugaggccaaguggccauugccuguuuuuuuuccaaaggguucaauguggagacaguggaguauaagaacaucagcuuuacagugugggauguggguggccaggacaagauucgaccccucuggagacacuacuuccagaacacccaagguaugcucaggccuagcguggguugguuggguaugagcagagaguguggcugucuuuguuaauggguggccaacuguuacccugcugcagcuccugggggcagaagaaagggaggaaagggagcaaauauuuggagggugucaggcagguguggucuuuugguuggggggaggggguuaccugucaucuuagugcagcccaugcucugccuuccuaggguugauauuuguggucgacagcaaugaucgggagcgaguaaaugaggcccgggaagagcugaugagaaugcuggcggaggacgagcuccgggaugcuguacuccuugucuuugcaaacaaacaggugagacuucuucccaccccugaauuugggagacagcaaacuggcuguggaaauuguuggcucuugggccuauuauaugguuaacccuuuuaguaugcucucaauguuagaagcgugggaaacugagcacuuggcuucuuuaugccccucuucuugugccccaccccaagcuuuauuuagcaacauuucaguccucaggaauugucucaaaucuuucuuucaucuugccuguuaucuacuuuaggagaauuggccucacuccugcugucagacagaccugauucuuuggucagucugaaucacgucucuugcuuccccaccauccucguauuugguuuccaauucuucaguacagugaccucuagugcuuuggaucuugaguucuaggugacuaaauccaaaguagcuccuuaggaucuuguucuggguuuccuaaaauaaaggaggaggggaaggugcugguacacauuucuuugguagauggguguucuagaagccuuuaaaaaauccugaggcuucuuuuuaugugucucccacgugcuccaggaucugccuaaugcuaugaacgcugcugagaucacagacaagcugggccugcauucccuucgucaccguaacugguacauucaggccaccugugccaccagcggggacgggcuguacgaaggccuggacuggcuggccaaucagcucaaaaacaagaagugaaagccagacagcccuaacaaagcaccccacccaccccugacauaccuacugucacccugccccaguccuaccccuuccucuccaugcaaguguggccagggcccuggguaucauguccacaugcccagcaagagccuugccuccccugccuccccuccuuuuuccuguccaccuauaugaccaaucccuaauugcuguccugaugaugagucauuccaauuuacuggauuuaaaacaaaaaguuguuacgguuucaugggguggccccucucucucucacccucuggguuucgggaggucgagugggguauucucuuuguuuggcagugguugcuguccucuuggcaucugaguccuuucccuguccccacaagcccuucuacucccuguuugccuuuccuuugccacccucucccuguuuuacauggaaauugcacgggccucucuguguuugcgugcaugugugcgccuguauauacauguauagagagauauauuugugggggccggggggagcggggaggggguggagugaagcucagggcuugcagccaggacacugcccacuggagccugucaucugccccuuccguguuggugagauuaagggaagaaggugggagggcauuagucaagccggacugccccagucuuugacugguuacccuccucucugcagguagguuuuucuggaugauaggacagaugauggauucuucaccaccauuuuccuuguacucuucucuccacccuucuuagggcuggaggauggcauuuaucucuagaugacuguucccaaggagaugccacucugcucugccuuacuguugggaaggagagaggaacccacucacucuuaucagcuuagaguguucaacugauccuuccccaccaucuucagaucuguuccucuggagcuugacugggggguggggauggcaaguccaugguguguguuagggacccagggcauugggggaagggaggcgaaggccugagguuuuccaucuucauucucuuuuguuauuaggagaaggugaggcaugggccaaucccauuccugccuuccagugccccaccacccuucugaucuuagggguuggaugggucaucuguccuuggucagaauuuucucacccuaguacuccuacuggccugaccagggcugacuggguauucuaaugaggagcugggaaguggggugacauagcugaccuuaguaucaaccccccucuucuccaacucuuguuuucuaguccaggauaugcuaaaggacgaagauuuucuauuguuuccaggcccucagaccauccuugcugucccuucacccuccaugccccugccauccucacucacuucucauaaauggaucuggggguuagaguggaggaaauaaaauccugaagugguugucagugcuugugggaugcaguggucuucaggauucuccccgcauuauuauguaguuguucagaagcuguugcuacugcgucucucugucugcagggggcacuuguuccugagguccucgccuggguccugacuucuguaguuucugugaagacguggcuguccugugggcuccugugugugcuggcugcgcccugagcuccgagacagcugcccauaaccugcuaaggucagggcccagggccccccacagcauggcugagggaccccuucccaguagggcugucccaagccccacuccauggggccagguuuccuggccacuuuuguugauagcagauggaucaauauuaguaaccccauccaagauugaacugugaaagagagguuccagggguaucucccucagugccaguuacuuagugauguguuacccaggaugcagcaggugugugcagguaucuugcucucuaggccugugugugugugugaguguguguguauauggguguggguguguuuguguguggugguugugggggggguguuggagguucuauuucauuuaaaaauguauucauuucccuggccccacagaugcuucccuccauacuuuuuauuugcucuguuuccucagauuuauuuugucuugccccauugccucuccuuccuugaacucuuuccuuuucaaucucaacucauucacugcuguugcucauuugcccuuuuccauguauuuuuuccuacuuaggauuuuccacucuaucuuugugguucaugaggacuuugccucuucuccugccucauucccugacuuucucuaguuagaugucaguccuaaauagguuuuccucacuucaggccucaccccucaccuuguuuuuuugggggcuccagggaccaaucuggggcuggaaauguuaggagguugccuuggugcugccccagaucuguccagcagggggcaguaagugaucuugguaguaucccuggcugcuaagcccuuggcaggggugguccuuucuacauucccauucacuuaacagcucuuuugggauuggguguuucauuccauuucugcccacucccucuccucuccucucugguagguuuaauuuuaugcuuucccugauuccagcuuucugcuuccugaggacucccgcuccccccaccccaaaguuugucugugguguuauagugguaacugcaguuccuccucuggaauguagacuguauauguuuaauaacucaccuucucuauccuugcucaaaaugugggauaacgcgaugacugugacccugguuggaaauuaaacuuguuuuaugca

SEQ ID NO: 192581 - RNA, 36363 nt, Homo sapiens
aauaaauuucucugugauugguuggugaagguuuucaaaccggagcugugggcgcggcgcugcucugccguugggugaggcgcggagcgaagugaaggguggcccagguggggccaggcugacugaagugaguagugggggugccagaccaggugcgucugccgcuggauugugauaggaagcagaguguucguguggugagccguggccgccgcggggguccgggacagcgggacagcgggacaggcuggcagccacagccucuccacucgggcuuuucuggggugggggucguggcaggucgaauggacgcggccugggagggucgggggcuucugucuuggcgccggguuuuguggaaagccgggggcgucuuuuugaggugguggcuggaccagggcaggagucauccuaaacaagagucucucagucagauacgaguuuaagagugguuggagugacaccccaucguuuucgaagggaagagcccugguguuugagaggcccgggcggccugcaguggagccccucuacuucgugggucucguaugucuagggaggcaaggcaaggcaaugacaucuuguccuucucauccugauucuuacccucaguaacaacgaggccuuacuuguacacuuucacguacauuucucuucacaggauuucauccguaggccgagaggugugugucggaaaguggggguagguggguagauaagcccuuuuuuuuuuuaagaaagcauuaucuuucuaaugugucggguaaauaagcuuuccgaguuauuguagguguuuagagaaggcgccuuuccuguagcuuaaucauucaauaaguauuuaucuuuuggaggggacuuaaaaaaauuuuuguauauuuaggggguacaagugcagauuucuuacaugcauauaucgcgucguggugaggucuggucucuuaguguccccaucacucaaauagugaacauuguacccaauacguaguuuuucaacccucagcccccuccaccuucccaucuuuuguauucuccaguguguauuauuccacucuguaugucuguguacccauugauuagcuuucacuuauaagugagaacaugcgguauuugacauucugaguuauuucacugaggauaauggccuccaguucuauccauguugcugcaaaagacgugauuucauucuuuuuuauggcugaguaguauucugugguguaugucugucuauauauuacauuuucuuuauccaauccuucguugaugaacacuuagguugauaccguaucuuugcuacuguaaauucugcugugauaaauauaucaaugcaggggucuuuuugauauacugauuucuuuuuuuuuuuugagacggagucucgcugugucgcccaggcuggagugcaguggcgcgaucucggcucacugcaagcuccgccucccggauucacgccauucuccugccucagccucccgaguagcugggacuauaggggcccgucaccacgcccggcuaauuuuuuguauuuuuaguagagacgggguuucaccguuuuagccaggauggucuugaucuacugaccuccugaucugcccaccucggccucccaaagugcugggauuacaggcaugagccaccacgcccggccgauauacugauuucuuacccuuauacccauuagugggauugcuggauugaaugguaguuccauuuuuaguucuuugagaagucuccauacuguuuuccauaaagguuguacuaguuuacuuuuuuuuucuuuuucuuuuucuuuuuugagaaggagucuugcucugugguccaggcugaagugcaguggugcgaucuuggcucacugcaaacucugccucccggguucaaaugauucuucugccucagccuccggaguagcuggaauuacaggugugcaccaccaugccuggcuaauuuuuuauuuuuaauagagauacgguuucaccauguuggccaggcuggucuugaacuucuggccucaagugaucagacugccuuggccucucaaaaugaugggauuagaggcgucagccaccaugccuggccuguuuacuuucauucaauagguauuucuuaagugcaaaguguaaguagaagacagucuuauuuggucuuaaagaaugugcaguuaauuugggguaacagaacuuaaaaagauaacuggugagucugguaagccuauacacuguugaaaguacugugcauuaguacaucccuuuuagaaaacuuuuuggcacuauuaagagccauaaaauguuuuuacacccuaauauagcacuccuagccuuggaaaucuagucuaaggaaaacagucaccugaagaaaaauauuguccauaggaaugcucaauucauuuauucaccaaauauuuauuagucauuuaccaaaugucagguacuguucuaggcaucagggaagaaaacacaaaaaucuccgcuuucuuggaacuuaagcuagaggagaaacagacaauaaacugaauaaauauguaaguauguuagauggagagaagugcuuuggaacaaaguaaagcaggguaauguuagagaaaggcugcaguuuacaauaggaugguuggaaagaccucacugagaaagcagcauuugaguaaagauauuugaggugagagagugaccaugcaagagauuccaggcagagguaagugaaaaacuggaaaugaccuaaacguccaaagaagagaauaguuaaauaguuguucaucaacucuuuagaacuuaauggaaacaugauagaagcaaaacacaaaauuauauguaauguaugauuguaacaccaugaaauaagaguguaaaaugggcaaagauuagaucagaugguacauauaguuguuuaggauagugagauuuuuguuuugcuauuaauuuuuuguuuuuguuuucguuuuguuuuuuuuugagacagaguuucacucuuguugcccgggcuggagugcaauggcgccaucuugggucacugcaaccucugccucucggguucaagcgauucuccugccucagccuccugaggagcugggauuacaggcaugcaccgucaugccuggcuaauuuuguauuuuuaguagagacaggguuucuccauguugaucaggcuggucucaaacugccgaccuaaggucauccaccugcuucagccucccaaagugcugggauuacaggcgugagccaccacaccuagccuguuuuacuguuaacuuuuugaacauagaagauuaauaauaaacaguauuuuuguaucugcuaaaugaauguuauagauaauaaaggaaaucauuuuggacugaaaugguuagggaaggcuucagugaauuggugagacuuauucuagaccuugaaggauggaagaccagaauaggaagaauucacagggaaaaaaagagguauucaguaugcugaacuucuaguaauuuucugaaaaaucacaauucaaaucuucccuuccuuauuuuagucuucauguuggauugagaacauuuuguuuacucucugcaagugauuugcuuauaaagaacauuugguuucaagauaauccuucuguccgccaguuguauuagagacuuucgauacagugaagcagaagcuggacauuucaggaaaagaauuguccucacauuguccucaaauguguuccuaugaaaggaucuuaaaguacugagauuaucuuugagaaugguuuuccuugacagcagggaaucuauauuguugauuucuuggaaaucuccagauuuagcaauguuugugggaaaguuuuucauuaaaacacuuuccugaaaaacuccagcaaccuuucauugcuuugucuuaaaguauuuaacacccuugaugcaucuaaaaaaccugauauauaggucucuuaauaauguuguuugaaggaggaggaagaagaggauagagacuuuucccaggauacccugcaguaagaucuguaauagucuguuuuucugaaggaugauaucuaccucuuggcugggugauugaaauuaaauugggggcucaaagcaaucacauccagcugagacucuuucaugguguuuccagauugcucccuuagggauacucacagauugggaaucuguaacauacugacuucuccaccucugggguuccccaucaauaacagcugagauucucuagcaccuuuugguuuaaagugcuccacaaacugaguuucuugcugcacgcagggaucguuucagcuuucccgaaaaggcagcagucucuguuguggaaagugacagcuguuuuacagcugcaaaagcaauguacuacaauaugacuuuguuuuuguuuccuuucacauuaguguaucuccuagcuauggacuaaauaauacauggggggaaauaaacaaguauucaugagggugaaaaugugacccagcaggaaaauuacaacuauuuucaauugacguugaauagggugaguaaauuuuagcuuuuugaguuacaauuuggcugagauaucagaguuaguacugauauagaaagauauuuuugucaucuauaaauaauuccugagagucacuucuguagaauguuaauaaaaauauaugguccccuagcauauaaagagaagaggauuauauucugcuagugccauuuuuggauuacccuaaguaaaucuauguuagaggaaaaaauaacucuucagaagcagcaaaccucaucuagaacagcuuguuuaaaagccuagaccuggccaaauuuugcuguuuccuugauucuucuuggucuggguuccagcuauaauuuguguuuuauauguguugcuguuuguaugacauguuaugguuugcaggaggucucugaguaggucugcaacauauauggucuaauugauauuuuuguaacuuaucucuucaauguguuggguuggagagaauauagauuuuggacucagaccuggguuucaaugagaacucgacauuuauugguuaauuuaagguuucuggacuuaguugcccauugucuguaaaauggagauaauuaaguuagugaggccaggcaugguggcucacgccuguaaucccagcacuuugggaggccgaggcaagcagauugcuagaggucaggaguucgagaccagccugaccaacuuggugaaacuccaucucuacuaaaaauacaaaaaaaaaaauuagcugggccugguggugggcaccuguaaucccagcuacucgggaggcugaggcaggagaaucacucgaacccugaaaauggaaguugcggugaaccgagauggugcuacugcacuccagccugggugacagagcaagacaccgucucagaaaaaaagucaaauucacuuaaagaaaaaguguacgugaagugucuaguuuagugcccgaaucauuucaaagcaccuaguaaauacuggauucuuuucuuucuaauuguauaguauuauuuuuaaaaauggucuaaaauucugaauuuacugauauccuuauuuggagacagccuaggggggaaaacaccuagauuugagaaucacuguuuuaggauggaaguaacaacuaucagaccaaaaccaaaccuaaacaaaagaaacucacuucauaccaacuaaaagauaccuuauauuuugguagugagauuguaaacuuauacauuuuaaaauuuuuguaauauucuaugagguaaauagagcaaguguuauuguuuucacuuuauagaugagucauggaauuuaagugauuuacugaagauuauacuacugguagauagaagagcuaaagguuugucccaggaccuuuuuauuuauuuauuuauuuauuuauuuauuuuaagagaagggggucuugugaugaucaggguggucucaaacuccuagacucaagugauccucccacuucagccuccugaauagcugggacuacaggcacgcaccaccacacccaucuugucccaggacuucugcucccucucccgcuuuuaacuguucuuuuugcuuuaaacuauauuacacguugauguugagguagaauggaaauucuuuugaccauagcaucacagauauguguguguuuguucucugaauuaacacuuaucaauuuuuuuuugugagcaucauauuaaaugcuacaugcuuguguguguaauauaguagugccgcauguaagguuucuccccucaaauuuauauucuagcugggacacagggcagaaucauaugguaaaguuuaauucaagugcaaagaguuuguaucugaguggcaacugccugaagcaguaggggaaggacuggaggaagggagugcaauugaagugaguggugacaaccugcaagugauaaggggguggguaugguagauacaugagagaagaguacacaagguuuagugauuaugcugugggaaggggaggaaccagaggugauucugaaguuuggaacugagcgacugagagaaugauaaaaauagggaaaucaaaauuggaagucaguaggguaugggauaggguaggucagugaguagcguaguugauggacaugaacaggaagaguagaacagugucaggaggcugaggccggagaaucacuugaaccugggaagcagagguugcagucagcugagguggcgccaguggacucuggccugggggacagagcaagauucugucucaaaaaauuaaaaaaaaaaaaauggacaagagaacagguuauauuguaauuuaagacuuaaaacccccccuaaaaaagcuuuuuuuuaaacaaccaguuuucaacauccuagcaccaugaaauuuuccuuuuugaauucuuggacagauagaaguuuugccgugguauugagcugucuuauagucucacgauauauaagugaaugccgagaugauagaaaguaauaccuuauauuaaaacuacugauuagagucuuccauuuuuaccucaggagagccaaaggaaaucaacauuugaauugacuacccaauguccugccccuguuucuguccuguagcacuuaggguauguugccuauuucauuauauguuaaauccauggcaucuccaugaauuccacagcucuuccugccgguuuuaaugcuauccuuuuaguuuuguucuuaguuuagagaaagaucuuuguaauaaauuuguuggucugguugcuuagcagcuugcugugauuauguagcuuggaacagauacuugccguuugaaaaucuugguuuccggcccugauucagguauauguugcauccaggcuuggaacugagaacuuuuuuucuauuauagcaauuaucauaugaguauaaauguauaauucugcagcauuuaauauauaaaauaucuucauguuuauauauucuuuuuuuuuuuuuuuugagacagagucuuacucuggcacccagacuggagugcaguggcaccaucuuagcuuacuacaaccucugccucccagguucaagcgauccuccugccucagccucccaaguagcuggaauuacaggcacacauaacugugcccagcuaauuuuuguguuuuuagaagagacgggguuuugccauguuggcucaggcuagucucgaacuccugaccucaagugauccgcccgccugggccucccaaagugcugggauuacaggcgugagcugccgugcccagccuauguucauauauucuuuguccuuugugcuuuuuuauauauuuuuucuugcucucauagcuuguggugcaaucuuguaaacauugcaaaaucacuaacccuucauaagaguucuuaaaauuuuauuuaggaaauaaggaccuggacuagaauguugaagcauugguuaagagaaacacaagaauccuuuaaugguauuucugaggacauuaaauuucuaauaaaauuugacuuuuuauuucauuuccuugauaguuuucauaacauccaguuaaugucuuucuuucuugacuguuaagugaagaucuuauuuccucaaaguguucccaguuaaagucuauuuggaauagaaccgccuguaacgacacuguuuuuucuauaguaucagcaggccuuugaggggaaauacaaagucugaaauucacuauacaggacacaguagcaaaugauuuuugcuuugcccuucgaacugugaaggugcuguauugucucucugaugccagaaugugguacaacauaauccuuugccucuacuuaguauaaauuuauuagacguaguuccugcacgcagcccagcagagagcccuguauuacagaaauaauucuugugcugcugagcuggcgauuuucccacuuaaucacucaugugacgucaucugugcuuuugguaggaaaugugcugaccauguccugcauuuuaaaaggcaguugcaacaggggcauuagcuaaaaaugaaauuaaaaauagauauuuuaaguuacauuguaggucuucaaagcccacaaggaauaaacuggcaaaauuauuauauuaaucaauaggcuugacuugaagaaccacauuuucuuguuggucagucacuugcuaaugaacugacaugcucuuuccuauuuguuuucugcuccaagugauuggaggggcuguuauauucaaaggucugaaaugguuuucuaauuuucagaugagucuuaaacauuccaaguuuguuuuuauaauaagaaucacacaaaacaucuguuguuagcuugagauucuuauaaugguaguuauaaauggaagaguccagauguuggucacuaauggcuggauugcuauagaaucuuuuguugugggcgagaaggcaggaccccuaauguauauuugauuucuuggcagaaagauggauacuaugaugcugaaugugcggaaucuguuugagcagcuugugcgccggguggagauucucagugaaggaaaugaaguccguaagucauucugagcuggccuguccaaaggaaaaacagauuucaaauuugggauuuuuacaaagcugaaguauuuuccaaucuuaaaguuguuuuccauuuggguuaccuaaaaagaaagcagugaucacuuacguggucaaagccuaaugggcacucauucuaaauggucacuaaaauucuuuucuauagcugcucuuaauagguuuuagccaggcuuuuuuauuaucuuuauuuauuuauuuuuuugagauggagucucucucugucacccaggcuggagugcaguggcgacaucucggcucacugcaaccucugcuccccggguucaagcgauuccuugucucagccucucgaguagcagggauuacagacacacgccaccacgcccggcuaauuuuuuguauuuuuaguagagacgggauuuugccauguugcacaggcuauucuugaacuucugaccucaggugauccgcccgccucggccucccaaagugcugggauuacaggcgugagccaccgugcccggcugcuuuuuuauuaucaagauucuuuuuccacugaauaguuggcacuauuuucugugccaugaacugggaaaaauuuacuaggauguugcuuuuuucuuuagaguaguaguugucuuuuuuuuauccuggauuuucuuuguguucuauaaagcauuuucaguugaagugggaaaaauucauaauuucuucuuuuuucuuuuuuuuuaagaaucucauucugucacccagguugcgccaccaugcccagcuacuuuaaaaaaaauuuuuuuuuaaauuuuuuuaauuuuuuuuuuauuuuugagauggagucuugcacugucacccaggcuggagugcaguggugcgaucucggcucacugcaagcuccgccuccuggguucacgccauucuccugccucagccuccugaguagcugggacuacaggcgcccgccaccacguccggcuaauuuuuuuguauuuucaguagagacgggguuucgcuguguuagccaggauggucucgaucuccugaccucgugaucugcccgccucggccucccaaagugcugggauuacaggcgugagccacugcgccuggccuuaaaaauuuuuuguagagauaaggucucccuauuuuacccaggcuaguguccaacuccuggccucaagcaguccucucacuucugccucccaaagugaugagauuauaggcaugagccaccaggcccaguccauaauuucuuuuugaaggagauacuaggcauuugcuuucaccuacuucauauauuugaugcuaaauaauuaaggauugagagccagguuuggugguuugcaccuguauucccagcuacucaggaggcugaggcagaagaaucacuugaggccaggaguuugagaccagcuugggcaacauagcaagacugucucugaaaauauuagcggucgggcauaguggcucaugcuuguaaucuuagcacuuugcagggcugagauggguggaucgauugaguccaggaguuugagaccagccugggcaacauggcaaaaccccaucucucucuuuuuuuuuuuuuuuuugagacagaaucucacucugucacccaggcuggagugcacugguguggucucggcucacugcaaccuccaccucccuggcucaagcaauuguccugccucagccuccugaguagcugggauuauaaguguccgccaccacacucggcuaauuuuuguauuuuuaguagagaugggguuuugucauguuggccaggcugaucuugaacuccugaccucaagugaucagcccaccacagccucccaaagugcugggauuacagguaugagcaccuggccacaaaaaccccaucucuacagaaaaaaaaacaaaaacaaaaaaacccgccagugugguggcaugcuccugugaucccagcuaccugggaggcugaggugggaggaucacuggggaggcagagguugcaguaagcugagaucacacuccuguacuccagccugggacagagcgagacccuguuucaaaaacaaaaaaauuagcuggguguggugacacaugccuguggucccagauacucaggaggcugaaguaucacuugagcccaggaguuugaggcuacagugaacuaugauugugccacugcacucccgccugggugaaagugagacuucaauuccuggggggaaauaauaaagagaauugagaugggguggugagcuggggagaaaaaggaggugcuaagaaaggaacagucugggaaauaaauuagcaagaaagaauaauggggaugaugguacugacaugugauccaagggaauuauucuauaccagcuucucuuuguauuaccauccuguccuauuucagauuuucauuaauaccuaauuuaguaaauguugcucucaagucagccucacugguguuaauguaagaacugugucuugaacuuuuuuuauuucuauaguacuuacuugugguaucuugcuuaugccauucaauauuuuuuuugaauugauugauguuuuuaauagcucuuauccacuuacaggccuuucaaaacaauauucuauuuucucucucuaauagcugcugcaugacccugucaucugguaccagcucaguaaccacaauggcauacuaauuagguuucucuuugaggucacaucaucucagaagauggaucagagugugguggggacuagaguagggaauaagagauauuaaaacucagauucauucagcaaauauuuugugagaaccuaucagggcuucuagcauuuuugaguugagggaaagggaugacuaaauggugucauggaggaaaggguuugagcugagcuuuagcuguaggguagaaucccaagaggcagagaugaaaggggguauuuuagaucaggcgacagccugagcagagcaagagggugugggacuugagggaaauaggaguaagggggugugacauaaucagaaccgugcuuugggaagauuacccuggcagagguguagucugcauuagagguggaugcugguacacugacuaggaaugacaugguugucauagcucaggaaagaggcaauaacagcccuaacuggaauggugguuaugaagauggaaggagggagaaauggguagaagagauugugauaauaagaccuguagaaggaggcagcugauagaauaugggggcagagggaagaaucugugguuuaagaguguugauaacuagugcuggcuuuuaccuguuauuucugugucuguuuuuccaccuauaaaauaggaauuuaaacaucuuuauuuucuuugugggagugcuaugaggauuugggcauaaauugagauauuaguugugaaaauacuuugggaaaugauuaugccaaaaaucucccaagauauuuauuuuuacagaaauccugauuuuauuguauaagcaaauuuuuaccuucccauuuauuucuauuauaaaacagagguacauuuuaccuccuucuccagaucucuaauuuggaauguuggcuuuuuuuauuuuuuauuuuuauuuuuugaaacaagaguuucacucuuguugcccaggcuggagugcgauggcgcaaucucagcucacugcaaccuccgccucccagguucaagugauucuccugccucagccuccugaguagcugggauuacaggcaugcaccaccacaccuggcuaauuuuguauuuuuaguagagacgggguuucuccauguuggucaggcuggucuugaacucccgaccucaagugauccucccaccuuggccucccaaagugcugggauuacaggggugagccaccgcgcccggcccucauuuauuuuuuauuuuuuuugaaacagagucucacucuguugcccaggcuggagugcagugguacgaucucagcucacuacaacuucugccucccagguucaagcaauuuuccugccccagccuccugaguagcugggauuucaggugucugccaccauuccuggcuaauuuuuguauuuuuauuuuuauuuauuuauuuauuuuuuuuauuuuuuugagauggaguuucacucuucuuacccaggcuggagugcaauggcacaaucguggcuuaccgcaaccucugccucccagguucaagugauucuccugccucagccucccgaguagcugggauuacaggcaugugccaccacgccuggcuaauuuuuuuguauuuuuaguagagacgggaucucaccauguuagccaggauggucucaaucuccugaccucgugaaccacccgccucagccucccaaagugcugggauuacaggcgugagccaccgcgccuggcaauuuuuguauuuuuaguagagacaggguuucaccacguuggccaggcugauauugaacucccgaccucaggugauccaaccgccuuggccucccaaagugcugggauuacaggugugaaccaccaugcucagccuaguuuuuauuuuuuuggagacaaggucucgcucuguugcccaggcuggaguacaguggugaaaucauagcuuacugcagcguugaacuccugggcucaagcaauccuccuaccucagccuccagaguagcugggacuauaggcucaugccacuacaccagcuaauuuuuuuuuuuuuuuuuuuuuuuuuugagacggagucucgcucugucgcccaggcuggaguacaguggcacgaucucggcucacugccagcuccgccucccagauucacgccauucucuugccucagccucccaaguagcugggacuauaggcgcccgccaccacgcucagcuaauuuuuguauuuuuaguagagacgggguuucaccguguuagucaggauggucucgaucuccugaccucaugauccuccugccucguccucccaaagugcuggauuuauaggcaugagccaccaugcccggcccacaccggcuaauuuuuauauuuauuuugauuauuuuauuuugaauuuuuauuauuuauuuugucucccaaacuacuauaaacacuacuuuuguuuuaauucuauuuuuuguagagacaaggucuugccauguuuccugggcuggucuugaacuccugggcucaagcgguccucccaccucggccucccaaagugcuggaauuacaggugugagcuaccgcaccugggcaaauguuggcuuuugaggaacuaaagugacccuguguuuuuuagacacuagaaucagguuugugcauccaccccagugucuguccucuuuuuucuuuuuuuuuuuuuuuuuuugagacagucucacucugucgcccagguuggagugcaguugugugaucucagcucacugcacccuccgucucguggguucaagugauccuccugccucagccucccaaguagcugggauuacaggcgcaugccaccaagccuggcuaguuuuuguauuuuuaguagcgauguuucaccauguuggccaggcuggucuugaacuccugaccucaagugauccaccugccuuggcccaccagagugcuggcauuacaggcgugagccucugugcccagccuguacucuucuuagauccuuaggaauuccccacaugcccaaguaucccuugacuccuuacucuugccuuucaucauuaacuucauuccucuuucucuuuuuuguauucauuuuuuuuuugagacagaauuuuucgcucuuuguugcccaggcuggagugcaauggcgagaucucggcucacugcaaccuccaccucccggguucaagugauucuccugucucagccucccgaguagcuggaauuacaggcaugugccaacacgccuggcuaauuuuguauuuuuaguagaggugggguuucuccauauuggucaggcuggucucgaacucccgaccucagaugauccaccuguccuggccucccaaagugcugggauuacaagcgugagccacggugucuggccuguauuguuuuuuaaaaagcuaaguccgggccgggcaaaguggcucacaccuguaaucccagcauuuugggaggccaaggcagguggaucacuuggucaggaguucaagaccagucugaccaacauggugaaaccccgucucuacuaaaaauacaaaaaguuagccgggcgugguagcauucaccuguaaucccaguuacuugggaggcugaggaaugagaauugcuugaacccaggagguggagguuguggucagccaagaucaugucauugcacuacagccugggcaacagagugagacuccaucucuuaaaaaagaaaaaaaaaaaaaaguuaaaaaaagagagcuaaguccaaguuacaggaagaucagaaugaaaguuaauauuuuaaaaaagaugacuuuaauagcauauuuuguugucuuguuuucuccaguccacacaguuuuuauguucuauuuuuaauuuuucauaagcugccugagcuuuuuaaaaaaaaucauugguguauaaauuaggaauaaguauaauuuaacauuuaucaggugccuguugugugccagugacauacuagguuugugcuacacuaugcauaguaggaaauaaugaaguauauaugacauauugccugucuucaagaagauuaugguauuuuaguuucagagacaggauuuuuuucucaugaaacagaagauaguacaaguaucaaaauauaugcuuuuggguaaucuagaaaaauuuaguguguagcaaacugauuaggaaaagauucacagaccagaugggacuugguaaauggguauguaauagguagggcauuccauuuggagugcauagcuuggucacaagugagaaggcaggaaugccucuguucugggggcagggacagacugguuuagcuagagggguauuuauugcauaguggugggagguaaguuugauuaaacugguaagguggucuuggaugcugguaaauuuaauuugaacagcggcuuuucauucauucauuuguucaacagauuauuucaagugucuacugugugcuaggcagguuacaacacuggagauaaaagagcaaaggagacauagggucuuugucuuuaagaagcuuagagaggguaguagggaaggcaaauggaagagccuguucaaaggccuccgggaguaaauggaaaaaaaaaaucaggauuucuggacccacuuaaauuugcuugcugagcuaugaaccaaauccugauuuuuaaauuuuaaauaaaucaaagaucacccucaauuuguuuugaggaaauuucccuucucuuuccuccuuuuugauaggggcacuucauaguuuaggguguacguaacuuuuuaaaggagguacuguaauuugaauuuuauaaaucuuuuuuuuuuuuuuuuuuuuugagacagcaucucacucuguugcccaggcuggagugcaguggcacgaucucagcucacugcgacuucugccuccucgaguagcugggauuacaggcgcacaccaccacacccagcuaauuuuuguguuaguagagacaggguuucaccauguuggccaggcuggccuugaacuacugaccucaagugaucugccugccuuagccuccccaaaugcugggauuacaggcaugagccaccgugcccggccugaauuuuauaaagcuuuuaaugugcacuucauggcaggcugguaccaagcugaauugugauucaccaacugaccaaaacagugccaugauuauuggucuucaacaucaaaauuguuucugaucuauggcccaaaaugccuucugacccaaucccagcaaacuuugcucauagcagaauuguacauaaaaauaguaucuuucggccgggcaugguggcuuaugccuauaauccuagcacuuugggaggcugaggcaggucaaucacuugaggucaggaguuugagaccagccuagccaacguggugaaaccccaucucuaguuaaaauacaaaaauuagccaggugugauggcacacgccuguagucccaguuacucaggaagcugaggcaggagaguugcuugaaccugggaggcggagguugcggugagccaagauugugcuacugcacuccagucugggugacagaggaagacugucucaaaagugaaaaguaggcugggcacaguggcuaacaccuguaauccuagcacuuuuggaggccaaggcaggugaaucaccugagguuaggaguuugagaccagccuggccaacauggugaaaccccgucucuacuacaaauacaaaaauuaacugggcauggugacacacaccuguaaucccagcuacucaggaggcugaggcaggagaauugcuugaaccugggaggcggagauugcagugagccaagauugcgccauugcacuucugccugggcaacaagagugaaacucugucucaaaaaaaaaaaaaguaauaucuuuuuuuuuuuuuuuuuuuuuuuuucacauuucucaccugcacacacaaaaaguaauauauuaaucagguauguaaauguucugcuuugggucugacuuaaacuaagcugaagcaguaauuuaauaaaaggaguauccuaaagaacaaacaaaccagcaaaauuaggucagaugaaaaucuuuuuauucucaaaauuguuuuucaguucgguaaauauuuugaguguguaugcauacgguauuuaguuugcaaacauauauguuuuuuucuuuaagcuaaaaaaaaaaacccacaaaaaaguaguauguuccagacuaacccagcauauuauuucuuaaaacuauuugaauuguaauauuuuuuuaauuguugauauccgcauuguuuaagauaacuaggucauaauaaccuauuuugcugaaauuugugguuuguaaaaacuaaaguuuccuuauuacuugguuuuucuggaacaaauugguauccugauuuguaaguuugauauuuggucaaaugauuaaaauuguuuaaaaaggacuauguauuguuucuaugcuuuuagguuaaauucauaggggaaaagugcccuuacuaccuaagaaucugcuagcugugugugaauuuggccuaguuucaguuuuaacuggguuaguuugaccagcagcagauguacaccuugagaccuucuuccuugauguugguggagagugauccuuagagauagacggagguuaacuagaaaauuguaaggcacuuuugcaaauacauugcagaacagcuuugccaauagcaggagauaagaaugaaugccaacaggguuaucuucuuccuuugagaugcugccuuggaagugauguucucuuugcagacauuugaagagacuucacauucugcuaucagggauguuccaaaagcuaguuugaucuucucuuccuguuuuuuuuuuuuucaacuggaauguuuacauacccuucagggcaguguuaaacagcaaaagcaaauuggcuuuuuacuuucaaaucaauauuuguauaauuauauagccaaauggaauuguaggucuagacaucuguaauauuaaucuacaucuacuggagcauauuacagcaguuacauuugaauuugcuguuuaacaucucucuggugcagcaaugcgugacuguaaaggaaacuguuuuuguuuuauagcuguaacuguccuggugcaugacagcugccccaaagguaucccccuuugauugccuucuguucaggagcuuucaguguuaguguuacaucuggagccaggugacuaaugaguuacauauuccauagcagaugccacuggcuaagccaaaaguaaguggccuauugaauaggaauugcuacccacaaaguucucaucagagugacaaacauauccaggaucugcuccuaguuauuuucagcuggauuugcccauaguucagcugguuccuuaauuaugaauuucaaauaaagcuaaccguaggacucauuuauuagagcaguuauacucuguuuggugcuugaauuauuaaagauucccccuuuccucagaauuuauccaguuggcgaaggacuuugaggauuuccguaaaaaguggcagaggacugaccaugagcuggggaaauacaaggaucuuuugaugaaagcagagacugagcgaagugcucuggauguuaagcugaagcaugcacguaaucagguggauguagagaucaaacggagacagagagcugaggcugacugcgaaaagcugguguguauuguuuuccgugcuagaacagugaugaugcaggagggggaaggcauugucugacaguuuccacuugccaaauauaccuaguuucuucuuccacauuaaagaacugaaagugaccuguucuuuaacagcuugcccaugauuagagcugaaauugcagacuaggaaucuuguucuucauaauuugaaauuuaaauguuuuugucacuuagacuugaaacuuacuuaacagacagauuucaaaugagaacuuaaagaauuagaggaaaagggagggagggagauccuaacguacuugaucugucacaaguuauuggccauccuucauuguuuauuuuaagugcuacccggaauauccauccuuacaugaguagcugguacuuugucauacauacaggcaagacaacugugacucuucuuuucaucaccccucucuaauucaggguaaaaggcuagauguauucaaccaguugagcaaugugacugacacagaacacuaucauuuugaugugccaggaugggucauaaugcaaaggaaagccuuuacugggagggacuaauccaucuugguauacaguguuagaugccucaguaaacucaaauugucugguuccagugcauuauagcuuuguauccauuuuaaugcauuuugcuccacuacuuugagagguggguggcugcuuugauccguagaagccaauauuuguccugauaaaaugacacuaaaguguuuuugcuaugugaaaucuauuuugggacucucauuuugcauuauucuccucuuggauuagcagguuaauccaaaagucuuguagcagaaacuucgcuguucuagauguaguucauuuuaccagucagaaaucagagacacaaucuggguuugaugugaauuaauaugcuauugguguagcagccuuccugaagguccauuugcauaaugcugcauuuuaaugucuucuggucugccugucccauaaacuugaggugaagcuuucuccccuggcuaguuaugauguuuuacuuugcuuuggucuguaggaacgacagauucagcugauucgagagaugcucaugugugacacaucuggcagcauucaacuaagcgaggagcaaaaaucagcucuggcuuuucucaacagaggccaaccauccagcagcaaugcugggaacaaaagguggaggaacugcaucuguuguuauccuaucacaagcaacacaggcugucagauauucuuguuaucugaauucuuaaauauacuucuucuagaaugugugcugaaaaaagcagaaaaagauuuuguggggagaguagguggggaauaaaggcacagggaugucccuguauauuuuauuuuauuuuauuuuuaaaucuuuccuaaggauguuguuucaccauggauacaauuuugauguuggugcuaaauugcacaucaauaacuaauccugugcauugcuaagaaacccaaaggugaaaguggcaguucagcaauacuuucaguguuuacucuccagagagcucuuacagcucuucugguuuagaaaggccucugugagccaagaccagacaauaauuuugguuccacugcaccacuguuuaaaauagucucaaccaggcuuugaauuuaacauccccaguacaauauguagggaaaggucagcuauuuauuuuguugccugguuguuuuauggggaaucuuuauaacuaagaagauguacaggcuuaauuucuuaaaaagucaguguuggguaauacucuuguuuguagaaaccagcacaguugggaucaaauuaaacuucauucccuugauuuugugaauuuggaguagccuguaauacaaacucgguagagaauagcacccauaacccugacuaacuuucaacugcccuuauaaggucuuugcugaaaaagcaacuguguugcaccuguacucaugcacacacacuccuccguggaaaccauacaaaguagccuaccacaggguuugagauuguaauugucucuauagugaagauuuugcuaugaaauuaacugauguuaccugaccaguaggacuuguucugaauguuggugaauuuuacauuccacagucuaccaugucuaacguuguauuguuucacugaucuagacuaucaaccauugaugaaucugguuccauuuuaucagauaucagcuuugacaagacugaugaaucacugguaauaaacauuugaucucugagaauuaccuacuuuucuuaccucugcuuccccaggaauaucucuccugucuucucuucugaacauccuauauuacuauuuuauuaguugauguguuauagauucugagcuagcaauuuaaaauauaaauccacaugagcuauaagaggcuggcuuauauauuaguuucugaagugagaauauauaauucagaauuuggcauaaguugaguucauuuaauagaucucugugugccacauguacuaacugauuauauuuugacuuauuaaagccccagcuaauaauaaaaauauuagcaagacuguaugucgucaggguuuauuugcugcucuuaaauagacuugugccuuauuucugaauuaguuugguucuuggggaaagcauagucauacuucacaauuagaaggaaaccaagguccugggauuucagccagaaaagugugauuagaguuucuaggcacuauauaaugcuuucaucaacaaugguuaacauguuaaacuauuuguugcccugcuuuuauggggcggcacacuucuuuuaacuuacagugaugcuucugcauaaaaggucaucuccugauacagucuuugauauaguucauugauuugugcaucuuuucuguuacuagcugaaaacuagcaaacaaaacaaaucaggaaguuuuuggugacugguuuucugguauagcaaaacaggugacaacuauuuguuacauggcuaggaguuuucuguucagauucaguguuugaccagggaaaauacggccauuuuauagauaaaaauauuaggcaucaccuuucucaaauagggaaugauauaguggaggucuggaauauauaauaaaacuagaucauauuaucaguugauuuuugagcuagaccuaugauacgauauuucuuguaacugaagcugaaucaaacaaccaguaacuaaauuacuggaccaugacuuggggaaguuaaauuuauuuagcuaagcuauuauuugcuguauaccacuguuucuagauacuguuuucagggaugaucaggaguaaggaaaucacagguaacuacuaaaaugaaugcaaauaguuaaaauaggugaauugaaaugagaccacaauaaaagacaaauaguucuucagugguggacacguuuuagggccuaaguuccuaaacuguagaacuuuuuuuuuuuuuuuuuuuuugagacagagucucacucugucacccaggcuagaaugcaguggcgcaaucucagcucacugcaagcuccgccucccggguuuaugccauucuccugccucagccuccagaguagcugggacugcaggcgcccgccaccacgccuggcuaauuuuuuuguauuuuuuuaguagagacgggguuucaccguguuagccaggauggucucgauauccugaccucaugauccgcccaccuuggccucucaaagugcugggauuacaggcaugagccaucgccuggcaacuguggaacuugugaaguggcaauauuaugcagagcauuugauuagacaguggcaaucccuugggggcaagaaucacaucuaauacaaucaguauagugccuaacauucuguaaguucuaaaacuaauuacaaaaauaaucagaaauaaaggaucagccacuggaaauauggcagaauuugauucuuuaaccucuucuugccucugugguauugauuccugauuuuauuauaauagcuucaauuuuucaaagaaagcacauuaacuuacuauagcucuauagcuacaacacuugagaccuucccuucucuaacccuccccgaauuguacguuagguagccugacugaagaagccuuuaaaguucucuguaaauuuauuugcacaggguuuagggauggccuaaccaaaaaaagaaauuaauacaguguaauugucaacaggauugggacucuucuuuggugaagacuuucaaacugaagaagagagaaaagaggguauguaugauuuguuuagucuuuuuuuaaaacaaaguaauaauggaguuauuuuuggaaauuuugccaugauacugcauuccugucauguugcucuagccauuguuaagcacauacuacagaugaauucaugcuguggggacaguauugauauucuuuuuuuuuuuuuuuuuucuuuuuuuugagacggaguuuugcucauuucccaggcuggagugcaauggcgcgaucucggcugaacgcaacguccgccucccggguucaagcaauucuccugcgucggccucccaagcagcugggauacaggugccugccaccaugccuggcuaauuuuuguauuuuuaguagaaacgggguuucaccauguuggccaggcuggucuugaacuccugaccucaggugauccaccugccucggccucccaaagugcugggauuacaggcgugagccacugcucccaaccaguacugguacucuuugaaguaguaacuuaggacagaauccuguccauuucacuguuuaggcugcauuucaauucauucauacaguggaaaaggauaaacuuaaguuuguuuugaauugucauaugaauuuuuacacagaacuuuugugcucuaauauaagcuucauauaaugggauauauagagaucuaucuguguaugcuuguuuaggguacuuaauguguuuccaagacuucauguccuuaguuaggauuacagcuguacuuuuucugguggugucaucuaaauuucuccauagcuugcucauuuuuucuagggcacugagagcauuuuuguacaacauauucuuuugaaacagcuuauucuucauguggaaauaggcaaagagagagagagagagaacacauuguuuguuauuuacuguagcccuaauccccaggaccuguauccaaguuguuugauggaauaauuuuaucuucugugcuucagaucugcuuggcauuaaaguuacgggucuuugucuccuuucuagcgcucuacuagccgacaguuuguugauggucccccuggaccuguaaagaaaacucguuccauuggcucugcaguagaccagguaagaauagucaggccaagguaacagagauuacuggccccaagcauuaaaacuucucugagucagcauugcagcauuguuuugagagacaugauguuuaguuaaaguuuuuguuuguuuuuugagacagaguuuuguucuuguagcccaggcuggagugcaauggcaccaucuuggcucacuguaaccuccaccuuccagguucaagugauucucuugucucagccucccacguagcugggauuacaggcgcaugccaccacgucuggcuaauuuuuguauuuuuaguagagacaggguuucaucauauuggucaggcuggucucgaacuccugaccaggugaucuaccugccucagccucccaaagugcugggauuacaggcgugagccuccgugccuggccuuugguuaaaguuuuucuaugcaguaggauccuuaucccuaugaauggaauuacucugauguaguaaacaacugucagagugagucuuaguugcuugaauauauacccccaugaccuauguuuaucuucuuagguacgagauuucuuuauuuuuacuuuuuaaaguagagggggagucucuccuugcugcccaggaugacucgaacugcggggcucaagugaucuucccaccuuggccucccaaaaugcugggauugcaggcaugagccacugcacccagccaaacaucagauuucaacauaagaauguuucaggucaggcgugguggcucacgccuguaaucccugcacuuugggaggccuaggcagguggaugaucaccugaggucaggaguucgagaccagccuggucaacauggcgaaaucccgucucuacuaaaaauacaaaaaucagucggccaggcgcgguggcucacgccuguaauccuagcacuuugggaggcugaggcggguggaucacgaggucaggagauugagaccauccuggcuaacacagugaaaccccaucucuacuaaaaauacaaaaaauuagcugggcaugguggcagacgccuguagucccagcuacucgggaggcugaggcaggagaauggcgugaacccgggagguggagcuugcagucagccgauauugggccacuguacuccagcgugggcgacacagcgagacuccgucucaaaaaaaaaaaaaucagucaggugugguggcgcaugcuuguaaucccagcuacucagaaggcugaggcaggagaaugccuugaaccugggaggcggagguugcagugagccgagaucacgccacuguucuccagccugggcgguagagugaaaaacucugucucaaaaaaaaaguaucagacuggggucuuaagucuugacuaagacuaaggaauuuuuuaccugcuccaaaauacccuauaguggaggguaaguuagauucuuuguuugucuuuccucauuacuacuuuuguugcaggggaaugaauccauaguugcaaaaacuacagugacuguucccaaugauggcgggcccaucgaagcuguguccacuauugagacugugccauauuggaccaggagccgaaggaaaacagguccauugaauuugugacuaaacuggccuguguaaaacaacuagcaaaauuuuggagaguugguuucuuagaacccucuggaggcggggauuggauguauuggguaguuucuuacugcugcauaccgaggaccagagaacugcuugugucaugcuuuaccuuugaauugcuagcccacuggcauaacuuuaguuuuucuugaaacuguuuuuuuacauagccauuaguucucacuuuuggcuaugauaacagauuacuguuuaucucccaguuaaaauuggagcuaaaauuuagaaggagcaaaauacuuaagacacaaagcuuaaaaguugcuuguuuucuagguacuuuacaaccuuggaacagugacuccacccugaacagcaggcagcuggagccaagaacugagacagacagugugggcacgccacagaguaauggagggaugcgccugcaugacuuuguuucuaagacgguaaaucugugauuguuguuuguguuuuaauuuuuuaauugugaaaguaauaaauaccaggaauaaaguuaaauacuuuaguguuauaaaguuaaaugucaaauuuccuuccucauuccaauuuuacucuccagaaguaacuauugguuacagagguaaguuucuuuccauucugugaguaauacuaaauuaaagagaccaacuuuucugaagcaauuguuaguacuuuuuuuuuuuuaauuugagacagagucuuacucugucacccaggcuggagugcagggguguaaucauagcucacuguagccuuaaccucccagucucaagcaauccuccugccucagccuccugaguaguagggauacagaugugugccaccacgcccggcuaauuuuuaaauuuuuuguagagacuuggucuugcuauguugcucaggcugguccugaacuccugggcucaagugcucccccugccucagcucccaaaguccugggauuacaggcaugagcuacugugccuggcccauuguuaguacuuuuuagugacacauguuuacauuuuuucuugaauauaucaccuaagauuuucaaaauguuuugcuuuuguaccauuuuauuuccuuauaaaaauccaagcaaauuaacugaggcucagaggaguuaacugacauuuuugagccacaugauaguaagugacagauuucacauccagguuuucuuuuuuucuuuuuuuuucuugagacagagucucacucuguugcccaggcuggagugcaguggugcgauuucggcucacugcaaccucugccucccggguucaagcaauccuccugccucagccucccgaguagcugggauuacaggugcccaccaccaugcccggccaauuuuuuguacuuuuaguagagaugggguuucaccauguuggccaggcuggucucaaacuacugaccucaggugauccucccgccucagccucccaaagugcugggauuacaggcgugagccaccaugcccugccaacauccaaguuuucugcucuuuguaaacaaguucuuuccacuaucacacacugcugccuuccagugggaugaccuuaaacaaguuacuuaaacucucuuugcuucuguuuccucaucuuaaaaugaagaaaacaaaaccuauuuuaugggauuacugugagaauuacauauguaaauaugucuaaagggcuuagaaaauuuuuuggcacauacuaagugcucaauaaauguuaguugauuauggcugggcacaguggcucacgccuguaaucccagcacuuagggagacugacgcaggcagaucaccugaggucgggaguucgagaccagccugaccaacauggagaaaccccgucucuacuaacaauauaaaaauuagccgggcgugguggcgcaugccuguaaucccagcuacuugggaggcugaggcaggagaaucgcuugaacccgggagguggagguugcagugagccaaccucuaccacgccauugcacuccagccugggcaacaagagcgaaacucugucucaaaaaaagacaaaaaaaggccaggcccaguggcucacgccuguaaucccagcacuuugggaggucgaggugggugaaucacaaggucaggaguucgagaccagccuggccaacauggugaaacccugucucuacuaaaaauacgaaaaauuagcugggcguaguggugggcaccuguaaucccaguuacucgggaggcugagacaggagaaucgcuugaaccugggaggcagagguugcagugagcugaaaucacaccacugcacuccagcccaggcgagagagugagauucggucucaaaaaaaaaaaaaaaaaaaaguuaguugauuaugaugauaauuuucuaauucauaucacucuguuccuucugcccuguuuuaucccagguuauuaaaccugaauccuguguuccauguggaaagcggauaaaauuuggcaaauuaucucugaagugucgagacugucguguggucucucauccagaaugucgggaccgcuguccccuucccugcauuccuacccugauaggaacaccugucaagauuggagagguaugacuuaugcaagccgucauuguuuuauggccucuuuauucgccuuucaaaggcuuagugucaguuuuuguucuaaaauuaaucaucucaaauauauuucuuuccacaaauaaugacuagaauuguaagauacuuacuuguagaagaguccuguuuggguuugucugucuaauaccuuucuaaaccaaacuucuuuccccgccccuuuuuccuucuugcucuucccugcuucuccuugccucuucuuccuuccuuccuccccuucaucccauuuuggaaaauuucagacauauauaaaacuagagaaauuaguauaacuaaccccugguucuuaucacuuaacuuccaugauuacuaacuuguguccauuuuuuuuuuuuuuuuuuuuuuuuuuuuuuuuuuuuuuuuagcucuauugccuaggcuggagugcacuggcaggaugucagcucacugcaaccuccgccccccugggcucaagcgauuuucuugccucagccucccaaguaccuggaauuacaggcauguaccaccaccaugcccggcuaauuuuuuuugguuguauuuuuuaguagagaugggguuucaucauguuggccaggguggucucaagcuccugaccucaagugauccgcccaccucagccucucaaagugcugagacuacaggcgugagccaccgcgccuggucauguccauucuuuuuuuaaugucucucuuuuuuuugagacagaguuucccuguuguccaggcuggauugcaguguugcaacuuuggcucacugcagccucugucuccugggcucaagugauucucaugccucagccucccaaguugcugggacuacagccaugugccaccaugcucaacuaauuuuuuuguauuuuuaguagagacgggguuuugccauguuggccaggcuggucuugaacuccugaccucaagugauccgccugccucggccuccuaaaguguugggauucuaggugugagccauggcacccagccuuuaugucuguucuugauuuaucaauacugucguugccuccuccugacucuguccaaugaauuacuuggaagcaaaucucagcuaucauauaauuuuaucugugauaaaauuaucuuuuauucuugcucuuauguuagacauacuucauaauagguuaucaaaaugaaguugcuuauuuccaaauauuuaaccaguuuaauccaaacugauuaaauccauuaagaaauuauuuauugcugagugugguagcucaugccuguaaucccagcacuuugggaggcugaggcaggaaaaucacuugagcccaagaguuugagaccagccuggacaacaaagcaagacuccaucucuacaaagaauaaauaaauaaguuagccagguuaguggugugcgccuguguuuguagcuccucaggaggcuagguuggacuauugcuugagguggggagguugaaacugcagugagcugugaucacaccacugcacuccagccuggggaauagagcaagacccuaucucaaaaaaaaaaaaaauuauuauguaaguaacauuagcaagaaucaaaaugacuaucuuccuaccuacucuucagcaaaucaaauauuauuuuccccugaucuuacaaguucuuauccaugccuguacauuuuguuuuguuuuguuuuguuuuguuuuguuuuugagagggaguuuuguucuuguugcccaggcuggagugcaauggcgcaaucucgacucaccacaaccuccaccuccuggguucaagcgauucuccugccucagccucccucauagcugggauuacaggcaugcgccaccaugccuggcuaauuuuguauuuuuaguagagacaggguuucuccauguuagucaggcaggucucgaacuccugaccucaggugauccgcccaccucggccuccuacagugcugggauuacaggcgugagcuaccgcaccuggccgccuguacauuuuuuuuacacauguucuguacucuaauauagaaccauggaguucuccccuacagguagguuugugucauaaucaacugauaagauauguuaaauaauuuuuuuuacugagaauaaugaaaguauacacaauuuuuuucucuuguuccagcuuucuucuguuagaaaaaaaaaucuguuuagaguaauaaauuauuuuauauuaaaggcuauaccuguaaccucauuauugcuuguuuucugcuguccuugaguggaugagaaggagguaauuauagcugguggucuuauuccuuguucacauaacagugugguguauauaugaaaaagaaaaagugugguauauaugauaauaaaucaguccugguguggagguaggaaaaauaauugagagucucuguuuuaauauaugcuuugggaauaggaauguaaaaguagacaugaugucccaguuugagaauaagauuggaggugguucuucgcauguggucuucaucuguuggucuacauggcguaaauaauaauuuaaagcucuuuuuuuuuuccagggaaugcuggcagacuuugugucccagacuucuccaaugauccccuccauuguugugcauuguguaaaugagauugagcaaagaggucugacugagguaagagucaacuguaggagauggugaauuuguuauuuguguuaauucggagguuuuuaaauaaaaaugucaucuugauaauagacaggccuguauaggaucucuggcugugaccgcacaguaaaagagcugaaagagaaauuccucagagugaaaacuguaccccuccucagcaaaguggaugauauccaugcuaucuguagccuucuaaaagacuuucuucgaaaccucaaagaaccucuucugaccuuucgccuuaacagagccuuuauggaagcagcagguaagggcagauguaauacuugaauaugaauuccuccacggcaguaguuuuucuuacucucuuuauuuuuuuauuuauuuuuuauuuuuuagacagagucucacucucgcccaggcugaagucaguggcgcaaucucagcucacugcaaccuccgucucccagguugaagcgauucuccugccucagccuccugaguagcuaggauuacaggcgugugccaccaugccugguuaauguuuucuaucuuuaguagagaugggguuucaccauguuagccaggauggucucgaucuccugcccugugauuugccugccucggccucccaaagugcugcgauuacaggcgugagccaccgugcccagccucuuuuuuuuuuuuuuuuaagacggagucuuucucugucgcccaggcuggagugcaguggcgcuaucggcucacugcaaacuccgccuccuggguucaagcgauucuccugccucagccuccugaguagcugagauuacaggcguuaacgguguuauaccauguuagccaggcuggucucaaacuccugaccucaggugaucuacccaccuuguccucccaaagugcugggauuacaggcaugagccaccacaccuggccaccuuccucuuuuuauuagcuccugccuaguacaaugccugaaacauaguaggugcucaaguaguuugauggaugaguaacuguaugcgugucacccuugccuauccucuugcuuucucauuacguuauuguguacaguguucuuccuuucuuuccuuccucuccaguuagguuggagcuuuuucaauucuuagaauauaccaaguuuacucccuaccuuaaggccuucacauuuguugucucaaccugaaugcucuuacauuagauacaguaugguuugcuccuuuauuucuuucauauuucucuucauauaccuuguccccagaaacaccuuuccugacaaccuugucuagauuaacagcucucauuucuuucuagcuucuugccugccuuguuuucuucauuuauguaucacucuaccugauagguauuugcuuuuugacugacuccaccaauagaauguagguuccauaagauaagggcuuuguuuacuucugcuuuauccucagcacuuguaccuggcacaucguaggcccuuaaauaugucucaugaaugaauaccuucuugguaauuguagucacugcaauuguaugccugucugccuagcacaucaguugccaacugcuuucccuaacugcaaaggccgauuuuuuaaaaguuuugacuucuaauauugagcuguuggccaguauccugcuuguuaaugaaacuagagucugauguagucaugaacuaaucaggaguuucagaagcuuacuguauagaugagacuuuguggucgauaacuuggaagcccgcugucaagggaaagaagucuaggccucuuggugcuuucuuuucaauuacagaaaucacagaugaagacaacagcauagcugccauguaccaagcuguuggugaacugccccaggccaacagggacacauuagcuuuccucaugauucacuugcagaggugaguacagcagaaacuuguucugggaguuagggaauuuuuuuccaaggggaagauaauguggguugaguguuugggaguaugagggaugaauuguuuucuuauagaauuuauauuuuggucugcauuuaagcaaggagcaagacuucuaauuuaauauucuuuugcuuagaguggcucagaguccacauacuaaaauggauguugccaaucuggcuaaagucuuuggcccuacaauaguggcccaugcugugcccaauccagacccagugacaauguuacaggacaucaagcgucaacccaagguaggcaggugcguguguguguguaugugaacuuguguaaugugauaacuugaaagacaguugagaagcccugagcuuuggaaguuugcuaacagauuugcuggcuuuuaggugguugagcgccugcuuuccuugccucuggaguauuggagucaguucaugaugguggagcaagagaacauugacccccuacaugucauugaaaacucaaaugccuuuucaacaccacagacaccagauauuaaagguaaggcccaagaugugcuucuucagggacuugacucucucuuuaguuuuagucauaugaccucuuccugccuuugcuagagcuguuugaaaauucuaacauuaaaggaaaauuuguauaauucuaccaucguaauuuuuuuuugcuuuuccauguucuccuuucuuuauccauauggauauauguuuuuuaaauauagauauaauaggcugggcaugguggcucacaccuguagucccagcacuuugggagggaggcugaggcggacggaucacaaggucaggggauugagaccauucuggccaacauggugaaaccccaucucuacuaaaaauacaaaaauuagcugggugugguggcgcaugccuguaaucccagcuaccagggcggcugaggcacaaggaauugcuggaacccaggaggcggaauuugcagugagcugagaucccgccacugcacuccagccuggugacagagugagacucugucuaaaaaaaaaaaaaaaaaaaaaaaaaaaauauauauauauauauauauauaauaguuuaaauauaauucauucuuauuucacuuagcauguugugagaacuuuuucucauguauaaucuuauuuaucauuuacuuaaauguucuaguagguauuaacauuauuuuucaauuuuucauaauuacaaguaaugcuauagucaauauagcauuucucuuaaugauaaauuccuaagagugggaucacugaauuaaauggcuugaacauuuuuaugugucuugguauguuuuaccaacuugauuuauuaaauuucuuauaggcuuuugccaauuuauauugcuaaccaacaauuuuauaugaauaggcugguuucacuccagucucacuggcauuggagacccauucuuucauuauugcaaguuccuucuaagggagcauauugcuucuucuaguauagcuaaaagucagauguuuagauguuagauuugugaaguguggaguuagagaauggccuaaaucaggacgugucagcuauucauugaguucaaaagauacacuaguguguuacagaaugaugacaaaaaugaucucugggacuuugcuagaugucuaaccuuagcucuuaagugcuucagaggguaaucagcuuaaaacuagccaucuaaaaagaugccuucuuuuuucccaccucucuuaaaaauaugucugaacuuugaagugaguuuacugggaccugugaccacuccugaacaucagcuucucaagacuccuucaucuaguucccugucacagagaguccguuccacccucaccaagaacacuccuagguaugcagaauuggccuuccuaggaaauaaaaaacaacuacuuucuuagacuucuuauuauauugaagcuuauugaaagaaaaauugcauucgauuuuagcuagcaacuagacuuuaaaagggaacguggggcuauaaggauuccuucuuuaaaaagguucugaaagucuuuacuauuuccccucucucguuguuggugacuaagaauacuuaagcaacuauugcaaaauaguugucuaggguuuccuacuuauaauggguuauaucaaguaauauuauaguuguuuauucaaccauuuuuuauagaauauuuuuccaguucauucucuuuuuauuguagauuugggagcaaaagcaagucugccacuaaccuaggacgacaaggcaacuuuuuugcuucuccaaugcucaagugaagucacaucugccuguuacuucccagcauugacugacuauaagaaaggacacaucuguacucugcucugcagccuccuguacucauuacuacuuuuagcauucuccaggcuuuuacucaaguuuaauugugcaugaggguuuuauuaaaacuauauauaucuccccuuccuucuccucaagucacauaauaucagcacuuugugcuggucauuguugggagcuuuuagaugagacaucuuuccagggguagaaggguuaguauggaauugguugugauucuuuuuggggaaggggguuauuguuccuuuggcuuaaagccaaaugcugcucauagaaugaucuuucucuaguuucauuuagaacugauuuccgugagacaaugacagaaacccuaccuaucugauaagauuagcuugucucagggugggaagugggagggcagggcaaagaaaggauuagaccagaggauuuaggaugccuccuucuaagaaccagaaguucucauuccccauuaugaacugagcuauaauauggagcuuucauaaaaaugggaugcauugaggacagaacuagugaugggaguaugcguagcuuugauuuggaugauuaggucuuuaauaguguugaguggcacaaccuuguaaaugugaaaguacaacucguauuuaucucugaugugcugcuggcugaacuuuggguucauuuggggucaaagccaguuuuucuuuuaaaauugaauucauucugaugcuuggcccccauacccccaaccuuguccaguggagcccaacuucuaaaggucaauauaucauccuuuggcaucccaacuaacaauaaagaguaggcuauaagggaagauugucaauauuuugugguaagaaaagcuacagucauuuuuucuuugcacuuuggaugcugaaauuuuucccauggaacauagccacaucuagauagaugugagcuuuuucuucuguuaaaauuauucuuaaugucuguaaaaacgauuuucuucuguagaauguuugacuucguauugacccuuaucuguaaaacaccuauuugggauaauauuuggaaaaaaaguaaauagcuuuuucaaaaugaa

SEQ ID NO: 192582 - RNA, 107791 nt, Homo sapiens
uugaaaaguucaaauuuuaauuaaaaucuuuauugaauaaaaauguuucagacuagguaagacuaagaaagcagaauguuuuacaucucuaaaaaauauuaaagcuaaaucucuauaaaugcaguacaaagaaaagccuacagcuuaagacaccucucccucccauccauacaauuuggaauaucaacuguguacaacaaauguacucaaguuuauaauguccccaaaccuuaagacuagaaaaucaucccaagaaaaaggccuauaguugguuuaauuucacccugagaauacugugauaaaaaucaauauauuucagagcuaguaaguauuuaaaaauuagugucucaaaaaggggacaucauaagggaaauacaggguuuagaggucugagcucaagugguguaagacaguucuuucuucuuccuccuuuaaacucuucacuuugcucuaacacggaagaugggggacagugaucccgaagguauuacuaaaauauugcagcuuucaguaauuaugagaagcacagauaucaccagaaaagaaagcaaucauuuggaguacaguaaauucacuggcagauacaaaagcuuauuugggagacagcagaucucucuaagcaccgaagaguguagguugguuuuucaauugccucaaaaagugcucuguuguauuauaccucaggacgucgaguucaggauguaguuuagagagcaggacauaaaguaguaaauuccucauauauaucacagcaagaaaauuaaccuaaaaaauuuaaagacuaaauaaucucuuaacagguaaauacuaaaaaauuaaauugguauucauuuaaaaauauacaaacugugcccuuuauacuaaagugcauucagucguaauguuuaagccccuaaauuccuucuguauguucucuaauuccaaaauaguguguaacaauauacuacuaaucaucugucuaccuuaauauugccuuuugggaauacaguagaaucugggcuauuaucagguggaauauuuccccaguuacaagccuuacagcacuuaugcauaucaucacugcuaaaaugaagaauuuaaguaaaguuaucucuaguauuuagaauguguuuuuuguguuuuuuuguuuuguuuuugauuuuaagaaggaauucuuuuccaaaguuacuuccaaguaaauuacauuucaugcugggauaccugcuuaugugcaucacauuuugacaaagggcaguggcucgcuaacacuaacaugaauuuaaggcccagcaucauugcaauuugucacucuucauccucauccucaucauaauaccgauuucucuuuaucuguucuuccacagagagcucuuugaccacuucucccucccagaguuccacauccugggauuucugauucugaguagugaauucuucagcaaagguguugucuacaaaacucgaccaauucagagacuuggguucuuguggagauuguuguuugaggaagcuguuaucaucuucaucggagucugcaccauuuucuacaagauucucauucuccaucuccaaacuaugaccuuccuuacuucucuucccugucucuccuuuagauucuuuguuuugccagguuguuuuucccacauucccauucuucuuagaagccuuggcauuuuccacuuguuuccuuucugcaacucuuccacccacagacucuucacucugcucugacaugcuccagccuuuccugauagguggggacacaguuuuugggcucuugacagaggugcuuugaaaugaagcugcuacagugaaugggcggcuucuuuccuucagugaagaagaucgucuuagcuucuucagaucuagaucgacauccucaggaacuucgggcuugcugauuucgucuucaggaggccauuugggcuuugacauuuugaucccuuccuccaaggcacuuccugaacuuccaaguucagugggggguggccaggcgauccucagcuucuugguuucagcuggcuugucuuccuucuccugcugagaggaggccuuggcuuccauacuugcagccaggacacccaccuuagcaauaggggcaucuucuaccccugggcugugaggggucucccuugcauuugcaagcugggcuggucucuccaaaaucucuucguuuucauuuuugcuugcccauagauccuuguguggucugugcccaaagccuucaucauaguugcccuuagauuuaaagaguugauugaagugaggcuuacaauagauucuuccauguaaagaugcauauguuccuagacugucauuaaaagaaaaaaagcauaaacuuagcaaaucuucacauucucacuuauaccaggaggcuaaaaucuggcaauuccaguauuuucagaagaugccaaguaagaaaaagaucuuuaaaagcccuucagugaccaggaauuccuuacccccauuuuagcacauuuguuuucuuaucauaacacaaagcacggguugggugcaguggcucaugccuguaaucccagcgcuuugggaggccagggugagaggaucgcuugagcccaggaguuugagaccagcccggccaacauagugagaauucaucucuacaaaaaauuuaaaaauuagcugggugugguggcacaugccuguagucucagcuacuugggaagcugaagugggagaaucacuugaacccgggaggcagagguugcagugagcugagauugugccacugugauagagcgagacugucuuaaaaaaaaaaaaaaagaaaaaaaaaccaacaguaauagaaacuuuaaaucauucugagccuugagaggaauguggcuaugcaaccugggucacacagcauguagcugcaacucuuucuuuucacuauaaauuaugaagaccaaagggcaccagagauaagacccccucagaucacuaucccuucuuugcgagugauaaucuuccuuggaauguaccaaucuguacccaaucaaaucacugugguauaugcacuggucuuauaugaaaaaugucauaaucuuugcuaaaauuucuguguaagugaaacuaacuuucuccacuuuggaaugcugaccccauucauuuggagucaguguuucuggguagccaucaucaagcuuuugugcuugaauuaacucuauucuuaacgguauauaaauacauauauauauauauauuuuuuuuuucuuuuucuuuucuuuuuuugagagaaucucgcucugucgcccaggcuggagugcaguugcacaaucuuggcucacugcaaccuccgccucccaaguuuaagcaauucuccugccucagccuccugaguagcugggauuacaggagugcgccaccacgccuggcuaauuuuuguauuguuuuguuuuguuagagucucgcucugucgccaggcuggagugcaguggcaugaucucagcucacugcaaccucugccuccuggguucaagcgauucuccuaccucagccuccugaguaguugggacuacaggugugugccaccaugcacggcaaauuuuuguauuuuuaguagagacgggguuucaccauguuggccaggauagucucgaucucuugaccucgugaucugcccgccucggccucccaaagggcugggauuacaggcgugagccaccacgcccagccauuuuuguuuuuuuuugagacagagucucgcucugucacccaggcuggagugcagugacacgaucucagcucacugcaagcuccgccucccagguucacgccauucuccugccucagccucccgaguagcugggacuacaggcacucgccaccacaccugacuaauauuuuguauuuuuaguagagacgggguuucaccuuguuagccaggauggucucaaucuccugaccucgugaucugcccaccucggccucccaaagugcugggauuacaggcaugagcaacugcacccagccauuuuuuguuguuuuuuuuuuugaguggaggucuugcucugucacccaggcuggagugcaaugguaugaucauagcucacugcagccuugaccuccagggcucaagugauccuccagccucagucucagccuccccaaauuuuucauagagaugggaucuccggccaggugcagucccagcacuuugggaggccgaggugggcagaucacuugaggucagaaguuugagaccagccugaccaacauggugaaaccccaucucuacuaagaaauacaaaaauuggccaggcgugguugcucacaccuguaaucccagcacuuugggaggccgaggagggcagacugacugaggucaggaguucaagaccagcguggcuaacauggugaaaccucaucucuaugaaaaauacaaaaauuagccaggcauguugcacacgccuguagucccaaccacucgggaggcugaggcaggagaauugcuugaaccugggagguggagguugcagugagcugacaucaucccacugcacuccagccugggcgacagagcaagacuccaucuccggaaaaaaaaaaaaaaagaaagaaauuagcugggcgugguggugcccgccuguaaucccagcuacucaggagacugaggcaugagaaucgcuugaaccugggagacaaagguugcagugagccaggaucacaccacugcacuccagccugggcaacagagugagacuccaucucaaaaagaaaaaccagauggggucucucuauguuacccaggcuagucuugaacuucuggcaucaagugauccuccuaccugggcacucccaaaaugcuaggauuacaggugugauccuuauauccacaccuagauauaagcuugauuaauagaagaauggugaggaguugacaggagguaguuuuucccuaaugucaguccuagacaagccuuuaggagauuuggugucucuugcaggaugauaaguuuuaucuuuuuaaaguuuuuucccuuaaguuacgaaccauucugaagagugacaaauguuaaaggggguauaaaacggcagcacuuccacaaaagaaauaaggugcuuuaagccaggcacaguggcucacaccuauaaucucagcacuuugggaggccgaggcggguggaucacgaggucaggagaucaagaccauccuggcuaacauggugaaaccccuucucuacuaaaaauacaaaaaauuagcugggugugguggcgggcgccuguagucccagcuacuugggaggcugaggcaggagaaucgcuugaacucaggagguagagguugcagugagcugagaucacgccacugcacuccacccugggcaacagagugagacucuguauccaaaaaaaaaaaaaaaaaaaaaggugcuuuggagaaaaaaauuaacacagugggcagcagaagaacuaaugaguggaagugacugagguacacuuuggcugcauguuuggagaagcugucuagcuagagcuaucuaauagcuagaaaugucacacagaugccaaaacaucuuucaagaguauuuuaggaaggauugcucagaaaggaaagcuggagaaagugacaucuugguuacuuccuucuguaagacucuaugauuaaaaugaguuaauuuggaauguuuccccgauuugucacauuuauauuugcacuuugaguuacuuggaagaaaugauauguaacaacuauuuucucagaaauaaagugaggcaacauagagaaaaagacaugcucuccaggggcuauuauuauugccauuauuaucauuuauacagugguuaagacaaguaagggcuuaaacaaguaaccucuugagauuucuuaacuuugugauucugugauaccaagggaaaacauucuauuaaauuaggucacagggggguuuaccugcaacucauauuauuuaagcuucgguccuaacauguaaauuaacauaucaauacaccaagaaguuccaaacaccaucauuauuugguaugaaagacuugucacuaaaugaugcuuuuuacuuuauucaagagccuucaacagaauaucauuagcacaguagcuuuuagcaccagugcucuaaaagccaaagacucccucuagaguuccaguuauagacagauggcuuguuuugggcugacuuaccugaguuuguuguugcaauaggagcaacggaagcagcugaugugaaacaccugcugguuggccaagagacgcuccauuggauagacugucuucugacauuccacgcaggucucucuugcaggugccugaaacuucuaggaaaaacaaaaagacaacuuuagcaugggcagcgaugaguuagcacugucuugagauggacccuagaauuuacuuugucuaagggcucccuuagcuggucagucaauucucauggagcacuaaaccugcuacaauucuaucagcugacucuuuaaagccaagaggcucucuugauauucccuucccaaacuguguggcugcucuaaauguagcagccaccaaggauagguggagcuacgucuggauuacaaagaauggcuuagacaagucacgacccacauaaaaaauguuaggagcaggggaugggggaaggggucgggggggggagugcagggauuaggagaaaauguuaucacacacagaagaaagaaguuugauucaagugccaaguaaacacaagacagauucuaaaggggauaaauuucaaggagaggaagagcauuuggcuuugggaauuaggaaagacauuucaguaaagccccuuuuauucugcucugcuuauaaucuugauuuguucaaucaacuagacauacuauuuuuaaacaagucaaaacugacacacaaguggaacaauuuauaagagacacaaaguauuuuauuaggacaccagagggaagcauagcccauuaaagcuauagguucuauaauauuucuaaaaaccaauggagagaaaaacuaaugcaaugggaaacacacugguuaauguauuaaugacugggaauucaugaacuguuuguaaaguuggaacaaacaugggcacagugguucuaccugauaaacucaauccuaaagaauauaaaacaguugguauucuagcacugauaaaagccagaacuccaaaaauauuauaagcuuucacaugauaagaaauaguuacaugggccaggugcgguggcucaugcuuguaaucccagcacuuuaggaggccgaggugggcggaucaugaggucaggaguucgagaccagccuggccaacauggugaaaccccgucuccaguaaaaauacaaaaauuaggcaggcguagugguacacucguguaaucccaguuacucgggaggcugaggcaggagaauggcgugaacccgggaggcagagcuuguagugagccgagauggcgccacugcacuccagccugggcgacagagugagacuccaucucaaaaaauaaagaaaagaaauaguuacauggcuacuaagggguggggaguagaugggaaugcaaagucccuagguguaugggaguuaacccuugacuugcccaacacaaacaccucaaccaguagaugcgggagacagcuuagguggccaggaagcucucaucagcaauuaggaggugcuuuugcugccaugaucagccugggcucucaccagaaaacacaugaugguaaguaaugcaaauuaaucccaaggcccaggaccuggauaguuaagccugaaaugaaccagguuaugggcaagauagaauuuugaguaaaaaaaauccaaaauaggcuggguguagugucucacgcccauaaucccacacuuugggagguugagguaggcagaucacgaggucaggaguucaagaccagccuggccaacauagugaaaccccaucucuacuaaaaauacaaaaauuagccgggcaugguggcgugugccuauagucccagcuacucgggaggcugaggcaggagaaucgcuugaaccugggaggcagagguugcagugagccgagauugagccacugcacuccagcuugggcaacagagugagacuuggucucaaaaaaaaaaaaaaaaaaaaaaaacccaaaacaggcccauaaaaaauucagacuguugguucacuugccacaugauucacuaggagguaaagcaaaaaauaaaaaugguuuuccaaguagauuugggcaggaagugagagcagaaaaugugcauaaaaugaaaauaaagaaaucuauaaaaggaaguuuaauaaaauuagugguaaacucccaaguagugcccaagggauuuaagaaggaaggaacaaagcugaguggaaauggcuaguuaccaggacucugcuuuauucuaggggcaauguccuaaaaagaaacaucuaaagaaucaaaagaccacagguuacaaccuaguuuagcauaagggagguauuuaaauauaaccaaauguuauuguaaugaauguuguugcaaguaauuaacacauuaucguauuuggaguucagaauucuuuuuuucuuauauggacacugcuaaauggagauaucuuugcagaguuuuaauuaaguuuucucuaaaaggacuaggucuuugucuagguaggagauacacuggccaggugcgauggcccaggccuguaaucccagcacuuugggaggccaaggcagguggaucacuugaggucgaaguuccagagcagccuggccaacauggugaaacccugucucuacagaaaaugcaaacauuagcugggcgugguggcgggcgccuguaauuccagcuaccagagaggcugaggcacaagaaucacuugaacccaggaagcagaaguugcugugagcugagaucucaucacugcccuccagccuuggagacagggcaagacucugucucaaaacaacaacaacaaaaggagagauauuaaaaagcagaauaaauuuuugguguaauaguauaauggaugcuacuggagagagccuguacaaaucacaauucacauaauguaaaaguaggacaaauguauuuaucagauuaaaaaucauuuucaguugcagaaagggaauucugcguuuuuuguuuuuuuuguuuuguuuuguuuuuugagacagagucucacucugucacccagacuggaguacaguggcgcgaucucagcucacugcaagcuccaccuuccggguucaagcgauucuccugccucagccuccugaguagcugggauuacaggcgugcaccaccacacucggcuaauuuuuguauuuuuaguagagaugggguuucaccauguuggucaggcugguuucuaacuccuaaccuugugaucugcccaccuuggccucccaaagugcugggauuacaggugugagccacugcgccuggcccggaauucuguauuuuuuaacacuugaaauagauguaggagaguaagugcucauucuggucaguaaagacacagcaggagacagaaacuucacaugggauaagaggagauggauacuguucugcuaaaggggaacugaaggacgcagagcacuccuccaucacaaacacacggaggggaggcacacacugugggagggggaagcagcccagggaacagaaggaaaggagaaccugugagaaagcugaaaguugagcucacauuaggaggaaaguggaaggcaggagcagaaauuagguaccaggagcaggaggcagaagcuggaagagacaaacaggaaccuucaaugaauacacagcauuuggcgugcccuggagagcuuuacugcagcugagcugaaacucagagacucagauccaagaauaagaccacauuuuucuuuuuuuccuuuuuaaguaacucugcuaaucauggcaaaaucagccucacucguaucuaccugaggcuggaacauaucccagcucaggagagcgagcuuuuaugagccuucacccacacaaggagugucucauuaacaauucuuuaguggcuuacuaccucccacaccugacccacaucggcucucucuuuaauagagccuucacccacauggagcaaaaagucugucuuccuccuuaacaucaaguuaauagauugcuagcucacauaauugacuaaccuugagcuucuaacuagccagaccuaucagagucccauuauuccuauucauuucucacaucaacccuuuucaauauuauuuaagguuuaugcagcagcagcugccuaagggccccuucuaguuucauaaagacaagagggucccgacaugguaaaaugccaacucacagcggcugcggcugugccuccccuuuauuuucuauguccugggcucucagccacuuuucuguaauugcccccaugucuauucagacaacaggaagcauagucagugccuaaaaaucucuaccauuaucacaggccuggcauacauccugcccaugccuucauggcaugcucagacuuggcacagccauguuuaaaacacugccaauacgacaauguuagacauuuuuuaucuucacaguauauuuuuucaguuaguaagagauuuuuuuuuucauuccccuucucccaccauuuugccccuaccaaguagaaaguuaaacaccaggucuuaucaaaguucacauagucaauaacagaaauagaauuaaaacuguaggaaaacagccuguugcauggcaggagugaugccaucuuggagugaaaccaccaugcuaacuggugguuugacuccugcauaccaaggugguuuguucugcagcaaagucuuuaaacaaugccuguagcauagauuaucccucauaaagggguagugcccagagcauagacaaccccucauaaagaugcuuauccaaucgcuccagugauaaguuuugcaagaaagucaagcgugacuagcugcacauguuuuauccuaaaaccuugcuauauaaaggauauuuucuggagggcuggugcagggauccacugucucauggccuccuagacaucacuucuguucauaagcucuuauuaaauguuucuuucugagaaacuggauuugucagccucuuucuuuggcuuuucagcucccucagccuuuguggguaggucugcauagaccugcucacugcacaaacucagaacuccugacucacaaaccaagagagcauuuucuaaauuguccuggaauguuaaauuuccacagccaagggaaacucuuuggggaggagagcagaugcuaacccaaaugaaauuaaucccacgacagcaauuugaacaaacuauggucuucccuuuguuucaaauaaaaauguguagauaauaucuucaggauauucuagagugaaugagguaaucuauaaauaauugauguucauaaauacugucuuucccguuugagggauauuacagacccucuguugauuaccaucuacuuaaagcuguuuuucuaacaaauuugcauggcuucauuuacauucuuuuacccucuugucucauauauuuuuuacucuaauaaaggccccaguuguggugugugugggagguaggggggagcagcugacaacagacauugauguuaacuagccuuuagacauagugaaagaagaugaaaauucuguauugacgucaagccucuauuccucagaauaccacaaaaugccuuucauuccuuccaauuuguguaaaauaucuagguaaugaaacugaaauucuucaccacacagcaaaugguugggccagcccugugcagccuuaacccuuccucuaauuuucugugaaacucuaugaaagcauuuuggggaauauucauaucuuaaauagagugcucuacacagagaagaaaggacaguccucugaaaaggcaguaauagugagugagugagaaaagauucuagacacucuucuagcauaauuuugacagcuuugcaagccagcauaaaaccucccacugugucuucagggggaggaacagcuggcaggguaccgagaggggcagugcagugugugcugcccucucacguagagugccauguucucucucaacauucaucagcaaaacgcugugaggaggccugggacuugguugucccguacacagugagggcagacaguuguucccuagggccagucacaucuccuugccucuuccuucccuauccucuccucugggaacguuuaggggaugauuucuuucaaaugggaggacauaaagccuaagagaucucugagucucuugaaguagaaaggccugauacuucucacaggguccacuaagcucugcucucagaacgacacccuuuuugagaaugaaccuguaacuucauugguaccaagucuuaccaaguaagcucuguggccaguguucaaaguguacagaauccuuaaagaccucuaucauuucuuuuuacuuuauuaagcuaaaauuugaaaugaauugaaucucuaccuuagauguccucuuuucaauaacagacaggcacuaagaaacaguuuuuuccaggaugugugggauccaaaaaucuauucugagugaacaaguuuauucuuagcuguauguaauuucccaaaguggagaaacaacuucuguucauagucugcagccaugagaccaguucugccagcaggucuuccuauaaacauuuacuaaaguaucuguauauuugccugcagacuguaaaggggaacucugaggaagagcaaauaaauugcccuuaaauaacaguggagauguaacuggguuccaccaggcucuguacaccaugaucaucugagcuguggaccagaggcaaacagccaggccaguuuacucuggucauuacacaaugcucaaaacccgaggugugugacuaugcagauagggccgucuacuacuauacuacuauucuacugcugagugaccagugccaaaggaguaggcaugggucugaggcagagacagagacagcuuuaccucuguuuccucucccuggugccaaaggagaccuaagugaggugugcccuuucacacaccacucauccgcucaccccguggaacuugaguggggagggauccccacccaguacaaggaagucuggccaagcaguugaacgagggaugcaagacugcauugagaauucaaauagucacaagaacagauuuuaguuccuguauuuccccagguccuggguuacacagaauccaucaccaaguuagauuugcuagccguucuugauccccaaccacaaccugagcacucacaucuaggcagcauugcugucagagaggaaaguaacccugugggguuugcuacuuugugagacuccagauacugacaaagaaagugcugauggcagcaucagccaaccuucaaggccagaacacagccaugcggagcacauguacagauucaaucaccaugaccccgcccauucuuccuggacuugcuuucucuuucugcuuucuuuaccuuuuguuccuuuucaauaaaccuuacucuucucauaaaucucugccuccuuuaaaauuuucauguuuuaucuuuuucaccuugcucaccuuuuaaauccacucuuuaaauccuggauucuccccuuuccuccuuuuguuccaaacccucccugauguccccuccucuucauacuuugugugcaguaaaacuuuuaucuguggaccaaucaugcucacagucagagguauaagcacggcagauaugagcaugaguugggagcagcacaaaccaccuuaaaacucauucuauuuauugaguuucucucaaaugcuaaaacuuuugaaacacaacccugcuacuuaaaagagcacuagaggagaaagacacuaaagaaguguggguaauccaaacgagugaaguagccccucauuagcaagcuagucaauuaaaacaagucagcuaacaaaccuaaaauaaguuuugcauuuuuaauaaacauuuuuuggcuuauuuuuaugggaauauauauuugcccauagaagaggaaaagacgacuuuuaaaacuuggguaauaaaagcagauuauagauugaggagccuagcucuguugcccaggcuggaguacaguggcgcgaucuuggcucacugcaaccuccaccucccggguucaagcaauucuccugccucagccucccaaguagcugggauuacaggugccugccaucaugcucagcuaauuuuuguauucuuaguagagacaggcuuucaccauguuggccaggcuggucucaaacucuugaccucgugaucugcccgccuuggccucccaaagugcugggauuauaggugugagccaccaugccuggccaauuuuuuuuuuuuuuuuuuuuuuuugagauggaaucucacucugucacacaggcuggagagcaguggugugaucuuggcucacugcaaccucugcuucccggguucaagugauucuccugccucagccucccaaguagcugggacuacaggcacgcacuacugcgcccagcuaauuuuuguauuuuuagagacaggguuucaccauguuggccaggcuggucucgaacuccugaccucgugauccgccugccucggccccccaaagugcugggauuauagcugugagucaccgugccuggccucaauucuuaauaucuaauguuauacccuuaguauaaguguugcuugaaugucauuuuuuuuuuuuuuuuugagacaagaguuucaugcuuguugcccaggcuggagugcaauggcauaaucucgguucaccacaaccucugccucccagguucaagcaauucuccugccucggcuucccaaguagcugggauuacaggcaugugccaccaugcccggcuaauuuuuuuuuuuuuuuuuguacuuuuaguagagaugggguuucuccauguuguucaggcuggucuugaacucccgaccucaggugauccgcccgucucagccucccaaagugcugggauuacaggcgugagccaccacacccggccucauuuuuuuuuuuuuuuuuuuuuuuuuuuuuuuuuuuucagaaaaugggcuggccagcccccauuccaguggacacauucuuucguuaaaaauguuaaugacauuguuguaaacaacagguccuaaaaaaaaaaaaaagugggaacaacagggccagguguguuugguggcucauaccuguaaucccagcauuuugggaggccaagguggggggauuacuugaagccaaaaguucaaaaccagcuugggcaacauagugagaccccaucccuauaaaaauguaaaaaauauauuagcugggugugguggcaugugcuuauagucccagcuacuugggaggaugguuugagcucaggagauagaggcugcagggagcugugaccacaccacugcacuccagccugggugacaaagugagaaccugucucaaaaaaaaaaaaaaaaaaaaaagcuaaccacagguuaagaucaagcucugcagauuaggaagccauuaucuuuaaggugaaauugcacaucucguccaaugugcugauuuuaguugaacagauuuuuccuggcugggcacaguggcucaugccuauaaucccaucccagcacuuugggaggccgaggcaggcagaucacccaaggccuggagauugaggccagccugggaaacauggcaaaaucacaucucuuaaaaaaaaaaaaaaaaaagccaggcaugguggcaugugcguauaguucuagcuacucaggaggcugagacaggaggauugcauuagccugggaggucaaggcugcagugagccgugaucacaccaccauacuccagccugagcaacagagcaagacccugucucaaaaaaacaaaacaggccaggcgcagugguucacgccuguaaucccagcacuuugggaggccaaggcaggcggaucacgaggucaggagauugagaccaucccggcuaacacggugaaaccccgucucuacuaaaacuacaaaaaguuagccgggcguaguggcaggacaccuguagucccagcuacucgggaggccgagguaggagaauggcgugaacccgggaggcggagcuugcagugagccaagauagcgccacugcacuccagccugggcgacagagcgagacucugucucaaaacaaaacaaaaacaaacaaacaaacaaacaaaaacaaggccaggugugguggcuuacccagcacuuugggaggccaaggcaggcagaucacaaggucaggaguuugagaccagccuggccaacauggugaaacccugucucuaccaaaaaauacaaaaaaauuagccaggcaugguggcgcaugccuguaaucccagccacucaggaggcugagacaggagaauugcuugaacaugggggggcggagguuacaguaagccgagaucaugccacugcacuccagccugggugacagagcgagauucugucucaaaaaaaaaaaaaagauaauaauaauaaauaaacaaaaacaaaaauaaaaaaaccgacauuauuuuaaaacuuucaugaguuuuccagaguucaaacugagagucauuagugagccuucucgcucccgggccaaagaccugagcagaggcagcaagauuuccagggaaagcgacuggcuucagugugcucuucuguggcauuaucauccacaggaaagcaaaaccagguuauaaucaacaucaucaucauaaaagguacaauuagcucuaccaguagaccaauguccaaaggcucagagagaaauugccaucauaccuucauugcuuugggaggagaacuuucagaaagacuggaggcucuggaaucuggacuuaguggcuugggauggacaggcuguugaaccucacucuuaaccugggagucaccugcuugaguuacaaaaggaagacauuuuacaguaucucauggaaugucuuggaaaguguucuuccgaaaagcaaaguuugggcacuuucauuaaugacagauccuuccaacaccaggaaaaacacugcuuuucuguugaagaauauucgaacacuaacaacuauggcucagguauucucugguccugucagaaaucagguucucagugaggaggcuuucuuacccucugccacacguagcagaaauccaaaccacucuguauaaagaacuuucuuccuugugccauuugucauuuuuaaaggccguuuauagacuuagaugucuuuuuggucauuaacauuccuaauaacuuuuucugaaguguuucaacugaaguuggaaaaagggggagaugugagggcagaaauuuuguacucugugugugugugugugugugugugugcgcgcgugcgcgcauuuguguauacauguaaccugacacuguuuuuggucaguucuauagcagauaccaauggaugaagauuauggaaaagggcuccaugaaguuuuuuucauaaucauugaaauuccaacuacaugaguuacuuuccugccaaaaugaagaggugagucaacaaaguacuaaaauauuaaggcuuauuuuucaaaaaaauguuucauaaaccuagucaaaaacauuucucagaaacauuucuagucccagaaaaaugauugcaaaaaaagaauguuucuggauucaagcagaaggaguuuuucuccgaaauuuuaagguaggauuaacuagagaucuguuuaauucaucauucuauuucaguuguaggguuuucaguguccaguaaacuagccuggggagaugcuagaaauccacauauauauguuuuucuuuuuugucuugugaccuacaagaaauuuauauauauauaguauauauauaucauauauguguauauaugauauauauacacauauaugauauauauauacauauauaucauauauguauauaugauauauauauacauguauauaugauauauauauacauguauauauauauacauauauauacguguguguguguguguguguauauauauauauauauuuuuuuuuuuuuuuuuuuucagagucucacucugucacccaggcuggagugcaguggcaugaucucggcucacugcaaccucugccuccugggcucaagugauccuccugccucagccucccaaguagcugggaccacagaugcaugccaccaugcccagcuaaguuuugguacuuuugguagagacaggguuucaccauguugcccaggcuggucuccaacuccugagcucaagcaaacugccugccucaaccucacgaagugcugggauuacaggcaugagccauagcgcccagcaaacauauauauacauauauauauauauauauauuuuuuuugagauggauuuucacucugcugcccaggcuggagugcaguggcaugaucucagcucacugcagccuccaccuccuggguucaagcaauucuccugucucagccuccugaguagcugggacuacaggcacccaccaccacauccggcuaacuuuuuguguuuuuaauagagaugggguuucaccauguugaccaggcuggucuugaacuccugaccucaggugauccacccgccuuggccucccaaagugcugggauuacaggcgugagccaccgugccuggccagcaacauauauauauauuuuguuuugagucggagucucgcucuguagcccaggcuggagugcgauggugcgaucucagcucacugcaaccuccaccuccuggguucaagcaauucuccugccucaguguccugaguagcugggauuacaggcgcccaccaccacgccuggcuaauuuuuguauuuuuaguagagcuugggguuucaccauauuggccaggcuggucuugaauuccugaccucaagugauccacccacuuaggccucccaaagugcugggauuacaggugugagccacugcgccuggcccagcaacauauauuuuuaaaugggcugggcacaguggcucacgcccguaaucucaacacuuugagaggcugcggugguaggacugcuugagaccaggaguuggagaccaaccugggcaacaaagugagaccuuuucucuacaaaaauauuaaaaaauuagcuggguacggccaggcacgguggcucacgccuguaauccuagcacuuugugaggccgaggcggguggauugccugagcucaggaguucaagaccagccugggcuacauggugaaacccugucucuacuaaaauacaaaaaauuagccaggcaugguggugugcgccuguaaucccagcuacucaggaagcugagacaggagaaucgcuugaaccugggagggggagguuacagugagccgagauugcaccacugcacuccaaccugggugacagagugagacucccucaaagaaaauuagcuggguaugguggugugugccuguaguccuagcuauuugggaggcugaggugggaggacugcuugagcccaggaguuugaggcugcagugagcuaugaucacaccacugcacuccagccuaggcaacagaaagagacccugucucuaaaaaaugaaaauuaaaaguuauacugaaaaucagaauaaaaaguggacauagucaaguaaaaaacaaaaaaaaacauuuuugucuuugggaaaagggaggcucaaaaugacuccaaaauaggaugacaggugacaaaauucacugucagcaggaaaaucccuagaaccuggcuaggagguugacuauaauauacauuuagauaaacagggaaaaaauauguaucuuuaacagauuauucaaauacuuauucacuaaagaauagguauuuaugaauaacauuauaaaugaauaaaauccguauuggccaaacuucuguuaaaaugaaacuucaaaauuaguuuauacagcuucaauucugaaaggguuuggugcaaaaaguaggaugaauucaaugagaaaagcauuacaaguauucaguuugucccaaguuaacuauauucaauugaauuuaacuucuccuuaagccaugaaguguguaaaggacauucaagcauuagcccuuaaauucaaguagaggauuuacuauguuauuuucucagcacugacaguaaugggaacaccccugaaccaaauacagauagaaaacaagaaccucauccuccagaucuaagaaagaaugcuuacgggagucaucuucggcagggguggaacggacugccaggcuauucucauuugcagaaaucuacaaaaaaaaaaaaaaaaaaaaaguuagagggggauuaagagucauauuaaaaauaaaagagcaaacugcuguuaaugccauaaaaaccugcugacuccagucagucacuggcugccuaggggaaauaacgggcaccagaacagcugagcauuugaacaagaggcagcaaaaugucuuuuaugaggauauuaacaugccucucaauuacagaguaacccgagaaacagacugcacucaacugccaaaagugugcaucaucucccuuuauaaaacaacuucuaaaccauauuuuucugcucucaaaaaacaaagcaaaacaaagcccucuaucaaggagagcaaagcuccucaccguauaaccauaacccacuccaaggaaagauaaaguauuuaaauauaggaaccauucuuauuuuuuaauuuuccuaauucuuauuucccaaccaacuacauccugcugaaacgagcuugccuauauagaagaccuuuugacaguuauaaaacaaauuuaccuaaaacuaaccucaguauuaucuuugaggacaguuucccuucuaaucccagucucaaaauggcaauguuuaaaaagauggcagaucuuacguauagguguauauaucauuuucucaaaagccaucaaauuuaaauaaaagaacucucuauuagagcucucccuccuuucuacuggcccccaugccuuccugguaucuuacuccacauccaaaaucaugaagagucaacaggugacccaaugugcacucuucacauaauuuccuuuuauucagaugccacggauuuuaugggcaaugcugaguguuuauaucaggaugucugacaaacugaauagauuuacaaugaagauuaagcugcuggcugacugcaccugaauuucagcgugguuauuuuuuccacuacucucuucauuacaggaauucugacauggcauaaaauaaaccgguacaaucacagccagcauuuacuggguguuuacuaugugccagguauucaacuaaucgccuuacaaaugcacuauuuuaucuaaugauaugaaauaaauuuucugaaaguugugcaugccuacaaaaagcucuucaguucuugagaauuaguagguaccuccaucccaggauguucuucucucaccuuuaauuuggucaccuugaaccugugagguaaucuuugcuuuuuuuuuuuuuuuuugaauggagucuugcucuguugcaaggcuggaauccaauggugcgaucucagcucacugcaaccucugccuccuggguuuaagugauucuccugccucagccucccgaguagcugggauuacaggugcccauuaucacacccggcuaauuuuuguauuuuuaguagagcaggguuucaccauguuggccaggauggucucagacuccugaccucagguaaucugcccaccuuggccucccaaagugcuaggauuacaggcgugagccaccucgccaggcacauguccuuuuuuuuuuuuuaacaagcugaaguucaaauaacacuuagguauugguuaacaaaagcuaggcaaacagccaaaaggauagcuaagggucugaaaaacauugcgaauuuuaaggcagcugaggguuuguaaaccugcagcaugugcuugaagaauauguauugucuuuaucuccuuucuuccccacccacuucaugauucacagucgcacuaauguccuuuuaggcuauaauuaaaauguucuaaucuuccaguucaguucagaguuccaguuucaaaucagcaugaagacaaugacgaaggaaacaugaauuuagauacagggacaauucaagcauuauuucccaaaugacuguuucccaaacuaugcuccugggauaaagauggggauauuucaaugcugggaauauuuuucucuuaaaauuucuuucuuucuuuuuuuuuuuuaacaguauauaagaaaaacuucaaaaauauuuagucaguuauucuuaagaaauaaucucccauuuaaaagaugagaaaacaagacaguuuaacaagauaacucacuuaauacauggcaugugccucaugggcuaaugccugaguccacugcugcaaggauguuugcaauuuaugggggauuauaugaccauguaacacaugacugccaaguauuuugucuuguuauuccaacauacauuugugauguuuuuauaaaauaaacuauucuaauauuuuuuucuguucuggucuuugaaucaaauuuuguagccaucaguuugagaccauuuuucugugggucugcuuugauccaagaguaguauaucucaugaguuccuguuaguauucugacaauauaccauccuacuuuguaaagucuguuguagucaaauaaguuugagacagggugcagugguucacaccuguacuuccaguacuuugggaggcugaggcugaggggauugcuugaagccagaaguuugagaccauucugagaauuauagcgagacccugucuauacaaaaaauaaagauaaaaauaaauuagccagaugugguggugcacaccuguagucccagccacuugggaggcugaggcaggaagaucacuugagcccaagaguuggaggcuacagugagcuaugaucacacuacuacacuccagccugggugacagagcaagaccucaucucuaaaaaaauuuaaaaaauacaaauuccaacuaagcuugagaacuguugcucuuaauccauuuaaugaucuccaugucuuuuggaagaauggcgucaagggugucaauaaguguaacagaagcaauggcuuuucuccuaagauuaaaucacuguaauagauuugaaaacccuuucuccucaucucauuuaacauucgauuaucauauugacugaaagacuaaaagaauuggacaaugggcaaugguagagaacaugauaauuccccugacauaaauaauguuacuuauuucaauuaagccauucaucuaaugauuaauacauaacacacaaauaugauuugcuuaaaaucuuucaguggcuuucuccugcugcaccacuacauccaaacccuuaagggugacauaaagauuuacccuagcccucuccuuccaccugucucucacugcugccuauguguaccucaugcuccagccaagucagcaaaccuguaauucuggccaagcacgguggcuuacagcuguaaucccucacuuugggaggccaaggcggguggaucacgugaggucaggaguucaagaccagccuggccaacauggugaaaccccaucucuacuaaaaauacaaacaauuagccaggcaugguggcacguacccggaaucacaguuacuugggaggcugcggcaggagaauugcuugaaccugggagauggagguuguagugagcugagaucacgccacugcacuccagccugggugacagagcgagacuccaucuccaaacaaacaaacaaucccuguaauuccucagccaucaucucugguuuccaaaucucuguuguaucugccuggaauagccuucuauuucuaacucaaccuuccccucauucacuuggccuacuuccacacguucuucaagacucagcucagacaucaccuucuugaggaagucagguuaaauaucuuugcucugggcuucugugguccuguauaccccucucacagccucacagcaccuaucauacauuuuuaugauagcugaccucuuauuaaucucuccucuacucuguuuucuugcacauaaagaccacauggaaugguuugucaauaaguuuuuaagcuuauuauuuccuaugcuuacuuagcauagugacugccuuucaaaauaauaugaguggaagaguaagauuuucuugcacaaaauguguuaaauguauacuuaaauuaagaauauaugaguaucugaagauaaucucuaaucaaauauauuuuuauuuuauuuuuguaaauuauucuucccaggagcauggaaucaaguugcccugaaucuaugcucucccaaauagauuuuuuuuuuuugagauggaguuucgcucuuguugcuuaggcuggagugcaguggugugaccucagcccacugcaacauccgccuccuggguucaagcgauucaacugucucagccuccugaguaucugggauuacaggcaugcaccaccaugcccggcuaauuuuuuguauuuuuauuagagacgggguuucuccauguuggucaggcuugucucgaacucucgaccucagaugaucugccugccuuggccucccaaagugcugggauuacaggcgugagccaccacacucggcccgaauagauuuuuauuuuauuuauuuauuuuugagacagagucuugcucugucgcccaggcuggagugcagugcacucagcucacugcaaccuccaccuccugggaucaagcgauucuccugccacagccucccgagcagcugggauuacaggcaugcacccccacacccggcuuuuuauauuuuuaguagagaugggguuucacccugugggcuaggcuggucucgaacuccugaccucaggugauccaccugccucacccucccaaagugcugggauuacaggcgugagccacugugcccagccuccaaauagauuuuaaaaaaucacuucagcucuuugccuucugagcaucugcugagcaaaauaauuuuccaaugaaggcucauuauuuggucagcuauaaguugcagagcuacucaacugaaauuaugugaccugcaaaaauggcaaucuguccuggcagcuguuaccaaauucccagacacucuacagccuagaguuagaguuguuucuaauuucaagcaucuaauuuagaacacaugcuuccuuggcaacuggacaucagacuuuucaaccuaccuuuuccccuuccugaugggugaugcagaccucaggaccugggggcacauucuccuuuugcuccauuuuaugaauuuugauuucgccaccacuggcuuucagcucauucuacaaaauaaaaauaacuguaaaaauuuuuuuaaagucccaucauucuguucucuucauagcacaucuauuagauaaacuuggaauguuaaaaaauucuucuaagaagccucgggucaaaucaacccccuaacucucacaagcaaaacccacugacuagugaaaugacaaaagcagcuuuguggacacauaccucagaguuaaauaucuguaugcuaguguaaaacuggauugcucauuagaauacagacacaucaacacaggcacacagaacaccccaagcauacaacauucuugugauucacucuucuagcagcagagcuugugguaaugcaaagcuugugaguuuuaucagaaaagaccauucuggagcaggggaaaggagaugccaagugccaauaauagaaaauauacugaccauacauauauaaaugcccggccuggaaagagagacagggaugauguauacauauaaaaacugaaauuauauuuaaugauaccauaaagaaaccuuuuuggugggacuuucaaaaagcauguuuuuccauauacaauucauauauuguacuaaagacauaauuuauuuuacuucucaaaacagagccucaacauaaaagaacaugcauuuuauugucauaaggaauaaggauaauugcauuuuuuuccuugcaaaggacacuggggugaauauuacaauuaacucaucuauuacaucuaaaaucaacauagaaccugggugcaguggcucacgccuguaaucccagcacuuugggaagcugaggcggguggaucgccugaggucaggaguucaagaccagccuggcgaacauggugaaauccugucucuacuaaaaauacaaaaaauuagccacgugugguggugcacacuuguaaucccaguuacuugggaggcugaggcaggagaaucgcuugaaucagggaggcagagguugcagugagccgagaucacgccacugcacuccagccuggggaacaagagugaaacuccaucucaaaauaaaaaaauaaaauaaaauaaaauaaacauagaggucgaugacuauagacauuucccaccauuagucugcuaauaauguaguaaucuaguacuuuucuguucucugugaaucuuuaggcaugggaggaaacaauuuauggccaccaggucaaugaaaggaaugugaguaugacuuagucaccuagugaugguauucuagauuacgacccacagcaccggaggugcaucugugaggaggagcuggcagcuagcacugcagaacauuauauagcccaacaacucauuccugaccccaucucaaagccccaccuccagaacugcugccagagaguauguaugugccuuguuacaaccauauucuguaaggggccugggaaauucuuuggggaugagacaaaauguacuuuuuacaagaauucccaaagaguuuucaacucuuaaaaucuccagagcaggagaacuguaaugcagaaaugguuaggaguuaaaaaaaaaaaguuacucaacagguuuccccacauagggagucaccuggugggaauguuuacagcaggagggcacugagaagcaguaaaaucugguaacaagaggaaguucagcuucgcagaucccaauuugcuguaucuccugaccugccuucuaagggaagucuaaauuugcucgcuuuucacauucacggugcauaaucagccugugauacuccacuuugcuaauugauuuacacacaucaucucuucuuaaaacauaaaguuguuaaaauuacaguuaaaaaaccaagaugaaauuauucauugcccagagaauuaguccaccaaauauuauuagagaauguauacuuaauaauguggggaagagaaggcuuaacucccagaauacucauuaugguuuccaauaugcaccaauuucgaucugccuaagaacaaauaaaauucaauauuguucuuuuugauuuuguuagacaauuaggacaucaagagauuaaugguuuguaauuugaaaucuuagaacaaaugcuugaaggauacaaaaauauguguguguacauuuguaucuauguguguguauacauauauaugugaauaaauggcauuugaaagguaacuuccuuuuuuuuuuuuuuuuuuugagauggagucucacccugucacccaggcuggaguacaguggugugaucucagcucacuguaaccuccaucuccuagguucaagugauucuccugccucagccucccuaguagcugggauuacaggugugugccacuacaccuggcuaauuuuuuuuuuguauuuuuaguagagacgggauuucaccauguuggccaggcugguucugaacuccugacuucaaaugacccacccaccucaggcucccaaaguguugggauuacggugugagcuccugcgccuggcuauaagguaacuucaauuuagcaguucuguagcaucagcuuacccguuaagcacaggacaacguaaaggggaaggacccuccauuguauuuugaauaccaaucuuuuuuuuuuuuccuggagacggagucuugcugugucgcccaggcuggaguguaguggcgcaaucuugccucacugcaaccucugccuccuggguuccagcgauucuccugccucagccucccaaguagcugggauuacaggugccugccaccaugcuggcuaauuuuuguauuuuuaguagagaugggguuucaccacguuagccaagcuggucuugaacuccugaccucaggcaaucugcccaccucggccucccaaagugcugggauuacaggugugagccaucacacccagcugaauaucaaaauuuucaugcuuacugagcacgucaccuucuugugaucucucccuuuuccuuaucuacuauucuacuucuuuaggaaaacaguacaucguaaggauuaaagauuaaguagaagaucuacuguaugacuccuucauaugaaauuuccaaaauaggcagauacauaaagacaggaaguagcuaagugguugccaggggaugagagcaggggaaguugggagugacuacacagguaugaaguuucuuuucagggugauggaaagguucuggaauuaaacagugguaaugguuguacaaccuugugaauaugcuaaguaucacaagauuguauacuuuaaaauggugauuuuauauuaugugaguuauaucucaguaaaaaaucacaaaaaaaacccucguuaaugaacacagcugauauuucucuccagucuucuucuuucuucccucaaaagccaaaauaagcucuucagucuucuuccuucuucccucaacaaccaagauaaaauaagaguuauauuaaaacuaauaaaauacuacuucuuuaacaacacaaagauuaaguagaagagccagggaaacucucaaugauacucacugguaacaucacaaaaaaagugaguggggugggaaccaggacuaagaaagcaaagucaggauuagaccaugguaagaacugcaaauccagcgaggguaggguucaugugaaaagagaacagcuaggggaccagggcucagauacaagggucuggugacauuuccuaauuccaguacucagugaccaucugcuggaugauggaaugaaugaaugaaugaaugaugcagaacacauacuguauaguugguugagcugcuuuguuuggacacagcugccugguacuuggccauucgauccuuuauagagguuucugagaggcguggaaguuccagauuucgucuacucucauuuuucuccgagucaaauguagaagaugacaacugaccuggaagcauccaaauaacauguuuuauuuuauuucugagauggggucucacucuaucacccaggcugaagugcaguggcacgaucauagcucacuacagccucgaacuccugagcucaagauauccucccgccucagccucccaaagcgcuggaauuauagguguaaaccaccgugacuggccaacauguuuuauuagaagauaaaagugauucaaauaauuucaaaauucuaaauuuuggguuauuuuuaucuaauggccaauaucuucuguuaaaagcacgaagaagaaaaucaggaauauaauugucauuuauaaaguaauauucacucacuuucuuagcauuaaaagaaccuuaccauaauugaggauugcauauuuuauuuuuugagacagggucucacucugucacccaggcuagaguauggggcagugguacaaucauagcucacugcagcuuugaagucuugggcucaaaugauccaaccaccucaguuucccaaguagcagugacuucaaggaugcaccaccacgcugggcuuuuuuuuuuuuuuucuguagagauaggucuauguugcccaggcuggucucaaacuccuggauuuaagugguccuccugucucagccucccuaagugcugagauuauaggucugagccaccaugccugggcucguauuuuaaaauucuggcuaauuuaacaugaaaaagaagagaucucaaugcuuuuuaauuuacauuucuuugaugacuagguagcugauguuuuccuguuuuuacuaauuuuuucuuuugugaagugccuguauauguccccuuuaaaacauaauuccacucucaaaguguuauguuaucacugguaauacaggguaaccaaaccugauaggggacacagcccaucuacugaagcccucaaaccccagaugacuggaggcaaaacugaucguagcacuuuacuuauagcuccucaaaguacccuuugcuuaccauagguuaccacuaacaaggguggauuaaaaauaugaaaaaagcagccgggcaugacggcucaugccuguaaucccagcacuuugggagcacgucaacuuccgucucaaaaaaaaaaaaaaaaaaaaagcuauuuaucgagagcaaugagauuugagaauggcuugcaucuaauaggcagacuuccuuuuaauuugugccacucuuccuuuaaaagcauuggcuucgaguccaaaagauguuacuacuagugaguacuuccuaaaggaccucauacacauggaacucucugcuuaccugggccuauuuccaggucaucuagagaauagcuguuuucagagaucuuccuuccacuugcacuucggcuuugggcccggagaaucuggaaaacgaaacccaacgauaaguuuugcagaaacaaugggaaaucuugacgcaagguucaacuugcaaaccuucuuuauaaauaaaauccagauuugauuuuauauuuuauauucuauagaauuuuuuuuaaauuacaaauaucaagcacuacacauucacaggugcccagggaaaaauaaguaacccuauauagguaauauucucugcuaaagauggcuuccuaaccagcaagcuuuguaacacuuauuggaggggaauccucacauaccagaugacaaugacauguccuucuaaacugccaagugcugaugcagaaucugcuguuuccuuucuccgucucauguuauuucugcuauugcugccuuaguucaugucuucaucaucuuuccccuggacuacugcauuauaccucuuuaacugguucuucauuaucuuccaauccagucucuaugaugcuaccauuauccccaauaauacaaaguaauuauccaaaaauauaaaucuauuuuacccuccuuuucaaaauucuuucagcauuccuacucauuccugaaauuaaacucgaagugcuuaguaagucacagaaguccuguucuagaucuggucccuaccgagccagccuccuuuguccuucuguugccuuacaaaugccuguuccuucaaagacucaguguaagcacuaugaagucugaguaccuugccaacauaaauuuagguaaucuuuccucuguucucaagguaccuggucaaacuguugggugacugucccucuacugcacuguaagcucacuaagggcagagaccaugccuuuuuguccauauauuuccaggacuuacagaaaaguggaugacacagauuuuuuuuuuuugagacagagucucacuccgucacccaggcuggaguauagugaugugaucuuggcucacugcagccuccgccucccagguucaagugauucuccugccucagccuccugaguagcugggauuacaggcgccugccaccaugcucagcuaauuuuuauauuuuuaguagagacaggguuucaccauguuggccaggcuggucucgaacuccugaccucaggugauccgcccaccucggccucccaaagugcugugauuacaagcuugagccacugcgccuggccaacaaagauuuuuuuuaaugaaguguuuugugauuccauuaaauuacuacauuuaucucugucauaucuaagguagaucuuuaaugaaaguuacaaauuauaauuuuuaagacuguagugucaaagaauauucccagacauaguacacagggaguaugucauguuuauucagcuuauaaugagauccuuacaucagauccuaucauucaaaucucaguuuauuuccagacaacuugagguuaaaaaagauaucugaaauccaguaugacaggagauaagaauaaaacacuuagcacccuuuugaauuuaacauuaguaaauaguuacuaaaucuuuaaguucaauggacuaaucaacuuuacuguaaaguuugaggaagugagacugggcaugguggcucacaccuguaaaaccaccauuuugggaggccaaggcgggcagauugcuggagcucaggaauuugagaccagacugggcaacauggugagacccugucucuacuaaaaauacaaaaaauuagccagguguggugacaugcaccugcggucccagcuacuugggaggcugaggugggaggauugcuugaaccaggggggcagagguugcagggagcagagaucgcuccacugcacuccagccugagaaacagagugagacccugucucaaaaaaaaaaaaaaagaaaagaaagugaacuaucacuuuuacauauuuuuuauacccccuccuuggagacagaaaacauaccacaucagaaaucagagccaaggauuggucuguuuauaccacaccaguaagaauaguuucuuucaaauucaauauauauuuaauauaucucccaaggcuaggcacaguggcucaagcuuauaauccuagcacuuugggaggcugagacagguggaucacuugagcccaggaguuugagaccagcuugggcagcauggcaaaaccuugucucuacaaaaaagauacaaaaguuagacugggcacgguggcucacgccuguaaucccagcacuuugggaggccgaggcagaaggaucacgaggucaggaguucgagaccagccugaccaacauggugaaaccccgucucuacuaaaaaugcaaaaaaauuagccaggcgugguggcccgcaccuguaaucccagcuacucaggaggcugaagcaggagaaucgcuugaacccaggaggcggagguugcagugagcagagaucaggccacugcacuccagccugggugacaaagcaagacuccgucucaaaaaaaaccaaaaguuagcugggcauuauggcaugcgccuguagucccagguacucagaaggcugcaguaggaaaauugcuugagccugggagguguauguugcagugagccaagaucaugccacugcacuccagccugggcaacagagugugacccugucucaaaagaaauaauaaaaauaaaaauauauuauauacauauuacauauguguguguguguauauauaauuugucuccuugcuggguuuggugguucaugccuguaaucccaacacuuugggaggcugagccaggaggauccuuugagccuaggaguucaagacuagccugggcaacauaggaagacuccaucucuacaaaaaagaauacagugagccgugaccgcacuacugcauuccagccugggugaugaguaagacccugcucaaaaaguaauaauaauaauuuauauccagucagcuuugcaauuuauauuguugauuuaagucuauuuuuucuuucuuucuuuuuuuuuuuuuuuuacaguagagacagggucucaccacguugcccaggcuggucucaaacucuugggcucaaggagccucggccucccaaggugcugggauuacaggugugggccacugcauccggccugauugggucuauuuuuaauaaaaacuaaaacaagcuggaacaacacuauccgugcuacaucacacacaggucaggcauacuuucaugaauuauuauacauccauaugacucacacagcucaacauacucuugcucuaggagcagccgcuaucugaaaaugaagugguugggugcgguggcucacaccuguaaucccagcacuuugggaggccaagguggguggaucucuugaggucaagaguucgaggccagccuggccaacauugugaaacccugucucuacuaaauauacaaaaauuagcugggguggcggugcgcaccuguaaucucagcuacucaggaggcugagguugagaaucacuugaacuucagagauggagguugcagugagcagaaauugugccacugcucuccaggcuaggugacagagcgagacuccaucucaaaaaaaaaaaaaaaaaaaagaaaaaagauaaugaagaucuuggucaaaaggaaaagauaugucuggcaggauacccucaauccacauuuuuaauuuuuauuuauuuauuuauuuugagacagagucuuacucugucacccaggcuggaauacaguggugugaucucagcucacugcaacccccaccuccuaagcucacacaauucuccugucucagccuccagaguagcugggauuacaggcgucugcuaccacaccuaauuauuugaguuuuugguagaguugggguuucaccauguuggucaagcuggucugaaacuccugaccucaaaugaucugcccuccuuggccucccaaagugcugggaugacaggcguaagccaccgcgccuggcccaccuuuuuauuuuguuuucaacauacuucuuauuugcugaucauuaaaauaaagaaaauuccacauauuuauuccaaaugcugcugcacuggaagauaaccacuacaaaaauuagaauuuucaaaacucaaaaugggagaaagccuacugauaaacuucuuuugaaaaaccaaaaggggccgggugcaguggcucacaccuguaauccuagcacuuugggaggccgaggcagguggaucacuugaggucaggaguuugagaccagccucgcccacauggcgaaaccccaucucuacuaaaaauacaaaaauuagcugagcaugguggcacgugccuguaauccuagcuacuggggaggcugaggcaggagaaucgcuugaaccagggagguggagguugcagugggccaagauuacugcacuccagccugggcaacagagcaagaccccauuuccaaaaaaaaaaaaaaaaagaaaaaaagaaaagaacaaccaaaaggaaacggguucuguguucuuaauacagauauuugcuuucugucaaaguucaagcacaauuccaagaauauguguuacauguuacaaccugcagagagcuguuuucugucuaguuggagcuacacauccuucucugucuugugugaagucccugcacugcuguuauugggagcauaaucauuuagaaccagagcauacaccuugccagggcagaggcuuucuuugguuuuaaacgcauaaaauuucccaucuuuguuagcuuuuaauuuaaacugcuggguuaauuaaauaaggcccccuuaccuuuuuuuugaagccuuuugcuccauggggguaucaaaacucugcauuaauuuauuucaaguacuaaaaaaguacaugaacaaagccauuuggucucagagaaaaauaggaagagaacugucucugaaaaaucccucauacagacuguggcucugaggagaaacacagcugugagguaagauggguuuucaugauaucgcagguucagugaagcacagcauuacuuucaauauauuucaccuuuaaaccacucaaacauuaagaauaacaaggcuuggcugggcaugguggcucaugccuguaaucccagcacuuugggaggccaaggcagguggauuaccugaggucaggaguucaagaccaaccuggccaaccuggugaaaccccaucucuacuaaaaauacaaaaaauuagccaggcauggugguggacaccuguaaucccagcuacuugggaggcugaggcaggagaaucacuugaaccugggaggcagagguugcagcgagccaagaucacgccauugcacuccagccugggcaacaagagcgaaacuccgccccacccccccaaaaaaaaaaaaaaaaaagaauaacaacaaggcugggcgugguagcucacgccuguaauccagcacuuugggaggcagaggcaggaggguugcuugaggccaggaguuugagaucagccugggcaacauggugagacccugucucugcuuuaaaaaaaaaaaaaaaaaauuagccaggcauaguggugaugccugcagucccagcuacuccggaggcugaagugggaugauugaguccaggaagucgaggcuguagugaccuaugauugugccccggcacuccagccuggacgauauaacaaggcccugucucaaaagcaagcaaacaaacaaacaaacaaaaaugaucucaaaugcauuuaagaugaguuuuaugauccacauuuuccaagugguaaucugagguacaggaagaaggagggguuuccuccaauauuucucaaggaaguaaaggaacacaaaacacacacacacacacacacgaauucugauaccaaaauacucuucuguaacagacuuuuaucacauuuuagcucuuuuuacucagacacuugagggagccuuaaucauucuaaugucaaggaaagagaauagacaagauacuuuuaagacuuucuggaauuuccugaggccuggccucacccacccugaaguccuccuuccugucagcugacaauaacucuuguuaguaugaacaucccuuaaauauucucugugaauccauaaaucaaacgcaccaagauguacuaguaagaggauaaaaguuuuagacaguagucuguagaauuuuuuucuguauuuuuuaaaacagaaauaaaguaaguuagguucuaaauaaguaacaaagcaggauuuccugucuuuucuacaccuaucuucagaaaaaauuaucuuuaaaagcugauucucaacacuuuaauuuacugagaguccccugccucacuuagccacuuccuucaaccuuucaacuucagcuuccuuuggacgcugucaucucaccaaagucaagggcagaggaagguuggcuuuuagggaaaaauggagcuuugcugaacuaugcauggaaaucggggcauagauaaaaccuagccuugauuuauuaaaguauugagagaaaaauuucuuucuucagggacucucuuagaaagagaguuaauguaaguaaaauaauacacauagaaagagauuuaucuccaggugguaggauuucucuacauuuuuuguauucccaagcauucuacaaauacuuuguguuagucuuacaauuaggaaaagaaaaaaaaaagaaaggauaacaagucauaucuauuaauuuaaguagacaaaaaugguaaaaccaaaugcuaaugcuuuggggaauguguccuuauauuguacuagugguguuauaaucuugagaacaagcugaaaauauauaagaauaaacaauaaaucauaccuuuugauguaagaacaauguuuaaugaauuauaucuuuuuaauuuuauuuuuuauuuuuuuugagacaaagucuugcucugucgcccaggauggagugcagugguaugaucucagcucacugcaaccucugccucccagguucaggcaauucucuugccucaggcuucugaguagcugggauuucaggcgcaugucaccacgccaggcuaauuuuuguauuuuuaauagagaugggguuuugccauguuggccaggcuggucucgaacuccugaccucaagugcugggauuacaagugugccuugugccuuggccucccaaagugcugggauuacaagugugagccaccacgccaggucccaaacucacaagcuucuaacuccagugcuuucauucauaucucuugcauuccaauguauuccuucuguucacuguccugaugcuuuucaauuaguuaagcauaaacugugggaagacagaguuaaagucuuugagaacauagcuguuuuuauguuuucaauuuuugccaguuuccuuagauuucaaagauauguagggcccauuguuucuauccaauaaauaguuauuauauccaugaagauaguguuauaugguagaagggguacuacccaauuucaauccuguucugauauuaauuagccacaugccauggggcauaucaauuaacuucucugaccucaucuaaucgcaucuguaaaauugggauuguaaaguucuaacugacugagggcagugagcuggauuaaauaacuucuuaaacucucuuaagguucuaggaucuauaugucaacaauuuugauagcgauuucucacucauuguaacucacugaugaguuagaaugaguuagaaggcuagaggaaaugacuuguaaauauauucaucuggauacacaccuguguugucuaauuuaggaaugagcccacuagcaggaagacaaagguaguaauauuuguacuggggggagaugaagucuuucuagcccccuugaagucuaauauagccaacauugcuuaaagaauauuccaguccccugacauugcuuguugauauguuuuacuauaaugaaacugguuaaaaaccaguacauaguuaguggacaugaaaguaagcagagaagaagagaugaguggucucuagcuggcacaucaaggacagucauuuagggcaaggaacaguuaaaaagauuggaauucuuugacugcaucuuuacccuggaucaauuauuaucuuaccacacacacacacacacacacacacacgagauuacucagaguuauuaagaguaaauaaaaaauuuaugcugauauguagucuuuacaagaaauguaccacuauaaauagaugucagucaaaauaaugcugaggauagccuuauuuacauuuuugaaaugacaagagaagcuacaaacuauaggugaauaugcuaaaucagcaaaaaguuaguuuuaccaagauauguaagaaagugcauugauagaaaaacaaagacaauucuuguguacaauuaacaauaacaugcaaaaccaauuauccacauuuaaagcacuagcaauguaucuauugaagauuaaauguuaggucaagguaaaagugaagauucacugacaggcaaauuaaagauauacuccccuacauugagaugacuguauagacuccacauugauguuaauaguuauucaaauaccuuuccuccccaaacuuacuuuaaaauuuuaacuuaaaaccaugcaauuuggcugggcgcaguggcucacaccuauaaucccagcauuuugggaggccaagguggggggaucacaaggucaggaguucaagaccagccugacccacacggugaaacccagucucuacuaaaaacacaaaaauuagcuggugugguggcaugcgccuguaaucucagccacucaggaggcugagggaggagaaucacuugaacccgggagguggagguugcagugagcugggauugugccacugcacuccagccugggcgacagagcaaacaaacaaacaaacaaaacuaugcaauuaauacaauuaugaacauccucagaauuguauucuucuugggauauaauucuaaauaagacauauucagaaagcagaagaaaauuuuuuaucuuaacguuaaguagauaaaggaacacauacaauuauuaacuaagaggaagauaagauguuaugaauaauuucugcaacaaucugggcauucccuauggacaccuacccauucaucaagaaggccuauauaaauuauuucuuugaugcagauuacagauuggcuaugaauaaguaccugaugaacagagaucaucacacuuuagcuugguugccuuacucucuaaagacucauucuacuacaucagcgcauauacacucuuauguacgaguguuaugcaaaacuaaacaaaauaccaagugucacuuccaggaacuuacaagaagaaaaaccacaaagauguuggaacaagugaaguuuuuguuggcauuuugaugcuaucuauacauaucaugauccuggugcuaauaagaacugaaauucagagggaagcugaagggcugggagucuacggggagaggucacaaacaagagaaaagggugaugagucaaaggaaacuuccuuuguuauuuuauauaugucuauuuuaccugaauauauugcuuuauuuauuuuauuuauuuauuuauuuuucuuugaggcagucucgcucugucgcccaggcuggagugcaguggcgcaaucucggcucacugcaagcuccgccucccggguucacgccauucuccugccucagccuuccgaguagcugggacuacaggcgcccgccaccacgcccggcuaauuuuuuuuuuguauuuuuaguagagaugggguuucaccguguuauccaggauggucuugaucuccugaccucgugauccgccugccucggccucccaaagugcugggauuacaggcgcgagccaccgcgcccggccugcuuuauuuuuauaauauaaaaucccagcacuuuggaaggccgagguggguggaucacuugaggcugggaguucgagaccagccuggccaacauggcaaaaccccgucucuacuaaaaauacaaaaauuagccggacuucguggugcacacuuguaaucccagcuacucaggaggcugaggcagagaauugcuugaaccugggaggcugcagugagcugagauggugccacugcacuccagccugggcaacagagcgaggcugucucaaaaaaaaaaaaaggcaacaugacaauaacuaaacaugggucauaacuaguuggucaguuaucuuuuucauaaaaggcuguccugaaugguuaucuuggccaccuaaaauccagauuaauacauauaaggaauuaggaaugcuaaaccacacucacuaagugucaccguggcauuucuuuucuuuucuuuucgagagaaguuuugcucuugcugcccaggcugggaugcaauggugucaucucagcucacugcaaacucugccuucuggguucaagugauucuucugccacagccucuugagcagcugggauuacagacaugcaccaccaucuccagcuaauuuuuguauuuuuaguagagaugggguuucuccauguuggucaggcuggucucaaacucucgaccucaggugauccaccugccuuggccucccaaagugcuggaauuacaggcgugagccacugcucccagcccacuguggcauuucuuuugacgauagguuacauuaauccauauaccacucauucacucauaggaaguagaaccaucacauucaggcugggcgcgguagcacuuugggaggcugaggugggcagaucaccugaggucaggaguucaagaccagccuauccaacauagugaaaccccaucucuacuaaaaauacaaaaaaaguuagccgggaauggcagcggacaccuguaaucccagcuacucgggggcuaaggcaggagaauugcuugaaccuaggagacagagguugcagugagccaagauugugccacugcaccccauccugggcaauagaaugagacucuguuucaaaaauaaauaaauaaaaccaucauauucagcuaaaccaccugaccuaaauaaccuaucuauucaucaaauguagagaauaacugagaaauaggcuuuaaucaauuuucauuauuuggaaggcagcuaugcuuaccacuauaccaccaaugccaccuuccuuuuauuaaauaaauacuaugaacuaaguuauugaccacuaggguauaaaaacauccuuacuuuucuucuugaauuuauaaaaauaaguuuuuauuuuugccuuaucuaguagcaaacauaaaacuauccugacuuaaaaagccaacauuguucuuucuccuauuuuuuccuuggaucacaaguucauauacagucaagcaagcaccccaaaaaucccagaauugaaaacagguguauucccuucagaaaaaucaaagcuagaauguuuagcuauuaaaguguuucucuccagacugagaucaagugacuucacugcaguggcucaagaguggcugacucccuccuuccaaaucagcccaucauagaacaccuauugcuaaauagcaaaagccagaggcuuagacuggaucccucauaauuggagacuucaaaguguucagaacuucaagccuggccuuugaaguaaaaucuuuuuuuuuuuuuuaaguacaauugcaauuuuuuuauuuuucuccagaggcuaguuuuucuucaguccuuaagaacucugcuccuuauaugggcuucgguggcagucauggggcagcaccgcaggucuacagugggguggagguguucgguccuugcgggcuucaugaccuugauuucuggcggucguggggcagcacccgcaggucuacaguggggggaagguguucgauccuugugggcuucaugaccuugauuccugacuaccgugcugugaauggcacaacucacacaguaauguagcuucacauccagccugggaaguacacaggcaucuaggacgcucacuucagaaauaucgcugacugccgcagccucuacauuucaagcauuucaagugaugaauuucuuuucuuuuuuuuuuuuuuuuuuugagacggagucucacucuugcccaggcuggagugcaguggcgugaucucggcucacugcaagcucugccucccggguucacgccauucuccugccucagccucccgaguagcugggacuacaggcgcccgccaccacgcccaacuaauuuuuuuguguuuuuaguagagacaggguuucaccguguuagccaggauggucucaaucuccugacuucgugauccgcccgccucagccucccaaagugcugggauuacaggcgugagccaccgcgcccggccuaugaugaauuucuuaauaagccuugucauugggcacacaaugggcacaguuuaugcagcaaauuggcugcagugaauagcguacaccugguugcggcccucuuuggugugaccauuguuucuucuuuucuuugucaucuuggagguacaggcccaagaaagaugaaguaaaaaucuuaauuugagggugacuaaaugagugcuucaagaccacuuaccccaaauccacauucugcaagacaguucaagaaaaaaggcaaaguagccgucuaccucaaggcuaugggcuccacaguacuuagcacagcuguacccaaauguaaacacuucccauggcgugcuucuucccugucucccagguuagucacaaugaugccaaggugcucugucauugacauucucauccuuuaagaauuucaggcugggugugguggcucaugccuguaauuucaccagcuugggaggccaaggcaggaggaucacuugagcccaggaguuuaagaacagucugggcaacauagcgaaacgcugucuccauaaaaaauuuuaaaaauuagcugagaguggugguacacaccuguggccccagcuauuugggaggcugaggcagaggggucaaggcugcagugagccauaacuguaccacuguacuccuccagccugggcaacagaguuaagacccuaucuccauaaaaaaaaaaaaaacaaaaacaaaaaaaaaacgcauuucaaacaauaacagcaguuuaauucuuccuuuggaaucuagguaaaacuggucuucucuauaaagucuacuauguucuggucucauuucaaaaaguauaaacacacugaaguuaaaacgugaaauauuaagaauaaaagauucaaaaaguagcaguugggggaugaguauuccaagguuugaguauaagauuggcugugagacuauacagguagguugagcucagacuauagaauaccugacagaacuguuaaaaauaaucuagacugagacugggcgugguggcucaugccuguaaucccagcucuuugggaggcuugaggcaggcagaucaccugaggucaggaguucaagaccagccugaccaauaugaugaaacuccgucucuacuaaacauacaaaaauuagcugggcgugguggcgggcgccuauaaucccagcuauuugggaggcugaggcaggagaauuacuugaaccugggagauggagguugcagugagccgagaucgcaccaauacacuccagccugaguaacagugagagauucugucucaaaaauaaauaaauaaauaaauaaauauaaucuagacuguuuucaguauggacaaugaugcuuauuuacaaacagcaauaaaaccaaggguggcuguguuuuccacucccuaagcaguccauuaagugacaaaucaggaaauuaaaaauggcacacacaaaaagcaaugaaaccuagaagcccaggugaaucuuaugucucuuccaucuucuuguuuuuaagggacagggaucuuacuguguugcccaggcuggagugcaguggcgaucauggcucacugcaaccucaaacucucaugcucaagcaaucuucugccucagccuccuaaguagcugggacuaucaaugcauacuaccacaccuggcuaauuuuuaaauuuuuaguagagacgaggucuggcuauguugcccaggcuggucucaaacuccugggcacaagcaauccuccugccuugggccucccuaaauucucauuacagauguaagccaccgugcccagccucuuccaucuuccuauaccuuuagcaaucaaucugguggcccagugcuaucagccaucuaguaggaucuuuauuuuuauuuuuauauauuuuuugagacagagucucacucuguugcccaggcuggagugcaguggcaugaucucggcucacugcauccuccaccucccagguucaagugauucuccugccucagccucccaaguagcugugacuaccagcaacgccaccaugccuggcuaauuuuuguauuuuuaguggagacgggguuucaccauguuggccaggcuggucucgaacuccuggccacaagugaucccccaaccucugccucccaaaaugcugggauuacaggcuugagccaccacgcccggacuaguaagaucuuauauggaaaguuuuucuccucuccaagcagccuuagggagauaggcuuguucugacccauaucucacuagauauuuaugagaaaaagugucucaccauauccuuacacauaaucagcauuuuugucugcuacagucccagucauuuccuaccuuuggccaguuucaacaugcagcagccuuuugcacugaaucuacauuguguguacuggcaugacaucagcuguccuguuccuagcagggucugggaggaggagacuuacaauggugcuuugagucacaacaaaaccccuuccucucuauuuaggauuucugacauuuuuuccuuccacuuaaaauucuucuucccauuuaaauaaaacaaauuuuuaaauuaaaaccauaaaggggaaagaaggaguuggcaggacuaaaggucuaaaaacuugagagggaagagaguuaagaaacguuauaaaacugcuuugugguuacaucucuugccaacugguuucacuguuaaaguagagcuaaagcucaugcacagagaaguguuguagcuuuacacaucgucaaaaacucgcacaacuucaaacaugacccgcaaacauucaagaacuuuucuaauucuaaguagaaaagugacuggcacugcaagucaugggaagggauugacaauaucacaucuaauauaacugaagacuacaggaugaguuauuuuuuaucucagaaagaaugcuuaauauuauuauauuacuuuccaaacauagggacuugggccaaauauuuagcuuaaaaaaaauccagcuuucccaucuagguggaaucuagaguaacagaugguuuugcuccccaucaggucuguuuauuucauuauaacgacuguuguaacgaaccauccccauguacaaagccagauauauaggaaaguaugagaaaacuggaaaaauuuaccagcucuguggccucuggauuguguuauaaaucaccagcauauguaacucauuuucuaguuaaguaauucccucuggggacgaggucugcaauccacaugaaggaucaaauuucauuagcaguuguaggaaaacgcaacccugugcauuugcaagucaaaacucccgaaagcuauagcuagucuggcuaucuucauugauuuugccugagagaggauuuuagcugauagaaaacauuuguuggaaggcacagaugaggaaguugagaagaagagaagggauucagcuagcagagacaaguaagccucagucuuaauguuaaacuccggccuuaacacucagucugcagcuguguccaagcagagagcuauucagcaguaauuccacccccaaagcuacaaaugauaaagaacacaggaagacaauuuaaaagggcaaguguacaaaaacacauaauccaaucgguauuaaacucucuucauuucuagauaccaauuugaaucccagugugaaccugauuuaacaugaaauugugucagagacucacaaaucuuagcaucuauguaaauaaugcauuugagacuauuaacuuaucuaacuggaaucaaaagacauacugaccacauauucgccucuacucaaaauagcuagauuggaaaaacagcuuuguuuagugcuugaauuggcuuucucaaguuucaaacccgcccaauucuuaccuuaguuugaguugguucaccuuucucaaacaucaucuuaagccuguucagcggaacauuauauuucucuauuuugcccgaagcaucuguguuuucacugauuucugauuuuucuacuucaugccuggauucuccuagacaauuuuccauuuuuuuacuuucuguugaguggucuuuaagauccucaccguccuugauguggggauaucgacccugaacgagggcuucaggaggugaccugagucuagaucugggguggauuuguucuucuuggucagcuuuggcuccagaagcagcguggcuugucacuucagcaggaggauggucugcucugugccuaaucucagugcugcuguuccguagagagucugugugagacucugcucccagcccuggguucucccacuucuucuuuaacacagucaggguccccuuucuaaagugcugggagagauuuucgguguucuagaagaacaagaaguagaugccaguuauaacuugccugcugaaacauucaaacauguuguucuuuguaaaaugaaaguuaaaacuccaagcugcuccugguccacugcuguuucagacagcugugaacaguuacagccuugccacauggagaaagcauccacccggcagagggagagggagaggggaagagagaaaaacucaggagcugaagcaggaagugauaaaacaggauggccuuauaaggacaaaaugagaagaaaggcaaacccagcucuaaugauaguuacaugcgaaacaagagauuuuuacccaaagauuaauggggaaaaaaacaagaaagaaaaagcaaaauacaagugcuugaaacacuguaacuacacaucagcaaaguucaucauuaccugccauaaaauaacaugguaaauucugcuggguuuuuuuuucuucuuuuaaauaagacaaagaugcaggauaguugcaggauagcugaaacuauaccauuaauuacggauaguggcagcaaggauugaaacaauuuguagaacccuggagaaguccccagacuuuccaaguauuugcauaaauauuuaguuauaucugacauaauuuacaugcauaugagcagucaaauuuuauuuuucauaagaauuuaaucuuuuuuuuuucccugcucuucucuacaaguuuaucuguguauaaauucucacuuaucagggccaggcacgguggcucacgccuguaaucccagcacuuugggaggccgaggccggcggaucacaaggucaggaguuugagaccagccagaccaacauggagaaacccugucucuaaaaaaaauacaaaaauuaacugggugcaguggugcacacccauagucccagcuacucuggaggcugaggcaggagaaucgcuugaaccugggaaguggagguugcagugagccaagacugcgccacuacacuccagccugggugacaaagugagacgccaucccccaaccaaaaaaaaaaaaaaaauucucaguuaucaagaaauucacuguuuuacagauccucugguuguaaaauaugcaggcuucaaaugcaaauaccacuacuuaucacucagaugaucaaaggacacacauuuacauaucuaagagaguucacuuucacuagggccaaaaauggaauuaauuuauacauguaagacagacugaaaacaaccuggaaauugucacuguuguuccauaauagaggaaacacgcuuguugaaaauuaaaugucccggcugggcgcaguggcucaugccuguaaucccagcacuuugggaggccgaggcggguggaucaccugaggucaggaguucguggccagcccggccaacaccgugaaaccacgucucuacuaaaaauacaaaaaauagcugggcgugguggcacgcgccuguagucccagcuacucaggaggcugaggcagaaaaauggcuugaaccugggaggcggagguugcagugagcccaaaucgcgccacugcacuccaguccgggugacagagugagacucugucucaaaaaaaaaaagaaaaauuaaauuaaauuaaaugucccguacuuugaaaggacuguacuccuaaauaaauugaacagcaccaccuucccaacaaacugcaaacuccaauaccuucucuccuguagucugugacucaccagucuuucaacuaagaaagaaaggacaaacaaccuaggaauuaaacaggauuagcagcuauuuugggaauuaagucucucacccuauuacucuucugaauauacucuugaaagccacuucaucaaguagaaauaaggcuugaaaagaaauuauagaacugcuugauucuaguguuuaaauuuuagcuuacaaaaugauccauugggggaagaauguaugcaucagagauauaagaagcuuaaaaaguuuucuugcuggaaaagaaggaauuacagaacagcuccagaagcugguucuacccuaacugccagcagcacucuuggcucuguaaggucucgugccacacaauggaugagucaucuaggucucugacuucaccugcccuuacuguaaccacacaggagcccugacaaucaaaguggcacuuugccuugguaacuggacacuguuuuucucagauaccuaucaugugaucaaaguauacuuauugacaugaaaagaugcucauaggauacuuuugaaugaagaaagcaaauuauaagacagcaugauccuauuuuaauuuuuuuuuagagacggggucucgcucugucacccaggcugaaaugcagugguguaaucauagcucacugcagcuguuugacuuccugggcucaagugauccucccaccucagccuccugaguagcuaggacuacagguguaugucagcaugccuggcauuuuuuuuuuuuuuuuuuuuuuugagacggagguucacucuuguugcacaggcuggagugcaauggcgugaucucggcucacugcaaccucggccuccuggauucaagcaauucucaugccucagccuccugaguagcugggauuacaggcaugugccaccauaccuggcuaauuuuguauuuuuaguagagacgggguuucuccauguuggucaggcuggucucgaacucccagccucaggugaucugccugccucggccucccaaagugcugggauuauaggcaugagccacugcgccuggccccaacugucucuuuaaaauguucauaacauuaucuuauuuuuaauuuauuauuuuucucaauuaaaaaaguaauaacuuauugggggaaaaacucucaaucaauauagaaauauguacccgacaugaauagaugcuguaauacaugccauuuucccuacuugacuccccaccucucccaaccuagauacccaguccugacaguuuauaugguauauauguugucuuuuuuucuauuuuguacacuauauguauuuuuuuguacaaaaucauacuguacuuacuguucuacacuuugcauuuaaucaccuaaugugcuuuugauaucuuuucaugcccauacaugaaaucuucaaucuuuuuuucuuuuugagacggagucucacucugucacccaggcuagaguguaguggcacgaucuugguucacugcaaccucugccucccaguuuccagcaguucucuugccucagccucucaaguagcugggcuuacaggaacauacuaccaugccggcuaauuuuaguguuauuaguagagacgggguuucaccauguuggccaggcugguccugaccucaggugaucuaccugccuuggccucccaaagugcugggauuauagguguaagccaccaugccuggccaaaaucuuaauaaccauauaguauauuauacuguaugugcaauuaccauucccccacugaugaauauauguauugcucaaaauuauuugccaacuguuuagauuacaauuuauaucucauuauuaauuuacauuuaucugaucaucagugaggcuaagcauguuuuuacacuguuacuucuuuguuaucuauuuuauuuauuuauuuacuuauuuauuuuugagacagguucuugcucuauugcccaugcuagagugcaguggcaugaucacggcucacugcagccuugaccuccugggcucaagugauccugccaccucugccucccaaguaucugggaccgcaggcccaugccaccacgcccagcuaaauuuuuaaaauuuuuauagagaggguucucacuauguugcccaggcucaaacucccaggcucaagugauccucccaccucggccucccaaaguguggggaucacaggugugagcuaccaugcccacccucuucuuuaaauaccuauucacguccacuuaccucaacugcuaaaagcacuggaggcuucugcuuuauuuuaucucacuauagcaucugacauuacugaccacucucccugguaaaaauugcuuccaacuuuucugugauaccccuuuuucuuagauuucuucccauuuugagaugcaagaaggguguagaaaaaaacaauaaugaaaaaaagauuucacugggcgcaguggcucacaccuguaguccuggcacuuugggaggccgaggcgggcggaucacaaggucaagagauugagaccauccuggccaacauggugaaacccugucucuacuacaaauacaaaaauuaggugggcgugguggcgugcgccuguaauccuagcuacucgggaggcugaggcaggagaaucgcuugaacccgggaggcggagguugcagugagcugcgaucaugccacugcacuccagccuggcgaaagagcaagauuccauaugaaaaaaaaaaaaaaagauuucuucucauuuaucuggccacuacucaguuucauaauuuaguaauucuuuuucuuuuuuuuuuuuuuuuacagguuucuccuccucugucccucccuuauaugguggggucccucaggguuuuugucuuagguccucugcuuugcuuacuuuacauauucucuguauaugauguuauucaucccgauuucacccaccauauagauuauaguaucaacaaauacauagauagauguauacuguguaucuauauagacagaguuauagaacuuaucucuagauagacaucucuccuuuucuaccaauucuaccuggaagugcuagaggcaucuuaaacuccuucuugauuaagguugaagucuucacuuucuuuuuucuuuucuuuuuuuuuuuuuuuuuuugagauggagucuugcucugucacccaggcuggagugcaguggugcaaucuuggcucaccacagccucugccuccuggguucaagcaauucuccugccucagucucccgaguagcugggauuacaggcgugagccaccaagcccggcuaauuuuuuguauuuuuaguagagaugggguuucaccauguuggcuaagcuggucucgaacuccugaccucaggugauccacccgccucagccgggauuacagaugugagccaccgugccaggcccgaagucuucccuuuacuccucacucucuaaccuguuucuuuucuugaauugucuaucuuggugaaugcgacaaccaucuuuucaucugucaaguaggccuguucucuuaugccuucaugcugugcgugugcugcuuccuccaucuagaauacaaagauucugccacucccugucgccucugcuuagcuaauuccucuugguccuuuaggguugagucaggcacugccucuucugggaagccuuucuagauguagcacaguucagaucccuccuaaauucucccccagcccacucugaguauuuauuugauaugguaauuuuuuuuuucuuuuuuuuuuuuuugagacggagucucgcucugucacccaggcuggaguguggagugcaguggcgcggucuuggcucacugcaagcuccgccuccuggguucaugccauucuccugccucagccucccgaguagcuaggacuacaggcgcccgccaccgugcccggcuaauuuuuguauuuuuaguagagacgggguuucaccguguuagccaggauggucucgaucuccugaccuugugauccgcccgccucggccucccaaagugcugggauuacaggcuugagccaccgcgccgggccugauaugguacuuaucacaccuggguuguaauucuauuuuccaaauucuaaacagucccuuuggagguagagaauacaucuuauucuucuugugucuucaggagcuggaacauaagagaugcuccacauaugauugucuauacucguggggucaacuucucuuaacccacugucuugaaccuaguccaauucaggccucuauucuaccacucccaaacaacacaagaugaccaaugaccuucauguugccaaauccgauggucaauucucagcuuaccuguguguuugauucuguuaacuccccuucuagaaacacuuucuucacucggcuucuggcacuuguuuccucugcugguuacuccuuauaucuccaaccuuuaaacaccaaggugccccugagcuaagucaugagaccacuucucugucuacacucacuuccuagcuuauaucaugcaccucauagcuuuaaguaccacugacacuuugacacauguccauuuuauccgcagcggggaucucuuccaauucuagauuuuuauauaguauccaaguuccuacugacauuuccauuuggaugucuuaauaaaacauguuacaguuuacaugugcaaaacugagcuucuacuauuucucccucucuaaucugcuuuuacuguagucuuccccaucucaauuaaugguauuuuaauuuaauuguguuugggccaaaaacauuguugcuauucuuuuauuuuuuacuuuuuguaauagagauggggucugcuauauugcccaggcugaucuugaacuccugaccucaagugauccuucugccuugaccucccaaaguucugggauuacaggcacaagccacuguggcagagccacugcugccauucuugauucuucuuucucucuacauucaacauacauccugaccacuucucaacaccuauacugcuacuacucuaguccaaaccauauuauaccuggccuaaaucauuauaauugucucuuaauuggucuccaugcuccugccauuauuguuccucuacauucucuuccuucuauuuuuuuacauuuaaaaaauagagauacagggucucacuagguugcccaggcuagucuugaacuccuggccucaagcaauccucccaccucggccuccugcgauccucccgccuuggccuccuaaagugcugggauuagagccuucucuucagccauaaaaaaggaugaguucauguccuuugcagggacauggaugaagcuggaaaccaucauucucagcaaacuaucgcaaggacaaaaaaccaaacaccgcauguucuuacucacaggugggaauugaacaaugagaacacuuggacacaggaaggggaacaucacacacacgggggccuguugugggguggggagagcggggagggauagcauuaggagauauaccuaauguaaaugacgaguuaaugggugcagcacaccaacauggcacauguauacauauguaacaaaccugcauguugugcacauguacccuagaacuuaaaguauaauaauaaaaaaagaaaaaaaaauuuaagucagaccacaucacuccuuugcauauaaacccucuccaaaggccuccuugcauucagaguuaaagcccaggucuuuacaaugacaccauuugaccuuucucuucuauuccucaaacacaccaagacuguucuugccugaggacauccgcacaagcgguuccuucugccugacucuucucccuggcucaugucuucaaaucucugcucaaacguuuccucaccacaggccuucauugaccacccuagacucuauccuccuuaccugccucaugcuguuccacagcacuaaucacuacugacacaauuucuuuuuuaaauuuuuuuauuuuuuuugagacggggucucacucugucgcccaggcuggagugcaguggugcuaucucggcuuacugcaaucucugccucccggguucaagugauucuccuggcucagccuccagaguagcugggacuacaggcaugugccaacacacucagcuaauuuuuguauuuuuaguggagacaagguuucaccaucuuggccagguuggucucccaacuccuaacuucaggugaucugccugccucggccucccaaagugcugggauuauaggcgugagccaccgcgcccagccauacugacacaauuucuuuauugucugucuuuugcacuagaauguaaauuccacgagggcugggauguagucugugcuuggcauguaguaggugcucagugaaaacuuguuaaauggaugacagugaagggaaggaagaaagaaaggagcaaguugggggaaaaacagaggcaagagggaaggaagaaaagaaaccagcaguugaguaaaguaaugguaguuuuuucuuuuuuucuuuuucuuuuuuuuugagacagagucucgcucuggcugacugcagagucaagcuggagugcaguugcgugaucucggcucacugcaagcuccgccucccagguucacgccauucuccugccucagccucccgaguagcugggacuacaggcgcccgccaccacgcccggcuaauuuuuuuguauuuuuaguacagacgggguuucaccguguuagccaggauggucucgaucucuugaccucgugaucugcccgccucggucucccaaagugcugggauuacaggcgugagccaccgcacccggccaguuuuuucuuauaaugcaccagaggagacccauuuuuuaauuacaggaaaaugaagccaaggaccuuagccuuagaacaaauuuacaggaacauauuaugcacuaauuuaaauagguuagcuacugaaaacugccaggaggauguuuuuguaaugccauccgaauuaaggaauuauugaccaaacauaugaguuuuuuuccucacaagauuaaaucaaguaaaauuucaaaagacauguauuauucagccucaccggaaguuagcaagcacggagacuagagaacggguagaagcagagaguuuauucuggagguuuuugucuuugguagauccugcagcuaggaaacuugcuaacuagauugggucaagaaguuugcuuuaaacaaaaaacccagaagaugacaacagcugcacagcuacuaccauuuaaaugcacagauguagaaguucugauugucugauuuggaaaaaaggaagaccaccuaggaaacccuguguucucauuugaguagaagccauuuuacuaaccucaggcaagcauuuggccucuuguccuucacucaacacaggaaagaaaaagugguucaaaaggagaaaagcagugaaaaaauaagauucccugcacuaagccaaguuguccugagcaaauggcucagagaucacaccagcuggcacaaauguccacucagcugacauagaacccaagccccacagaggcugcagguggcuuggccacacaauucugcucaagaagugccacaugcccuggaauuucugaauacuuacacuucucuucuucuccauguuuguuucuucagcugcuuucugguaccuucagagaagggaaggaaagaaugucucaaauuaaacuuauauuuuuacucuuucaauuuuuuaucuuuuuuugagaugaagucucacgcuuauugcccaggcugcagugcaguggugcgaucucggcucacugcaacuucuaccucccggguucgagugauucuccugucucagccuccagaacagcugggauuacaggcacccaccaccaugcccagcuaauuuuuguaguuuuaguagagaugggguuuuaccauguuggccaggcuggucucgaacuccugaccucaagugauccaccugccucggccucccaaagugagugcccagcuuuuuuuuuuuuuuuuuuuuuuuugagauagggucucacucuguugcucaggcuggaauccagugguacaaccaugguucaucaugguucacugcagccuugaccucccgggcucaagcaaaccuccugucucagccuccugaguggcugggacuauguaagugcacaccaccacaccuggcuuaauuuuuuuauuuuuguagagauggggucuugccauguugccuaggcuggucucaaacuccugagcuaaagugauccucaugcuucagccuccuaaaguauugagauuacaggcaugagccaccagcccggcuacuuucuuuuuucuuuuuuuuuuuuuugagaugggauuucccucuguuacccaggcugaaguucaguagcgugaucuugucacacugcaaccuccgccuccagggcucaagugaucccaccaccucauccuccugaguagcugggaccacagaugcacaccaccacaccuggcuaauuuuguauuuuucguagagacaggguuucaccauguugaccaggccagucucaaacuccugaguuuaagugaucugcuggccucagccuccccaaaugcugggauuacaggcaugagccaccaggcccagccccccagccacuuuuaaucuuuaagaaaaccaguucugggcugggugaaguggcucaugccuguaaucccagcacuucagaggccgagguggguggaucgccugaggucaggaguucaagaccagccuggccagcauggugaaaccccaccucuacuaaaaauacaaaaaucagccaggcauaguggcgcacaccuauaaucccagcuacucggggggcugagggacgagaaucgccucaacccaggaggcggagguugcagugagcugagaucacgccacugcacucuagccuaggugacggagcgagauucaaaacaaacaaacccaaaaaaacagucugcauaccuauuucugccagcaguugcuuuuaaucaacucuaucagaagaagcuguaaaucagagcagaccucacuuccugcagcuauuccagucaucugcucugauauaacaacaagauccccguggauaaggucaaaugcugaaacaauuggauagagcagaaagucuaggcuuuaagccccaguuuugcugcuuauuaacugugaucucuggcaagugacuuaaucucucuaagccucaguuuccuuaucuagaaagaaguuacaaucuacuuucaggauugccaggaagauuaaauguaaucauguguaaaaacauuuugaaauuaguuaaguccauacagcaaugcauuaauuccaacauauacauuuccccucccauauuuaugccugauaucuuacaauuguucucagccaaaugguugagagauagucacauugccuguacauguugaauuuaguguaaguuauugauauugucauuuuaacucaguuaaaaguauuugaugguacuacaugguuuuguuuuguuugagacagaguuucgcucuuguugcccaggcuggagugcaauggcacaaucucggcucacugcaaucuccgccucccggguucaagcauucuccuaccccagccucucaaguagcuaagauuacaggcaugugccaccaugcccggcuaauuuuuguauuuuuuacuaaagacaggguuucaccauguuggccaggcugguguugaacucuugaccucaugugauccaccugccucagccuuccaaagugcugggauuaaaggcuugagccacagcacacagcuauuauuauauguuuuaaaugccacuuaaaaaugucuuuuaaaagaucauacuauguuuggcauuuaaggaaaaauuauuuuacauaugcacaagagugauaugugagaaaaguuuguaauaagcagugauuaguuuaaucagcauuuuuucuuagagaugcaaaaauaguggcacagcuauaguugaugacaucuuagauuucauaaauaauuauuuguuauuacuuuuaucauuuugucauuuuuauuacuuggauuggaagaccucugagaaaaaaauuaaaguucuuuucaaggaggaacagguuuucuccauuuaaagacuaagugguccggagauuugugcagguacaagcugcacaaaucuccagaccacccagaacaaccuuuuuuuuuuuuuuugagacagagucuugcucuguugcccaggcuggagugcaguggcacgaucucagcuagcugcaaccuccgcuuccuggguucaagugauucucaucccucggccucccaaguagcugggauuacaggcaugccccaccacaccuggcuaauuuuugcauuuuuaguagagacaggguuucaccauguuggccaggcuugucucgaacuccuggccucaagagauacgccugcuuuggucucucaaacugcugagauuacaggcaugagccaccaugccuggcccuagaacaaccuuaaccuggcuuccuccagaccucugagucaugcauugaagucagcaccaccacguggagaaucaccauuaugugccucuccuugggccugccuuagcagaacucagccccaccccuagaaaagggcacuguccucugccuaaagguagaauuucagaauucaugaggcauuuggaguaggagguaaaagaagaagaaaaaaagcagccucaggccuggugcaguggcucacaccuguaaucccagcacuuugggaggccgagcugggcggaucgcuugaacccaggaguucgagaccagacugcgcaacacaguaaaacccugucucuacgaaaaauacaaaaauuagccagguguggugcacgccugcagucccagcuaccggggaggcugagauaggaggauuccuugagccagggagguugaggcugcagcgagcuacgaucaugccacuguacucuagccugagcuacagaguaagacccuguagcuugccuugaccuccaggacucaagcaauucuccuaccucagccuugcaagaagcugggucuaaagacgucuaccaucacacccgacuaauuuaaaaaaauuuuuuuuaguauagggucacgcuauguugcccaagcuggucucaaacuccugagcucaagugauccuccugucucagccuuucaaaguguugaaauuacaggcaugagccaccaugcccagccaagaaagaguauuacauaaagggucuuccaauccuaucacuuuuuuuuuuuuuuuuuuuuuuugagaaggaguccugcucagucuccuaggcuggaguauagugguguaaucucggcucacugcaaccucugucucccggguucaagugauucuccugaguagcugggauuacaggugugcaccgcuaugcccggcuaauuuuuguuuuuuuacuagagacggguuucaccaaguuugccacgcuggucucgaacuccugaccucaagugauccaccagccuuggccucccaaagugcugggauuacagguguaagccaccgugcccagcccccaauccuaucacugucuaauuuuaauaaucagauauuaacaagcaucucagucgccauguaguacugcucugcaauugagcagaacucucuaaugggguaggguaaaagggcuaccaaaaauuucuggcacuucguugaccauaacuaggaagaaagugggauuagaacugcugugauucaauugacaagcugaaaauauauuugcaacuuauauuacagacaaaaaauuaauuucccuagaauauaaauaacuacuaauaagcaggaaaaugacaacugaauaaauaaaaaggcagauauaaacauacuguucacggcugggugcggugucucaugccugugaucccagcacuucgggagauggagguggguggaucaccugaggucaggaguuggaaaccagccccgccaaccuggcaaaacccugucucuacuaaacauacaaaaauuagccaggcauggugguaggcaccugaaauuccagcuacuagagagacugaggcacgagaaucgccugaacccgggagguggagguugcagugagccgagauugcaccacugcacucuggccugggugacagagccagacuccaucucaaaaaaaacaaaaacauacaguucacaaaaagaacaucucaugacucuuaaacagaaaagauguucaaccucaaaaugcaaauucaaacaaugcuaacaacauuuuaccuauuaaguaggaaaauauuuuuuuuucuuuuuuuuuuuuuuugacauggagucucacucugucgcccaggcuggagugcaguggcgugaucucggcucacugcaacgucugccucccagguucaagugauucuccugccucagccucccaaguagcugggauuacaggcacgcaccaccacacccggauaagcuuuuuguauuuuuaguagagaugagguuucaccauguuggccagacuggucuccaacuccugaccucagguguccgccugccucagccucccaaagugcugggauuacaggcgugagccaccgcacccggccggaaaagauuuucuuaaaaagcuaauaugcaggggguucccuuucucggcuuggaguccuucucccucugucucuguauggggaagcugcuucuuccgucuuucuugccuauuaaagacucucugcuccuuaaaaccacacacacacacacacacacgcacacgcacacagcuaauaagcuaauaugcaguuggguuggguagcucaugcuuguaaucccaguaaucccagcgcuuugggaaguggaggcgauaggauugcuugaggucaggaguucgaggcugccgugggcugucauuguaccaccgaacuucuguuuaaaacaaauaaacaaacaaaaaaggcuaauaugggacauuggugaggguauggggaaacagguucugucuuacauugcuggugggaagguaaauugguaaaaccuuuauagaaggcauuuugucuaugccuucuuuaauaucugccaaaauuauaaaagcacaaauguuauaauuuaccaauucuuucugcucccagaauuuguccuauagauacacuaaaaaaagauuuuaauauuggauuauuuaucauagcauuaaauauaacagcaaaagacugagaacaaccugaauguccguuagcagaggagugguaaauuauaauguauauguauaaugaaauacugugcagcaacaaaaggacaaagggaaggugguagugauuguacaauaauaugaauguacuuaaugccacugaacuguguucuuaaaagugguuggccaggugcaguggcucacgccuguaaucccagcacuuugggaggccaaggcgggcggaucuccugaggucaggaguuuaaggccagccuggccaacauggugaaaccccaucucuacuaaaaauauaaagauuagcugggcaugguggcucaugccuguagucccagcaacucgagcggcugaggcacgagaauccuuugaaucugggagguggagguugcaguaagcugagaucacaccaccgcacuccagccugggcaacagagugagacucggucucaaaaaaaaaagaaaaaaagugguuaaaaugguaaauuuuauguuauauacuguguauuuuaccacaguuaaaacaaaacaguaugauacuggcauaaagacagauauacagaccaauggaacagaacacacagcccagaaauaaacccuuacauguauggucagauaauuuuuugacaagggugccaagaccauccaguggggaaaggaaaaucuuuucaacaaauggugcuaggaaaacuggauagccacaugcaaaaaaaugaaauuggacuaccauauacaaaaauuaagucaaauggaucaaagaccuaacuauaagagcugaaacuauaaaacucuugguugaaacauaugggaaaagucucaugacacuggauuuggcaaugauuuuuugaaauuuauuuuuugucguuuuucuuucuuauucuuguuuuucuuauuuuuucaucuuauuuuaauuuuuuauuaucuuuugaucaucucaucauuacaagauuugguaaugccuuauuggaauacaacaccaaaagcacaggcacaaaagaaaaaacaaacuagacuucaguaaaauuaaaaacuuuucugaggcuuggcaugguggcucacaccuguaaucucagcacuuugggaggccaaggugggcggaucaugugaggucaggaguucaagaccagccuggccaacaugacgaaaccuugucucuacuaaaaauacaaaaauuagccaggugugguggugggcaccuauaauccccgcuacuugggaggcugaggcuggugaaucauuugaacccaggagguggagauugcagugagccgagauugcgccacugcacuccagcccuggcgacaaagcaagacucugucucaaaaaaaacaaaacaaaacaaacaaaaaaagacaaaaaaaacuuuugcgcaucaaagaacacuaucaacaagccgggugcaguggcucaugacuguaaucccagcacuuuggcaggccgaggcagguggaucacuugaggucagucaagacuggccaacaugguaaaaccccgucucuacuaaaaauauaaaaauuagcuggguguggugguggguaccuguaaucccagcuauugaggaggcugaggcaggagaaucgcuugaaccugguagguggagguugcagugagcugagauugcaccacugcacuccagccugggcgacagagcgaggcucugucucacgaagaaaaaaaaaaucaugaagaaaaaaaaaaagaacauuaucaacaaagugaaaaguucccauggagugggagaaaauauuugcaacucauauuugaguuuuaaguaacaaaaaugagauaaugugauacauacuauucugcuucucccuuucuccauuucagagagaaauucagagaagcugacauuuucauucgagaaauacuuauugcugucuacuauguuccaagcacuagagaaaaaguaacgaaagaaauaaccaaaacagacauaauaucugcucuccgaugcuuacaauuuagacacuaaaaacagaagcacacaaauauacauacacauacacacacacagagugguaaguccuuugaaaaaaaagaacaggguauuauuaaauaacaaaggaacacaauugagaaaggaagaggaaaucaaggaaagccucacuuauauuaauuagccugauuugauaauucuacaauguauucauguauuaaaacaucacauuggcuggaugugguaguucaugccuguaaucccagcacuuugggaggcugagucgaguagaucacuugaggccaggaguuaagacuggccugggcaacauggagaaaccucgucucuauuaaaaagacaaaaauuagccaccaggcacguuggugcacaccuguaguuucagcuacucggagacugaggugggaggaucgcuugaaccugggaagaggaaguugcagugagccaagauagcaccaccacacuccagccugggugauaaagcgagacucugucucaaaaaacaaacaaaaaaccaucacauuggaccccauacauauguaaaauuauucuuugucagcuaaaaacaaauggaugaguacgauggcucaagccugugaucccagcacuuugggaggccaaggcaggccaaucacuugagcccgggaguuugagaaaagccuaggcaacauggcgagaccccaucucuuaaaaaaaaaauaacuagcagggcuugguggcaugcgccuguagucccaguuacucaggaagcugaggugggaggaucaccugagcccaggaauuugaggaugcagugugccgugauggcgccacugcacuccagccugggcaacagagugagacucuaucucaaaauaacauaacauaacauaacauaacauaacauaacauaacauaacauaacauaacauaacauaaaauaaaaaauuuuuaaaaggagcgccucacugagaaaaugaccuguaggcugagaugugaaguuugaccagaugaaguuagccagacaaaaggaagggaggaaagcauaccaggaacagaaaaacaccaugcauaaaggccucaaggcaagaaagugucucauguauauagggugcacaaagaacucuaguguugcagaagcucacugagaggggaaagggcaggcaaugaggcgggaggcagggaugggccaugcagguaaugcuaaggacuuugaauuuaaugguaggauggucacugauucaauucguguuuuuaaagagugcucuggaguguggagaauggacuggaggggcugagaauggagguggcauuaaugagagauaaugcuggcugggcugcagagauaauggcacuagagauaaagaaaagugaauagauuugagauauauuucgagaaagaaucaguaggguaguaaucagauggggaagagagaaugauuccuagguuucuggcagcugagucaauggaaguaaugcuuccugggacgaggaauugugaaagaagagcaaauuuggaaacggggaagaucaagaguucaaugcuagccauguuaacuaaaacauccauuuggugguagcagugaugagaugcauguguccggagcucagaagaaagcucugagcuaguuguaugcauuuagaacuugcgugcccauggaugguauuaaagccacaggaguagaugacaucugcaagcaguguguagugugagaagaugccuggaacucaguccuggagacucgaacauuucagcagucagaacaaaugauaagagagacugacaaggaagagagagagagggaggaagaaaaugaugagacugccagagaagccaagagaagcaaaaaugugggagggaaaaaguggugagaguucauguaagauaaaggccaagaaacaucccuuugauuuagcaacauggaaguguuugguaaucuugacaauccucucucauuauaauuaauucacccauauuccuuuaaugggcauuuggauuguuuccaguuuuucaccauugcaaauaacgcuuuggggaauguccuuuuacguauauuuuucccacuuguacuaauauaucugucuaagagauucccuaaaagugagaauucagggauacaguggauuguagcuauuauaaaaaggaacuuagaacuggccuugaacuugcguuuccacaccccuuggauaaucaucuacaguauauuacagcaauaauacaauauaugaaaacuagaaccaauuggcagacagguuuauauuuagccaacuguucuccaaggcaagguauuuacauugugguuaguugaguaaauaagcucagagguucccuucccuuuagugucuaauagaaacauagauuaaaaaaaaaucaaaauaguucccaucuuuagccuuguccuuuuagcauggaggcaucuguaagaccagguguauacaccaaaggcugucuuuaauccuguucucaaaccccuacucaaauaucuccaccuuuuauuuguaaugaaguuccugcuaaauaguagauaacagggagaaaggcucuacaccaccucuuucuuccaaguuagaucccugguacuuuuauauuuuguacucuuagauugccacaagacugaggcucaauacuucugaauuccguguucaggccucagacuuuucucagaggcccuuacagcaacuagcauucuucugacacaaaaugugaaggacacaaaaugggggcaccauuuugaagauccaaauuugagaaaauaaaacauuuacaauaaaauuucuguaauuaaaauuuuguuccucuuuccuucccagauuuuuuuuuuuuuuuuuuuuuuuuuuuuuuuuuuuuuuugcgguccagccuccuuuucuuuacauaaggaauuuaaucuugcaacagcucacuaaugcucagcuguggggcaggcagcugauggaggacgcuaaaauuaucuggggaguaauaacagugucucaaauuuuucuagggccagaaaacagaguuccugagccaugacucuugcuuguaugcccucaaauagagcaaagggaaugcugagccaaaaagggaaaacagaaacucccaagguuuaagcaauguauuuucuucuggaaaaauuucaccacuaaaauguuacagagaagcgaaagaagaggaaguuaaccaggcugacuugaaggucaauuuuuuucuuauugaaggaagaauagucacagaaaacuaaauaugaacgcucuuuguuuuuuuuuuuuaagauagguucucacucugucacccaggcuggaaggcaguggugcaaucauaguucacugcagccuugagcuucuggacucaagugauccucucuacccggccuccuccuguuuccuggaacuaggaauggguaaaguuauaacaaaaacaggagaagcugugauaagguagaggcaugcuggcaggggguuagguuagggaucuucaugcugugaucaucaauucuaccaucuugguguaugaccuucagucauaauugcuaauccucaagcuccuaaucugucaaaggaauagggcaaaugcuagccagaccagugguuucaagcucugcuagcugcagaacccucucuucaaaugcugucuuacgcagaaccuaaccuuuacaagggaucaaagcaggauugcuggaauggaaaaucuaaagagcugggccugggaucugggacugggaucugggccugggaucugggcuuggguuuagcccuuaggguguuccaguuguuggagaacuggcccugagauuccucugaagacuucaauuaagauaguuuaaaaacuaccaggcuagauucucuuuaauuccaaaaauguaugagucaaacaaauuccacccaaagagucaacuguuaucaaaugaaggaucauauuaugcugaagucaguggugagugaaaccaaagcuagcuauucaaauggauguaucaauaggaacuucuuaccucaaauuuaacgacuguuauagaggcuuagucagagaaauaagccugcagcuauaaaggaccaugggacacaagcucugaugcuagaaaaaguacucuucuauacauauaaacacaaaaugcacuguuaacaauuagaaaguaaagcugacuuaucuacaaacaucagcuagauuaagcuuccuccaaacaacaauuucauauuaaucucugaucagagaccuccuaaguuuuccuacuguuuuuagcuaggcuuguauaggacucacuauuugcaaaccccauaaauauaaagccacuagguguuggaaacagacauuaguauaugcuuuguggaaaauaguccuguagucuacagccauaccacccucaacgcgccugaucucaacugaucucggaaaauaguccugcagucuucuuugggaagcugcagugagugaaccuuacaaaccuuaaguaauauuagcaacguguuuccacugaguauaaaaccuagaacagaaauccaggcugauucccugguuuucacuccuuucaguauauaccaccaccuguccuacuucuaugccuuuaccuccuguugcuccccuuccucuggaaugucuucagcauucuccaagccuaccaaauaacucuauucaucuuuccaaaccaguuccauguguuaagcacaucagaagaaaaauaugugacaggaacaaacucaaauauuaacuucagcagguuacuuccuuuaccucaguuuucucaacuauaaaagagggguaaagccccuuccucauauaguuuuuguuaggauucaaaauaguauauauuuuauauauuucuuuuuuuuuuucugagacggagucucacucuguugcccaggcuggagugcaguggcaugaucuuggcucaccacaaccuccgccucccaggcuccagugauucuuccaccucagccucccaaguagcugggauuacaggcacgcaccaccaccgcccagcuaaauuuuuguauuuuuuuguauuauuauuauuuuuugagacagagucucgcucuguagcccaggcuggagugcaguggcgugaucucggcucacugcaaccuccgccccccaggucccaguuaagcaauucuccugccucagccucccgaguagcugggauuacaggcaugggccacgaugcccagcuaauuuuuguauuuuuuaguagagauaggguuucaccacguuggccaggcuggucuugaacuccugaccucgugaucugcccgccucagccucccaaaguacugggauuacaggugugagccauugcgcccagccauuuuuuuguauuuuuaguagagaugggguuucaccauguugggcaggcuugucuugaacuccugaccucaaaugauccaccugccauggccucccaaagugcugagauuacaggcaugagccagcgugcccagccaaaauaguauguguuucuaucaagggucuagcauggugccuggcacacugauuguaauuaauggguucaggauugacaguuuugcaauccuuucagccuucauggagaaaagacagugaacccaguauaccaugagaaggaccugugagaucccucugcacuuucucucugcaagauuaagaaggcccuaaagaugaagccuuuuccaaccucuuaacucuccuuagugcuacuauaggacccaaauccuaaugagaacuggcugggcuggacaaugacagaauagaguggugagaaaggcacuggggaagaggugagagccucacugaagugacugagcugggcaaggaagaaagugaggccaggaaggggacugacauccagggcuggguguccuggugaggucaaaacacagggucacugggaauaagaguuaaacaaguggaaaaacagaaggcuccaaucaaacaguagguucuccaaaugcaucauuucagagaaggauucugagugauagguugagacgggaggcagaggcaugggagacaacaugcagguugcagaaacagggaagaucaagaaauuaugaguccagguugggcacagugguucacaccuguaaucccagcacuuugggaggcugaggcaggaggaucgcuugaauccaggaguucaagaccagccugggcaacauagugagacgcugucuuuacaaaaauaaaaaauuagacgggcaugguggugcaugccuguggucccagcuacuugggaggcugaggcaggaggacugcuugagccugggaggucgagucugcagugaaccauaauugcaccacugcacucuagccugggcgacagaguaugacccugucucaaaaaaaaaaaaaaaagagagagagagaaaaagaaaagaaauuaugagcccaaaguaucagacaggucacugauguggacccagugauccuuuaaugaggacaccauuggugccaauggcccugggggacauuuagacacauguguuagaaucuuguuggguuuucuccccuaucacuuuuuuuuuucuuuuuugguugucacaaugucauggguucauuuagaggagggcaugaugaugaauacccugcauggggaagaucugccuuaccccaaaugcuacagcacccccagugagaaacacuaaaaaaaaaaaaugaugcuagaagccagcguccccuggaggcuggcacgccacugcaaugaaggggaggauaacagugcauuauaguuagaugugagccugaaagcacaugucuagaacuucagaagcaggcaugagaaacaaugaaugggaaacauuauuggagauauagaagaguagcaacccuggcccccaaaauauuucagggaagcaugugcagaaggagcaggcagccaggccgggcgugguggcucacgccuguaaucccagcacuuugggaggucgaggugggcagaucaugaggucaggaguucaagaccagccugaccaauaugaugaaaucccaucucuacuaaaaauacaaaaauuagccgggcauggugacaugugccuguaaucccagcuacucgggaggcugaggcaggagaaucgcuugaacccaggaggcggagguugcagugagcugagauugcacuauugcacuccagucugggugacagagugagacuccaucucaaaaaaaaaaaaaaaaaaagaaagagcaggcagccacugcucaaacacagaaugcaugucaugcaugucaagggaaagccaaguuuaguuaaagacagguggggcuaaggagggugaaaaggguaagaacguggagaaguuucugugcaggacagggaguuuccaagucccauaaucacaucucaacaccgucugauauccuucccuuucucucuauuccuguucccccuugacccccaacagcuuucacuuggguucccaagagagccucauaaauugucuccauguuaccaaucucucaccuuucuaauauagcuuuacacuguugccagaaggcuuuuucuaaaauaccggucugaucaugucacucuccccacaugaaaaccaauugcguucccugguuuucuuacuaaauccuaaccuuagcagagcauccgaggucuuccaucuggcccuaaaugaauuacaccaguuccuucucccuucuguauuuuuccauggcagacugcuugcuuuccuauucccuuuauucguguucagcuuccauaauccuuugcuucaaucuccuaucuuagacucgacucauuccacuucaagcucacugcuuugacuccacaaguccaucccuuccacuaccagugcuucuuaaacuucccugaagguaaaaauuaccugggauacuuguuaaaaacauaauuuccuggacucuauccacacauacugaaucagaauauaggaugauuuuaaaacauguccaggccaggcacaguggugugugccuauagucccagcuacucagaaggcugaggugggaggauugcuugagcccaggaguuugaggcugcacugagcuguguggucacaccacugcacuccagccugggugacagagugaaacccugucucaacauuuuuuuuuuaauuaaaaaaauuuaaaauguccaaaaaauucugacauuccuccuaucagagaagguggagucaaauugcccuuccccgaaaugagucagcuuuagugacucacuucuaaugaagugaaugugguaaaagugauacuguaugacuuccgaggcuaggucauaaaaggcaacacaacuuugaacucccccuuuucuucccuccuucccucugucucuggaugauugcccugggaacugagccaccaagccaaacagccacauggaauggccauguguagguguuccuaccauggccccagcugagaucccagaugacagcaucaaccgccugacuugugagugagccagccuuuugaugauuacagcucccagccuuugggccacccuggcugaugcuaaguagagcagagauccugcccaaacuggagcuucaaaagcaaaauaaaugcuggaauuauuauuauuauuauuauuauuauuauuauuauuuaagacagagucucgcucuguugcccaggcuguagugcaguggcacgauuucagcuuacugcaaccuccgccuccuggguucaagcaauucuccugccucagccuccugagcagcugggacuacaguacaggcaugugccaccaugcucgacuaauauuuguauuuuuaguagagacaggguuucaccauguuggccaggcugaucuugaacuccugaccucaagugauccacccaccucggccucccaaagugcugggaucacaggcaugagccaccgcgccugaccggauguguucuaaugaaguuuuauuuacuaaucagcagccagugggcuguagugugccuguguagguuacacuuuucagcagaacuucgugcaaugaugaaauguuucugugcuguucaauacgacagucaccaacaaguaguuacugagcacuugaaaagugauaaaugcagcugguaaacauuuaaaacuaaauuuuaaauguuauuuaauuuuaauuaacuuaaacugaaauagccaccuauauaguggcuaccacauuggaaagugcagguauagagagugcuuaacgcaccauucaaccaaaucaaaacucgccucaacacucaucucaaccagaaagccuuccugaugagcuccugucugugaugcucugucucuuauucuguaccuaauccucacuccuauucauuuuagacuugcugauauuuugcuuuauaauuauuucauaauuaucuuuuuuaaaauaauuuuugugucuauaacuguuucuuccacaaacuaaacaaaaauucaaagaauagaauguaucuucugauuauuacccuccuccuccuucuccacaguaccucauauaguguuuaaaauccacgaggcgcccaauaaaauuauuuuacauuauguacuuccuucaccaauuucccugacagguggcaaugugugcuccagacagaugguccuuuuggaccaggaucagcacuuacuuggagaauauuuccacaauagccgaugacuuguucuuguugacaagagaaaguucuuuggcuguuacccucaaugauagugagguccauugccgucuauuaaauggagaugauuccaucuugucuacagacacugaaauaccuaugcaauaaagaaagucagaacauuagacacagaagaggauucuccaacauccaaggauuggcaguggugugguagagcccuaaacuugcagaccacacuccuccacuguucucccccaaacuguguaaccuuggucaaaugauccaauaucuuuggguugugguuucuuauaaaaggaggcuacaccagaugaccuuuaaggucccuuccaguuccauuuuaugacugaccccacugugcaaacaucaauuggccuuucccugaacugaagucuguuccaaagucacauuuggagugaaauguuucccucuucugaauuacaucccaggggagguacagucagcaucucaguagagccagguccaaauuaguuucuaccuacauucaaguuucuuuuggcugcccucucuccccaagcucugcagcacuggccacucagugccagggagagagcugggggcgcagcgugguguaauaggaagagcagggcuuuaaggugagacagacuucggggaaauccuaacuuuguuaccuugaacauauuauguaauauuuuccauuucacuuucuucagcuaaaaaauaaggauaauaucuaucuuuaggagguuuugauauagauuuaaggagauaauauauuuaaaauacuggguauauuacaguaguauuaagagcauuuuaaguauaauuauuaucauugacucuuguuauaauucucauuuuaaagccuuuaucaaggagaaguauaauguacuuuaaguucaggagacaaacccuauuuuccaacaucccuuucagccaaagaauacauaaagccauacccuugauaucaccuagucccuacccauuaaucuggaucguuugguuauuuugccccacuaauuaccaaaggaaaggaguuccaaccuuuguccagaagacgagagauuagaaaugagucaacaguuuccuuauuugaagagugaaaaauauaaaguaccacuuuguuucugauccaggagucuugaaaacuaaaaaaaaauaauaauaaaguacugcuaauucacagcuuaccagaaguaaaagaaaaauaaaguacuacuugcagcucuuggcaaccgaagagcauaacugaucugguugaauguaugguucaucagguacugcuuucaauaaccuugacaacuguagaacacagagaguauuuaaauccagcaacucaagcugccauuucacauuaaaaguccugggucaggcugggcaugguggcucaugccuguaaucucaacacuuugggaggccgagguggguggaucacuugaggucugaggucaggaguuuaggaccagccugaccaacauggugaaauccugucucuacugaaaacacaaaauuagccaggagugguagcgcaugccuauaaucccagcgacuugggaggcugaggcaggaaaauugcuugaggcagagguugcagggaaccgagaucacaccauugcacuccagcccaggcaacaaggacgaaacuccguuucaaaaaaaaaaaaaaaaaaaaaaagguccugggucagacauggugguucauaccuguaaucccagcacuuugggaggauagcuugaggccaggaguuugagaccagccuggguaacauagcaagacccccucuucucuacaaaaaauuaaaaauuagcugggcgugguggcacacaccuauaguccuagcuacuaggcccaggaguuggaggcuacaaugagcuaugaauugcgccacuggacuccagccugggugacagaccaagauguucucaaaaaaaaaaaaaaaaaaaaaaaaagucccgugaugcagaauaagcaauggacaauucuaaaagaccacacuacuacuguucuacauguaauauuuguucuuccaaugaaauccuugucggaaaauaauacuaguuuuguuaauauguuuuaauccucauguuggaaggcauaguaugcccuuuaaugguaaggagcucuggguuagagacagauaagucuaagugggaauguuggccucaucacuuaaugaaaaguuucccuaaaacuuggauuucucauccauaauaauagcauuuacuucacaguauucuuaugagaaauaaauaagauaaagaagaaaagacccugauacagaauaaguaagcaauaaauguuacuguuuaguguuuuuaauguuuucuuuucuuccugaacaaaauaaucuuaauucuauacauguacuuugcaauaaacuggaauguaccaaauaauacaugauaccuauuugucuaucugguauuaaacuggcagacucaccaaacaaugccagccccuucucuaagaugaaaaagacacagaagcaacaaacauuucagcuaaacuuaacuauauaaaacuaucauaguuuuuuuuaaacucuguaaggcaaguuaaggaaaugcuaaugaaugcuuuaagauauuauuugguagaaauauacuaccaauauaguuguggguauaaauacugucaguucuuccauaaagaucaacucuggaucaaaggggaaaaaauauauacaagauacauuugcaggccaggcacgguggcucacaccugcaaucccagcacuuugggaggccgaggcaggcagaucacuugaggucagguguccaagaccagccugaccaacauggugaaacccagacucuacuaaaaauacaaaaauuagccagguguggugguacaccccuguaaucccagcuacuugagaggcugaggcaggagaaucacuugaacccuggaggcagaggaugcagugagcugagaucaugccacugcacuccagccugggugacagagugaaugagacuccaccucaaaaaaaaaaaaaaaaaaagguauguuucuaaaaaaggaaaaggauuuauuauuugagauaccgagcacgauaaagaaaaaaaagguuaacucccaagucuaaguccgugguuuugauuacucccagccagaaaguuaagaaaagucagaacaucuauuuugguauacagcuaggagaggcacacaguucuuagaguucuuacacucagggaaugagaugacucucacccugaccacacuugucuucacagaagcauaauguuauuucuuagcaaugugauuaguaccuaugaaacagauaaacgugagaaucaauacaugauuuuugauagacucugguaccaggcuauugaauaacuacuucuuaugagauguagggagaugucccugccugaaugguguacauaaucuacugugcuugcugacauacacacaaauauuuauaguacaagacagaaugugguuagaggcuaugcgugguguaggaauacaagaccugauuuucuggcuuugugagagggaaaggaaaagauaucagaugacuugggacuuaaagaacgggcagaauuucaucaaagugaaggcaggaggaggaaggaggagaauagcauuagcaccuuuggggagugaguuaaacucuaggugcaagagaaguugaagauagacaagacuuggccaggugugguggcucacgccuauaaucccagcacuuugggaggcugaggcaggcggaucaccugaggucaggaguuugagaccagccugcccaagauggccaaaccccaucucuacuaaaaauacaaaaaauuagcugggcgugguggcacgcgccuguaaucccagcugcucggaaggcugaggcaagagacucucucgaaccugggaggcggagguugcagugagccgagauugcaccacuguacuccagccugggugacaagagcgaaacugucucaaaaaaaaaaaaaaaaaaaaaaagacauaauggggccugacugggaagaaaaccaugcuaaggaguuugggccauauuucaauagugggaagaaguaacccaugagugaucagagauuaggucuaaucuuaugugcuauuuacuuagcacaugcaugguuuuuauaacaaaaaaaguuucugauccucaauauccacaccuguaagauaagaucucuguaguggauuaaccacagucucucugguggaacacagaaaguuucugaaaaagcauguaacaugacuaacaucauauuuuaaaauauuauucagcaguagugugcaacuugcuaagagggaaaaagacuggagucuaaauuacuagucaagaagauccugaaacuaagugagagguaaucaagguuuaaauucguaaauuaauuaggguagguggaaauggaaaagugggaagagagaaauugacaguucuuagaauaaaaugaacuuaggguaaaagagaaucaaagcuggcaucaucaaacccgaaugauggaaggcuguugauuccauuaacagagacaguaaauauagaaagaagagggaaaaugaugaguguugauuuacacauguugagacauacaugucagcaagagaaauccaaaugauauacaauaggaaacuacaaauucaaagcuaaaguuagaaauccgacucuuggaagauuuuaagacacuaacuuuaugcuuugcauauaucucaauccucacaaucauucuacaggauugguuuuauugucuuauauuuaugguaacgaaauugagauucagacauauuaacuuuacaaagaucacuuagcuauaaaguagcagagcugggauucaaacgcauauucuguuugauuccaaaguccauuuucuuucaacuacaauuaaugaagaaugauuaaaaccgccacuuuuagccaauguagaaaaccagcuagaaaaaucccugaaccaccuagcugaaaacccauacaaauuauuuuucaguaagagaauaguggugaguaucuucccagaguggugaauaucagagauaaucauuccugcuuucagggaaacuuaaaaguuauccugggcucacuuggaauacccuccauuguaguaacuggcuuucauuggccugcauuaaaggugugguauuggggccagcaugguggcucacgccuguaaucccagcacuuugggaggcugaggcaggcggaucaccugaggucaggaguuccggacccagucuggccaauguagcaaaauccugucuuuacuaaacauacaaaaaauuagccaggcaugguggcaggcgccuguaaucccagcuacuugggaggcugaggcaggacaacugcuugaacccgggaagcagagguugcagugagucgagaucaugccauugcacuccagccugggcgacagagcgagacucugucucaaaaaaaaaaaaaaaaaaaagaaagguauauuaucucuccccacccacacagucucucucagauaugaguuccauuuucagacuuucagacuccaaaacccauucucuucagucauaugcauucuacuaccacaugaacugugaaggaagaacugcuggauuggaagacaguuggcugcaagaguuaaaggaaacauauaacaaaaauaaacacagauuuuuagcuucagagacuagaaggaucguugcaugacaaauaaaugguauacauagaaaggggaacaguuugcugagaaggaagaugccuucaguuucagauacaaauggcagauuuuuuucauuaagaaaguagcuuggaaaucaaguaaccaaauccccuuuuuuacagugaggaaacugagaugcauaaagcuccaaucauuuuccaaagucaccagcugguuaguauuagagcuagaguucuaacucccaggaucaauguucuuuuaucaaaccagguagcuugagaugggccacuaaauuguccuaggguaggguaagcuguagcuuggagauaaagaucucucgaacaaagguccuugaaaaguugaagagugacucacugggaaaucugccccagguaucugcuuccucaagcuguugcuuacggugaggccgguaacugcuccaagaaaccuauucuaauaaauucauuuacagacucuccugaccaaggaaacugucucucagaaaccaggcuuggacaaaaacagccgggcgcgguggcuuaugccuguaaucccagcacucugggaggcuuaggugaguggaucacuuaaguucaggaguucgaggccagccuggccaacaugguaaaacccugucucuacuaaaaauacaaaaauuagccaggcgugguggugcaugccuguaauuccagcuacucgggagggugaggcagaagaaaaauugugucacugcacuccagccugggcaacagcacaagacucugucucaaaacaaaaccaaaaaaaacaaaacaaaaaaaaaccaccaaaccaaaccaaaaaauaaaugagcuggcccugcaaccagcccuccccaagccacuaauaaaauccuguucuuauauauccgaucucaguggccuccucucuuuuuuuucuccugagaugguuacuuauucaagcuguauggcuuccugaacauagccucaaaaaauuagaacaaaguaaaaacuacaaacucacuuaugaagaaaaaaugggccacaugugguggcucaugccuguaaucccagcacuuugggaggccgaggcaggcagaucacaugagcucaggaguuugagaccagccugggcaacauggugaaacccugucucuacaaagaaaaaauacagaaaacuaucuggccaugguggugugucuguggucccagcuacucaagaggcugaggugggucacuugagccuagagguuaagguugcagugagccgugaucacaccacuguacucaaccuggacuauagagccagacccugucaaaaaaaaaaaaagaaaagaaaagaaaaaaaaaaguaaagaaaagaaagaaaagaaaggaaagaaagaaaagaaaaacauuauuuuuaagaaauagauuguagaguuuuaguuuuucuaccaaccucucuucccaauuugaaugucaucagguaaaagggagcaauuaaaagaaaaaaaaaaacuaaaaaacuucaaguugcaaagggaauuuuaaauaaaagcaacaugaaauacauugcuacauaauguuuuuucagaaaauuacauuucuaaauuuauauuucuguacaaaaauagugacuaaauucacauucuugaacauuuuuuggaaguuaauaguuauuuauuuuuuuuuugagauggagucucacucugucgcccaggcuagagugcaguggcgcaaucucggcucacugcaaccuccgccucccagguucaagcaauuguccugccucagccuccuggguagcugugauuacaggcaugugccaccacacucggcuaauuuuuuuuuuuguauuuuuaguagagaugggguuucaccauguuggucaggcuggucuugaacuccugaccucaugauccgcccgccucggccuuccaaagugcugggauuacaggcgugagccaccgugccuggcuggaaguuaauaguucuuuaaccuuuuuuuuuuaaacuuuuuuuuuuaaacauggacugcuucacaaauuuguguguuaacuucacacagggaccaugcuaaucuucucuguaucauuucaacuuuaguauauguaugacugaagugagcacucaccuuuuauucugaaacaauuucauacauaagaguugcaaaaacaguacaagaguucccauauacauuucaccuagcuuuaucuuauauuaccauaguacaauuagcaaaacuaagaaaugagcacugguacaauacuauuaacuauagacuuuauugaaauuccaccaguuuuuuaauuaacgucuuauuucuguuucaggaucauacacugcauuuaguugucgugucuuccuaagucuaccccaaucuaugacaguuacucugcuuuuccuugucuuucaugaccucgauauuguugaaaguauuggucagauauuauguagaauguuccucaauuuggguuucuugguuucuccaauaaaauagaaucaagacuccuuggagaagcgguugauuccagagcuggggaagggcaaauacaagaucagccuggaacaucuugcaauacucaaaagacaaaacaaaaaaaaguuuuuuuaaaaaacaugauauuuucucagauuagauugagauuauaaauguuugaaaggaauaauccagaguugauguucccuucacagugcaucauaucagaggguacgugauguugaugugaugucuuauuacucacgacauuagccuugaucacaugguuaaugugguauaucagguuucuccucuguaaaguuauuauuuguuuucccuuuguaauucauaaauauuaugagggagaacuuugacucuguuucuccuuaaacuuuuucccauuaauuuuagcauucaugggugugucuugcuuauggcaauuauuacugguauucuaauggugauuuucuguuacugucauccuuucuacauuuauuaauugaaauucuucuauaacgaagauuuguucucccucauuuauucaaccauuuacuuagaagauuuuacauuacuuagaaccauuuacauagagaugaagucucccuauguuguccaggcuggucucaaauuccugagcucagaugauguugaaggccgaaagagugagggucgugaucaacucaguauaccacuggaggcuauaugaguaaacagcaaacuguucucaugaaugcagaauguuggcaaacugacaaauugcaucugccacccagaaggaaugcugagggcagucacaccagcaguguuucuugugauuaggcauaauugauaccuguuaacaguaauaugaaccugugaucaauuaagcagcugaccaaucguuaccuccuccucccugcucuuucuacccaauaaauacaaagggcuguggaagcucagugggcugccuuugcucacuagaagcagggaacucucuuuuucuuccucugaccccuuccuuuaaaauaguuacuuuuaaguuuucauuucugcuuuccacacccuuaguucagucuuauaaugauggucucaaguaguaacaguaguaacugucauagugauggucucaaguaguaaccuuggcaguaugccacaagaugaucuuccugcuucggcccuccaaagugcuaggauuacaggcaugagccaccacguccagcccaaccauuuauuuauauuaggaugguuucauagauaguuacuuuauucccuguauuauaauccaauacuauccuuauuuuauugcuuaaauuguuccagcucuuggaguuuuuggcuuggcuccaguguucucucaacuugcccuguuuuuuguuuguuuuguuuuuagcacuuccuuacuuucuagcacugcaagauguuccaggcucgucuuguauuuaccaugccucagcccuggaaucaacuauuuccccaaggagcccuguuuucuuuuaugggagaaguuagcaucugggcacuacuaguuaugcucauugccacugagaugucacugcuucuaggcgucuuaguggacaaaaccaagaauuauauguauguauacuggcccauguauacacacugcuuuuugugugugugugugugugugugacagaauccacugucacccaggcuggacugcaguggugcaaucacagcucacugcagccuaccuccugagcacaaaugauccucccaccucagccugccaaguagcugggacuagacacaugccaccgcgccuggcuaauauuuuaaauuuuuuuguagagacagagucuccccguauuguccaggcuggugucaaacuccugggccuaagugauccucacgccucagccucccaaagugcugggauuauaggugugagccacugugccuggccuauaggcacacauuucuuuauuuagcucuauaucuaccuauacuuuuuuuuuuuuuuuuuuuuuuuuucugagauggagucucacucugucaccaggcuggagugcaguggugcgaucucggcucacugcaaccucugccucccggcuucaagccacucuccugccucagccuucugaguagcugggaccgcaggcaugcgccaccacacccgaguaauuuuuguauuuuuaguagagacaggguuucaccauguuggccaggauggucucgaucucuugaccucgugaucugcccaccucggccccccaaagugcugggauuacaggugugagucaccgcgcccagcccuauaaaaauuuuauaaacuauaaauucauacugauauuucugacuccagucuagcaucacaagguucauucuaguauucccucuuggcuuauuuauaacuucuuucucugauaguaaaaagccuaaccccacagaacuuugauuucugaaaacagaucuagaaucucuaaaauuaugccauaaccagcuucuccucccaugauacaccguauauuuuuuucacuccauuugaaauguuaucccguacucaaccuauucaccuuaaaagacucaagugaaagaacacacauggcccuuuuccaaacugcccuagcccuauuccuaaucagcauaagucaaucccccugccuuauaauaauuucauaauuccuacucaauagcaagauauuugaagucagaagacagaucuacuuugucuuuuaaccuucugacaucuaguauuuaauacauugcuuucuaaauagaaagaacucuauaaauacgccuuccauaaaauuacacauagcuuuaaguuuuaucugaaacacaauuaguacagaaacugaaugcuuauccugcagucccaagacuaguuaugaggaagcauauauuuuucagaacugugaauuacccaguaauuuuagcuuauucaaacucucauauaaacucacaauauaaaaaaauggaaccacuaaauaacaucaaauguuauaaauaaaaagcucacuacucuauuauucagaaacaugaugauagacaagucugcaggcauguuagaauaaucacugcuacuguucuuggaagagcuucagguauguguagaaacaugaaucuagacaauagcacaauuguaacauugaccaaauucccaggggucaacaagaauguaaauguuuacaucaggacagacucacuucaauaauauuugaucucuuuaucgccuuuuaaaggauauuuugugccuucaaaaacacuaagacccagagcaaaagcaacaaaaaugaggcuguguaauugagaauaaauuccacuuuucucuuuucuugcagaauccucuuuuccuaccuccacucuuacucccaggaaucaauaaagagucagucucucucccuucucugagcgagcucacuuacucucaacucaucaaaagucacuuauuccacaugauucccaaagcuggauccuaaggccuaacuuuccuggcuuccacuccuagaguuucuuuuuuuuuuuuuuuuuuagacagaguuucacucuuguugcccaugcuggagugcaaugucgcaaucuuggcucacugcaacuuccgccuccuggguucaagugauucuccugccucagccuuccgaauagcugggauuacaggugcucaccaccauacccggcuaaguuuuuguauuuuuaguagagacgagguuucaccauguuggccaggcuggucucgaacuccugaccucuagugagccacccgccucggccucccaaagugcugggauuagaggcgugagccaccacgcccagcccaguccuagaauuucuacuccaugcuggauaguuucauauguccaauaugcaacguaacauaacccaaaucauauguauuauccuuucuuaaccucuacucuucaaauuaaguucauuuaauuacaaaucauuuuucuccaaagaauugguauaugaauuuuugcuucuaucaaauaaaauaacacauaacauaguauaacaaaauguacacaaaguuugaaguuaaaaggagaacuuacagguucucacugggccucuaacuguggugacaugugcaaguuucuuuacuucucugaggcauauaccauuaccuacccuagcuagucaaaaauucuauauaaaaugccuaacacagggacacauuuuggaaagaaaauagcaagaggcuaagggcauggggcauggauuagaauuuagcuguugagaucucucaccacgaacacuagcugagugaucuugggcaaguuuaauaacuugccccaaaaaaaaaaaaaaaaaaggaagucauuuauuuacuuauuuacuuaucaguaaaugcuauuuuaccccucucccugcuuuuuuugucuuuugcuuuucugccaucuaguauauuuuuuuuuuuuuuuuuuuuuuuuuuuugagauggagucucgcucugucgcccaggcuggagggcaguggcgugaucugggcucacugcaagcuccgccucccggguucacgucauucuccugccuuagccucccgaguagcugggacuacaggugcccaccaccacgcccagcuaauuuuuuguauuuuucaguagagauggguuucaccguguuagccaggauggucuccaucuccugaccucgugaucugcccaccacaaccuccccaagugcugggauuagaggcgugauaguguauugcuuucuaaauagaaggaacucuauaaaugcagcuugaauaaaauuggacaaagcuuugcacauauggauuuugcacaagcuuuuccucacaucuuuagguaugcucaaguuauuucuugaugcaagccauucucugagcacacuacuccccccgaggacacugcuacccucugucugaaaaugcuugagccucccuggccuucugcuaugggucccagcuugggugacacuuuguuccagaugccuucccugaccccucaagcuugggcuaaaagguucccuauaaguucucaaaguauuagaccuaucccuaccugaucagaugguaauuuuuuuucugagacaaggucucacucuuaucucccaggcuggaacgcaguggugugaucauaauuauugcagccucgaacuccugggcucaagcgauccucccagcucaaccucccaaagugcugggauuacaggugugagucacugugccuggcucacacuguaauuuuuuaaaaucacacuguauuuuaacuugcagaacagugccugacacauggggggcacucaaguauuuguuaaugaagagagggaucccaggcaucugaaauaauuuuuuggauucagcuauuuuuagagacuaguguuucuggggaaaagaaaucaaacaauagaguagguuguauauguuuauuccaaaauaaaucauuccaagguaugggaaaccaguggagauagccaucaaaaaaauggucuccaguauucuacuaagguagaauaaaacugaaacccaucaauauuguuuuaguuaacuccuucuacugagauaauuuagguguuuucuuauaaaugcuaaugaauuacuauuuggcucuacagguaacaaagccaaauaguaauuuuagaaaccaaaaggaagaugagaaauaaagggggaaaaacacuuaauucaguuggucacaaauuugaguguacauagaaucacuuaggaaacuuguauacaauacugauuuuucaggucccaucccaugauucugauucauuaggucuggagaagggcucaaaaaacccacauuuuaauaagaagaacguugaagcaacucuagugucagagguucccucaucaaaugcuggaaaacacugaauuaaaggguuuaaggcugggcacaguggcucaugccuguaaucuuagcacuuugggaggcugaggagacaggaccgcuuaaggucagaaguuccagaccagccuaggcaauauggcgagaccuguucucugccaaaaaauaaaguaaaauaaaauaaaauaaaauaaaauaaaauaaaauaaaauaaaauaaaaauuaacugggcaugguggugcaugccugugauccuugcuacuuggcugaaacaggaggaucacuugagcccaggaggucaaggcugcagugggccaugaucacaccauugcacuccagccugggcaacagagcaagacucugacucaaaaauaaguaaguaaaggguuuaagaccuacauguauucuaagaaaaauggaaagacagcaacauaaaauauuucuuauauugcccacuucaauuucauguugccauucaaauuugacaguguaaggaaaauggcugcucuuuaaaaguacacugagguuuggacaaaaaugaaucugagacacugcacugauuaauucaaucugccuaauuugaugcccaucaucuagguucaccuaguacuuuucuguccagacggcacaaaaucauuguguuaaaacaaugacucgugauaauaaaauugaguuauucucauucuuuuuuuuccucuagccaggucuguugcugaauuuaaaaugcugcuugagaaagauaagaagcuuaaaaaauagaaacuauuuuauuuuuaucuaccgaauaaaagggcaacuauaauuuacugagaggucaaaguuaaagcagggagccaacaggcuugugcucucauuuugaaucugccacuaauuagugguauggccaugaacaagccacuucucuggguccucuuucuucuugugcaaaaugaagggguuaaaauagccuaguguuuuucuagcugcaggucacaauuagugaguuguaaaagcaacuugagcgaucagaagcaacauguuuguuuugaugaaaaagaacagaaugcaaucgaaaaugucaaagugcaucagacauaguauagguagguuuuuucuaaaguuuuuguuucaguuauuuguauguguauaaacugaguaggaauguaaaauauuucuuauugugggguauaguuaaaauauaguuugacaaguguuagcgaggacguggagaaacuggaaccguuauacacugcuggugggaauguaaaauggugcagccacuuuggaaaacagucuggugguuccucaaaagauuaaacacagaguuaccaugggauccagcaauuccauuccucugugugugugugugugugugugugugugucuauauauauauagagagaguauauauauauauauauagagaguauauauauauauauauauaaaguauauauauauauauaaaguauguauauauauauauauacucaagagaaaugaaaacacauguccacacagaacuuguacacaaauguucgucaacugaugaaaggaugaacaaaaugugguaugcccauacaagggaauauuauucggcuauaaagaguaauguagugcugacacaugcuacaacauggaugaacccugaaaauauuaagcuaagugacaggagccagccacaaaagaccauuuacuguaugauuacauuuauaugaaagguccagaacaggaaaaucuauagagacagaaaaagaauuagugguugccugggacuggcaguaggaagacaaggaacugacugcugauggguaugaauuuucucuggaaggugauaaaauguuguaaaauugauuauggugauggcugcacaacugugugaccauauuaaaaccgcugaacugagcauuuuaaauaggugaauuguaugguauauaauuuuucaauaaaacuuuauaauuuuuaaacaauggcuugaaaaucauuagacucgaugacagaugaucacugaggucccugagaauucucauguggcccccccagggcucaccuugcccacccuuaccccaugacccucuggaggcaggacaguagaauggaaauagcagcugguuccaauucccauucuaguguuuaccagaugcauggcaaccucucuguacuuuacuuuccuucuauguaaaaggaagaugauaaaucugccuuacgggguuguuuuaaacuaaaggagacaauaaauguaaaacagugcccagcacauugcuugaggucagaggcagaucuugucagucuucgcaugcuucagagucuaagccacauucaauaaacauuauucuaaagguucagauacuagaacuccuauuuggguuuagcuuacuuuaugugucauauugacuuaacaagguuuagaucaauaaggcugugauuaaaaauaauucauggccaggcacaguggcucacaccuguaauccuaacacuucgggaggcugaggugggaggaucacuugaguccagaguucaagaucagccugggcaugauggugagacuccaucucuacaaaaaauuuuaauaauuagccgggugugguggugggugccugugguuccagcuacuugacaggcugaagugggaagauugccugagccuaggagauugaggcugcagugagcugugauggugccacugcauuccagccugggcaacagagugagaccgucucaaaaaaaaaaaaaaaucaaaaauguuacauuugcuucagcuguuugacuuuuuagcuugaaaguugcugucauuauuuaaaacauggcuggccagggugguggcucaugccuguaaucccagcacuuugggaggccaaggugggcagaucaccugaggucaggaguucgagaccagucugaccaacauggagaaaccccaucucuacuaaaaauacaaaauuagccgggcgugguggcgcaugccuguaaucccagcuacuugggaggcugaggcaggagaauugcuugaaccaggaagguggagguugcggugagccaagaucacaccauugcacaccagccugggcaacaagaacaaaauuccaucucaaaaaaaaaaaaaauugcucaucacuauauaauggaaguaguaacauuaguugaagagaaauuguuucuuuaaaauaucaauauuuuuauuucauaauuauuagaaaaacuacccauuuuuuaaaauguuuguuuugagcacuuugaccaauuauuuucuguaguuuuuauucaaaagucaaauuaaacacaaaucacuuuuuuaguauaaauauaacuuagugaauuauaaaaaggauaaguccaaauacaagcugggcuuuguaagguucuugugcaauguaaauuuuuuaaaucuuuaauuaggucaggugguuuucaaaaaaaaaacuucaguagccaugguggaauccacaaacauccuucccaucuccacacagcaccacccuuccuuauccuccuccuucccauggggaaccuucuucugcaggucucaacaagccuacuuguugagccuacagagcugccacuuccuucacugucuaggcuccucggucagugacuggccagggaugggccugcuccauauaaacaaugcuauggaaauacacaauguaagaaguagaagucccugccagcucuugucugcccuccccccaaaccaauucuacuucucaaagguaaccucugucaaagucuggagcauaaacuuucuguuauuaccuauacaauaauaauugccaccacaaagcacuaugugucagucacuguacuaagcacucuacauauguuaucucaguuuacccuugcaacaagucaugagguagguaccaucaggaugccuauuuuacagaugagaaaacugaggcacagagaaauugacacacaacaugcauaaauacaaacauguuuuagaaauacaaugguuucauguuaaugugcuguucagcaauuauuuauuuccucuugaacaucuucccaccucagggcauacagaucuaucucaaucuuucaguaccucauaauauuucauucuguaauaguuuaaaaccuauuuaacaaggccccuguggaugaucauguagguugcuuuugcuucuucacuguuaugaauaagaauggaacaaacaugcuuguacuauugccuaccuggggcggggugcaucuacggcauaaauuccuagaaggagcauuucuaguuuaaaaggccuaugcauuaaauuuuuaaauagauauucugagauuucccucaaaaaagucacauccauuuauauuugaaucuuucuccacauucuugucaguaauaagcauuauuuuuauuuuuuccaaucugauagaugugugaaaaugguacauuauuguuuuaguuuucacuccuuuaaucaugagugagguugagcauauuuucaaauauguguuggccacucaauacauuuacuuuuuuuuuauucugagacagagucucacucugucacccaggcuggagugcaguggccugaucuuggcucacugcagccucugccuccuggguuccagugauucuccugccuuagccuccugaguagcugggauuaccggggcgugccaccaugcccagcuaauuuuuuuauuuuuauuauuauuuuuugagacggagucuagcucugucgcccaggcuggagugcaguugcgcaaucucggcucacugcaagcuccaucucccggguucacgccauucuucugccucagccucccaaguagcugggacuacaggcaucccccacaauguccggcuaauuuuauauguauuuuuaguagagaugggguuucaccguguuagccaggauggucucgaucugcugaccucgugauccaccugccuuggccucccaaagugcugggauuacagacgugagccaccgcacccggucacgcccagcuaauuuuuguauuuuuuuuuagagauaggguuucaccauguuggccaggcuggucucgaacuucugaccucagaugauccacccuccuuggccucccaaagugcugggauuacaggugugaaucaccgugcccccuggccacauuuacuuuuuuuuuuugagacagagucucgcucugucgccaggcuggagugcaguggugcaauuuuggcucacuacaaccuccacuuccuggguucaagcaauucuccugccucagccuccugaguaguugggacuacaggugcaugccaccacacccagugaauuuuuguauuuuuaguagaggcgggguuucaccauguuggccaggaugguuuugaucucuugaccuugugauccaccugccucggccucccaaagugcugggauuacaggcaugagccaccacacccagccugccuauuuuuucuuuuggugaagaaugaggucucacuauguugcccaggcuggccucaaacuccuagccucaaccuaucucucacuucugccucccuaacugcugggguuacagguguaagccaccgugcccggccacauuuauuuuuuuaacgacauuuauaaauuguuuauuaucucuacaacuuacuuuuuuuuaaauuauacaaggacuuucugaauaucauguguaacuccuuguacaauuggauuugccucucacagcagcuguccuuuccuggugucugauucuuauccagaucucauuaauauucuuuccaaacaaaaaugccgcuugacuauacagaugagugccucguuucugcgggguucccuuuugcaggacacccaccccugacugcucauuaauauucuaagcagagcacaacccuguaagaagccugacggacacugacagcccaggcauugagagaggaucacugcugcuacccuccaccacccagucuagugcuuucagauaagggugguacucugaguaucaggaucaccuauggaaucugaaccucucauauggaguccaaacauguuaauuuuugcagacccagacccuaaacgcucaccaucuagacagauaaugucagaaucagguacaaguuugaaccccuuaagcauaagccugaggauugguuauugaguacuggccauaugccaggugcuuuacauguuaucucauuccauuugaucuuauucacuuaauucuuacacugccaugaagcaauuauuauuauuauuauuauuauuguaagagacagggucuugcuauguugcccaggcucgucuugaacuccugggcucaagcgauccucccaccuuggccucccaaagugcugggauuauaggcaugagccaccacacugggucagcaaauauuuauuauucucauuuuacagaggaagaaacuaaggcucuagaaauguucaauaacuugcucaaggucacagagcuaauaacugauagagcuaggauuugaaacaaucccacagaccauaauguccauguucuaaugacauauuacaaaccacaucuucccgguauuuaggggcugucuggaccggucuuauccuuuaagagucuugaaacuaggaauauuaaaggcugggccagaugccccagccuauuccacaucuaagccaacucuacccaaggcuccuuuuggcucaagucuacauauugagucuaccacacacuuacuggguaacaugaggaaaauuacucuaagccuuaguuucaucaucacuaaaauguucucuuagcacauugcuaaaauaaguacuuaauaaugauagcaguggugguaauaaaaauaccuaacauuuauugaccauuuaccaugugucagauacugucuuaauuguuuugcauauauaacuuauuuaaucuucacaguaacacacucagaauuauuaccgacucacuuuauguaaguguauuauugaauaauauucagaugaagaaacugaggcccaaagaaguuaaauaaauguuagcucuuuucauuuuuuaggagguuggccuggaaacaaaaugaucugcagcacggaaaauaaaccagaaaagcaguucuagcguacaugauauuucagggucagcuuauuucuguuaaaucaccaauaaaaagagaauaucucuaauguaauaauaucugagaaacugaugguuacuaccaggaacaccagaucugaucaaagaccugacaccauuucucugcaccauaaagucuaaaucgguaaaaguuaucucucuuaaggauaaaauuuuaggagcgggcgcaguggcucaugccuguaaucucagcacuuugggaggccgaggcgggaggaucaccugaggucacaaguuugagaccagcugaccaacauggagaaaccccgucucuacuaaaaauacaaaaaauuagccgggugugguggcacaugucuguaaucccaacuacuugggaggcuaaggcaagagaaucgcuugaaccugggaggcggggguugcagugaacugagaucacaccauugcacuccaaccugggcaacaagagcaaaacuccgucaaauaaaaaaaaaaaaaaaaaaaaaauuuaaaaaggcuaggcacgguggcuuaugacuguaaucucagcacucugggaggccgaggugggcggaucaccugaggucgggaguucaagaccagccugaccaacguggagaaaccccgucucuacuaaaaauacaaaauuagccaggugugguagcacgugccuguaauuccagcuacucgggaaggcugaggcaggagaaucucuugaacccggguggcagaaguugcgaugagccgagaucgcgccauuguacucuagccugggcaacaagagugaaacucugucaaaaaaaaaaaaaaaaaaaaaaaaaagggauaaaauuuuagguguuaucaacgcaucaacaccucuguaagaacucuaaguugggccaggcacaguggcucacgccuguaaucccagcacucugggagaccaaggaggauagauugcuugaguucaggaguucaagaccagccugggaaaaauggcaaaaccccaucucuacaaaaaguacaaacaaauaaguuagccaggugugguggcuugagccuguaaucccagcuacucagaaggcugaggugggaggauugcuucagccuuggagguggagguugcagugaauccagaucacgccacugcacuccagccugggcaacagagugagaccuuaucucaaaaaaaaaaaaaaaaaaaaaaaaagaacucuauguugaagagaacauaacuauaaccuucccacagggcuucuauuaccuuauucauuugugugaauaucuuaucuucuugugcuuaugaaccccaaauuaguuuuuuacauaauugugguaaucuucacauaucuuauuuagacagguaaaaaagaguaaccccaguuacagccuuugaaaacugacuuugggcaccuguaaucccagcacuuugggaggccgaggugggcggaugacgaggucaggagaucaagaccauccuggcuaacacagugaaaccccgucucuacuaaaaacacaaaaaauuagccgggcgugguggcgggugccuauggucccaauuacucgggaggcugaggcaggagaauggcaugaacccaggaggcggagcuugcagugagccgagaucgugccacugcacuccagccugggcgacagagcgagacuccgucucaaaacaaacaaacaaacaaaaaacugacuuugggccaggugcuguggcuuacgccuguaaucccagcacuuugggaggcuaaggugggaggaucacuugagcccaggaguuugaggcugcagugagccgugacuaugccacugcacuccagccucggcgacagggcaagacucuaucuugaaaaacaaaaacaacugacuuuggucuaaaauuuguaggucaugaagaaccacccaagaacuuuccuaaucuuuuuuuuuucccuuuaaauuaaaaaauuaccagaucaaauucaagucuaacuccaccucucucccaauuaauaaaauuuguuauuugcucauuugguucuuucccuccccgucccagcugaucauuaacuuauucuaagggcaaacauaauccaacgaagugagguuuucuuauuuuuccaguaguuuuuuuucacacauaguaagaaaaaucucuuucaguaaguagaaaaacagaucauuaagucacuagcuucaaauuuaagguaaagaguagagaaaaacauagcuaauuagaaaaagaauguggaaauuuacaauugaccaagaccaucacgacaaagcacagacuuccucugaacagcauauuucuccuuuaaccuuuguaccuuuccauacuuuaacaucagauguacugaauaccagugccuggaacauguaggggcucaauaaauaucuguuauaugaaugaaaaacaguguuacacuaguacugaauugccacacaucucagcaaaggcccaccuacauaacugaaaaucugccgagaaacuacaugcucauaagucuugccaauuacaugcuuaauuaaggcaaaauaguucauuaaggagccuucuuuacaaucucaaagcaaaagaaacacauacgcuuauuuuaggaaggcuccuucuguuaaagauauaaccuucuuaaagcagcccuuuguccuuaauaacuaaucaaguuuucuccaaauacagggcuucuuaguuucacuucuggacauuuccaggaagggccuggcuuccauucuuaucugaaauuuuagaugaugugcuguuuuucaggacuugcucaaucugaagagucaguucagaucaguuuaaccaauaccuucaagcaggagaauuaaaauggauuuacuaaaaagugacucuucucuaggcaaguucuuuaauccuuccuuucuuuaaaagagaagcuggccgggcacgguggcucauuccuauaaucccagcacuuugggagaccgaggcgggcggaucaccugaggucgggaguucgagaucagccugaccaacauggagaaacgccgucuguaccaaaaauacaaaaaaauuagccaggcaugguggugcaugccuguaauuccagcuacucgggaggcugaggcaggagaauugcuugaacccgggagguggagguugcagugagccgagcucgugccauugcauuccagccugggcaacaagagcgaaacuccgucucaaaaaaaaaaaaaaaaaaucugagcagcuaccacguaacaaugccuuaauaaaggacaagcaucacugaggcugaucacauaaagauguaccaaaucacaccgccacacaagugauaaaauuuggcuacuuaucuggaccagugcuagguaucuuauuaagaauugguuauagggccgggcguggugguucaccccuguaaucccagcacuuugggaggccgaggcaggcagaucacgaggucaggagaucgagaccauccuggcuaacauggugaaaccccuucucuacuaaaaaaaauacaaaaaauuagccgggcguuguggcgggcgccuguagucccagcuacucgggaggcuaaggcaggagaauggcgugaacccaggagguggagcuugcagugagcagagaucacaccacugcacucuagccuggacaacagagcaagacucugucucaaaaaaaaaaaaaaagaauugguuauaaacauuuuuuuuuaagagggagccuuacucucucucccaggcuaauuuuuguaauuuuaguagagacggaguuuugccauguuagccaggcuggucucgaacuccugaccucaagugauccgccagccuuggccuccuaaagugcugggauuacaggcgugagccaccacaccuggccugguuauaaacauauuaauguuacuguuucaauugaauuuuaaugauuagcuucuaaaagcuacauuuaauucgggacuguagaaaauaguuauugagaggcauuugcuggguaguggucuuucaguuggcaggggaaagaucaucacugucuuugggccucaauuucuucaucucaaaaacagguauugauucacacaggaugcuuaugaggacuaaaugaaaggauaaaagcaaaaguacuuugaaaacugucagcuacucuacaaagcauuauuuuaaauaaaacuucaagccagcauuaagaaaaaaaauggaauuaaaaaagacuaaccaaugaaaagaaauagaaauuagaacuaauucauuauaaugucugguucaacuagauguuaauaagaaaccuuuuguuuaaagcuguugcugaaaaucuuucuaaucaguacacugucuaaacagugugucuaaacaguaacacauuucagagcauguguuaauaguaaguauaaugaaaaucauuucauuuuuucuugaagauucuagauagcuuucuaauuuuucuccuagagaaugaaaacagaagaaaacuucugguuguuuguggauuccaguaauuggguuuuaguuuugccacacuggcuuuugaaaauguaauaggaguugauagacuaguauaauccagaguaacaaucugggaaguagauggcuauagugguaggaaaauaguggccuggauccuggaaacaccuuagaaaacuugcacucagauggaacuuaauccugguugucacaguauccaaacuuuuguccugcuaccuuccgaacuccucagagacugcuaccugauuugaacccagauggaccgaccucagcuguuguccaguuaaaaaaaauacaacacuuuggauugcaaaacaaaacaagacuuguccaaaugaaaaguccaucuucaaggcuuauucauucauucaacaaauauuuauuuagcauuuaccaagucuuuggcaguauuccaagugcugaagauauaauguuaaaaaugacagacaaggccgagcgcgauggcucacgccuguaaucccagcacuuugagaggccaaggcaggcggauaaugaggucgagagaugcagaccauccuggccaacauggugaaauccugucgcuaccaaaaauaaaaaauuuagcugggugugguggcaggugccuggagucccagcuacuugggaggcugaagcaggagacucuugaaccugggaguuggagguugcagugagucaagaucgugccauuccacuccacccugggugacagagugaggcuccaucucaaaaaaaaaaaagacagacauggucucuacucucaugaaauuuccauuccacuggagaagccggacaauuaaagacugugauuaguggugugaaggaaauacaaaaagaguaacuggaguugugguaggaacagggacacgaacagcuucuuuaggcagugaucagggaaggccucauugagugaaugacauuugaacugaaaccugaaugauggggagaacauaugcagccagcaaggugaagacaauagaugggggaguuuuccagguagaggaaagcaaaugcaaaggcccugaggaaggaauaauacagcuaggaaguaagugagaagcaugcgaugacacagagaugaguaguagucagauuaaauacggauuaauaacaaugcuaaaggauuuuaauuuuauucuaugugugauacaaagccaaacauuauuauauaaaaguguguuugcaagaucagauauauuucauguacuaaaugaguacuuuggccaggugcgguggcucaugccuauaaucccagcacuuugggaagcugaggugggcagaucacuugaggccaggaguucuagaccagccuggccaacauggugaaacccugucucuacuaauaauacaaaaaaaaaacaaaauuagccaggcgugguggcgcgugccuguagucccagcuacuccggaggucugaggcaugagaaucaccugaacccaggagguggggguugcagugagcugagauugcgccauugcacuccaaccugggacagaaugaaacugugucucaaaauaauaaaauaaaaugaguucuuaauuguuuauaugugcauaauggccacaaaaugaaaaggaagggaaagguucucauaccuaaaaggcuuguaaucuuacaaggaagcaauaauuuauaaauagugacaacauuaaguaagguaagaaaugaagcaaaaaucaaguguuaaguauaaagacuggggaggcagccacugauucaaguagaagaaauuagaaaaggcuuuuuuuuauuaaaaaaauuuaaaaagguagcauuugauuugggcucuuaaggaaaaggauuucaacaagaggguggggaaggggaggagcaugaggcugugguaacugcaugagcaaaggcacagaggcaggaaagaacugggcagguccaggaaacagagaauuauuguagggucacagugccaggugggugggucguguugugggagauaagccuaaaagaauaggcugucagagugggggugugggugucuugaagagcaugucagaaagcuagacugaauuuacuuaggcauugucuccccuuaaguuuguauauaaaucucuugagguacuugauaaacuucagguucccaggcccaucccucagacacacugaucugcaggucuaggugggaccugagacucuaccuuuuuaaccacugccagguaauucuaacacaggcaauuaaaggaaccauauuuugaaaaucagugcuuuuuuuuuuuaugacaacucugauaacuuuucugcaagggaaaaacugaagccaacucuaaggauuacucaaggacucaaggacucuggcaaaaaacuaaaaggggaaucugaauuagaagacugauuaaagaacucuuaucaccccuggggcagaaucagccaaacuuggggauugaucaaauguggguggagaaaaguauuaaagugguaaguacaaccucaagcuuucuccuuagugaaucuggguguacgcagaugcauggcguacagggacuauccacauagccuaacagguagcuggaaauacagaucuggaacucagauauacaaaggcauuaaacauauugguuugguacuucaaaguaaguucaauacaaauuaaagaauuaaauauaaaguguaaaacgguaaaaaucagaaggaaaugaaagugaguauuuaaccaaucucuggauggugaaggccuucuaaacaucacagcaccagaagaaaucucaaauuuaaaaauccaggcugggugugguggcucacgccuguaauuguaacacuuuggaaggccgaggcgggcagauuaccugggucaggaguucaagaccagccuggccaauauggagaaacccugucucuacuaaaaauacaaaaauuagcuaggcgugguggcaugugccuguaaucccagcuacuugggaggcugaggcaugagaaucacuugaacccuggaggaggaggcuagagugagccgagauugugccacugcacuccagccugggugacugagugacacacugucucaaaaaaaaaaaaaucuauagauaaguaauaauauacuauauacaaaauuaaaaggcaaacugguuaaauauuugaccacaggacaaaaaauuaauauucuuagaagaguuuauaccaaucucaaagaaaaacacuaagaaugguucuguaugaaguagaagaaguuguuaaauaacuugccuuggagacguacacccucuagucacaaaaugagacauuuuucacauacauuguagauaaucgaguuuuguggcacaggucagcagggcuucugugauuuuaucuuaccaguuuccaagugucagucuaugggagugccuaaaaaaauaccaaucuuuuugacuucuuuuuuuuucuuuucuucccccaacccccacagcaagaaccccauucaauuuuuuuuuuauacuucuauuuuccugaaaguuaaagggcacaaacaaauuaagcuguccccaggcuccccuugcuacuccgguggacacugccuuuacugcauccagucuuuccucaggcucuauauaucuaaaauuaggugaaagguuagagaugagacagaaaguaauuccagaaugucuagugaacaguaguagcuccaaaggcauccuuucagcacagagguuguccagucuuggggaucaaaagcccaacccucucauuuuacagaugaggcucugagucaaugaaucaaugacuuguccaagaucaccugauugguugaugacaacauuaaguugggaauccugacucucaaauagcacccuuuccauucugcaguacugcuucauugaucacaagcucuggccccucaaaacaaugggcauuuauaacaccacaauuccaacuucuguauacuuuccacuuugucacuccauucacucuauuuggucuaauaaaagccugugcuucccccacaaaacgcuccaaauaaaagaauaccaaacaaaaaaccaacauaauuaaaauguuaacgcccaaauaaaaaugggagugggauuaacccagacauaauucacagaagaaacagaaaugaauguaugaaaaauguucucucucacuagcaaagaaauacaaauuaauucauuucugccuaucaaauuaguaaagauuaaaaaauaauauucgggccgggcgcgguggcucaugcuguaaucccagcacuuugggaggccgaggugggcagaucuccugaggucaggggcuugaggucagccugaucaacagggugaaacccugucucuacuaaaaaacacaaaaauuagccagacgggcugggcgagguggcucaugccuguaaucccagcacuuugggaggccgaggugggcggaucacaaggucaggagauugagaccauccuggcuaacacggugaaaccccaucucuacuaaaaauaaaaaaaaaaauagccaggugugguggcgggcaccuguagucccagcuacucaggagucugaggcaggagaauggcaugaacccgggacguggagcuugcagugagcagagaucgugccacugcacuccagccugggcgacagagcgagacuccaucucaaaaaucaucauaauaauaauauucaauguuaccaaggccgcacuaagaugggcacucacaaucacugcaguugagaauguuaauuagucuaaucuuuacaaaaagcaauuugggagcagguuuaguauuuuuaaauuuucacacuccuugaccugguaauucaaccucugggaaucuaaccuaaggaaauaaugagucauuugcacaaagauuuaugcauaaauuuguucucaauuguuuucauuuaauguaaaaccaaaacacaaauaaauuaugcaaccucaauauaauaaauuauuaaauagauuacaauggagauuaaauauccauuuaaauguuuucaaaaauuuuugaugcuaugaaaaauaauauaaagcaaaaaaagcagacacaaaacuauaucuacugcaacaguaugaguucaauuaccuuuguguuuaugugaguguguguauaucaaagaaaacaaaaccacugaaaggaaauauaucaaaugauagaucucucuggaacagauuauggaauauggguuauuuugucuucuuuauaauuuguuuuuuccacauuuucuuuuuuucuuuucuuuucuuuuuuuuuuuuugauauggagucuugcuuugucacccaggcuggagugcaguggcaugagcuuggcucucugcaaccucugccuccuggguucaagggauucuccugcuucagccuccuuaguagcugggacuacaggcaugcgccaccaugcccagcuaauuuuuguauuuuuaguagagaugggguuucacuauguuggccaggcuggucucgaacuccugaccucaagugaucacccgccucagccucccaaagugcugggauuacaggcaugagccaucacacccggccuguuuuuuccacauuuucuauaauaaacauauauaauuuuuauuuuauaauaauauaaauaucuauaauuuuuauuuuuaaauguguuggcauauaugaaaauaaaacaauuauauauacaauaugaaagaaguuuuuuaaaaagauaaauuuucaggccacuuacauggaggugauaguggaagucauggaaagaaaucagauuauaaagggagaaaguauagugagaauaggaagcugagcagggcuauggugaacccggcauuuaaggggcaaaaagacugaguuaauggaucaugggaguaagugguuagauuagaaaauggagaaccagauaguagucaugucaagaaaagcaaaugaaaggaagaacuagacaaguuguucacuuggucaguuauugccaagggguaaggaccguuagacagaaaccacuggauacuaugcauggacagacagcuuuccuguagugcuggaagccaaauuuuugcucagacgccaaagcugagcaaauguuaccuguuuaguaaaacugacuaugaaauaaaagaagucccggggcauuagcuugaauuucaguuuauggagaaaaaaaagauuguggaaaucuaaaacuaaguaaagcggauauugggacuaauuuauggguaaugaaacaaaaauggcaauacuuugugcaagacaaaacauauuugaaggacuguaaaguuuuccauaucauaaacucuguuacagaauaauuaagggggaaaauagauccacacuuguuaucagaaguacaaaaaaguugcaucuuuuuuuccccuaaagaugaaaguucuuaguuucaggguaguaguauuuuuuuuuuuuuuuuuuuuuuuuuuuugagacggagucucacucugucacgcaggcuggagugcaguggcgcgaucuccgcucacugcaagcuccgccucccggguucacgccauucucccgccucagccucccgaguagcuaggacuacaggcgccugccaccacgcccggcuaauuuuguuuuuguauuuuuaguagagacuggguuucaccauguuagcuaggauggucucgaucuccugaccucgugauccucccgccucggccucccaaagugcugggauuacaggcgugagccaccgcgcccggcccaggguaguaguauuaagaaauuauuuaaaagaacaucaaaagaauguaaaauuuucaugguaucauguuaacuucuuaugaguggacacaggaagucucuagaaaguuuucacgugucaagaaaucaucugacaugcugaauaauggauugcuuguuaggucaaacuccauccuuuuuaugaaaagaggucuucaguagcacaauaauuugacugagucuugaggacucugcacccagcuucagaauaaacucaucaguaugguccuaccuuaucauccaccauagacucucaacuccauaaucauuaaguagaaacuacuucauuuacaaccacugguuuguuaguaaccugaagaggcuguguuaaguaaccucaccuggagauuacuguaugcaaucuaaaaugaaguaccuuaaguuucuaucaaaaaacauacagugaaagacaauagcaaacuuaaaaaacaauugccuuuucuaauggaaauuacuaacuuaggacucguuauacauuuuccuaucugcagaaaggguacaauucuaaucuaaaagucaucuaucuaauaguguauggaauuaagaaugccugaaacuaguuucacugucaauuuaaauaauaaauucuuccaauuugugguuaggugcccuauuaugccaaagaugucuaaugaacucccacacucucaauauucuuuugugucugugugugugucuuugauaaauuuuuuugguacgagggcucuaaguuaauugcaguuaacuggugaaaaauaccagagaaaauauaagaauuugaaaccugaagaaacacuagucaaaauuauacuuaaaaacauuuuuccccacccaccuaucuacccugucuuccccacccaagaaaaaaagaaagagaaaaacauuuugagggcaucuuagcaggaaaaaguauccccugucaccaagaugugaauuguuuuagcuucugaagcuuucuuuuagaauuauuagguugaaauuuagccccaccuuuaaccagagucuggaacaaagcuugaguguaccaaguuaaagaaaguuauacaaugagguaauuuuuacaaaauggcacuccuuugcuaauguugccaauauacuguucucuucccagggacuaccugauaacaacacuucccagcccaauacagaacaguggaaacagauccaacuauuuacuaaaugccacauuaacaacagggucuaaucccauuuuccauaggccauagaauuggaggaagagaggguaagaaauaugaaagugauacaaauacauagauugaagagaaucacucauuauuacucagagguuuuuguuuuuaaggaaaagcagaagagagaauuaaaaaacaaaacaaaacaccuauauucccuaugcuccuacaguacccugggcugaccucuaguauagaaaugaccucacuaauaccauaaauuguauguggaucugucuaacccauuugauuuuaaguucuuuuaggguaaagacguuuggcacuuugaaucuacaguaggacugacaugaaaggcacucaauauuuuguccaaagaaugaaauaaguuccuaaacuaauuaccuaguacauuauauguuguucuaucaaugcaaaacaagaaaacauauaugaacacacacuuuuuuuugccuucuuucacgccaacucuauaauuuuuugaagaucuaucuaaaacgugaucauccugcacccagguuauaccucuacaggaacuuagaacauguuguuaggggucauguucuuuugugucuacaucauaccucagaagaaaggauugguguuauuucauggcuccugaaauauuuagcauuugugaauaguauugguaaccaagcagauaaaagguacuguguuaaaccauuuaaaucaagagcaaaagaaagaauacuuaaugcaaaagaaaaccucuccccaaaaugggcauugccuuaaaaacugauaacucccuaauuaccuuugacuaaccugaaaagucaagucaauugaaccaucuggauuaggcagaucuggauuaggcagacuuaucuuuuauuuuuauuuauuuauuuauuuuuuuguagagacaagggucucgcuaaguugccuuggcuggucucaaacaccugggcucaagcgauccucccgccucaguuucccaaaguguugggauuauaggcgugagccacugcgcccguccaaggcagacuuuugaaagcuggaauuaggugcaagacaauaguaguucaaauaucucucaccaggaucagcuaaaccguucuugcaagcaucaguaaggaggcuaggaagggugccagaugguucguuccuagcagcuacaacuucaagcuuuaguauguguagccagggguguacaauuaccuuacauuaacaccaacauaugucgggggcaagugccagcgauauauacacgauagcgauucggggaugacacaucggcugcaaggacugcuauauucucaacauuccucaaaaggguguaagugucuuaaacagaguucagcuggcguaauggaagggagaaaaaaucgaaaagagagggaauggcugaaaaugaaggaaaaagaacaguugaauauuacaguauuucccuggaaggaggguauuuggaguuuuaaugaauugucaccuuccuccaccacaccagaaaguauacaguuagaaugcaguguucucggugggagaggacgggguauuugcagcucccgcccuugggcagcaaaggcucagcccgacauaagcacuccccacccagcgcaggccccagaagugaggaaagaacggaggaucagcgucccucgaccccuuaucucgagggggagggacucacacuccuugcacuccccccgccccaaaagucgaaggagaaagaggguguggagagaagccggggucuucccgcacucuccgguuguggagagagaaggcccuuaccuggcuaaaagccgccuuuccucugcgcugcuaccagcccugucacaggucccggcgcucuaccuagcgcaccugucgcgaccaagcugcuaacaccuacugcuccugcggccccgccccggaccccgcccaccgccgcgggggcgcgcac

SEQ ID NO: 192583 - RNA, 107791 nt, Homo sapiens
gugcgcgcccccgcggcggugggcgggguccggggcggggccgcaggagcaguagguguuagcagcuuggucgcgacaggugcgcuagguagagcgccgggaccugugacagggcugguagcagcgcagaggaaaggcggcuuuuagccagguaagggccuucucucuccacaaccggagagugcgggaagaccccggcuucucuccacacccucuuucuccuucgacuuuuggggcggggggagugcaaggagugugagucccucccccucgagauaaggggucgagggacgcugauccuccguucuuuccucacuucuggggccugcgcuggguggggagugcuuaugucgggcugagccuuugcugcccaagggcgggagcugcaaauaccccguccucucccaccgagaacacugcauucuaacuguauacuuucuggugugguggaggaaggugacaauucauuaaaacuccaaauacccuccuuccagggaaauacuguaauauucaacuguucuuuuuccuucauuuucagccauucccucucuuuucgauuuuuucucccuuccauuacgccagcugaacucuguuuaagacacuuacacccuuuugaggaauguugagaauauagcaguccuugcagccgaugugucauccccgaaucgcuaucguguauauaucgcuggcacuugcccccgacauauguugguguuaauguaagguaauuguacaccccuggcuacacauacuaaagcuugaaguuguagcugcuaggaacgaaccaucuggcacccuuccuagccuccuuacugaugcuugcaagaacgguuuagcugauccuggugagagauauuugaacuacuauugucuugcaccuaauuccagcuuucaaaagucugccuuggacgggcgcaguggcucacgccuauaaucccaacacuuugggaaacugaggcgggaggaucgcuugagcccagguguuugagaccagccaaggcaacuuagcgagacccuugucucuacaaaaaaauaaauaaauaaauaaaaauaaaagauaagucugccuaauccagaucugccuaauccagaugguucaauugacuugacuuuucagguuagucaaagguaauuagggaguuaucaguuuuuaaggcaaugcccauuuuggggagagguuuucuuuugcauuaaguauucuuucuuuugcucuugauuuaaaugguuuaacacaguaccuuuuaucugcuugguuaccaauacuauucacaaaugcuaaauauuucaggagccaugaaauaacaccaauccuuucuucugagguaugauguagacacaaaagaacaugaccccuaacaacauguucuaaguuccuguagagguauaaccugggugcaggaugaucacguuuuagauagaucuucaaaaaauuauagaguuggcgugaaagaaggcaaaaaaaaguguguguucauauauguuuucuuguuuugcauugauagaacaacauauaauguacuagguaauuaguuuaggaacuuauuucauucuuuggacaaaauauugagugccuuucaugucaguccuacuguagauucaaagugccaaacgucuuuacccuaaaagaacuuaaaaucaaauggguuagacagauccacauacaauuuaugguauuagugaggucauuucuauacuagaggucagcccaggguacuguaggagcauagggaauauagguguuuuguuuuguuuuuuaauucucucuucugcuuuuccuuaaaaacaaaaaccucugaguaauaaugagugauucucuucaaucuauguauuuguaucacuuucauauuucuuacccucucuuccuccaauucuauggccuauggaaaaugggauuagacccuguuguuaauguggcauuuaguaaauaguuggaucuguuuccacuguucuguauugggcugggaaguguuguuaucagguagucccugggaagagaacaguauauuggcaacauuagcaaaggagugccauuuuguaaaaauuaccucauuguauaacuuucuuuaacuugguacacucaagcuuuguuccagacucugguuaaagguggggcuaaauuucaaccuaauaauucuaaaagaaagcuucagaagcuaaaacaauucacaucuuggugacaggggauacuuuuuccugcuaagaugcccucaaaauguuuuucucuuucuuuuuuucuuggguggggaagacaggguagauagguggguggggaaaaauguuuuuaaguauaauuuugacuaguguuucuucagguuucaaauucuuauauuuucucugguauuuuucaccaguuaacugcaauuaacuuagagcccucguaccaaaaaaauuuaucaaagacacacacacagacacaaaagaauauugagagugugggaguucauuagacaucuuuggcauaauagggcaccuaaccacaaauuggaagaauuuauuauuuaaauugacagugaaacuaguuucaggcauucuuaauuccauacacuauuagauagaugacuuuuagauuagaauuguacccuuucugcagauaggaaaauguauaacgaguccuaaguuaguaauuuccauuagaaaaggcaauuguuuuuuaaguuugcuauugucuuucacuguauguuuuuugauagaaacuuaagguacuucauuuuagauugcauacaguaaucuccaggugagguuacuuaacacagccucuucagguuacuaacaaaccagugguuguaaaugaaguaguuucuacuuaaugauuauggaguugagagucuaugguggaugauaagguaggaccauacugaugaguuuauucugaagcugggugcagaguccucaagacucagucaaauuauugugcuacugaagaccucuuuucauaaaaaggauggaguuugaccuaacaagcaauccauuauucagcaugucagaugauuucuugacacgugaaaacuuucuagagacuuccuguguccacucauaagaaguuaacaugauaccaugaaaauuuuacauucuuuugauguucuuuuaaauaauuucuuaauacuacuacccugggccgggcgcgguggcucacgccuguaaucccagcacuuugggaggccgaggcgggaggaucacgaggucaggagaucgagaccauccuagcuaacauggugaaacccagucucuacuaaaaauacaaaaacaaaauuagccgggcgugguggcaggcgccuguaguccuagcuacucgggaggcugaggcgggagaauggcgugaacccgggaggcggagcuugcagugagcggagaucgcgccacugcacuccagccugcgugacagagugagacuccgucucaaaaaaaaaaaaaaaaaaaaaaaaaaaauacuacuacccugaaacuaagaacuuucaucuuuaggggaaaaaaagaugcaacuuuuuuguacuucugauaacaaguguggaucuauuuucccccuuaauuauucuguaacagaguuuaugauauggaaaacuuuacaguccuucaaauauguuuugucuugcacaaaguauugccauuuuuguuucauuacccauaaauuagucccaauauccgcuuuacuuaguuuuagauuuccacaaucuuuuuuuucuccauaaacugaaauucaagcuaaugccccgggacuucuuuuauuucauagucaguuuuacuaaacagguaacauuugcucagcuuuggcgucugagcaaaaauuuggcuuccagcacuacaggaaagcugucuguccaugcauaguauccagugguuucugucuaacgguccuuaccccuuggcaauaacugaccaagugaacaacuugucuaguucuuccuuucauuugcuuuucuugacaugacuacuaucugguucuccauuuucuaaucuaaccacuuacucccaugauccauuaacucagucuuuuugccccuuaaaugccggguucaccauagcccugcucagcuuccuauucucacuauacuuucucccuuuauaaucugauuucuuuccaugacuuccacuaucaccuccauguaaguggccugaaaauuuaucuuuuuaaaaaacuucuuucauauuguauauauaauuguuuuauuuucauauaugccaacacauuuaaaaauaaaaauuauagauauuuauauuauuauaaaauaaaaauuauauauguuuauuauagaaaauguggaaaaaacaggccgggugugauggcucaugccuguaaucccagcacuuugggaggcugaggcgggugaucacuugaggucaggaguucgagaccagccuggccaacauagugaaaccccaucucuacuaaaaauacaaaaauuagcugggcaugguggcgcaugccuguagucccagcuacuaaggaggcugaagcaggagaaucccuugaacccaggaggcagagguugcagagagccaagcucaugccacugcacuccagccugggugacaaagcaagacuccauaucaaaaaaaaaaaaagaaaagaaaagaaaaaaagaaaauguggaaaaaacaaauuauaaagaagacaaaauaacccauauuccauaaucuguuccagagagaucuaucauuugauauauuuccuuucagugguuuuguuuucuuugauauacacacacucacauaaacacaaagguaauugaacucauacuguugcaguagauauaguuuugugucugcuuuuuuugcuuuauauuauuuuucauagcaucaaaaauuuuugaaaacauuuaaauggauauuuaaucuccauuguaaucuauuuaauaauuuauuauauugagguugcauaauuuauuuguguuuugguuuuacauuaaaugaaaacaauugagaacaaauuuaugcauaaaucuuugugcaaaugacucauuauuuccuuagguuagauucccagagguugaauuaccaggucaaggagugugaaaauuuaaaaauacuaaaccugcucccaaauugcuuuuuguaaagauuagacuaauuaacauucucaacugcagugauugugagugcccaucuuagugcggccuugguaacauugaauauuauuauuaugaugauuuuugagauggagucucgcucugucgcccaggcuggagugcaguggcacgaucucugcucacugcaagcuccacgucccggguucaugccauucuccugccucagacuccugaguagcugggacuacaggugcccgccaccacaccuggcuauuuuuuuuuuuauuuuuaguagagaugggguuucaccguguuagccaggauggucucaaucuccugaccuugugauccgcccaccucggccucccaaagugcugggauuacaggcaugagccaccucgcccagcccgucuggcuaauuuuuguguuuuuuaguagagacaggguuucacccuguugaucaggcugaccucaagccccugaccucaggagaucugcccaccucggccucccaaagugcugggauuacagcaugagccaccgcgcccggcccgaauauuauuuuuuaaucuuuacuaauuugauaggcagaaaugaauuaauuuguauuucuuugcuagugagagagaacauuuuucauacauucauuucuguuucuucugugaauuaugucuggguuaaucccacucccauuuuuauuugggcguuaacauuuuaauuauguugguuuuuuguuugguauucuuuuauuuggagcguuuugugggggaagcacaggcuuuuauuagaccaaauagagugaauggagugacaaaguggaaaguauacagaaguuggaauugugguguuauaaaugcccauuguuuugaggggccagagcuugugaucaaugaagcaguacugcagaauggaaagggugcuauuugagagucaggauucccaacuuaauguugucaucaaccaaucaggugaucuuggacaagucauugauucauugacucagagccucaucuguaaaaugagaggguugggcuuuugauccccaagacuggacaaccucugugcugaaaggaugccuuuggagcuacuacuguucacuagacauucuggaauuacuuucugucucaucucuaaccuuucaccuaauuuuagauauauagagccugaggaaagacuggaugcaguaaaggcaguguccaccggaguagcaaggggagccuggggacagcuuaauuuguuugugcccuuuaacuuucaggaaaauagaaguauaaaaaaaaaauugaaugggguucuugcuguggggguugggggaagaaaagaaaaaaaaagaagucaaaaagauugguauuuuuuuaggcacucccauagacugacacuuggaaacugguaagauaaaaucacagaagcccugcugaccugugccacaaaacucgauuaucuacaauguaugugaaaaaugucucauuuugugacuagaggguguacgucuccaaggcaaguuauuuaacaacuucuucuacuucauacagaaccauucuuaguguuuuucuuugagauugguauaaacucuucuaagaauauuaauuuuuuguccuguggucaaauauuuaaccaguuugccuuuuaauuuuguauauaguauauuauuacuuaucuauagauuuuuuuuuuuuugagacagugugucacucagucacccaggcuggagugcaguggcacaaucucggcucacucuagccuccuccuccaggguucaagugauucucaugccucagccucccaaguagcugggauuacaggcacaugccaccacgccuagcuaauuuuuguauuuuuaguagagacaggguuucuccauauuggccaggcuggucuugaacuccugacccagguaaucugcccgccucggccuuccaaaguguuacaauuacaggcgugagccaccacacccagccuggauuuuuaaauuugagauuucuucuggugcugugauguuuagaaggccuucaccauccagagauugguuaaauacucacuuucauuuccuucugauuuuuaccguuuuacacuuuauauuuaauucuuuaauuuguauugaacuuacuuugaaguaccaaaccaauauguuuaaugccuuuguauaucugaguuccagaucuguauuuccagcuaccuguuaggcuauguggauagucccuguacgccaugcaucugcguacacccagauucacuaaggagaaagcuugagguuguacuuaccacuuuaauacuuuucuccacccacauuugaucaauccccaaguuuggcugauucugccccaggggugauaagaguucuuuaaucagucuucuaauucagauuccccuuuuaguuuuuugccagaguccuugaguccuugaguaauccuuagaguuggcuucaguuuuucccuugcagaaaaguuaucagaguugucauaaaaaaaaaaagcacugauuuucaaaauaugguuccuuuaauugccuguguuagaauuaccuggcagugguuaaaaagguagagucucaggucccaccuagaccugcagaucagugugucugagggaugggccugggaaccugaaguuuaucaaguaccucaagagauuuauauacaaacuuaaggggagacaaugccuaaguaaauucagucuagcuuucugacaugcucuucaagacacccacacccccacucugacagccuauucuuuuaggcuuaucucccacaacacgacccacccaccuggcacugugacccuacaauaauucucuguuuccuggaccugcccaguucuuuccugccucugugccuuugcucaugcaguuaccacagccucaugcuccuccccuuccccacccucuuguugaaauccuuuuccuuaagagcccaaaucaaaugcuaccuuuuuaaauuuuuuuaauaaaaaaaagccuuuucuaauuucuucuacuugaaucaguggcugccuccccagucuuuauacuuaacacuugauuuuugcuucauuucuuaccuuacuuaauguugucacuauuuauaaauuauugcuuccuuguaagauuacaagccuuuuagguaugagaaccuuucccuuccuuuucauuuuguggccauuaugcacauauaaacaauuaagaacucauuuuauuuuauuauuuugagacacaguuucauucugucccagguuggagugcaauggcgcaaucucagcucacugcaacccccaccuccuggguucaggugauucucaugccucagaccuccggaguagcugggacuacaggcacgcgccaccacgccuggcuaauuuuguuuuuuuuuuguauuauuaguagagacaggguuucaccauguuggccaggcuggucuagaacuccuggccucaagugaucugcccaccucagcuucccaaagugcugggauuauaggcaugagccaccgcaccuggccaaaguacucauuuaguacaugaaauauaucugaucuugcaaacacacuuuuauauaauaauguuuggcuuuguaucacacauagaauaaaauuaaaauccuuuagcauuguuauuaauccguauuuaaucugacuacuacucaucucugugucaucgcaugcuucucacuuacuuccuagcuguauuauuccuuccucagggccuuugcauuugcuuuccucuaccuggaaaacucccccaucuauugucuucaccuugcuggcugcauauguucuccccaucauucagguuucaguucaaaugucauucacucaaugaggccuucccugaucacugccuaaagaagcuguucgugucccuguuccuaccacaacuccaguuacucuuuuuguauuuccuucacaccacuaaucacagucuuuaauuguccggcuucuccaguggaauggaaauuucaugagaguagagaccaugucugucuuuuuuuuuuuugagauggagccucacucugucacccaggguggaguggaauggcacgaucuugacucacugcaaccuccaacucccagguucaagagucuccugcuucagccucccaaguagcugggacuccaggcaccugccaccacacccagcuaaauuuuuuauuuuugguagcgacaggauuucaccauguuggccaggauggucugcaucucucgaccucauuauccgccugccuuggccucucaaagugcugggauuacaggcgugagccaucgcgcucggccuugucugucauuuuuaacauuauaucuucagcacuuggaauacugccaaagacuugguaaaugcuaaauaaauauuuguugaaugaaugaauaagccuugaagauggacuuuucauuuggacaagucuuguuuuguuuugcaauccaaaguguuguauuuuuuuuaacuggacaacagcugaggucgguccaucuggguucaaaucagguagcagucucugaggaguucggaagguagcaggacaaaaguuuggauacugugacaaccaggauuaaguuccaucugagugcaaguuuucuaagguguuuccaggauccaggccacuauuuuccuaccacuauagccaucuacuucccagauuguuacucuggauuauacuagucuaucaacuccuauuacauuuucaaaagccaguguggcaaaacuaaaacccaauuacuggaauccacaaacaaccagaaguuuucuucuguuuucauucucuaggagaaaaauuagaaagcuaucuagaaucuucaagaaaaaaugaaaugauuuucauuauacuuacuauuaacacaugcucugaaauguguuacuguuuagacacacuguuuagacaguguacugauuagaaagauuuucagcaacagcuuuaaacaaaagguuucuuauuaacaucuaguugaaccagacauuauaaugaauuaguucuaauuucuauuucuuuucauugguuagucuuuuuuaauuccauuuuuuuucuuaaugcuggcuugaaguuuuauuuaaaauaaugcuuuguagaguagcugacaguuuucaaaguacuuuugcuuuuauccuuucauuuaguccucauaagcauccugugugaaucaauaccuguuuuugagaugaagaaauugaggcccaaagacagugaugaucuuuccccugccaacugaaagaccacuacccagcaaaugccucucaauaacuauuuucuacagucccgaauuaaauguagcuuuuagaagcuaaucauuaaaauucaauugaaacaguaacauuaauauguuuauaaccaggccaggugugguggcucacgccuguaaucccagcacuuuaggaggccaaggcuggcggaucacuugaggucaggaguucgagaccagccuggcuaacauggcaaaacuccgucucuacuaaaauuacaaaaauuagccugggagagagaguaaggcucccucuuaaaaaaaaauguuuauaaccaauucuuuuuuuuuuuuuuugagacagagucuugcucuguuguccaggcuagagugcaguggugugaucucugcucacugcaagcuccaccuccuggguucacgccauucuccugccuuagccucccgaguagcugggacuacaggcgcccgccacaacgcccggcuaauuuuuuguauuuuuuuuaguagagaagggguuucaccauguuagccaggauggucucgaucuccugaccucgugaucugccugccucggccucccaaagugcugggauuacaggggugaaccaccacgcccggcccuauaaccaauucuuaauaagauaccuagcacugguccagauaaguagccaaauuuuaucacuuguguggcggugugauuugguacaucuuuaugugaucagccucagugaugcuuguccuuuauuaaggcauuguuacgugguagcugcucagauuuuuuuuuuuuuuuuuugagacggaguuucgcucuuguugcccaggcuggaaugcaauggcacgagcucggcucacugcaaccuccaccucccggguucaagcaauucuccugccucagccucccgaguagcuggaauuacaggcaugcaccaccaugccuggcuaauuuuuuuguauuuuugguacagacggcguuucuccauguuggucaggcugaucucgaacucccgaccucaggugauccgcccgccucggucucccaaagugcugggauuauaggaaugagccaccgugcccggccagcuucucuuuuaaagaaaggaaggauuaaagaacuugccuagagaagagucacuuuuuaguaaauccauuuuaauucuccugcuugaagguauugguuaaacugaucugaacugacucuucagauugagcaaguccugaaaaacagcacaucaucuaaaauuucagauaagaauggaagccaggcccuuccuggaaauguccagaagugaaacuaagaagcccuguauuuggagaaaacuugauuaguuauuaaggacaaagggcugcuuuaagaagguuauaucuuuaacagaaggagccuuccuaaaauaagcguauguguuucuuuugcuuugagauuguaaagaaggcuccuuaaugaacuauuuugccuuaauuaagcauguaauuggcaagacuuaugagcauguaguuucucggcagauuuucaguuauguaggugggccuuugcugagauguguggcaauucaguacuaguguaacacuguuuuucauucauauaacagauauuuauugagccccuacauguuccaggcacugguauucaguacaucugauguuaaaguauggaaagguacaaagguuaaaggagaaauaugcuguucagaggaagucugugcuuugucgugauggucuuggucaauuguaaauuuccacauucuuuuucuaauuagcuauguuuuucucuacucuuuaccuuaaauuugaagcuagugacuuaaugaucuguuuuucuacuuacugaaagagauuuuucuuacuaugugugaaaaaaaacuacuggaaaaauaagaaaaccucacuucguuggauuauguuugcccuuagaauaaguuaaugaucagcugggacggggagggaaagaaccaaaugagcaaauaacaaauuuuauuaauugggagagagguggaguuagacuugaauuugaucugguaauuuuuuaauuuaaagggaaaaaaaaaagauuaggaaaguucuugggugguucuucaugaccuacaaauuuuagaccaaagucaguuguuuuuguuuuucaagauagagucuugcccugucgccgaggcuggagugcaguggcauagucacggcucacugcagccucaaacuccugggcucaagugauccucccaccuuagccucccaaagugcugggauuacaggcguaagccacagcaccuggcccaaagucaguuuuuuguuuguuuguuuguuuugagacggagucucgcucugucgcccaggcuggagugcaguggcacgaucucggcucacugcaagcuccgccuccuggguucaugccauucuccugccucagccucccgaguaauugggaccauaggcacccgccaccacgcccggcuaauuuuuuguguuuuuaguagagacgggguuucacuguguuagccaggauggucuugaucuccugaccucgucauccgcccaccucggccucccaaagugcugggauuacaggugcccaaagucaguuuucaaaggcuguaacugggguuacucuuuuuuaccugucuaaauaagauaugugaagauuaccacaauuauguaaaaaacuaauuugggguucauaagcacaagaagauaagauauucacacaaaugaauaagguaauagaagcccugugggaagguuauaguuauguucucuucaacauagaguucuuuuuuuuuuuuuuuuuuuuuuuuugagauaaggucucacucuguugcccaggcuggagugcaguggcgugaucuggauucacugcaaccuccaccuccaaggcugaagcaauccucccaccucagccuucugaguagcugggauuacaggcucaagccaccacaccuggcuaacuuauuuguuuguacuuuuuguagagaugggguuuugccauuuuucccaggcuggucuugaacuccugaacucaagcaaucuauccuccuuggucucccagagugcugggauuacaggcgugagccacugugccuggcccaacuuagaguucuuacagagguguugaugcguugauaacaccuaaaauuuuaucccuuuuuuuuuuuuuuuuuuuuuuuuuugacagaguuucacucuuguugcccaggcuagaguacaauggcgcgaucucggcucaucgcaacuucugccacccggguucaagagauucuccugccucagccuucccgaguagcuggaauuacaggcacgugcuaccacaccuggcuaauuuuguauuuuuaguagagacgggguuucuccacguuggucaggcuggucuugaacucccgaccucaggugauccgcccaccucggccucccagagugcugagauuacagucauaagccaccgugccuagccuuuuuaaauuuuuuuuuuuuuuuuuuuuuuauuugacggaguuuugcucuuguugcccagguuggagugcaauggugugaucucaguucacugcaacccccgccucccagguucaagcgauucucuugccuuagccucccaaguaguugggauuacagacaugugccaccacacccggcuaauuuuuuguauuuuuaguagagacgggguuucuccauguuggucagcuggucucaaacuugugaccucaggugauccucccgccucggccucccaaagugcugagauuacaggcaugagccacugcgcccgcuccuaaaauuuuauccuuaagagagauaacuuuuaccgauuuagacuuuauggugcagagaaauggugucaggucuuugaucagaucugguguuccugguaguaaccaucaguuucucagauauuauuacauuagagauauucucuuuuuauuggugauuuaacagaaauaagcugacccugaaauaucauguacgcuagaacugcuuuucugguuuauuuuccgugcugcagaucauuuuguuuccaggccaaccuccuaaaaaaugaaaagagcuaacauuuauuuaacuucuuugggccucaguuucuucaucugaauauuauucaauaauacacuuacauaaagugagucgguaauaauucugaguguguuacugugaagauuaaauaaguuauauaugcaaaacaauuaagacaguaucugacacaugguaaauggucaauaaauguuagguauuuuuauuaccaccacugcuaucauuauuaaguacuuauuuuagcaaugugcuaagagaacauuuuagugaugaugaaacuaaggcuuagaguaauuuuccucauguuacccaguaagugugugguagacucaauauguagacuugagccaaaaggagccuuggguagaguuggcuuagauguggaauaggcuggggcaucuggcccagccuuuaauauuccuaguuucaagacucuuaaaggauaagaccgguccagacagccccuaaauaccgggaagaugugguuuguaauaugucauuagaacauggacauuauggucugugggauuguuucaaauccuagcucuaucaguuauuagcucugugaccuugagcaaguuauugaacauuucuagagccuuaguuucuuccucuguaaaaugagaauaauaaauauuugcugacccagugugguggcucaugccuauaaucccagcacuuugggaggccaaggugggaggaucgcuugagcccaggaguucaagacgagccugggcaacauagcaagacccugucucuuacaauaauaauaauaauaauaauaauugcuucauggcaguguaagaauuaagugaauaagaucaaauggaaugagauaacauguaaagcaccuggcauauggccaguacucaauaaccaauccucaggcuuaugcuuaagggguucaaacuuguaccugauucugacauuaucugucuagauggugagcguuuagggucugggucugcaaaaauuaacauguuuggacuccauaugagagguucagauuccauaggugauccugauacucagaguaccacccuuaucugaaagcacuagacugggugguggaggguagcagcagugauccucucucaaugccugggcugucaguguccgucaggcuucuuacaggguugugcucugcuuagaauauuaaugagcagucagggguggguguccugcaaaagggaaccccgcagaaacgaggcacucaucuguauagucaagcggcauuuuuguuuggaaagaauauuaaugagaucuggauaagaaucagacaccaggaaaggacagcugcugugagaggcaaauccaauuguacaaggaguuacacaugauauucagaaaguccuuguauaauuuaaaaaaaaguaaguuguagagauaauaaacaauuuauaaaugucguuaaaaaaauaaauguggccgggcacgguggcuuacaccuguaaccccagcaguuagggaggcagaagugagagauagguugaggcuaggaguuugaggccagccugggcaacauagugagaccucauucuucaccaaaagaaaaaauaggcaggcugggugugguggcucaugccuguaaucccagcacuuugggaggccgaggcagguggaucacaaggucaagagaucaaaaccauccuggccaacauggugaaaccccgccucuacuaaaaauacaaaaauucacugggugugguggcaugcaccuguagucccaacuacucaggaggcugaggcaggagaauugcuugaacccaggaaguggagguuguagugagccaaaauugcaccacugcacuccagccuggcgacagagcgagacucugucucaaaaaaaaaaaguaaauguggccagggggcacggugauucacaccuguaaucccagcacuuugggaggccaaggaggguggaucaucugaggucagaaguucgagaccagccuggccaacauggugaaacccuaucucuaaaaaaaaauacaaaaauuagcugggcgugaccgggugcgguggcucacgucuguaaucccagcacuuugggaggccaaggcagguggaucacgaggucagcagaucgagaccauccuggcuaacacggugaaaccccaucucuacuaaaaauacauauaaaauuagccggacauugugggggaugccuguagucccagcuacuugggaggcugaggcagaagaauggcgugaacccgggagauggagcuugcagugagccgagauugcgcaacugcacuccagccugggcgacagagcuagacuccgucucaaaaaauaauaauaaaaauaaaaaaauuagcugggcaugguggcacgccccgguaaucccagcuacucaggaggcuaaggcaggagaaucacuggaacccaggaggcagaggcugcagugagccaagaucaggccacugcacuccagccugggugacagagugagacucugucucagaauaaaaaaaaaguaaauguauugaguggccaacacauauuugaaaauaugcucaaccucacucaugauuaaaggagugaaaacuaaaacaauaauguaccauuuucacacaucuaucagauuggaaaaaauaaaaauaaugcuuauuacugacaagaauguggagaaagauucaaauauaaauggaugugacuuuuuugagggaaaucucagaauaucuauuuaaaaauuuaaugcauaggccuuuuaaacuagaaaugcuccuucuaggaauuuaugccguagaugcaccccgccccagguaggcaauaguacaagcauguuuguuccauucuuauucauaacagugaagaagcaaaagcaaccuacaugaucauccacaggggccuuguuaaauagguuuuaaacuauuacagaaugaaauauuaugagguacugaaagauugagauagaucuguaugcccugaggugggaagauguucaagaggaaauaaauaauugcugaacagcacauuaacaugaaaccauuguauuucuaaaacauguuuguauuuaugcauguugugugucaauuucucugugccucaguuuucucaucuguaaaauaggcauccugaugguaccuaccucaugacuuguugcaaggguaaacugagauaacauauguagagugcuuaguacagugacugacacauagugcuuugugguggcaauuauuauuguauagguaauaacagaaaguuuaugcuccagacuuugacagagguuaccuuugagaaguagaauugguuuggggggagggcagacaagagcuggcagggacuucuacuucuuacauuguguauuuccauagcauuguuuauauggagcaggcccaucccuggccagucacugaccgaggagccuagacagugaaggaaguggcagcucuguaggcucaacaaguaggcuuguugagaccugcagaagaagguuccccaugggaaggaggaggauaaggaaggguggugcuguguggagaugggaaggauguuuguggauuccaccauggcuacugaaguuuuuuuuuugaaaaccaccugaccuaauuaaagauuuaaaaaauuuacauugcacaagaaccuuacaaagcccagcuuguauuuggacuuauccuuuuuauaauucacuaaguuauauuuauacuaaaaaagugauuuguguuuaauuugacuuuugaauaaaaacuacagaaaauaauuggucaaagugcucaaaacaaacauuuuaaaaaauggguaguuuuucuaauaauuaugaaauaaaaauauugauauuuuaaagaaacaauuucucuucaacuaauguuacuacuuccauuauauagugaugagcaauuuuuuuuuuuuuugagauggaauuuuguucuuguugcccaggcuggugugcaauggugugaucuuggcucaccgcaaccuccaccuuccugguucaagcaauucuccugccucagccucccaaguagcugggauuacaggcaugcgccaccacgcccggcuaauuuuguauuuuuaguagagaugggguuucuccauguuggucagacuggucucgaacuccugaccucaggugaucugcccaccuuggccucccaaagugcugggauuacaggcaugagccaccacccuggccagccauguuuuaaauaaugacagcaacuuucaagcuaaaaagucaaacagcugaagcaaauguaacauuuuugauuuuuuuuuuuuuuugagacggucucacucuguugcccaggcuggaaugcaguggcaccaucacagcucacugcagccucaaucuccuaggcucaggcaaucuucccacuucagccugucaaguagcuggaaccacaggcacccaccaccacacccggcuaauuauuaaaauuuuuuguagagauggagucucaccaucaugcccaggcugaucuugaacucuggacucaagugauccucccaccucagccucccgaaguguuaggauuacaggugugagccacugugccuggccaugaauuauuuuuaaucacagccuuauugaucuaaaccuuguuaagucaauaugacacauaaaguaagcuaaacccaaauaggaguucuaguaucugaaccuuuagaauaauguuuauugaauguggcuuagacucugaagcaugcgaagacugacaagaucugccucugaccucaagcaaugugcugggcacuguuuuacauuuauugucuccuuuaguuuaaaacaaccccguaaggcagauuuaucaucuuccuuuuacauagaaggaaaguaaaguacagagagguugccaugcaucugguaaacacuagaaugggaauuggaaccagcugcuauuuccauucuacuguccugccuccagagggucaugggguaagggugggcaaggugagcccugggggggccacaugagaauucucagggaccucagugaucaucugucaucgagucuaaugauuuucaagccauuguuuaaaaauuauaaaguuuuauugaaaaauuauauaccauacaauucaccuauuuaaaaugcucaguucagcgguuuuaauauggucacacaguugugcagccaucaccauaaucaauuuuacaacauuuuaucaccuuccagagaaaauucauacccaucagcagucaguuccuugucuuccuacugccagucccaggcaaccacuaauucuuuuucugucucuauagauuuuccuguucuggaccuuucauauaaauguaaucauacaguaaauggucuuuuguggcuggcuccugucacuuagcuuaauauuuucaggguucauccauguuguagcaugugucagcacuacauuacucuuuauagccgaauaauauucccuuguaugggcauaccacauuuuguucauccuuucaucaguugacgaacauuuguguacaaguucuguguggacauguguuuucauuucucuugaguauauauauauauauacauacuuuauauauauauauauacuuuauauauauauauauauauacucucuauauauauauauauauacucucucuauauauauauagacacacacacacacacacacacacacacagaggaauggaauugcuggaucccaugguaacucuguguuuaaucuuuugaggaaccaccagacuguuuuccaaaguggcugcaccauuuuacauucccaccagcaguguauaacgguuccaguuucuccacguccucgcuaacacuugucaaacuauauuuuaacuauaccccacaauaagaaauauuuuacauuccuacucaguuuauacacauacaaauaacugaaacaaaaacuuuagaaaaaaccuaccuauacuaugucugaugcacuuugacauuuucgauugcauucuguucuuuuucaucaaaacaaacauguugcuucugaucgcucaaguugcuuuuacaacucacuaauugugaccugcagcuagaaaaacacuaggcuauuuuaaccccuucauuuugcacaagaagaaagaggacccagagaaguggcuuguucauggccauaccacuaauuaguggcagauucaaaaugagagcacaagccuguuggcucccugcuuuaacuuugaccucucaguaaauuauaguugcccuuuuauucgguagauaaaaauaaaauaguuucuauuuuuuaagcuucuuaucuuucucaagcagcauuuuaaauucagcaacagaccuggcuagaggaaaaaaaagaaugagaauaacucaauuuuauuaucacgagucauuguuuuaacacaaugauuuugugccgucuggacagaaaaguacuaggugaaccuagaugaugggcaucaaauuaggcagauugaauuaaucagugcagugucucagauucauuuuuguccaaaccucaguguacuuuuaaagagcagccauuuuccuuacacugucaaauuugaauggcaacaugaaauugaagugggcaauauaagaaauauuuuauguugcugucuuuccauuuuucuuagaauacauguaggucuuaaacccuuuacuuacuuauuuuugagucagagucuugcucuguugcccaggcuggagugcaauggugugaucauggcccacugcagccuugaccuccugggcucaagugauccuccuguuucagccaaguagcaaggaucacaggcaugcaccaccaugcccaguuaauuuuuauuuuauuuuauuuuauuuuauuuuauuuuauuuuauuuuauuuuacuuuauuuuuuggcagagaacaggucucgccauauugccuaggcuggucuggaacuucugaccuuaagcgguccugucuccucagccucccaaagugcuaagauuacaggcaugagccacugugcccagccuuaaacccuuuaauucaguguuuuccagcauuugaugagggaaccucugacacuagaguugcuucaacguucuucuuauuaaaauguggguuuuuugagcccuucuccagaccuaaugaaucagaaucaugggaugggaccugaaaaaucaguauuguauacaaguuuccuaagugauucuauguacacucaaauuugugaccaacugaauuaaguguuuuucccccuuuauuucucaucuuccuuuugguuucuaaaauuacuauuuggcuuuguuaccuguagagccaaauaguaauucauuagcauuuauaagaaaacaccuaaauuaucucaguagaaggaguuaacuaaaacaauauugauggguuucaguuuuauucuaccuuaguagaauacuggagaccauuuuuuugauggcuaucuccacugguuucccauaccuuggaaugauuuauuuuggaauaaacauauacaaccuacucuauuguuugauuucuuuuccccagaaacacuagucucuaaaaauagcugaauccaaaaaauuauuucagaugccugggaucccucucuucauuaacaaauacuugagugccccccaugugucaggcacuguucugcaaguuaaaauacagugugauuuuaaaaaauuacagugugagccaggcacagugacucacaccuguaaucccagcacuuugggagguugagcugggaggaucgcuugagcccaggaguucgaggcugcaauaauuaugaucacaccacugcguuccagccugggagauaagagugagaccuugucucagaaaaaaaauuaccaucugaucagguagggauaggucuaauacuuugagaacuuauagggaaccuuuuagcccaagcuugaggggucagggaaggcaucuggaacaaagugucacccaagcugggacccauagcagaaggccagggaggcucaagcauuuucagacagaggguagcaguguccucggggggaguagugugcucagagaauggcuugcaucaagaaauaacuugagcauaccuaaagaugugaggaaaagcuugugcaaaauccauaugugcaaagcuuuguccaauuuuauucaagcugcauuuauagaguuccuucuauuuagaaagcaauacacuaucacgccucuaaucccagcacuuggggagguuguggugggcagaucacgaggucaggagauggagaccauccuggcuaacacggugaaacccaucucuacugaaaaauacaaaaaauuagcugggcgugguggugggcaccuguagucccagcuacucgggaggcuaaggcaggagaaugacgugaacccgggaggcggagcuugcagugagcccagaucacgccacugcccuccagccugggcgacagagcgagacuccaucucaaaaaaaaaaaaaaaaaaaaaaaaaaaauauacuagauggcagaaaagcaaaagacaaaaaaagcagggagagggguaaaauagcauuuacugauaaguaaauaaguaaauaaaugacuuccuuuuuuuuuuuuuuuuuuggggcaaguuauuaaacuugcccaagaucacucagcuaguguucguggugagagaucucaacagcuaaauucuaauccaugccccaugcccuuagccucuugcuauuuucuuuccaaaaugugucccuguguuaggcauuuuauauagaauuuuugacuagcuaggguagguaaugguauaugccucagagaaguaaagaaacuugcacaugucaccacaguuagaggcccagugagaaccuguaaguucuccuuuuaacuucaaacuuuguguacauuuuguuauacuauguuauguguuauuuuauuugauagaagcaaaaauucauauaccaauucuuuggagaaaaaugauuuguaauuaaaugaacuuaauuugaagaguagagguuaagaaaggauaauacauaugauuuggguuauguuacguugcauauuggacauaugaaacuauccagcauggaguagaaauucuaggacugggcugggcgugguggcucacgccucuaaucccagcacuuugggaggccgaggcggguggcucacuagaggucaggaguucgagaccagccuggccaacauggugaaaccucgucucuacuaaaaauacaaaaacuuagccggguaugguggugagcaccuguaaucccagcuauucggaaggcugaggcaggagaaucacuugaacccaggaggcggaaguugcagugagccaagauugcgacauugcacuccagcaugggcaacaagagugaaacucugucuaaaaaaaaaaaaaaaaaagaaacucuaggaguggaagccaggaaaguuaggccuuaggauccagcuuugggaaucauguggaauaagugacuuuugaugaguugagaguaagugagcucgcucagagaagggagagagacugacucuuuauugauuccugggaguaagaguggagguaggaaaagaggauucugcaagaaaagagaaaaguggaauuuauucucaauuacacagccucauuuuuguugcuuuugcucugggucuuaguguuuuugaaggcacaaaauauccuuuaaaaggcgauaaagagaucaaauauuauugaagugagucuguccugauguaaacauuuacauucuuguugaccccugggaauuuggucaauguuacaauugugcuauugucuagauucauguuucuacacauaccugaagcucuuccaagaacaguagcagugauuauucuaacaugccugcagacuugucuaucaucauguuucugaauaauagaguagugagcuuuuuauuuauaacauuugauguuauuuagugguuccauuuuuuuauauugugaguuuauaugagaguuugaauaagcuaaaauuacuggguaauucacaguucugaaaaauauaugcuuccucauaacuagucuugggacugcaggauaagcauucaguuucuguacuaauuguguuucagauaaaacuuaaagcuauguguaauuuuauggaaggcguauuuauagaguucuuucuauuuagaaagcaauguauuaaauacuagaugucagaagguuaaaagacaaaguagaucugucuucugacuucaaauaucuugcuauugaguaggaauuaugaaauuauuauaaggcagggggauugacuuaugcugauuaggaauagggcuagggcaguuuggaaaagggccauguguguucuuucacuugagucuuuuaaggugaauagguugaguacgggauaacauuucaaauggagugaaaaaaauauacgguguaucaugggaggagaagcugguuauggcauaauuuuagagauucuagaucuguuuucagaaaucaaaguucugugggguuaggcuuuuuacuaucagagaaagaaguuauaaauaagccaagagggaauacuagaaugaaccuugugaugcuagacuggagucagaaauaucaguaugaauuuauaguuuauaaaauuuuuauagggcugggcgcggugacucacaccuguaaucccagcacuuuggggggccgaggugggcagaucacgaggucaagagaucgagaccauccuggccaacauggugaaacccugucucuacuaaaaauacaaaaauuacucgggugugguggcgcaugccugcggucccagcuacucagaaggcugaggcaggagaguggcuugaagccgggaggcagagguugcagugagccgagaucgcaccacugcacuccagccuggugacagagugagacuccaucucagaaaaaaaaaaaaaaaaaaaaaaaaaguauagguagauauagagcuaaauaaagaaaugugugccuauaggccaggcacaguggcucacaccuauaaucccagcacuuugggaggcugaggcgugaggaucacuuaggcccaggaguuugacaccagccuggacaauacggggagacucugucucuacaaaaaaauuuaaaauauuagccaggcgcgguggcaugugucuagucccagcuacuuggcaggcugaggugggaggaucauuugugcucaggagguaggcugcagugagcugugauugcaccacugcaguccagccugggugacaguggauucugucacacacacacacacacacacaaaaagcaguguguauacaugggccaguauacauacauauaauucuugguuuuguccacuaagacgccuagaagcagugacaucucaguggcaaugagcauaacuaguagugcccagaugcuaacuucucccauaaaagaaaacagggcuccuuggggaaauaguugauuccagggcugaggcaugguaaauacaagacgagccuggaacaucuugcagugcuagaaaguaaggaagugcuaaaaacaaaacaaacaaaaaacagggcaaguugagagaacacuggagccaagccaaaaacuccaagagcuggaacaauuuaagcaauaaaauaaggauaguauuggauuauaauacagggaauaaaguaacuaucuaugaaaccauccuaauauaaauaaaugguugggcuggacgugguggcucaugccuguaauccuagcacuuuggagggccgaagcaggaagaucaucuuguggcauacugccaagguuacuacuugagaccaucacuaugacaguuacuacuguuacuacuugagaccaucauuauaagacugaacuaaggguguggaaagcagaaaugaaaacuuaaaaguaacuauuuuaaaggaaggggucagaggaagaaaaagagaguucccugcuucuagugagcaaaggcagcccacugagcuuccacagcccuuuguauuuauuggguagaaagagcagggaggaggagguaacgauuggucagcugcuuaauugaucacagguucauauuacuguuaacagguaucaauuaugccuaaucacaagaaacacugcuggugugacugcccucagcauuccuucuggguggcagaugcaauuugucaguuugccaacauucugcauucaugagaacaguuugcuguuuacucauauagccuccagugguauacugaguugaucacgacccucacucuuucggccuucaacaucaucugagcucaggaauuugagaccagccuggacaacauagggagacuucaucucuauguaaaugguucuaaguaauguaaaaucuucuaaguaaaugguugaauaaaugagggagaacaaaucuucguuauagaagaauuucaauuaauaaauguagaaaggaugacaguaacagaaaaucaccauuagaauaccaguaauaauugccauaagcaagacacacccaugaaugcuaaaauuaaugggaaaaaguuuaaggagaaacagagucaaaguucucccucauaauauuuaugaauuacaaagggaaaacaaauaauaacuuuacagaggagaaaccugauauaccacauuaaccaugugaucaaggcuaaugucgugaguaauaagacaucacaucaacaucacguacccucugauaugaugcacugugaagggaacaucaacucuggauuauuccuuucaaacauuuauaaucucaaucuaaucugagaaaauaucauguuuuuuaaaaaaacuuuuuuuuguuuugucuuuugaguauugcaagauguuccaggcugaucuuguauuugcccuuccccagcucuggaaucaaccgcuucuccaaggagucuugauucuauuuuauuggagaaaccaagaaacccaaauugaggaacauucuacauaauaucugaccaauacuuucaacaauaucgaggucaugaaagacaaggaaaagcagaguaacugucauagauugggguagacuuaggaagacacgacaacuaaaugcaguguaugauccugaaacagaaauaagacguuaauuaaaaaacugguggaauuucaauaaagucuauaguuaauaguauuguaccagugcucauuucuuaguuuugcuaauuguacuaugguaauauaagauaaagcuaggugaaauguauaugggaacucuuguacuguuuuugcaacucuuauguaugaaauuguuucagaauaaaaggugagugcucacuucagucauacauauacuaaaguugaaaugauacagagaagauuagcauggucccugugugaaguuaacacacaaauuugugaagcaguccauguuuaaaaaaaaaaguuuaaaaaaaaaagguuaaagaacuauuaacuuccagccaggcacgguggcucacgccuguaaucccagcacuuuggaaggccgaggcgggcggaucaugaggucaggaguucaagaccagccugaccaacauggugaaaccccaucucuacuaaaaauacaaaaaaaaaaauuagccgagugugguggcacaugccuguaaucacagcuacccaggaggcugaggcaggacaauugcuugaaccugggaggcggagguugcagugagccgagauugcgccacugcacucuagccugggcgacagagugagacuccaucucaaaaaaaaaauaaauaacuauuaacuuccaaaaaauguucaagaaugugaauuuagucacuauuuuuguacagaaauauaaauuuagaaauguaauuuucugaaaaaacauuauguagcaauguauuucauguugcuuuuauuuaaaauucccuuugcaacuugaaguuuuuuaguuuuuuuuuuucuuuuaauugcucccuuuuaccugaugacauucaaauugggaagagagguugguagaaaaacuaaaacucuacaaucuauuucuuaaaaauaauguuuuucuuuucuuucuuuccuuucuuuucuuucuuuucuuuacuuuuuuuuuucuuuucuuuucuuuuuuuuuuuuugacagggucuggcucuauaguccagguugaguacaguggugugaucacggcucacugcaaccuuaaccucuaggcucaagugacccaccucagccucuugaguagcugggaccacagacacaccaccauggccagauaguuuucuguauuuuuucuuuguagagacaggguuucaccauguugcccaggcuggucucaaacuccugagcucaugugaucugccugccucggccucccaaagugcugggauuacaggcaugagccaccacauguggcccauuuuuucuucauaagugaguuuguaguuuuuacuuuguucuaauuuuuugaggcuauguucaggaagccauacagcuugaauaaguaaccaucucaggagaaaaaaaagagaggaggccacugagaucggauauauaagaacaggauuuuauuaguggcuuggggagggcugguugcagggccagcucauuuauuuuuugguuugguuuggugguuuuuuuuuguuuuguuuuuuuugguuuuguuuugagacagagucuugugcuguugcccaggcuggagugcagugacacaauuuuucuucugccucacccucccgaguagcuggaauuacaggcaugcaccaccacgccuggcuaauuuuuguauuuuuaguagagacaggguuuuaccauguuggccaggcuggccucgaacuccugaacuuaagugauccacucaccuaagccucccagagugcugggauuacaggcauaagccaccgcgcccggcuguuuuuguccaagccugguuucugagagacaguuuccuuggucaggagagucuguaaaugaauuuauuagaauagguuucuuggagcaguuaccggccucaccguaagcaacagcuugaggaagcagauaccuggggcagauuucccagugagucacucuucaacuuuucaaggaccuuuguucgagagaucuuuaucuccaagcuacagcuuacccuacccuaggacaauuuaguggcccaucucaagcuaccugguuugauaaaagaacauugauccugggaguuagaacucuagcucuaauacuaaccagcuggugacuuuggaaaaugauuggagcuuuaugcaucucaguuuccucacuguaaaaaaggggauuugguuacuugauuuccaagcuacuuucuuaaugaaaaaaaucugccauuuguaucugaaacugaaggcaucuuccuucucagcaaacuguuccccuuucuauguauaccauuuauuugucaugcaacgauccuucuagucucugaagcuaaaaaucuguguuuauuuuuguuauauguuuccuuuaacucuugcagccaacugucuuccaauccagcaguucuuccuucacaguucaugugguaguagaaugcauaugacugaagagaauggguuuuggagucugaaagucugaaaauggaacucauaucugagagagacuguguggguggggagagauaauauaccuuucuuuuuuuuuuuuuuuuuuuugagacagagucucgcucugucgcccaggcuggagugcaauggcaugaucucgacucacugcaaccucugcuucccggguucaagcaguuguccugccucagccucccaaguagcugggauuacaggcgccugccaccaugccuggcuaauuuuuuguauguuuaguaaagacaggauuuugcuacauuggccagacuggguccggaacuccugaccucaggugauccgccugccucagccucccaaagugcugggauuacaggcgugagccaccaugcuggccccaauaccacaccuuuaaugcaggccaaugaaagccaguuacuacaauggaggguauuccaagugagcccaggauaacuuuuaaguuucccugaaagcaggaaugauuaucucugauauucaccacucugggaagauacucaccacuauucucuuacugaaaaauaauuuguauggguuuucagcuaggugguucagggauuuuucuagcugguuuucuacauuggcuaaaaguggcgguuuuaaucauucuucauuaauuguaguugaaagaaaauggacuuuggaaucaaacagaauaugcguuugaaucccagcucugcuacuuuauagcuaagugaucuuuguaaaguuaauaugucugaaucucaauuucguuaccauaaauauaagacaauaaaaccaauccuguagaaugauugugaggauugagauauaugcaaagcauaaaguuagugucuuaaaaucuuccaagagucggauuucuaacuuuagcuuugaauuuguaguuuccuauuguauaucauuuggauuucucuugcugacauguaugucucaacauguguaaaucaacacucaucauuuucccucuucuuucuauauuuacugucucuguuaauggaaucaacagccuuccaucauucggguuugaugaugccagcuuugauucucuuuuacccuaaguucauuuuauucuaagaacugucaauuucucucuucccacuuuuccauuuccaccuacccuaauuaauuuacgaauuuaaaccuugauuaccucucacuuaguuucaggaucuucuugacuaguaauuuagacuccagucuuuuucccucuuagcaaguugcacacuacugcugaauaauauuuuaaaauaugauguuagucauguuacaugcuuuuucagaaacuuucuguguuccaccagagagacugugguuaauccacuacagagaucuuaucuuacagguguggauauugaggaucagaaacuuuuuuuguuauaaaaaccaugcaugugcuaaguaaauagcacauaagauuagaccuaaucucugaucacucauggguuacuucuucccacuauugaaauauggcccaaacuccuuagcaugguuuucuucccagucaggccccauuaugucuuuuuuuuuuuuuuuuuuuuuuugagacaguuucgcucuugucacccaggcuggaguacaguggugcaaucucggcucacugcaaccuccgccucccagguucgagagagucucuugccucagccuuccgagcagcugggauuacaggcgcgugccaccacgcccagcuaauuuuuuguauuuuuaguagagaugggguuuggccaucuugggcaggcuggucucaaacuccugaccucaggugauccgccugccucagccucccaaagugcugggauuauaggcgugagccaccacaccuggccaagucuugucuaucuucaacuucucuugcaccuagaguuuaacucacuccccaaaggugcuaaugcuauucuccuccuuccuccuccugccuucacuuugaugaaauucugcccguucuuuaagucccaagucaucugauaucuuuuccuuucccucucacaaagccagaaaaucaggucuuguauuccuacaccacgcauagccucuaaccacauucugucuuguacuauaaauauuuguguguaugucagcaagcacaguagauuauguacaccauucaggcagggacaucucccuacaucucauaagaaguaguuauucaauagccugguaccagagucuaucaaaaaucauguauugauucucacguuuaucuguuucauagguacuaaucacauugcuaagaaauaacauuaugcuucugugaagacaaguguggucagggugagagucaucucauucccugaguguaagaacucuaagaacugugugccucuccuagcuguauaccaaaauagauguucugacuuuucuuaacuuucuggcugggaguaaucaaaaccacggacuuagacuugggaguuaaccuuuuuuuucuuuaucgugcucgguaucucaaauaauaaauccuuuuccuuuuuuagaaacauaccuuuuuuuuuuuuuuuuuuugagguggagucucauucacucugucacccaggcuggagugcaguggcaugaucucagcucacugcauccucugccuccaggguucaagugauucuccugccucagccucucaaguagcugggauuacagggguguaccaccacaccuggcuaauuuuuguauuuuuaguagagucuggguuucaccauguuggucaggcuggucuuggacaccugaccucaagugaucugccugccucggccucccaaagugcugggauugcaggugugagccaccgugccuggccugcaaauguaucuuguauauauuuuuuccccuuugauccagaguugaucuuuauggaagaacugacaguauuuauacccacaacuauauugguaguauauuucuaccaaauaauaucuuaaagcauucauuagcauuuccuuaacuugccuuacagaguuuaaaaaaaacuaugauaguuuuauauaguuaaguuuagcugaaauguuuguugcuucugugucuuuuucaucuuagagaaggggcuggcauuguuuggugagucugccaguuuaauaccagauagacaaauagguaucauguauuauuugguacauuccaguuuauugcaaaguacauguauagaauuaagauuauuuuguucaggaagaaaagaaaacauuaaaaacacuaaacaguaacauuuauugcuuacuuauucuguaucagggucuuuucuucuuuaucuuauuuauuucucauaagaauacugugaaguaaaugcuauuauuauggaugagaaauccaaguuuuagggaaacuuuucauuaagugaugaggccaacauucccacuuagacuuaucugucucuaacccagagcuccuuaccauuaaagggcauacuaugccuuccaacaugaggauuaaaacauauuaacaaaacuaguauuauuuuccgacaaggauuucauuggaagaacaaauauuacauguagaacaguaguaguguggucuuuuagaauuguccauugcuuauucugcaucacgggacuuuuuuuuuuuuuuuuuuuuuuuuugagaacaucuuggucugucacccaggcuggaguccaguggcgcaauucauagcucauuguagccuccaacuccugggccuaguagcuaggacuauaggugugugccaccacgcccagcuaauuuuuaauuuuuuguagagaagagggggucuugcuauguuacccaggcuggucucaaacuccuggccucaagcuauccucccaaagugcugggauuacagguaugaaccaccaugucugacccaggaccuuuuuuuuuuuuuuuuuuuuuuugaaacggaguuucguccuuguugccugggcuggagugcaauggugugaucucgguucccugcaaccucugccucaagcaauuuuccugccucagccucccaagucgcugggauuauaggcaugcgcuaccacuccuggcuaauuuuguguuuucaguagagacaggauuucaccauguuggucaggcugguccuaaacuccugaccucagaccucaagugauccacccaccucggccucccaaaguguugagauuacaggcaugagccaccaugcccagccugacccaggacuuuuaaugugaaauggcagcuugaguugcuggauuuaaauacucucuguguucuacaguugucaagguuauugaaagcaguaccugaugaaccauacauucaaccagaucaguuaugcucuucgguugccaagagcugcaaguaguacuuuauuuuucuuuuacuucugguaagcugugaauuagcaguacuuuauuauuauuuuuuuuuaguuuucaagacuccuggaucagaaacaaagugguacuuuauauuuuucacucuucaaauaaggaaacuguugacucauuucuaaucucucgucuucuggacaaagguuggaacuccuuuccuuugguaauuaguggggcaaaauaaccaaacgauccagauuaauggguagggacuaggugauaucaaggguauggcuuuauguauucuuuggcugaaagggauguuggaaaauaggguuugucuccugaacuuaaaguacauuauacuucuccuugauaaaggcuuuaaaaugagaauuauaacaagagucaaugauaauaauuauacuuaaaaugcucuuaauacuacuguaauauacccaguauuuuaaauauauuaucuccuuaaaucuauaucaaaaccuccuaaagauagauauuauccuuauuuuuuagcugaagaaagugaaauggaaaauauuacauaauauguucaagguaacaaaguuaggauuuccccgaagucugucucaccuuaaagcccugcucuuccuauuacaccacgcugcgcccccagcucucucccuggcacugaguggccagugcugcagagcuuggggagagagggcagccaaaagaaacuugaauguagguagaaacuaauuuggaccuggcucuacugagaugcugacuguaccuccccugggauguaauucagaagagggaaacauuucacuccaaaugugacuuuggaacagacuucaguucagggaaaggccaauugauguuugcacaguggggucagucauaaaauggaacuggaagggaccuuaaaggucaucugguguagccuccuuuuauaagaaaccacaacccaaagauauuggaucauuugaccaagguuacacaguuugggggagaacaguggaggaguguggucugcaaguuuagggcucuaccacaccacugccaauccuuggauguuggagaauccucuucugugucuaauguucugacuuucuuuauugcauagguauuucagugucuguagacaagauggaaucaucuccauuuaauagacggcaauggaccucacuaucauugaggguaacagccaaagaacuuucucuugucaacaagaacaagucaucggcuauuguggaaauauucuccaaguaagugcugauccugguccaaaaggaccaucugucuggagcacacauugccaccugucagggaaauuggugaaggaaguacauaauguaaaauaauuuuauugggcgccucguggauuuuaaacacuauaugagguacuguggagaaggaggaggaggguaauaaucagaagauacauucuauucuuugaauuuuuguuuaguuuguggaagaaacaguuauagacacaaaaauuauuuuaaaaaagauaauuaugaaauaauuauaaagcaaaauaucagcaagucuaaaaugaauaggagugaggauuagguacagaauaagagacagagcaucacagacaggagcucaucaggaaggcuuucugguugagaugaguguugaggcgaguuuugauuugguugaauggugcguuaagcacucucuauaccugcacuuuccaaugugguagccacuauauagguggcuauuucaguuuaaguuaauuaaaauuaaauaacauuuaaaauuuaguuuuaaauguuuaccagcugcauuuaucacuuuucaagugcucaguaacuacuuguuggugacugucguauugaacagcacagaaacauuucaucauugcacgaaguucugcugaaaaguguaaccuacacaggcacacuacagcccacuggcugcugauuaguaaauaaaacuucauuagaacacauccggucaggcgcgguggcucaugccugugaucccagcacuuugggaggccgagguggguggaucacuugaggucaggaguucaagaucagccuggccaacauggugaaacccugucucuacuaaaaauacaaauauuagucgagcaugguggcacaugccuguacuguagucccagcugcucaggaggcugaggcaggagaauugcuugaacccaggaggcggagguugcaguaagcugaaaucgugccacugcacuacagccugggcaacagagcgagacucugucuuaaauaauaauaauaauaauaauaauaauaauaauaauuccagcauuuauuuugcuuuugaagcuccaguuugggcaggaucucugcucuacuuagcaucagccaggguggcccaaaggcugggagcuguaaucaucaaaaggcuggcucacucacaagucaggcgguugaugcugucaucugggaucucagcuggggccaugguaggaacaccuacacauggccauuccauguggcuguuuggcuugguggcucaguucccagggcaaucauccagagacagagggaaggagggaagaaaagggggaguucaaaguuguguugccuuuuaugaccuagccucggaagucauacaguaucacuuuuaccacauucacuucauuagaagugagucacuaaagcugacucauuucggggaagggcaauuugacuccaccuucucugauaggaggaaugucagaauuuuuuggacauuuuaaauuuuuuuaauuaaaaaaaaaauguugagacaggguuucacucugucacccaggcuggagugcaguggugugaccacacagcucagugcagccucaaacuccugggcucaagcaauccucccaccucagccuucugaguagcugggacuauaggcacacaccacugugccuggccuggacauguuuuaaaaucauccuauauucugauucaguauguguggauagaguccaggaaauuauguuuuuaacaaguaucccagguaauuuuuaccuucagggaaguuuaagaagcacugguaguggaagggauggacuuguggagucaaagcagugagcuugaaguggaaugagucgagucuaagauaggagauugaagcaaaggauuauggaagcugaacacgaauaaagggaauaggaaagcaagcagucugccauggaaaaauacagaagggagaaggaacugguguaauucauuuagggccagauggaagaccucggaugcucugcuaagguuaggauuuaguaagaaaaccagggaacgcaauugguuuucauguggggagagugacaugaucagaccgguauuuuagaaaaagccuucuggcaacaguguaaagcuauauuagaaaggugagagauugguaacauggagacaauuuaugaggcucucuugggaacccaagugaaagcuguugggggucaagggggaacaggaauagagagaaagggaaggauaucagacgguguugagaugugauuaugggacuuggaaacucccuguccugcacagaaacuucuccacguucuuacccuuuucacccuccuuagccccaccugucuuuaacuaaacuuggcuuucccuugacaugcaugacaugcauucuguguuugagcaguggcugccugcucuuucuuuuuuuuuuuuuuuuuuugagauggagucucacucugucacccagacuggagugcaauagugcaaucucagcucacugcaaccuccgccuccuggguucaagcgauucuccugccucagccucccgaguagcugggauuacaggcacaugucaccaugcccggcuaauuuuuguauuuuuaguagagaugggauuucaucauauuggucaggcuggucuugaacuccugaccucaugaucugcccaccucgaccucccaaagugcugggauuacaggcgugagccaccacgcccggccuggcugccugcuccuucugcacaugcuucccugaaauauuuugggggccaggguugcuacucuucuauaucuccaauaauguuucccauucauuguuucucaugccugcuucugaaguucuagacaugugcuuucaggcucacaucuaacuauaaugcacuguuauccuccccuucauugcaguggcgugccagccuccaggggacgcuggcuucuagcaucauuuuuuuuuuuuaguguuucucacugggggugcuguagcauuugggguaaggcagaucuuccccaugcaggguauucaucaucaugcccuccucuaaaugaacccaugacauugugacaaccaaaaaagaaaaaaaaaagugauaggggagaaaacccaacaagauucuaacacaugugucuaaaugucccccagggccauuggcaccaaugguguccucauuaaaggaucacuggguccacaucagugaccugucugauacuuugggcucauaauuucuuuucuuuuucucucucucucuuuuuuuuuuuuuuuugagacagggucauacucugucgcccaggcuagagugcaguggugcaauuaugguucacugcagacucgaccucccaggcucaagcaguccuccugccucagccucccaaguagcugggaccacaggcaugcaccaccaugcccgucuaauuuuuuauuuuuguaaagacagcgucucacuauguugcccaggcuggucuugaacuccuggauucaagcgauccuccugccucagccucccaaagugcugggauuacaggugugaaccacugugcccaaccuggacucauaauuucuugaucuucccuguuucugcaaccugcauguugucucccaugccucugccucccgucucaaccuaucacucagaauccuucucugaaaugaugcauuuggagaaccuacuguuugauuggagccuucuguuuuuccacuuguuuaacucuuauucccagugacccuguguuuugaccucaccaggacacccagcccuggaugucaguccccuuccuggccucacuuucuuccuugcccagcucagucacuucagugaggcucucaccucuuccccagugccuuucucaccacucuauucugucauuguccagcccagccaguucucauuaggauuuggguccuauaguagcacuaaggagaguuaagagguuggaaaaggcuucaucuuuagggccuucuuaaucuugcagagagaaagugcagagggaucucacagguccuucucaugguauacuggguucacugucuuuucuccaugaaggcugaaaggauugcaaaacugucaauccugaacccauuaauuacaaucagugugccaggcaccaugcuagacccuugauagaaacacauacuauuuuggcugggcacgcuggcucaugccuguaaucucagcacuuugggaggccauggcagguggaucauuugaggucaggaguucaagacaagccugcccaacauggugaaaccccaucucuacuaaaaauacaaaaaaauggcugggcgcaauggcucacaccuguaaucccaguacuuugggaggcugaggcgggcagaucacgaggucaggaguucaagaccagccuggccaacguggugaaacccuaucucuacuaaaaaauacaaaaauuagcugggcaucguggcccaugccuguaaucccagcuacucgggaggcugaggcaggagaauugcuuaacugggaccuggggggcggagguugcagugagccgagaucacgccacugcacuccagccugggcuacagagcgagacucugucucaaaaaauaauaauaauacaaaaaaauacaaaaauuuagcugggcggugguggugcgugccuguaaucccagcuacuugggaggcugagguggaagaaucacuggagccugggaggcggagguuguggugagccaagaucaugccacugcacuccagccugggcaacagagugagacuccgucucagaaaaaaaaaaagaaauauauaaaauauauacuauuuugaauccuaacaaaaacuauaugaggaaggggcuuuaccccucuuuuauaguugagaaaacugagguaaaggaaguaaccugcugaaguuaauauuugaguuuguuccugucacauauuuuucuucugaugugcuuaacacauggaacugguuuggaaagaugaauagaguuauuugguaggcuuggagaaugcugaagacauuccagaggaaggggagcaacaggagguaaaggcauagaaguaggacagguggugguauauacugaaaggagugaaaaccagggaaucagccuggauuucuguucuagguuuuauacucaguggaaacacguugcuaauauuacuuaagguuuguaagguucacucacugcagcuucccaaagaagacugcaggacuauuuuccgagaucaguugagaucaggcgcguugagggugguauggcuguagacuacaggacuauuuuccacaaagcauauacuaaugucuguuuccaacaccuaguggcuuuauauuuaugggguuugcaaauagugaguccuauacaagccuagcuaaaaacaguaggaaaacuuaggaggucucugaucagagauuaauaugaaauuguuguuuggaggaagcuuaaucuagcugauguuuguagauaagucagcuuuacuuucuaauuguuaacagugcauuuuguguuuauauguauagaagaguacuuuuucuagcaucagagcuugugucccaugguccuuuauagcugcaggcuuauuucucugacuaagccucuauaacagucguuaaauuugagguaagaaguuccuauugauacauccauuugaauagcuagcuuugguuucacucaccacugacuucagcauaauaugauccuucauuugauaacaguugacucuuuggguggaauuuguuugacucauacauuuuuggaauuaaagagaaucuagccugguaguuuuuaaacuaucuuaauugaagucuucagaggaaucucagggccaguucuccaacaacuggaacacccuaagggcuaaacccaagcccagaucccaggcccagaucccagucccagaucccaggcccagcucuuuagauuuuccauuccagcaauccugcuuugaucccuuguaaagguuagguucugcguaagacagcauuugaagagaggguucugcagcuagcagagcuugaaaccacuggucuggcuagcauuugcccuauuccuuugacagauuaggagcuugaggauuagcaauuaugacugaaggucauacaccaagaugguagaauugaugaucacagcaugaagaucccuaaccuaacccccugccagcaugccucuaccuuaucacagcuucuccuguuuuuguuauaacuuuacccauuccuaguuccaggaaacaggaggaggccggguagagaggaucacuugaguccagaagcucaaggcugcagugaacuaugauugcaccacugccuuccagccugggugacagagugagaaccuaucuuaaaaaaaaaaaacaaagagcguucauauuuaguuuucugugacuauucuuccuucaauaagaaaaaaauugaccuucaagucagccugguuaacuuccucuucuuucgcuucucuguaacauuuuaguggugaaauuuuuccagaagaaaauacauugcuuaaaccuugggaguuucuguuuucccuuuuuggcucagcauucccuuugcucuauuugagggcauacaagcaagagucauggcucaggaacucuguuuucuggcccuagaaaaauuugagacacuguuauuacuccccagauaauuuuagcguccuccaucagcugccugccccacagcugagcauuagugagcuguugcaagauuaaauuccuuauguaaagaaaaggaggcuggaccgcaaaaaaaaaaaaaaaaaaaaaaaaaaaaaaaaaaaaaaaucugggaaggaaagaggaacaaaauuuuaauuacagaaauuuuauuguaaauguuuuauuuucucaaauuuggaucuucaaaauggugcccccauuuuguguccuucacauuuugugucagaagaaugcuaguugcuguaagggccucugagaaaagucugaggccugaacacggaauucagaaguauugagccucagucuuguggcaaucuaagaguacaaaauauaaaaguaccagggaucuaacuuggaagaaagaggugguguagagccuuucucccuguuaucuacuauuuagcaggaacuucauuacaaauaaaagguggagauauuugaguagggguuugagaacaggauuaaagacagccuuugguguauacaccuggucuuacagaugccuccaugcuaaaaggacaaggcuaaagaugggaacuauuuugauuuuuuuuuaaucuauguuucuauuagacacuaaagggaagggaaccucugagcuuauuuacucaacuaaccacaauguaaauaccuugccuuggagaacaguuggcuaaauauaaaccugucugccaauugguucuaguuuucauauauuguauuauugcuguaauauacuguagaugauuauccaagggguguggaaacgcaaguucaaggccaguucuaaguuccuuuuuauaauagcuacaauccacuguaucccugaauucucacuuuuagggaaucucuuagacagauauauuaguacaagugggaaaaauauacguaaaaggacauuccccaaagcguuauuugcaauggugaaaaacuggaaacaauccaaaugcccauuaaaggaauaugggugaauuaauuauaaugagagaggauugucaagauuaccaaacacuuccauguugcuaaaucaaagggauguuucuuggccuuuaucuuacaugaacucucaccacuuuuucccucccacauuuuugcuucucuuggcuucucuggcagucucaucauuuucuuccucccucucucucucuuccuugucagucucucuuaucauuuguucugacugcugaaauguucgagucuccaggacugaguuccaggcaucuucucacacuacacacugcuugcagaugucaucuacuccuguggcuuuaauaccauccaugggcacgcaaguucuaaaugcauacaacuagcucagagcuuucuucugagcuccggacacaugcaucucaucacugcuaccaccaaauggauguuuuaguuaacauggcuagcauugaacucuugaucuuccccguuuccaaauuugcucuucuuucacaauuccucgucccaggaagcauuacuuccauugacucagcugccagaaaccuaggaaucauucucucuuccccaucugauuacuacccuacugauucuuucucgaaauauaucucaaaucuauucacuuuucuuuaucucuagugccauuaucucugcagcccagccagcauuaucucucauuaaugccaccuccauucucagccccuccaguccauucuccacacuccagagcacucuuuaaaaacacgaauugaaucagugaccauccuaccauuaaauucaaaguccuuagcauuaccugcauggcccaucccugccucccgccucauugccugcccuuuccccucucagugagcuucugcaacacuagaguucuuugugcacccuauauacaugagacacuuucuugccuugaggccuuuaugcaugguguuuuucuguuccugguaugcuuuccucccuuccuuuugucuggcuaacuucaucuggucaaacuucacaucucagccuacaggucauuuucucagugaggcgcuccuuuuaaaaauuuuuuauuuuauguuauguuauguuauguuauguuauguuauguuauguuauguuauguuauguuauguuauuuugagauagagucucacucuguugcccaggcuggagugcaguggcgccaucacggcacacugcauccucaaauuccugggcucaggugauccucccaccucagcuuccugaguaacugggacuacaggcgcaugccaccaagcccugcuaguuauuuuuuuuuuaagagauggggucucgccauguugccuaggcuuuucucaaacucccgggcucaagugauuggccugccuuggccucccaaagugcugggaucacaggcuugagccaucguacucauccauuuguuuuuagcugacaaagaauaauuuuacauauguaugggguccaaugugaugguuuuuuguuuguuuuuugagacagagucucgcuuuaucacccaggcuggagugugguggugcuaucuuggcucacugcaacuuccucuucccagguucaagcgauccucccaccucagucuccgaguagcugaaacuacaggugugcaccaacgugccugguggcuaauuuuugucuuuuuaauagagacgagguuucuccauguugcccaggccagucuuaacuccuggccucaagugaucuacucgacucagccucccaaagugcugggauuacaggcaugaacuaccacauccagccaaugugauguuuuaauacaugaauacauuguagaauuaucaaaucaggcuaauuaauauaagugaggcuuuccuugauuuccucuuccuuucucaauuguguuccuuuguuauuuaauaauacccuguucuuuuuuuucaaaggacuuaccacucuguguguguguauguguauguauauuugugugcuucuguuuuuagugucuaaauuguaagcaucggagagcagauauuaugucuguuuugguuauuucuuucguuacuuuuucucuagugcuuggaacauaguagacagcaauaaguauuucucgaaugaaaaugucagcuucucugaauuucucucugaaauggagaaagggagaagcagaauaguauguaucacauuaucucauuuuuguuacuuaaaacucaaauaugaguugcaaauauuuucucccacuccaugggaacuuuucacuuuguugauaauguucuuuuuuuuuuucuucaugauuuuuuuuuucuucgugagacagagccucgcucugucgcccaggcuggagugcaguggugcaaucucagcucacugcaaccuccaccuaccagguucaagcgauucuccugccucagccuccucaauagcugggauuacagguacccaccaccacacccagcuaauuuuuauauuuuuaguagagacgggguuuuaccauguuggccagucuugacugaccucaagugauccaccugccucggccugccaaagugcugggauuacagucaugagccacugcacccggcuuguugauaguguucuuugaugcgcaaaaguuuuuuuugucuuuuuuuguuuguuuuguuuuguuuuuuuugagacagagucuugcuuugucgccagggcuggagugcaguggcgcaaucucggcucacugcaaucuccaccuccuggguucaaaugauucaccagccucagccucccaaguagcggggauuauaggugcccaccaccacaccuggcuaauuuuuguauuuuuaguagagacaagguuucgucauguuggccaggcuggucuugaacuccugaccucacaugauccgcccaccuuggccucccaaagugcugagauuacaggugugagccaccaugccaagccucagaaaaguuuuuaauuuuacugaagucuaguuuguuuuuucuuuugugccugugcuuuugguguuguauuccaauaaggcauuaccaaaucuuguaaugaugagaugaucaaaagauaauaaaaaauuaaaauaagaugaaaaaauaagaaaaacaagaauaagaaagaaaaacgacaaaaaauaaauuucaaaaaaucauugccaaauccagugucaugagacuuuucccauauguuucaaccaagaguuuuauaguuucagcucuuauaguuaggucuuugauccauuugacuuaauuuuuguauaugguaguccaauuucauuuuuuugcauguggcuauccaguuuuccuagcaccauuuguugaaaagauuuuccuuuccccacuggauggucuuggcacccuugucaaaaaauuaucugaccauacauguaaggguuuauuucugggcuguguguucuguuccauuggucuguauaucugucuuuaugccaguaucauacuguuuuguuuuaacugugguaaaauacacaguauauaacauaaaauuuaccauuuuaaccacuuuuuuucuuuuuuuuuugagaccgagucucacucuguugcccaggcuggagugcgguggugugaucucagcuuacugcaaccuccaccucccagauucaaaggauucucgugccucagccgcucgaguugcugggacuacaggcaugagccaccaugcccagcuaaucuuuauauuuuuaguagagaugggguuucaccauguuggccaggcuggccuuaaacuccugaccucaggagauccgcccgccuuggccucccaaagugcugggauuacaggcgugagccacugcaccuggccaaccacuuuuaagaacacaguucaguggcauuaaguacauucauauuauuguacaaucacuaccaccuucccuuuguccuuuuguugcugcacaguauuucauuauacauauacauuauaauuuaccacuccucugcuaacggacauucagguuguucucagucuuuugcuguuauauuuaaugcuaugauaaauaauccaauauuaaaaucuuuuuuuaguguaucuauaggacaaauucugggagcagaaagaauugguaaauuauaacauuugugcuuuuauaauuuuggcagauauuaaagaaggcauagacaaaaugccuucuauaaagguuuuaccaauuuaccuucccaccagcaauguaagacagaaccuguuuccccauacccucaccaaugucccauauuagccuuuuuuguuuguuuauuuguuuuaaacagaaguucggugguacaaugacagcccacggcagccucgaacuccugaccucaagcaauccuaucgccuccacuucccaaagcgcugggauuacugggauuacaagcaugagcuacccaacccaacugcauauuagcuuauuagcugugugcgugugcgugugugugugugugugugugguuuuaaggagcagagagucuuuaauaggcaagaaagacggaagaagcagcuuccccauacagagacagagggagaaggacuccaagccgagaaagggaacccccugcauauuagcuuuuuaagaaaaucuuuuccggccgggugcgguggcucacgccuguaaucccagcacuuugggaggcugaggcaggcggacaccugaggucaggaguuggagaccagucuggccaacauggugaaaccucaucucuacuaaaaauacaaaaagcuuauccgggugugguggugcgugccuguaaucccagcuacuugggaggcugaggcaggagaaucacuugaaccugggaggcagacguugcagugagccgagaucacgccacugcacuccagccugggcgacagagugagacuccaugucaaaaaaaaaaaaaaagaaaaaaaaauauuuuccuacuuaauagguaaaauguuguuagcauuguuugaauuugcauuuugagguugaacaucuuuucuguuuaagagucaugagauguucuuuuugugaacuguauguuuuuguuuuuuuugagauggagucuggcucugucacccaggccagagugcaguggugcaaucucggcucacugcaaccuccaccucccggguucaggcgauucucgugccucagucucucuaguagcuggaauuucaggugccuaccaccaugccuggcuaauuuuuguauguuuaguagagacaggguuuugccagguuggcggggcugguuuccaacuccugaccucaggugauccacccaccuccaucucccgaagugcugggaucacaggcaugagacaccgcacccagccgugaacaguauguuuauaucugccuuuuuauuuauucaguugucauuuuccugcuuauuaguaguuauuuauauucuagggaaauuaauuuuuugucuguaauauaaguugcaaauauauuuucagcuugucaauugaaucacagcaguucuaaucccacuuucuuccuaguuauggucaacgaagugccagaaauuuuugguagcccuuuuacccuaccccauuagagaguucugcucaauugcagagcaguacuacauggcgacugagaugcuuguuaauaucugauuauuaaaauuagacagugauaggauugggggcugggcacgguggcuuacaccuguaaucccagcacuuugggaggccaaggcugguggaucacuugaggucaggaguucgagaccagcguggcaaacuuggugaaacccgucucuaguaaaaaaacaaaaauuagccgggcauagcggugcacaccuguaaucccagcuacucaggagaaucacuugaacccgggagacagagguugcagugagccgagauuacaccacuauacuccagccuaggagacugagcaggacuccuucucaaaaaaaaaaaaaaaaaaaaaaagugauaggauuggaagacccuuuauguaauacucuuucuuggcugggcaugguggcucaugccuguaauuucaacacuuugaaaggcugagacaggaggaucacuugagcucaggaguuugagaccagcuugggcaacauagcgugacccuauacuaaaaaaaauuuuuuuaaauuagucgggugugaugguagacgucuuuagacccagcuucuugcaaggcugagguaggagaauugcuugaguccuggaggucaaggcaagcuacagggucuuacucuguagcucaggcuagaguacaguggcaugaucguagcucgcugcagccucaaccucccuggcucaaggaauccuccuaucucagccuccccgguagcugggacugcaggcgugcaccacaccuggcuaauuuuuguauuuuucguagagacaggguuuuacuguguugcgcagucuggucucgaacuccuggguucaagcgauccgcccagcucggccucccaaagugcugggauuacaggugugagccacugcaccaggccugaggcugcuuuuuuucuucuucuuuuaccuccuacuccaaaugccucaugaauucugaaauucuaccuuuaggcagaggacagugcccuuuucuagggguggggcugaguucugcuaaggcaggcccaaggagaggcacauaauggugauucuccacgugguggugcugacuucaaugcaugacucagaggucuggaggaagccagguuaagguuguucuagggccaggcaugguggcucaugccuguaaucucagcaguuugagagaccaaagcaggcguaucucuugaggccaggaguucgagacaagccuggccaacauggugaaacccugucucuacuaaaaaugcaaaaauuagccaggugugguggggcaugccuguaaucccagcuacuugggaggccgagggaugagaaucacuugaacccaggaagcggagguugcagcuagcugagaucgugccacugcacuccagccugggcaacagagcaagacucugucucaaaaaaaaaaaaaaagguuguucuggguggucuggagauuugugcagcuuguaccugcacaaaucuccggaccacuuagucuuuaaauggagaaaaccuguuccuccuugaaaagaacuuuaauuuuuuucucagaggucuuccaauccaaguaauaaaaaugacaaaaugauaaaaguaauaacaaauaauuauuuaugaaaucuaagaugucaucaacuauagcugugccacuauuuuugcaucucuaagaaaaaaugcugauuaaacuaaucacugcuuauuacaaacuuuucucacauaucacucuugugcauauguaaaauaauuuuuccuuaaaugccaaacauaguaugaucuuuuaaaagacauuuuuaaguggcauuuaaaacauauaauaauagcugugugcuguggcucaagccuuuaaucccagcacuuuggaaggcugaggcagguggaucacaugaggucaagaguucaacaccagccuggccaacauggugaaacccugucuuuaguaaaaaauacaaaaauuagccgggcaugguggcacaugccuguaaucuuagcuacuugagaggcugggguaggagaaugcuugaacccgggaggcggagauugcagugagccgagauugugccauugcacuccagccugggcaacaagagcgaaacucugucucaaacaaaacaaaaccauguaguaccaucaaauacuuuuaacugaguuaaaaugacaauaucaauaacuuacacuaaauucaacauguacaggcaaugugacuaucucucaaccauuuggcugagaacaauuguaagauaucaggcauaaauaugggaggggaaauguauauguuggaauuaaugcauugcuguauggacuuaacuaauuucaaaauguuuuuacacaugauuacauuuaaucuuccuggcaauccugaaaguagauuguaacuucuuucuagauaaggaaacugaggcuuagagagauuaagucacuugccagagaucacaguuaauaagcagcaaaacuggggcuuaaagccuagacuuucugcucuauccaauuguuucagcauuugaccuuauccacggggaucuuguuguuauaucagagcagaugacuggaauagcugcaggaagugaggucugcucugauuuacagcuucuucugauagaguugauuaaaagcaacugcuggcagaaauagguaugcagacuguuuuuuuggguuuguuuguuuugaaucucgcuccgucaccuaggcuagagugcaguggcgugaucucagcucacugcaaccuccgccuccuggguugaggcgauucucgucccucagccccccgaguagcugggauuauaggugugcgccacuaugccuggcugauuuuuguauuuuuaguagaggugggguuucaccaugcuggccaggcuggucuugaacuccugaccucaggcgauccacccaccucggccucugaagugcugggauuacaggcaugagccacuucacccagcccagaacugguuuucuuaaagauuaaaaguggcuggggggcugggccugguggcucaugccuguaaucccagcauuuggggaggcugaggccagcagaucacuuaaacucaggaguuugagacuggccuggucaacauggugaaacccugucucuacgaaaaauacaaaauuagccaggugugguggugugcaucuguggucccagcuacucaggaggaugagguggugggaucacuugagcccuggaggcggagguugcagugugacaagaucacgcuacugaacuucagccuggguaacagagggaaaucccaucucaaaaaaaaaaaaaagaaaaaagaaaguagccgggcugguggcucaugccuguaaucucaauacuuuaggaggcugaagcaugaggaucacuuuagcucaggaguuugagaccagccuaggcaacauggcaagaccccaucucuacaaaaauaaaaaaauuaagccaggugugguggugugcacuuacauagucccagccacucaggaggcugagacaggagguuugcuugagcccgggaggucaaggcugcagugaaccaugaugaaccaugguuguaccacuggauuccagccugagcaacagagugagacccuaucucaaaaaaaaaaaaaaaaaaaaaaaagcugggcacucacuuugggaggccgaggcagguggaucacuugaggucaggaguucgagaccagccuggccaacaugguaaaaccccaucucuacuaaaacuacaaaaauuagcugggcaugguggugggugccuguaaucccagcuguucuggaggcugagacaggagaaucacucgaacccgggagguagaaguugcagugagccgagaucgcaccacugcacugcagccugggcaauaagcgugagacuucaucucaaaaaaagauaaaaaauugaaagaguaaaaauauaaguuuaauuugagacauucuuuccuucccuucucugaagguaccagaaagcagcugaagaaacaaacauggagaagaagagaaguguaaguauucagaaauuccagggcauguggcacuucuugagcagaauuguguggccaagccaccugcagccucuguggggcuuggguucuaugucagcugaguggacauuugugccagcuggugugaucucugagccauuugcucaggacaacuuggcuuagugcagggaaucuuauuuuuucacugcuuuucuccuuuugaaccacuuuuucuuuccuguguugagugaaggacaagaggccaaaugcuugccugagguuaguaaaauggcuucuacucaaaugagaacacaggguuuccuagguggucuuccuuuuuuccaaaucagacaaucagaacuucuacaucugugcauuuaaaugguaguagcugugcagcuguugucaucuucuggguuuuuuguuuaaagcaaacuucuugacccaaucuaguuagcaaguuuccuagcugcaggaucuaccaaagacaaaaaccuccagaauaaacucucugcuucuacccguucucuagucuccgugcuugcuaacuuccggugaggcugaauaauacaugucuuuugaaauuuuacuugauuuaaucuugugaggaaaaaaacucauauguuuggucaauaauuccuuaauucggauggcauuacaaaaacauccuccuggcaguuuucaguagcuaaccuauuuaaauuagugcauaauauguuccuguaaauuuguucuaaggcuaagguccuuggcuucauuuuccuguaauuaaaaaaugggucuccucuggugcauuauaagaaaaaacuggccgggugcgguggcucacgccuguaaucccagcacuuugggagaccgaggcgggcagaucacgaggucaagagaucgagaccauccuggcuaacacggugaaaccccgucuguacuaaaaauacaaaaaaauuagccgggcgugguggcgggcgccuguagucccagcuacucgggaggcugaggcaggagaauggcgugaaccugggaggcggagcuugcagugagccgagaucacgcaacugcacuccagcuugacucugcagucagccagagcgagacucugucucaaaaaaaaagaaaaagaaaaaaagaaaaaacuaccauuacuuuacucaacugcugguuucuuuucuuccuucccucuugccucuguuuuucccccaacuugcuccuuucuuucuuccuucccuucacugucauccauuuaacaaguuuucacugagcaccuacuacaugccaagcacagacuacaucccagcccucguggaauuuacauucuagugcaaaagacagacaauaaagaaauugugucaguauggcugggcgcgguggcucacgccuauaaucccagcacuuugggaggccgaggcaggcagaucaccugaaguuaggaguugggagaccaaccuggccaagauggugaaaccuugucuccacuaaaaauacaaaaauuagcugaguguguuggcacaugccuguagucccagcuacucuggaggcugagccaggagaaucacuugaacccgggaggcagagauugcaguaagccgagauagcaccacugcacuccagccugggcgacagagugagaccccgucucaaaaaaaauaaaaaaauuuaaaaaagaaauugugucaguagugauuagugcuguggaacagcaugaggcagguaaggaggauagagucuaggguggucaaugaaggccuguggugaggaaacguuugagcagagauuugaagacaugagccagggagaagagucaggcagaaggaaccgcuugugcggauguccucaggcaagaacagucuugguguguuugaggaauagaagagaaaggucaaauggugucauuguaaagaccugggcuuuaacucugaaugcaaggaggccuuuggagaggguuuauaugcaaaggagugauguggucugacuuaaauuuuuuuuucuuuuuuuauuauuauacuuuaaguucuaggguacaugugcacaacaugcagguuuguuacauauguauacaugugccauguuggugugcugcacccauuaacucgucauuuacauuagguauaucuccuaaugcuaucccuccccgcucuccccaccccacaacaggcccccgugugugugauguuccccuuccuguguccaaguguucucauuguucaauucccaccugugaguaagaacaugcgguguuugguuuuuuguccuugcgauaguuugcugagaaugaugguuuccagcuucauccaugucccugcaaaggacaugaacucauccuuuuuuauggcugaagagaaggcucuaaucccagcacuuuaggaggccaaggcgggaggaucgcaggaggccgaggugggaggauugcuugaggccaggaguucaagacuagccugggcaaccuagugagacccuguaucucuauuuuuuaaauguaaaaaaauagaaggaagagaauguagaggaacaauaauggcaggagcauggagaccaauuaagagacaauuauaaugauuuaggccagguauaauaugguuuggacuagaguaguagcaguauagguguugagaaguggucaggauguauguugaauguagagagaaagaagaaucaagaauggcagcaguggcucugccacaguggcuugugccuguaaucccagaacuuugggaggucaaggcagaaggaucacuugaggucaggaguucaagaucagccugggcaauauagcagaccccaucucuauuacaaaaaguaaaaaauaaaagaauagcaacaauguuuuuggcccaaacacaauuaaauuaaaauaccauuaauugagauggggaagacuacaguaaaagcagauuagagagggagaaauaguagaagcucaguuuugcacauguaaacuguaacauguuuuauuaagacauccaaauggaaaugucaguaggaacuuggauacuauauaaaaaucuagaauuggaagagauccccgcugcggauaaaauggacaugugucaaagugucagugguacuuaaagcuaugaggugcaugauauaagcuaggaagugaguguagacagagaaguggucucaugacuuagcucaggggcaccuugguguuuaaagguuggagauauaaggaguaaccagcagaggaaacaagugccagaagccgagugaagaaaguguuucuagaaggggaguuaacagaaucaaacacacagguaagcugagaauugaccaucggauuuggcaacaugaaggucauuggucaucuuguguuguuugggagugguagaauagaggccugaauuggacuagguucaagacaguggguuaagagaaguugaccccacgaguauagacaaucauauguggagcaucucuuauguuccagcuccugaagacacaagaagaauaagauguauucucuaccuccaaagggacuguuuagaauuuggaaaauagaauuacaacccaggugugauaaguaccauaucaggcccggcgcgguggcucaagccuguaaucccagcacuuugggaggccgaggcgggcggaucacaaggucaggagaucgagaccauccuggcuaacacggugaaaccccgucucuacuaaaaauacaaaaauuagccgggcacgguggcgggcgccuguaguccuagcuacucgggaggcugaggcaggagaauggcaugaacccaggaggcggagcuugcagugagccaagaccgcgccacugcacuccacacuccagccugggugacagagcgagacuccgucucaaaaaaaaaaaaaagaaaaaaaaaauuaccauaucaaauaaauacucagagugggcugggggagaauuuaggagggaucugaacugugcuacaucuagaaaggcuucccagaagaggcagugccugacucaacccuaaaggaccaagaggaauuagcuaagcagaggcgacagggaguggcagaaucuuuguauucuagauggaggaagcagcacacgcacagcaugaaggcauaagagaacaggccuacuugacagaugaaaagaugguugucgcauucaccaagauagacaauucaagaaaagaaacagguuagagagugaggaguaaagggaagacuucgggccuggcacgguggcucacaucuguaaucccggcugaggcggguggaucaccugaggucaggaguucgagaccagcuuagccaacauggugaaaccccaucucuacuaaaaauacaaaaaauuagccgggcuugguggcucacgccuguaaucccagcuacucgggagacugaggcaggagaauugcuugaacccaggaggcagaggcuguggugagccaagauugcaccacugcacuccagccugggugacagagcaagacuccaucucaaaaaaaaaaaaaaaaaaagaaaagaaaaaagaaagugaagacuucaaccuuaaucaagaaggaguuuaagaugccucuagcacuuccagguagaauugguagaaaaggagagaugucuaucuagagauaaguucuauaacucugucuauauagauacacaguauacaucuaucuauguauuuguugauacuauaaucuauauggugggugaaaucgggaugaauaacaucauauacagagaauauguaaaguaagcaaagcagaggaccuaagacaaaaacccugagggaccccaccauauaagggagggacagaggaggagaaaccuguaaaaaaaaaaaaaaaagaaaaagaauuacuaaauuaugaaacugaguaguggccagauaaaugagaagaaaucuuuuuuuuuuuuuuucauauggaaucuugcucuuucgccaggcuggagugcaguggcaugaucgcagcucacugcaaccuccgccucccggguucaagcgauucuccugccucagccucccgaguagcuaggauuacaggcgcacgccaccacgcccaccuaauuuuuguauuuguaguagagacaggguuucaccauguuggccaggauggucucaaucucuugaccuugugauccgcccgccucggccucccaaagugccaggacuacaggugugagccacugcgcccagugaaaucuuuuuuucauuauuguuuuuuucuacacccuucuugcaucucaaaaugggaagaaaucuaagaaaaagggguaucacagaaaaguuggaagcaauuuuuaccagggagaguggucaguaaugucagaugcuauagugagauaaaauaaagcagaagccuccagugcuuuuagcaguugagguaaguggacgugaauagguauuuaaagaagagggugggcaugguagcucacaccugugauccccacacuuugggaggccgaggugggaggaucacuugagccugggaguuugagccugggcaacauagugagaacccucucuauaaaaauuuuaaaaauuuagcugggcgugguggcaugggccugcggucccagauacuugggaggcagagguggcaggaucacuugagcccaggaggucaaggcugcagugagccgugaucaugccacugcacucuagcaugggcaauagagcaagaaccugucucaaaaauaaauaaguaaauaaauaaauaaaauagauaacaaagaaguaacaguguaaaaacaugcuuagccucacugaugaucagauaaauguaaauuaauaaugagauauaaauuguaaucuaaacaguuggcaaauaauuuugagcaauacauauauucaucagugggggaaugguaauugcacauacaguauaauauacuauaugguuauuaagauuuuggccaggcaugguggcuuacaccuauaaucccagcacuuugggaggccaaggcagguagaucaccugaggucaggaccagccuggccaacauggugaaaccccgucucuacuaauaacacuaaaauuagccggcaugguaguauguuccuguaagcccagcuacuugagaggcugaggcaagagaacugcuggaaacugggaggcagagguugcagugaaccaagaucgugccacuacacucuagccugggugacagagugagacuccgucucaaaaagaaaaaaagauugaagauuucauguaugggcaugaaaagauaucaaaagcacauuaggugauuaaaugcaaaguguagaacaguaaguacaguaugauuuuguacaaaaaaauacauauaguguacaaaauagaaaaaaagacaacauauauaccauauaaacugucaggacuggguaucuagguugggagagguggggagucaaguagggaaaauggcauguauuacagcaucuauucaugucggguacauauuucuauauugauugagaguuuuucccccaauaaguuauuacuuuuuuaauugagaaaaauaauaaauuaaaaauaagauaauguuaugaacauuuuaaagagacaguuggggccaggcgcaguggcucaugccuauaaucccagcacuuugggaggccgaggcaggcagaucaccugaggcugggaguucgagaccagccugaccaacauggagaaaccccgucucuacuaaaaauacaaaauuagccagguaugguggcacaugccuguaaucccagcuacucaggaggcugaggcaugagaauugcuugaauccaggaggccgagguugcagugagccgagaucacgccauugcacuccagccugugcaacaagagugaaccuccgucucaaaaaaaaaaaaaaaaaaaaaaaugccaggcaugcugacauacaccuguaguccuagcuacucaggaggcugaggugggaggaucacuugagcccaggaagucaaacagcugcagugagcuaugauuacaccacugcauuucagccugggugacagagcgagaccccgucucuaaaaaaaaauuaaaauaggaucaugcugucuuauaauuugcuuucuucauucaaaaguauccuaugagcaucuuuucaugucaauaaguauacuuugaucacaugauagguaucugagaaaaacaguguccaguuaccaaggcaaagugccacuuugauugucagggcuccugugugguuacaguaagggcaggugaagucagagaccuagaugacucauccauuguguggcacgagaccuuacagagccaagagugcugcuggcaguuaggguagaaccagcuucuggagcuguucuguaauuccuucuuuuccagcaagaaaacuuuuuaagcuucuuauaucucugaugcauacauucuucccccaauggaucauuuuguaagcuaaaauuuaaacacuagaaucaagcaguucuauaauuucuuuucaagccuuauuucuacuugaugaaguggcuuucaagaguauauucagaagaguaauagggugagagacuuaauucccaaaauagcugcuaauccuguuuaauuccuagguuguuuguccuuucuuucuuaguugaaagacuggugagucacagacuacaggagagaagguauuggaguuugcaguuuguugggaagguggugcuguucaauuuauuuaggaguacaguccuuucaaaguacgggacauuuaauuuaauuuaauuuuucuuuuuuuuuuugagacagagucucacucugucacccggacuggagugcaguggcgcgauuugggcucacugcaaccuccgccucccagguucaagccauuuuucugccucagccuccugaguagcugggacuacaggcgcgugccaccacgcccagcuauuuuuuguauuuuuaguagagacgugguuucacgguguuggccgggcuggccacgaacuccugaccucaggugauccacccgccucggccucccaaagugcugggauuacaggcaugagccacugcgcccagccgggacauuuaauuuucaacaagcguguuuccucuauuauggaacaacagugacaauuuccagguuguuuucagucugucuuacauguauaaauuaauuccauuuuuggcccuagugaaagugaacucucuuagauauguaaauguguguccuuugaucaucugagugauaaguagugguauuugcauuugaagccugcauauuuuacaaccagaggaucuguaaaacagugaauuucuugauaacugagaauuuuuuuuuuuuuuuugguugggggauggcgucucacuuugucacccaggcuggaguguaguggcgcagucuuggcucacugcaaccuccacuucccagguucaagcgauucuccugccucagccuccagaguagcugggacuaugggugugcaccacugcacccaguuaauuuuuguauuuuuuuuagagacaggguuucuccauguuggucuggcuggucucaaacuccugaccuugugauccgccggccucggccucccaaagugcugggauuacaggcgugagccaccgugccuggcccugauaagugagaauuuauacacagauaaacuuguagagaagagcagggaaaaaaaaaagauuaaauucuuaugaaaaauaaaauuugacugcucauaugcauguaaauuaugucagauauaacuaaauauuuaugcaaauacuuggaaagucuggggacuucuccaggguucuacaaauuguuucaauccuugcugccacuauccguaauuaaugguauaguuucagcuauccugcaacuauccugcaucuuugucuuauuuaaaagaagaaaaaaaaacccagcagaauuuaccauguuauuuuauggcagguaaugaugaacuuugcugauguguaguuacaguguuucaagcacuuguauuuugcuuuuucuuucuuguuuuuuuccccauuaaucuuuggguaaaaaucucuuguuucgcauguaacuaucauuagagcuggguuugccuuucuucucauuuuguccuuauaaggccauccuguuuuaucacuuccugcuucagcuccugaguuuuucucucuuccccucucccucucccucugccggguggaugcuuucuccauguggcaaggcuguaacuguucacagcugucugaaacagcaguggaccaggagcagcuuggaguuuuaacuuucauuuuacaaagaacaacauguuugaauguuucagcaggcaaguuauaacuggcaucuacuucuuguucuucuagaacaccgaaaaucucucccagcacuuuagaaaggggacccugacuguguuaaagaagaagugggagaacccagggcugggagcagagucucacacagacucucuacggaacagcagcacugagauuaggcacagagcagaccauccuccugcugaagugacaagccacgcugcuucuggagccaaagcugaccaagaagaacaaauccaccccagaucuagacucaggucaccuccugaagcccucguucagggucgauauccccacaucaaggacggugaggaucuuaaagaccacucaacagaaaguaaaaaaauggaaaauugucuaggagaauccaggcaugaaguagaaaaaucagaaaucagugaaaacacagaugcuucgggcaaaauagagaaauauaauguuccgcugaacaggcuuaagaugauguuugagaaaggugaaccaacucaaacuaagguaagaauugggcggguuugaaacuugagaaagccaauucaagcacuaaacaaagcuguuuuuccaaucuagcuauuuugaguagaggcgaauauguggucaguaugucuuuugauuccaguuagauaaguuaauagucucaaaugcauuauuuacauagaugcuaagauuugugagucucugacacaauuucauguuaaaucagguucacacugggauucaaauugguaucuagaaaugaagagaguuuaauaccgauuggauuauguguuuuuguacacuugcccuuuuaaauugucuuccuguguucuuuaucauuuguagcuuuggggguggaauuacugcugaauagcucucugcuuggacacagcugcagacugaguguuaaggccggaguuuaacauuaagacugaggcuuacuugucucugcuagcugaaucccuucucuucuucucaacuuccucaucugugccuuccaacaaauguuuucuaucagcuaaaauccucucucaggcaaaaucaaugaagauagccagacuagcuauagcuuucgggaguuuugacuugcaaaugcacaggguugcguuuuccuacaacugcuaaugaaauuugauccuucauguggauugcagaccucguccccagagggaauuacuuaacuagaaaaugaguuacauaugcuggugauuuauaacacaauccagaggccacagagcugguaaauuuuuccaguuuucucauacuuuccuauauaucuggcuuuguacauggggaugguucguuacaacagucguuauaaugaaauaaacagaccugauggggagcaaaaccaucuguuacucuagauuccaccuagaugggaaagcuggauuuuuuuuaagcuaaauauuuggcccaagucccuauguuuggaaaguaauauaauaauauuaagcauucuuucugagauaaaaaauaacucauccuguagucuucaguuauauuagaugugauauugucaaucccuucccaugacuugcagugccagucacuuuucuacuuagaauuagaaaaguucuugaauguuugcgggucauguuugaaguugugcgaguuuuugacgauguguaaagcuacaacacuucucugugcaugagcuuuagcucuacuuuaacagugaaaccaguuggcaagagauguaaccacaaagcaguuuuauaacguuucuuaacucucuucccucucaaguuuuuagaccuuuaguccugccaacuccuucuuuccccuuuaugguuuuaauuuaaaaauuuguuuuauuuaaaugggaagaagaauuuuaaguggaaggaaaaaaugucagaaauccuaaauagagaggaagggguuuuguugugacucaaagcaccauuguaagucuccuccucccagacccugcuaggaacaggacagcugaugucaugccaguacacacaauguagauucagugcaaaaggcugcugcauguugaaacuggccaaagguaggaaaugacugggacuguagcagacaaaaaugcugauuauguguaaggauauggugagacacuuuuucucauaaauaucuagugagauaugggucagaacaagccuaucucccuaaggcugcuuggagaggagaaaaacuuuccauauaagaucuuacuaguccgggcgugguggcucaagccuguaaucccagcauuuugggaggcagagguugggggaucacuuguggccaggaguucgagaccagccuggccaacauggugaaaccccgucuccacuaaaaauacaaaaauuagccaggcaugguggcguugcugguagucacagcuacuugggaggcugaggcaggagaaucacuugaaccugggagguggaggaugcagugagccgagaucaugccacugcacuccagccugggcaacagagugagacucugucucaaaaaauauauaaaaauaaaaauaaagauccuacuagauggcugauagcacugggccaccagauugauugcuaaagguauaggaagauggaagaggcugggcacgguggcuuacaucuguaaugagaauuuagggaggcccaaggcaggaggauugcuugugcccaggaguuugagaccagccugggcaacauagccagaccucgucucuacuaaaaauuuaaaaauuagccaggugugguaguaugcauugauagucccagcuacuuaggaggcugaggcagaagauugcuugagcaugagaguuugagguugcagugagccaugaucgccacugcacuccagccugggcaacacaguaagaucccugucccuuaaaaacaagaagauggaagagacauaagauucaccugggcuucuagguuucauugcuuuuugugugugccauuuuuaauuuccugauuugucacuuaauggacugcuuagggaguggaaaacacagccacccuugguuuuauugcuguuuguaaauaagcaucauuguccauacugaaaacagucuagauuauauuuauuuauuuauuuauuuauuuuugagacagaaucucucacuguuacucaggcuggaguguauuggugcgaucucggcucacugcaaccuccaucucccagguucaaguaauucuccugccucagccucccaaauagcugggauuauaggcgcccgccaccacgcccagcuaauuuuuguauguuuaguagagacggaguuucaucauauuggucaggcuggucuugaacuccugaccucaggugaucugccugccucaagccucccaaagagcugggauuacaggcaugagccaccacgcccagucucagucuagauuauuuuuaacaguucugucagguauucuauagucugagcucaaccuaccuguauagucucacagccaaucuuauacucaaaccuuggaauacucaucccccaacugcuacuuuuugaaucuuuuauucuuaauauuucacguuuuaacuucaguguguuuauacuuuuugaaaugagaccagaacauaguagacuuuauagagaagaccaguuuuaccuagauuccaaaggaagaauuaaacugcuguuauuguuugaaaugcguuuuuuuuuuguuuuuguuuuuuuuuuuuuuauggagauagggucuuaacucuguugcccaggcuggaggaguacagugguacaguuauggcucacugcagccuugaccccucugccucagccucccaaauagcuggggccacagguguguaccaccacucucagcuaauuuuuaaaauuuuuuauggagacagcguuucgcuauguugcccagacuguucuuaaacuccugggcucaagugauccuccugccuuggccucccaagcuggugaaauuacaggcaugagccaccacacccagccugaaauucuuaaaggaugagaaugucaaugacagagcaccuuggcaucauugugacuaaccugggagacagggaagaagcacgccaugggaaguguuuacauuuggguacagcugugcuaaguacuguggagcccauagccuugagguagacggcuacuuugccuuuuuucuugaacugucuugcagaauguggauuugggguaaguggucuugaagcacucauuuagucacccucaaauuaagauuuuuacuucaucuuucuugggccuguaccuccaagaugacaaagaaaagaagaaacaauggucacaccaaagagggccgcaaccagguguacgcuauucacugcagccaauuugcugcauaaacugugcccauugugugcccaaugacaaggcuuauuaagaaauucaucauaggccgggcgcgguggcucacgccuguaaucccagcacuuugggaggcugaggcgggcggaucacgaagucaggagauugagaccauccuggcuaacacggugaaacccugucucuacuaaaaacacaaaaaaauuaguugggcgugguggcgggcgccuguagucccagcuacucgggaggcugaggcaggagaauggcgugaacccgggaggcagagcuugcagugagccgagaucacgccacugcacuccagccugggcaagagugagacuccgucucaaaaaaaaaaaaaaaaaaagaaaagaaauucaucacuugaaaugcuugaaauguagaggcugcggcagucagcgauauuucugaagugagcguccuagaugccuguguacuucccaggcuggaugugaagcuacauuacugugugaguugugccauucacagcacgguagucaggaaucaaggucaugaagcccacaaggaucgaacaccuuccccccacuguagaccugcgggugcugccccacgaccgccagaaaucaaggucaugaagcccgcaaggaccgaacaccuccaccccacuguagaccugcggugcugccccaugacugccaccgaagcccauauaaggagcagaguucuuaaggacugaagaaaaacuagccucuggagaaaaauaaaaaaauugcaauuguacuuaaaaaaaaaaaaaagauuuuacuucaaaggccaggcuugaaguucugaacacuuugaagucuccaauuaugagggauccagucuaagccucuggcuuuugcuauuuagcaauagguguucuaugaugggcugauuuggaaggagggagucagccacucuugagccacugcagugaagucacuugaucucagucuggagagaaacacuuuaauagcuaaacauucuagcuuugauuuuucugaagggaauacaccuguuuucaauucugggauuuuuggggugcuugcuugacuguauaugaacuugugauccaaggaaaaaauaggagaaagaacaauguuggcuuuuuaagucaggauaguuuuauguuugcuacuagauaaggcaaaaauaaaaacuuauuuuuauaaauucaagaagaaaaguaaggauguuuuuauacccuaguggucaauaacuuaguucauaguauuuauuuaauaaaaggaagguggcauuggugguauagugguaagcauagcugccuuccaaauaaugaaaauugauuaaagccuauuucucaguuauucucuacauuugaugaauagauagguuauuuaggucaggugguuuagcugaauaugaugguuuuauuuauuuauuuuugaaacagagucucauucuauugcccaggauggggugcaguggcacaaucuuggcucacugcaaccucugucuccuagguucaagcaauucuccugccuuagcccccgaguagcugggauuacagguguccgcugccauucccggcuaacuuuuuuuguauuuuuaguagagaugggguuucacuauguuggauaggcuggucuugaacuccugaccucaggugaucugcccaccucagccucccaaagugcuaccgcgcccagccugaaugugaugguucuacuuccuaugagugaaugagugguauauggauuaauguaaccuaucgucaaaagaaaugccacagugggcugggagcaguggcucacgccuguaauuccagcacuuugggaggccaaggcagguggaucaccugaggucgagaguuugagaccagccugaccaacauggagaaaccccaucucuacuaaaaauacaaaaauuagcuggagaugguggugcaugucuguaaucccagcugcucaagaggcuguggcagaagaaucacuugaacccagaaggcagaguuugcagugagcugagaugacaccauugcaucccagccugggcagcaagagcaaaacuucucucgaaaagaaaagaaaagaaaugccacggugacacuuagugagugugguuuagcauuccuaauuccuuauauguauuaaucuggauuuuagguggccaagauaaccauucaggacagccuuuuaugaaaaagauaacugaccaacuaguuaugacccauguuuaguuauugucauguugccuuuuuuuuuuuuugagacagccucgcucuguugcccaggcuggagugcaguggcaccaucucagcucacugcagccucccagguucaagcaauucucugccucagccuccugaguagcugggauuacaagugugcaccacgaaguccggcuaauuuuuguauuuuuaguagagacgggguuuugccauguuggccaggcuggucucgaacucccagccucaagugauccacccaccucggccuuccaaagugcugggauuuuauauuauaaaaauaaagcaggccgggcgcgguggcucgcgccuguaaucccagcacuuugggaggccgaggcaggcggaucacgaggucaggagaucaagaccauccuggauaacacggugaaaccccaucucuacuaaaaauacaaaaaaaaaauuagccgggcgugguggcgggcgccuguagucccagcuacucggaaggcugaggcaggagaauggcgugaacccgggaggcggagcuugcagugagccgagauugcgccacugcacuccagccugggcgacagagcgagacugccucaaagaaaaauaaauaaauaaauaaaauaaauaaagcaauauauucagguaaaauagacauauauaaaauaacaaaggaaguuuccuuugacucaucacccuuuucucuuguuugugaccucuccccguagacucccagcccuucagcuucccucugaauuucaguucuuauuagcaccaggaucaugauauguauagauagcaucaaaaugccaacaaaaacuucacuuguuccaacaucuuugugguuuuucuucuuguaaguuccuggaagugacacuugguauuuuguuuaguuuugcauaacacucguacauaagaguguauaugcgcugauguaguagaaugagucuuuagagaguaaggcaaccaagcuaaagugugaugaucucuguucaucagguacuuauucauagccaaucuguaaucugcaucaaagaaauaauuuauauaggccuucuugaugaauggguagguguccauagggaaugcccagauuguugcagaaauuauucauaacaucuuaucuuccucuuaguuaauaauuguauguguuccuuuaucuacuuaacguuaagauaaaaaauuuucuucugcuuucugaauaugucuuauuuagaauuauaucccaagaagaauacaauucugaggauguucauaauuguauuaauugcauaguuuuguuuguuuguuuguuugcucugucgcccaggcuggagugcaguggcacaaucccagcucacugcaaccuccaccucccggguucaagugauucuccucccucagccuccugaguggcugagauuacaggcgcaugccaccacaccagcuaauuuuuguguuuuuaguagagacuggguuucaccgugugggucaggcuggucuugaacuccugaccuugugauccccccaccuuggccucccaaaaugcugggauuauaggugugagccacugcgcccagccaaauugcaugguuuuaaguuaaaauuuuaaaguaaguuuggggaggaaagguauuugaauaacuauuaacaucaauguggagucuauacagucaucucaauguaggggaguauaucuuuaauuugccugucagugaaucuucacuuuuaccuugaccuaacauuuaaucuucaauagauacauugcuagugcuuuaaauguggauaauugguuuugcauguuauuguuaauuguacacaagaauugucuuuguuuuucuaucaaugcacuuucuuacauaucuugguaaaacuaacuuuuugcugauuuagcauauucaccuauaguuuguagcuucucuugucauuucaaaaauguaaauaaggcuauccucagcauuauuuugacugacaucuauuuauagugguacauuucuuguaaagacuacauaucagcauaaauuuuuuauuuacucuuaauaacucugaguaaucucgugugugugugugugugugugugugugguaagauaauaauugauccaggguaaagaugcagucaaagaauuccaaucuuuuuaacuguuccuugcccuaaaugacuguccuugaugugccagcuagagaccacucaucucuucuucucugcuuacuuucauguccacuaacuauguacugguuuuuaaccaguuucauuauaguaaaacauaucaacaagcaaugucaggggacuggaauauucuuuaagcaauguuggcuauauuagacuucaagggggcuagaaagacuucaucuccccccaguacaaauauuacuaccuuugucuuccugcuagugggcucauuccuaaauuagacaacacagguguguauccagaugaauauauuuacaagucauuuccucuagccuucuaacucauucuaacucaucagugaguuacaaugagugagaaaucgcuaucaaaauuguugacauauagauccuagaaccuuaagagaguuuaagaaguuauuuaauccagcucacugcccucagucaguuagaacuuuacaaucccaauuuuacagaugcgauuagaugaggucagagaaguuaauugauaugccccauggcauguggcuaauuaauaucagaacaggauugaaauuggguaguaccccuucuaccauauaacacuaucuucauggauauaauaacuauuuauuggauagaaacaaugggcccuacauaucuuugaaaucuaaggaaacuggcaaaaauugaaaacauaaaaacagcuauguucucaaagacuuuaacucugucuucccacaguuuaugcuuaacuaauugaaaagcaucaggacagugaacagaaggaauacauuggaaugcaagagauaugaaugaaagcacuggaguuagaagcuugugaguuugggaccuggcgugguggcucacacuuguaaucccagcacuuugggaggccaaggcacaaggcacacuuguaaucccagcacuugaggucaggaguucgagaccagccuggccaacauggcaaaaccccaucucuauuaaaaauacaaaaauuagccuggcguggugacaugcgccugaaaucccagcuacucagaagccugaggcaagagaauugccugaaccugggaggcagagguugcagugagcugagaucauaccacugcacuccauccugggcgacagagcaagacuuugucucaaaaaaaauaaaaaauaaaauuaaaaagauauaauucauuaaacauuguucuuacaucaaaagguaugauuuauuguuuauucuuauauauuuucagcuuguucucaagauuauaacaccacuaguacaauauaaggacacauuccccaaagcauuagcauuugguuuuaccauuuuugucuacuuaaauuaauagauaugacuuguuauccuuucuuuuuuuuuucuuuuccuaauuguaagacuaacacaaaguauuuguagaaugcuugggaauacaaaaaauguagagaaauccuaccaccuggagauaaaucucuuucuauguguauuauuuuacuuacauuaacucucuuucuaagagagucccugaagaaagaaauuuuucucucaauacuuuaauaaaucaaggcuagguuuuaucuaugccccgauuuccaugcauaguucagcaaagcuccauuuuucccuaaaagccaaccuuccucugcccuugacuuuggugagaugacagcguccaaaggaagcugaaguugaaagguugaaggaaguggcuaagugaggcaggggacucucaguaaauuaaaguguugagaaucagcuuuuaaagauaauuuuuucugaagauagguguagaaaagacaggaaauccugcuuuguuacuuauuuagaaccuaacuuacuuuauuucuguuuuaaaaaauacagaaaaaaauucuacagacuacugucuaaaacuuuuauccucuuacuaguacaucuuggugcguuugauuuauggauucacagagaauauuuaagggauguucauacuaacaagaguuauugucagcugacaggaaggaggacuucagggugggugaggccaggccucaggaaauuccagaaagucuuaaaaguaucuugucuauucucuuuccuugacauuagaaugauuaaggcucccucaagugucugaguaaaaagagcuaaaaugugauaaaagucuguuacagaagaguauuuugguaucagaauucguguguguguguguguguguuuuguguuccuuuacuuccuugagaaauauuggaggaaaccccuccuucuuccuguaccucagauuaccacuuggaaaauguggaucauaaaacucaucuuaaaugcauuugagaucauuuuuguuuguuuguuuguuugcuugcuuuugagacagggccuuguuauaucguccaggcuggagugccggggcacaaucauaggucacuacagccucgacuuccuggacucaaucaucccacuucagccuccggaguagcugggacugcaggcaucaccacuaugccuggcuaauuuuuuuuuuuuuuuuuuaaagcagagacagggucucaccauguugcccaggcugaucucaaacuccuggccucaagcaacccuccugccucugccucccaaagugcuggauuacaggcgugagcuaccacgcccagccuuguuguuauucuuuuuuuuuuuuuuuuuuggggggguggggcggaguuucgcucuuguugcccaggcuggagugcaauggcgugaucuuggcucgcugcaaccucugccucccagguucaagugauucuccugccucagccucccaaguagcugggauuacagguguccaccaccaugccuggcuaauuuuuuguauuuuuaguagagaugggguuucaccagguuggccagguuggucuugaacuccugaccucagguaauccaccugccuuggccucccaaagugcugggauuacaggcaugagccaccaugcccagccaagccuuguuauucuuaauguuugagugguuuaaaggugaaauauauugaaaguaaugcugugcuucacugaaccugcgauaucaugaaaacccaucuuaccucacagcuguguuucuccucagagccacagucuguaugagggauuuuucagagacaguucucuuccuauuuuucucugagaccaaauggcuuuguucauguacuuuuuuaguacuugaaauaaauuaaugcagaguuuugauacccccauggagcaaaaggcuucaaaaaaaagguaagggggccuuauuuaauuaacccagcaguuuaaauuaaaagcuaacaaagaugggaaauuuuaugcguuuaaaaccaaagaaagccucugcccuggcaagguguaugcucugguucuaaaugauuaugcucccaauaacagcagugcagggacuucacacaagacagagaaggauguguagcuccaacuagacagaaaacagcucucugcagguuguaacauguaacacauauucuuggaauugugcuugaacuuugacagaaagcaaauaucuguauuaagaacacagaacccguuuccuuuugguuguucuuuucuuuuuuucuuuuuuuuuuuuuuuuuggaaauggggucuugcucuguugcccaggcuggagugcaguaaucuuggcccacugcaaccuccaccucccugguucaagcgauucuccugccucagccuccccaguagcuaggauuacaggcacgugccaccaugcucagcuaauuuuuguauuuuuaguagagaugggguuucgccaugugggcgaggcuggucucaaacuccugaccucaagugauccaccugccucggccucccaaagugcuaggauuacaggugugagccacugcacccggccccuuuugguuuuucaaaagaaguuuaucaguaggcuuucucccauuuugaguuuugaaaauucuaauuuuuguagugguuaucuuccagugcagcagcauuuggaauaaauauguggaauuuucuuuauuuuaaugaucagcaaauaagaaguauguugaaaacaaaauaaaaaggugggccaggcgcgguggcuuacgccugucaucccagcacuuugggaggccaaggagggcagaucauuugaggucaggaguuucagaccagcuugaccaacauggugaaaccccaacucuaccaaaaacucaaauaauuaggugugguagcagacgccuguaaucccagcuacucuggaggcugagacaggagaauugugugagcuuaggagguggggguugcagugagcugagaucacaccacuguauuccagccugggugacagaguaagacucugucucaaaauaaauaaauaaauaaaaauuaaaaauguggauugaggguauccugccagacauaucuuuuccuuuugaccaagaucuucauuaucuuuuuucuuuuuuuuuuuuuuuuuuuugagauggagucucgcucugucaccuagccuggagagcaguggcacaauuucugcucacugcaaccuccaucucugaaguucaagugauucucaaccucagccuccugaguagcugagauuacaggugcgcaccgccaccccagcuaauuuuuguauauuuaguagagacaggguuucacaauguuggccaggcuggccucgaacucuugaccucaagagauccacccaccuuggccucccaaagugcugggauuacaggugugagccaccgcacccaaccacuucauuuucagauagcggcugcuccuagagcaagaguauguugagcugugugagucauauggauguauaauaauucaugaaaguaugccugaccugugugugauguagcacggauaguguuguuccagcuuguuuuaguuuuuauuaaaaauagacccaaucaggccggaugcaguggcccacaccuguaaucccagcaccuugggaggccgaggcuccuugagcccaagaguuugagaccagccugggcaacguggugagacccugucucuacuguaaaaaaaaaaaaaaaagaaagaaagaaaaaauagacuuaaaucaacaauauaaauugcaaagcugacuggauauaaauuauuauuauuacuuuuugagcagggucuuacucaucacccaggcuggaaugcaguagugcggucacggcucacuguauucuuuuuuguagagauggagucuuccuauguugcccaggcuagucuugaacuccuaggcucaaaggauccuccuggcucagccucccaaaguguugggauuacaggcaugaaccaccaaacccagcaaggagacaaauuauauauacacacacacacauauguaauauguauauaauauauuuuuauuuuuauuauuucuuuugagacagggucacacucuguugcccaggcuggagugcaguggcaugaucuuggcucacugcaacauacaccucccaggcucaagcaauuuuccuacugcagccuucugaguaccugggacuacaggcgcaugccauaaugcccagcuaacuuuugguuuuuuuugagacggagucuugcuuugucacccaggcuggagugcaguggccugaucucugcucacugcaaccuccgccuccuggguucaagcgauucuccugcuucagccuccugaguagcugggauuacaggugcgggccaccacgccuggcuaauuuuuuugcauuuuuaguagagacgggguuucaccauguuggucaggcuggucucgaacuccugaccucgugauccuucugccucggccucccaaagugcugggauuacaggcgugagccaccgugcccagucuaacuuuuguaucuuuuuuguagagacaagguuuugccaugcugcccaagcuggucucaaacuccugggcucaagugauccaccugucucagccucccaaagugcuaggauuauaagcuugagccacugugccuagccuugggagauauauuaaauauauauugaauuugaaagaaacuauucuuacuggugugguauaaacagaccaauccuuggcucugauuucugaugugguauguuuucugucuccaaggaggggguauaaaaaauauguaaaagugauaguucacuuucuuuucuuuuuuuuuuuuuuugagacagggucucacucuguuucucaggcuggagugcaguggagcgaucucugcucccugcaaccucugccccccugguucaagcaauccucccaccucagccucccaaguagcugggaccgcaggugcaugucaccacaccuggcuaauuuuuuguauuuuuaguagagacagggucucaccauguugcccagucuggucucaaauuccugagcuccagcaaucugcccgccuuggccucccaaaauggugguuuuacaggugugagccaccaugcccagucucacuuccucaaacuuuacaguaaaguugauuaguccauugaacuuaaagauuuaguaacuauuuacuaauguuaaauucaaaagggugcuaaguguuuuauucuuaucuccugucauacuggauuucagauaucuuuuuuaaccucaaguugucuggaaauaaacugagauuugaaugauaggaucugauguaaggaucucauuauaagcugaauaaacaugacauacucccuguguacuaugucugggaauauucuuugacacuacagucuuaaaaauuauaauuuguaacuuucauuaaagaucuaccuuagauaugacagagauaaauguaguaauuuaauggaaucacaaaacacuucauuaaaaaaaaucuuuguuggccaggcgcaguggcucaagcuuguaaucacagcacuuugggaggccgaggugggcggaucaccugaggucaggaguucgagaccagccuggccaacauggugaaacccugucucuacuaaaaauauaaaaauuagcugagcaugguggcaggcgccuguaaucccagcuacucaggaggcugaggcaggagaaucacuugaaccugggaggcggaggcugcagugagccaagaucacaucacuauacuccagccugggugacggagugagacucugucucaaaaaaaaaaaaucugugucauccacuuuucuguaaguccuggaaauauauggacaaaaaggcauggucucugcccuuagugagcuuacagugcaguagagggacagucacccaacaguuugaccagguaccuugagaacagaggaaagauuaccuaaauuuauguuggcaagguacucagacuucauagugcuuacacugagucuuugaaggaacaggcauuuguaaggcaacagaaggacaaaggaggcuggcucgguagggaccagaucuagaacaggacuucugugacuuacuaagcacuucgaguuuaauuucaggaaugaguaggaaugcugaaagaauuuugaaaaggaggguaaaauagauuuauauuuuuggauaauuacuuuguauuauuggggauaaugguagcaucauagagacuggauuggaagauaaugaagaaccaguuaaagagguauaaugcaguaguccaggggaaagaugaugaagacaugaacuaaggcagcaauagcagaaauaacaugagacggagaaaggaaacagcagauucugcaucagcacuuggcaguuuagaaggacaugucauugucaucugguaugugaggauuccccuccaauaaguguuacaaagcuugcugguuaggaagccaucuuuagcagagaauauuaccuauauaggguuacuuauuuuucccugggcaccugugaauguguagugcuugauauuuguaauuuaaaaaaaauucuauagaauauaaaauauaaaaucaaaucuggauuuuauuuauaaagaagguuugcaaguugaaccuugcgucaagauuucccauuguuucugcaaaacuuaucguuggguuucguuuuccagauucuccgggcccaaagccgaagugcaaguggaaggaagaucucugaaaacagcuauucucuagaugaccuggaaauaggcccagguaagcagagaguuccauguguaugagguccuuuaggaaguacucacuaguaguaacaucuuuuggacucgaagccaaugcuuuuaaaggaagaguggcacaaauuaaaaggaagucugccuauuagaugcaagccauucucaaaucucauugcucucgauaaauagcuuuuuuuuuuuuuuuuuuuuugagacggaaguugacgugcucccaaagugcugggauuacaggcaugagccgucaugcccggcugcuuuuuucauauuuuuaauccacccuuguuagugguaaccuaugguaagcaaaggguacuuugaggagcuauaaguaaagugcuacgaucaguuuugccuccagucaucugggguuugagggcuucaguagaugggcuguguccccuaucagguuugguuacccuguauuaccagugauaacauaacacuuugagaguggaauuauguuuuaaaggggacauauacaggcacuucacaaaagaaaaaauuaguaaaaacaggaaaacaucagcuaccuagucaucaaagaaauguaaauuaaaaagcauugagaucucuucuuuuucauguuaaauuagccagaauuuuaaaauacgagcccaggcaugguggcucagaccuauaaucucagcacuuagggaggcugagacaggaggaccacuuaaauccaggaguuugagaccagccugggcaacauagaccuaucucuacagaaaaaaaaaaaaaaagcccagcgugguggugcauccuugaagucacugcuacuugggaaacugaggugguuggaucauuugagcccaagacuucaaagcugcagugagcuaugauuguaccacugccccauacucuagccugggugacagagugagacccugucucaaaaaauaaaauaugcaauccucaauuaugguaagguucuuuuaaugcuaagaaagugagugaauauuacuuuauaaaugacaauuauauuccugauuuucuucuucgugcuuuuaacagaagauauuggccauuagauaaaaauaacccaaaauuuagaauuuugaaauuauuugaaucacuuuuaucuucuaauaaaacauguuggccagucacggugguuuacaccuauaauuccagcgcuuugggaggcugaggcgggaggauaucuugagcucaggaguucgaggcuguagugagcuaugaucgugccacugcacuucagccugggugauagagugagaccccaucucagaaauaaaauaaaacauguuauuuggaugcuuccaggucaguugucaucuucuacauuugacucggagaaaaaugagaguagacgaaaucuggaacuuccacgccucucagaaaccucuauaaaggaucgaauggccaaguaccaggcagcuguguccaaacaaagcagcucaaccaacuauacaguauguguucugcaucauucauucauucauucauuccaucauccagcagauggucacugaguacuggaauuaggaaaugucaccagacccuuguaucugagcccugguccccuagcuguucucuuuucacaugaacccuacccucgcuggauuugcaguucuuaccauggucuaauccugacuuugcuuucuuaguccugguucccaccccacucacuuuuuuugugauguuaccagugaguaucauugagaguuucccuggcucuucuacuuaaucuuuguguuguuaaagaaguaguauuuuauuaguuuuaauauaacucuuauuuuaucuugguuguugagggaagaaggaagaagacugaagagcuuauuuuggcuuuugagggaagaaagaagaagacuggagagaaauaucagcuguguucauuaacgaggguuuuuuuugugauuuuuuacugagauauaacucacauaauauaaaaucaccauuuuaaaguauacaaucuugugauacuuagcauauucacaagguuguacaaccauuaccacuguuuaauuccagaaccuuuccaucacccugaaaagaaacuucauaccuguguagucacucccaacuuccccugcucucauccccuggcaaccacuuagcuacuuccugucuuuauguaucugccuauuuuggaaauuucauaugaaggagucauacaguagaucuucuacuuaaucuuuaauccuuacgauguacuguuuuccuaaagaaguagaauaguagauaaggaaaagggagagaucacaagaaggugacgugcucaguaagcaugaaaauuuugauauucagcugggugugauggcucacaccuguaaucccagcacuuugggaggccgaggugggcagauugccugaggucaggaguucaagaccagcuuggcuaacguggugaaaccccaucucuacuaaaaauacaaaaauuagccagcaugguggcaggcaccuguaaucccagcuacuugggaggcugaggcaggagaaucgcuggaacccaggaggcagagguugcagugaggcaagauugcgccacuacacuccagccugggcgacacagcaagacuccgucuccaggaaaaaaaaaaaagauugguauucaaaauacaauggaggguccuuccccuuuacguuguccugugcuuaacggguaagcugaugcuacagaacugcuaaauugaaguuaccuuauagccaggcgcaggagcucacaccguaaucccaacacuuugggagccugaggugggugggucauuugaagucaggaguucagaaccagccuggccaacauggugaaaucccgucucuacuaaaaauacaaaaaaaaaauuagccagguguaguggcacacaccuguaaucccagcuacuagggaggcugaggcaggagaaucacuugaaccuaggagauggagguuacagugagcugagaucacaccacuguacuccagccugggugacagggugagacuccaucucaaaaaaaaaaaaaaaaaaaggaaguuaccuuucaaaugccauuuauucacauauauauguauacacacacauagauacaaauguacacacacauauuuuuguauccuucaagcauuuguucuaagauuucaaauuacaaaccauuaaucucuugauguccuaauugucuaacaaaaucaaaaagaacaauauugaauuuuauuuguucuuaggcagaucgaaauuggugcauauuggaaaccauaaugaguauucugggaguuaagccuucucuuccccacauuauuaaguauacauucucuaauaauauuugguggacuaauucucugggcaaugaauaauuucaucuugguuuuuuaacuguaauuuuaacaacuuuauguuuuaagaagagaugauguguguaaaucaauuagcaaaguggaguaucacaggcugauuaugcaccgugaaugugaaaagcgagcaaauuuagacuucccuuagaaggcaggucaggagauacagcaaauugggaucugcgaagcugaacuuccucuuguuaccagauuuuacugcuucucagugcccuccugcuguaaacauucccaccaggugacucccuauguggggaaaccuguugaguaacuuuuuuuuuuuaacuccuaaccauuucugcauuacaguucuccugcucuggagauuuuaagaguugaaaacucuuugggaauucuuguaaaaaguacauuuugucucauccccaaagaauuucccaggccccuuacagaauaugguuguaacaaggcacauacauacucucuggcagcaguucuggagguggggcuuugagauggggucaggaaugaguuguugggcuauauaauguucugcagugcuagcugccagcuccuccucacagaugcaccuccggugcugugggucguaaucuagaauaccaucacuaggugacuaagucauacucacauuccuuucauugaccugguggccauaaauuguuuccucccaugccuaaagauucacagagaacagaaaaguacuagauuacuacauuauuagcagacuaauggugggaaaugucuauagucaucgaccucuauguuuauuuuauuuuauuuuauuuuuuuauuuugagauggaguuucacucuuguuccccaggcuggagugcaguggcgugaucucggcucacugcaaccucugccucccugauucaagcgauucuccugccucagccucccaaguaacugggauuacaagugugcaccaccacacguggcuaauuuuuuguauuuuuaguagagacaggauuucaccauguucgccaggcuggucuugaacuccugaccucaggcgauccacccgccucagcuucccaaagugcugggauuacaggcgugagccacugcacccagguucuauguugauuuuagauguaauagaugaguuaauuguaauauucaccccaguguccuuugcaaggaaaaaaaugcaauuauccuuauuccuuaugacaauaaaaugcauguucuuuuauguugaggcucuguuuugagaaguaaaauaaauuaugucuuuaguacaauauaugaauuguauauggaaaaacaugcuuuuugaaagucccaccaaaaagguuucuuuaugguaucauuaaauauaauuucaguuuuuauauguauacaucaucccugucucucuuuccaggccgggcauuuauauauguauggucaguauauuuucuauuauuggcacuuggcaucuccuuuccccugcuccagaauggucuuuucugauaaaacucacaagcuuugcauuaccacaagcucugcugcuagaagagugaaucacaagaauguuguaugcuugggguguucugugugccuguguugaugugucuguauucuaaugagcaauccaguuuuacacuagcauacagauauuuaacucugagguauguguccacaaagcugcuuuugucauuucacuagucaguggguuuugcuugugagaguuaggggguugauuugacccgaggcuucuuagaagaauuuuuuaacauuccaaguuuaucuaauagaugugcuaugaagagaacagaaugaugggacuuuaaaaaaauuuuuacaguuauuuuuauuuuguagaaugagcugaaagccagugguggcgaaaucaaaauucauaaaauggagcaaaaggagaaugugcccccagguccugaggucugcaucacccaucaggaaggggaaaagguagguugaaaagucugauguccaguugccaaggaagcauguguucuaaauuagaugcuugaaauuagaaacaacucuaacucuaggcuguagagugucugggaauuugguaacagcugccaggacagauugccauuuuugcaggucacauaauuucaguugaguagcucugcaacuuauagcugaccaaauaaugagccuucauuggaaaauuauuuugcucagcagaugcucagaaggcaaagagcugaagugauuuuuuaaaaucuauuuggaggcugggcacaguggcucacgccuguaaucccagcacuuugggagggugaggcagguggaucaccugaggucaggaguucgagaccagccuagcccacagggugaaaccccaucucuacuaaaaauauaaaaagccgggugugggggugcaugccuguaaucccagcugcucgggaggcuguggcaggagaaucgcuugaucccaggagguggagguugcagugagcugagugcacugcacuccagccugggcgacagagcaagacucugucucaaaaauaaauaaauaaaauaaaaaucuauucgggccgagugugguggcucacgccuguaaucccagcacuuugggaggccaaggcaggcagaucaucugaggucgagaguucgagacaagccugaccaacauggagaaaccccgucucuaauaaaaauacaaaaaauuagccgggcaugguggugcaugccuguaaucccagauacucaggaggcugagacaguugaaucgcuugaacccaggaggcggauguugcagugggcugaggucacaccacugcacuccagccuaagcaacaagagcgaaacuccaucucaaaaaaaaaaaaucuauuugggagagcauagauucagggcaacuugauuccaugcuccugggaagaauaauuuacaaaaauaaaauaaaaauauauuugauuagagauuaucuucagauacucauauauucuuaauuuaaguauacauuuaacacauuuugugcaagaaaaucuuacucuuccacucauauuauuuugaaaggcagucacuaugcuaaguaagcauaggaaauaauaagcuuaaaaacuuauugacaaaccauuccauguggucuuuaugugcaagaaaacagaguagaggagagauuaauaagaggucagcuaucauaaaaauguaugauaggugcugugaggcugugagagggguauacaggaccacagaagcccagagcaaagauauuuaaccugacuuccucaagaaggugaugucugagcugagucuugaagaacguguggaaguaggccaagugaaugaggggaagguugaguuagaaauagaaggcuauuccaggcagauacaacagagauuuggaaaccagagaugauggcugaggaauuacagggauuguuuguuuguuuggagauggagucucgcucugucacccaggcuggagugcaguggcgugaucucagcucacuacaaccuccaucucccagguucaagcaauucuccugccgcagccucccaaguaacugugauuccggguacgugccaccaugccuggcuaauuguuuguauuuuuaguagagaugggguuucaccauguuggccaggcuggucuugaacuccugaccucacgugauccacccgccuuggccucccaaagugagggauuacagcuguaagccaccgugcuuggccagaauuacagguuugcugacuuggcuggagcaugagguacacauaggcagcagugagagacagguggaaggagagggcuaggguaaaucuuuaugucacccuuaaggguuuggauguaguggugcagcaggagaaagccacugaaagauuuuaagcaaaucauauuuguguguuauguauuaaucauuagaugaauggcuuaauugaaauaaguaacauuauuuaugucaggggaauuaucauguucucuaccauugcccauuguccaauucuuuuagucuuucagucaauaugauaaucgaauguuaaaugagaugaggagaaaggguuuucaaaucuauuacagugauuuaaucuuaggagaaaagccauugcuucuguuacacuuauugacacccuugacgccauucuuccaaaagacauggagaucauuaaauggauuaagagcaacaguucucaagcuuaguuggaauuuguauuuuuuaaauuuuuuuagagaugaggucuugcucugucacccaggcuggaguguaguagugugaucauagcucacuguagccuccaacucuugggcucaagugaucuuccugccucagccucccaaguggcugggacuacaggugugcaccaccacaucuggcuaauuuauuuuuaucuuuauuuuuuguauagacagggucucgcuauaauucucagaauggucucaaacuucuggcuucaagcaauccccucagccucagccucccaaaguacuggaaguacaggugugaaccacugcacccugucucaaacuuauuugacuacaacagacuuuacaaaguaggaugguauauugucagaauacuaacaggaacucaugagauauacuacucuuggaucaaagcagacccacagaaaaauggucucaaacugauggcuacaaaauuugauucaaagaccagaacagaaaaaaauauuagaauaguuuauuuuauaaaaacaucacaaauguauguuggaauaacaagacaaaauacuuggcagucauguguuacauggucauauaaucccccauaaauugcaaacauccuugcagcaguggacucaggcauuagcccaugaggcacaugccauguauuaagugaguuaucuuguuaaacugucuuguuuucucaucuuuuaaaugggagauuauuucuuaagaauaacugacuaaauauuuuugaaguuuuucuuauauacuguuaaaaaaaaaaaagaaagaaagaaauuuuaagagaaaaauauucccagcauugaaauauccccaucuuuaucccaggagcauaguuugggaaacagucauuugggaaauaaugcuugaauugucccuguaucuaaauucauguuuccuucgucauugucuucaugcugauuugaaacuggaacucugaacugaacuggaagauuagaacauuuuaauuauagccuaaaaggacauuagugcgacugugaaucaugaaguggguggggaagaaaggagauaaagacaauacauauucuucaagcacaugcugcagguuuacaaacccucagcugccuuaaaauucgcaauguuuuucagacccuuagcuauccuuuuggcuguuugccuagcuuuuguuaaccaauaccuaaguguuauuugaacuucagcuuguuaaaaaaaaaaaaaggacaugugccuggcgagguggcucacgccuguaauccuagcacuuugggaggccaaggugggcagauuaccugaggucaggagucugagaccauccuggccaacauggugaaacccugcucuacuaaaaauacaaaaauuagccgggugugauaaugggcaccuguaaucccagcuacucgggaggcugaggcaggagaaucacuuaaacccaggaggcagagguugcagugagcugagaucgcaccauuggauuccagccuugcaacagagcaagacuccauucaaaaaaaaaaaaaaaaagcaaagauuaccucacagguucaaggugaccaaauuaaaggugagagaagaacauccugggauggagguaccuacuaauucucaagaacugaagagcuuuuuguaggcaugcacaacuuucagaaaauuuauuucauaucauuagauaaaauagugcauuuguaaggcgauuaguugaauaccuggcacauaguaaacacccaguaaaugcuggcugugauuguaccgguuuauuuuaugccaugucagaauuccuguaaugaagagaguaguggaaaaaauaaccacgcugaaauucaggugcagucagccagcagcuuaaucuucauuguaaaucuauucaguuugucagacauccugauauaaacacucagcauugcccauaaaauccguggcaucugaauaaaaggaaauuaugugaagagugcacauugggucaccuguugacucuucaugauuuuggauguggaguaagauaccaggaaggcaugggggccaguagaaaggagggagagcucuaauagagaguucuuuuauuuaaauuugauggcuuuugagaaaaugauauauacaccuauacguaagaucugccaucuuuuuaaacauugccauuuugagacugggauuagaagggaaacuguccucaaagauaauacugagguuaguuuuagguaaauuuguuuuauaacugucaaaaggucuucuauauaggcaagcucguuucagcaggauguaguugguugggaaauaagaauuaggaaaauuaaaaaauaagaaugguuccuauauuuaaauacuuuaucuuuccuuggaguggguuaugguuauacggugaggagcuuugcucuccuugauagagggcuuuguuuugcuuuguuuuuugagagcagaaaaauaugguuuagaaguuguuuuauaaagggagaugaugcacacuuuuggcaguugagugcagucuguuucucggguuacucuguaauugagaggcauguuaauauccucauaaaagacauuuugcugccucuuguucaaaugcucagcuguucuggugcccguuauuuccccuaggcagccagugacugacuggagucagcagguuuuuauggcauuaacagcaguuugcucuuuuauuuuuaauaugacucuuaaucccccucuaacuuuuuuuuuuuuuuuuuuuuuguagauuucugcaaaugagaauagccuggcaguccguuccaccccugccgaagaugacucccguaagcauucuuucuuagaucuggaggaugagguucuuguuuucuaucuguauuugguucagggguguucccauuacugucagugcugagaaaauaacauaguaaauccucuacuugaauuuaagggcuaaugcuugaauguccuuuacacacuucauggcuuaaggagaaguuaaauucaauugaauauaguuaacuugggacaaacugaauacuuguaaugcuuuucucauugaauucauccuacuuuuugcaccaaacccuuucagaauugaagcuguauaaacuaauuuugaaguuucauuuuaacagaaguuuggccaauacggauuuuauucauuuauaauguuauucauaaauaccuauucuuuagugaauaaguauuugaauaaucuguuaaagauacauauuuuuucccuguuuaucuaaauguauauuauagucaaccuccuagccagguucuagggauuuuccugcugacagugaauuuugucaccugucauccuauuuuggagucauuuugagccucccuuuucccaaagacaaaaauguuuuuuuuuguuuuuuacuugacuauguccacuuuuuauucugauuuucaguauaacuuuuaauuuucauuuuuuagagacagggucucuuucuguugccuaggcuggagugcaguggugugaucauagcucacugcagccucaaacuccugggcucaagcaguccucccaccucagccucccaaauagcuaggacuacaggcacacaccaccauacccagcuaauuuucuuugagggagucucacucugucacccagguuggagugcaguggugcaaucucggcucacuguaaccucccccucccagguucaagcgauucuccugucucagcuuccugaguagcugggauuacaggcgcacaccaccaugccuggcuaauuuuuuguauuuuaguagagacaggguuucaccauguagcccaggcuggucuugaacuccugagcucaggcaauccacccgccucggccucacaaagugcuaggauuacaggcgugagccaccgugccuggccguacccagcuaauuuuuuaauauuuuuguagagaaaaggucucacuuuguugcccagguuggucuccaacuccuggucucaagcaguccuaccaccgcagccucucaaaguguugagauuacgggcgugagccacugugcccagcccauuuaaaaauauauguugcugggccaggcgcaguggcucacaccuguaaucccagcacuuugggaggccuaaguggguggaucacuugaggucaggaauucaagaccagccuggccaauauggugaaaccccaagcucuacuaaaaauacaaaaauuagccaggcgugguggugggcgccuguaaucccagcuacucaggacacugaggcaggagaauugcuugaacccaggagguggagguugcagugagcugagaucgcaccaucgcacuccagccugggcuacagagcgagacuccgacucaaaacaaaauauauauauauguugcuggccaggcacgguggcucacgccuguaaucccagcacuuugggaggccaaggcggguggaucaccugaggucaggaguucaagaccagccuggucaacauggugaaaccccaucucuauuaaaaacacaaaaaguuagccggaugugguggugggugccuguagucccagcuacucaggaggcugagacaggagaauugcuugaacccaggagguggaggcugcagugagcugagaucaugccacugcacuccagccugggcagcagagugaaaauccaucucaaaaaaaauauauauauauauauauauguauauauauguuugcugggcgcuauggcucaugccuguaaucccagcacuucgugagguugaggcaggcaguuugcuugagcucaggaguuggagaccagccugggcaacauggugaaacccugucucuaccaaaaguaccaaaacuuagcugggcaugguggcaugcaucuguggucccagcuacuugggaggcugaggcaggaggaucacuugagcccaggaggcagagguugcagugagccgagaucaugccacugcacuccagccugggugacagagugagacucugaaaaaaaaaaaaaaaaaaaauauauauauauauauacacacacacacacacacacguauauauauguauauauauauacauguauauauauaucauauauacauguauauauauaucauauauacauauaugauauauauguauauauauaucauauauguguauauauaucauauauacacauauaugauauauauauacuauauauauauaaauuucuuguaggucacaagacaaaaaagaaaaacauauauauguggauuucuagcaucuccccaggcuaguuuacuggacacugaaaacccuacaacugaaauagaaugaugaauuaaacagaucucuaguuaauccuaccuuaaaauuucggagaaaaacuccuucugcuugaauccagaaacauucuuuuuuugcaaucauuuuucugggacuagaaauguuucugagaaauguuuuugacuagguuuaugaaacauuuuuuugaaaaauaagccuuaauauuuuaguacuuuguugacucaccucuucauuuuggcaggaaaguaacucauguaguuggaauuucaaugauuaugaaaaaaacuucauggagcccuuuuccauaaucuucauccauugguaucugcuauagaacugaccaaaaacagugucagguuacauguauacacaaaugcgcgcacgcgcgcacacacacacacacacacacacacagaguacaaaauuucugcccucacaucucccccuuuuuccaacuucaguugaaacacuucagaaaaaguuauuaggaauguuaaugaccaaaaagacaucuaagucuauaaacggccuuuaaaaaugacaaauggcacaaggaagaaaguucuuuauacagagugguuuggauuucugcuacguguggcagaggguaagaaagccuccucacugagaaccugauuucugacaggaccagagaauaccugagccauaguuguuaguguucgaauauucuucaacagaaaagcaguguuuuuccugguguuggaaggaucugucauuaaugaaagugcccaaacuuugcuuuucggaagaacacuuuccaagacauuccaugagauacuguaaaaugucuuccuuuuguaacucaagcaggugacucccagguuaagagugagguucaacagccuguccaucccaagccacuaaguccagauuccagagccuccagucuuucugaaaguucuccucccaaagcaaugaagguaugauggcaauuucucucugagccuuuggacauuggucuacugguagagcuaauuguaccuuuuaugaugaugauguugauuauaaccugguuuugcuuuccuguggaugauaaugccacagaagagcacacugaagccagucgcuuucccuggaaaucuugcugccucugcucaggucuuuggcccgggagcgagaaggcucacuaaugacucucaguuugaacucuggaaaacucaugaaaguuuuaaaauaaugucgguuuuuuuauuuuuguuuuuguuuauuuauuauuauuaucuuuuuuuuuuuuuugagacagaaucucgcucugucacccaggcuggagugcaguggcaugaucucggcuuacuguaaccuccgcccccccauguucaagcaauucuccugucucagccuccugaguggcugggauuacaggcaugcgccaccaugccuggcuaauuuuuuuguauuuuuugguagagacaggguuucaccauguuggccaggcuggucucaaacuccugaccuugugaucugccugccuuggccucccaaagugcuggguaagccaccacaccuggccuuguuuuuguuuguuuguuuguuuguuuuuguuuuguuuugagacagagucucgcucugucgcccaggcuggagugcaguggcgcuaucuuggcucacugcaagcuccgccucccggguucacgccauucuccuaccucggccucccgaguagcugggacuacagguguccugccacuacgcccggcuaacuuuuuguaguuuuaguagagacgggguuucaccguguuagccgggauggucucaaucuccugaccucgugauccgccugccuuggccucccaaagugcugggauuacaggcgugaaccacugcgccuggccuguuuuguuuuuuugagacagggucuugcucuguugcucaggcuggaguaugguggugugaucacggcucacugcagccuugaccucccaggcuaaugcaauccuccugucucagccuccugaguagcuagaacuauacgcacaugccaccaugccuggcuuuuuuuuuuuuuuuuuuaagagaugugauuuugccauguuucccaggcuggccucaaucuccaggccuugggugaucugccugccucggccucccaaagugcugggaugggauuauaggcaugagccacugugcccagccaggaaaaaucuguucaacuaaaaucagcacauuggacgagaugugcaauuucaccuuaaagauaauggcuuccuaaucugcagagcuugaucuuaaccugugguuagcuuuuuuuuuuuuuuuuuuuuuugagacagguucucacuuugucacccaggcuggagugcagugguguggucacagcucccugcagccucuaucuccugagcucaaaccauccucccaaguagcugggacuauaagcacaugccaccacacccagcuaauauauuuuuuacauuuuuauagggauggggucucacuauguugcccaagcugguuuugaacuuuuggcuucaaguaauccccccaccuuggccucccaaaaugcugggauuacagguaugagccaccaaacacaccuggcccuguuguucccacuuuuuuuuuuuuuuaggaccuguuguuuacaacaaugucauuaacauuuuuaacgaaagaauguguccacuggaaugggggcuggccagcccauuuucugaaaaaaaaaaaaaaaaaaaaaaaaaaaaaaaaaaaaugaggccgggugugguggcucacgccuguaaucccagcacuuugggaggcugagacgggcggaucaccugaggucgggaguucaagaccagccugaacaacauggagaaaccccaucucuacuaaaaguacaaaaaaaaaaaaaaaaauuagccgggcaugguggcacaugccuguaaucccagcuacuugggaagccgaggcaggagaauugcuugaaccugggaggcagagguuguggugaaccgagauuaugccauugcacuccagccugggcaacaagcaugaaacucuugucucaaaaaaaaaaaaaaaaaugacauucaagcaacacuuauacuaaggguauaacauuagauauuaagaauugaggccaggcacggugacucacagcuauaaucccagcacuuuggggggccgaggcaggcggaucacgaggucaggaguucgagaccagccuggccaacauggugaaacccugucucuaaaaauacaaaaauuagcugggcgcaguagugcgugccuguagucccagcuacuugggaggcugaggcaggagaaucacuugaacccgggaagcagagguugcagugagccaagaucacaccacugcucuccagccugugugacagagugagauuccaucucaaaaaaaaaaaaaaaaaaaaaaaauuggccaggcaugguggcucacaccuauaaucccagcacuuugggaggccaaggcgggcagaucacgaggucaagaguuugagaccagccuggccaacauggugaaagccugucucuacuaagaauacaaaaauuagcugagcaugauggcaggcaccuguaaucccagcuacuugggaggcugaggcaggagaauugcuugaacccgggagguggagguugcagugagccaagaucgcgccacuguacuccagccugggcaacagagcuaggcuccucaaucuauaaucugcuuuuauuacccaaguuuuaaaagucgucuuuuccucuucuaugggcaaauauauauucccauaaaaauaagccaaaaaauguuuauuaaaaaugcaaaacuuauuuuagguuuguuagcugacuuguuuuaauugacuagcuugcuaaugaggggcuacuucacucguuuggauuacccacacuucuuuagugucuuucuccucuagugcucuuuuaaguagcaggguuguguuucaaaaguuuuagcauuugagagaaacucaauaaauagaaugaguuuuaaggugguuugugcugcucccaacucaugcucauaucugccgugcuuauaccucugacugugagcaugauugguccacagauaaaaguuuuacugcacacaaaguaugaagaggaggggacaucagggaggguuuggaacaaaaggaggaaaggggagaauccaggauuuaaagaguggauuuaaaaggugagcaaggugaaaaagauaaaacaugaaaauuuuaaaggaggcagagauuuaugagaagaguaagguuuauugaaaaggaacaaaagguaaagaaagcagaaagagaaagcaaguccaggaagaaugggcggggucauggugauugaaucuguacaugugcuccgcauggcuguguucuggccuugaagguuggcugaugcugccaucagcacuuucuuugucaguaucuggagucucacaaaguagcaaaccccacaggguuacuuuccucucugacagcaaugcugccuagaugugagugcucagguugugguuggggaucaagaacggcuagcaaaucuaacuuggugauggauucuguguaacccaggaccuggggaaauacaggaacuaaaaucuguucuugugacuauuugaauucucaaugcagucuugcaucccucguucaacugcuuggccagacuuccuuguacuggguggggaucccuccccacucaaguuccacggggugagcggaugaguggugugugaaagggcacaccucacuuaggucuccuuuggcaccagggagaggaaacagagguaaagcugucucugucucugccucagacccaugccuacuccuuuggcacuggucacucagcaguagaauaguaguauaguaguagacggcccuaucugcauagucacacaccucggguuuugagcauuguguaaugaccagaguaaacuggccuggcuguuugccucugguccacagcucagaugaucaugguguacagagccugguggaacccaguuacaucuccacuguuauuuaagggcaauuuauuugcucuuccucagaguuccccuuuacagucugcaggcaaauauacagauacuuuaguaaauguuuauaggaagaccugcuggcagaacuggucucauggcugcagacuaugaacagaaguuguuucuccacuuugggaaauuacauacagcuaagaauaaacuuguucacucagaauagauuuuuggaucccacacauccuggaaaaaacuguuucuuagugccugucuguuauugaaaagaggacaucuaagguagagauucaauucauuucaaauuuuagcuuaauaaaguaaaaagaaaugauagaggucuuuaaggauucuguacacuuugaacacuggccacagagcuuacuugguaagacuugguaccaaugaaguuacagguucauucucaaaaagggugucguucugagagcagagcuuaguggacccugugagaaguaucaggccuuucuacuucaagagacucagagaucucuuaggcuuuauguccucccauuugaaagaaaucauccccuaaacguucccagaggagaggauagggaaggaagaggcaaggagaugugacuggcccuagggaacaacugucugcccucacuguguacgggacaaccaagucccaggccuccucacagcguuuugcugaugaauguugagagagaacauggcacucuacgugagagggcagcacacacugcacugccccucucgguacccugccagcuguuccucccccugaagacacagugggagguuuuaugcuggcuugcaaagcugucaaaauuaugcuagaagagugucuagaaucuuuucucacucacucacuauuacugccuuuucagaggacuguccuuucuucucuguguagagcacucuauuuaagauaugaauauuccccaaaaugcuuucauagaguuucacagaaaauuagaggaaggguuaaggcugcacagggcuggcccaaccauuugcuguguggugaagaauuucaguuucauuaccuagauauuuuacacaaauuggaaggaaugaaaggcauuuugugguauucugaggaauagaggcuugacgucaauacagaauuuucaucuucuuucacuaugucuaaaggcuaguuaacaucaaugucuguugucagcugcuccccccuaccucccacacacaccacaacuggggccuuuauuagaguaaaaaauauaugagacaagaggguaaaagaauguaaaugaagccaugcaaauuuguuagaaaaacagcuuuaaguagaugguaaucaacagagggucuguaauaucccucaaacgggaaagacaguauuuaugaacaucaauuauuuauagauuaccucauucacucuagaauauccugaagauauuaucuacacauuuuuauuugaaacaaagggaagaccauaguuuguucaaauugcugucgugggauuaauuucauuuggguuagcaucugcucuccuccccaaagaguuucccuuggcuguggaaauuuaacauuccaggacaauuuagaaaaugcucucuugguuugugagucaggaguucugaguuugugcagugagcaggucuaugcagaccuacccacaaaggcugagggagcugaaaagccaaagaaagaggcugacaaauccaguuucucagaaagaaacauuuaauaagagcuuaugaacagaagugaugucuaggaggccaugagacaguggaucccugcaccagcccuccagaaaauauccuuuauauagcaagguuuuaggauaaaacaugugcagcuagucacgcuugacuuucuugcaaaacuuaucacuggagcgauuggauaagcaucuuuaugagggguugucuaugcucugggcacuaccccuuuaugagggauaaucuaugcuacaggcauuguuuaaagacuuugcugcagaacaaaccaccuugguaugcaggagucaaaccaccaguuagcauggugguuucacuccaagauggcaucacuccugccaugcaacaggcuguuuuccuacaguuuuaauucuauuucuguuauugacuaugugaacuuugauaagaccugguguuuaacuuucuacuugguaggggcaaaauggugggagaaggggaaugaaaaaaaaaaucucuuacuaacugaaaaaauauacugugaagauaaaaaaugucuaacauugucguauuggcaguguuuuaaacauggcugugccaagucugagcaugccaugaaggcaugggcaggauguaugccaggccugugauaaugguagagauuuuuaggcacugacuaugcuuccuguugucugaauagacaugggggcaauuacagaaaaguggcugagagcccaggacauagaaaauaaaggggaggcacagccgcagccgcugugaguuggcauuuuaccaugucgggacccucuugucuuuaugaaacuagaaggggcccuuaggcagcugcugcugcauaaaccuuaaauaauauugaaaaggguugaugugagaaaugaauaggaauaaugggacucugauaggucuggcuaguuagaagcucaagguuagucaauuaugugagcuagcaaucuauuaacuugauguuaaggaggaagacagacuuuuugcuccaugugggugaaggcucuauuaaagagagagccgaugugggucaggugugggagguaguaagccacuaaagaauuguuaaugagacacuccuugugugggugaaggcucauaaaagcucgcucuccugagcugggauauguuccagccucagguagauacgagugaggcugauuuugccaugauuagcagaguuacuuaaaaaggaaaaaaagaaaaauguggucuuauucuuggaucugagucucugaguuucagcucagcugcaguaaagcucuccagggcacgccaaaugcuguguauucauugaagguuccuguuugucucuuccagcuucugccuccugcuccugguaccuaauuucugcuccugccuuccacuuuccuccuaaugugagcucaacuuucagcuuucucacagguucuccuuuccuucuguucccugggcugcuucccccucccacagugugugccuccccuccguguguuugugauggaggagugcucugcguccuucaguuccccuuuagcagaacaguauccaucuccucuuaucccaugugaaguuucugucuccugcugugucuuuacugaccagaaugagcacuuacucuccuacaucuauuucaaguguuaaaaaauacagaauuccgggccaggcgcaguggcucacaccuguaaucccagcacuuugggaggccaaggugggcagaucacaagguuaggaguuagaaaccagccugaccaacauggugaaaccccaucucuacuaaaaauacaaaaauuagccgagugugguggugcacgccuguaaucccagcuacucaggaggcugaggcaggagaaucgcuugaacccggaagguggagcuugcagugagcugagaucgcgccacuguacuccagucugggugacagagugagacucugucucaaaaaacaaaacaaaacaaaaaaaacaaaaaacgcagaauucccuuucugcaacugaaaaugauuuuuaaucugauaaauacauuuguccuacuuuuacauuaugugaauugugauuuguacaggcucucuccaguagcauccauuauacuauuacaccaaaaauuuauucugcuuuuuaauaucucuccuuuuguuguuguuguuuugagacagagucuugcccugucuccaaggcuggagggcagugaugagaucucagcucacagcaacuucugcuuccuggguucaagugauucuugugccucagccucucugguagcuggaauuacaggcgcccgccaccacgcccagcuaauguuugcauuuucuguagagacaggguuucaccauguuggccaggcugcucuggaacuucgaccucaagugauccaccugccuuggccucccaaagugcugggauuacaggccugggccaucgcaccuggccaguguaucuccuaccuagacaaagaccuaguccuuuuagagaaaacuuaauuaaaacucugcaaagauaucuccauuuagcaguguccauauaagaaaaaaagaauucugaacuccaaauacgauaauguguuaauuacuugcaacaacauucauuacaauaacauuugguuauauuuaaauaccucccuuaugcuaaacuagguuguaaccuguggucuuuugauucuuuagauguuucuuuuuaggacauugccccuagaauaaagcagaguccugguaacuagccauuuccacucagcuuuguuccuuccuucuuaaaucccuugggcacuacuugggaguuuaccacuaauuuuauuaaacuuccuuuuauagauuucuuuauuuucauuuuaugcacauuuucugcucucacuuccugcccaaaucuacuuggaaaaccauuuuuauuuuuugcuuuaccuccuagugaaucauguggcaagugaaccaacagucugaauuuuuuaugggccuguuuuggguuuuuuuuuuuuuuuuuuuuuuuugagaccaagucucacucuguugcccaagcuggagugcaguggcucaaucucggcucacugcaaccucugccucccagguucaagcgauucuccugccucagccucccgaguagcugggacuauaggcacacgccaccaugcccggcuaauuuuuguauuuuuaguagagaugggguuucacuauguuggccaggcuggucuugaacuccugaccucgugaucugccuaccucaaccucccaaagugugggauuaugggcgugagacacuacacccagccuauuuuggauuuuuuuuacucaaaauucuaucuugcccauaaccugguucauuucaggcuuaacuauccagguccugggccuugggauuaauuugcauuacuuaccaucauguguuuucuggugagagcccaggcugaucauggcagcaaaagcaccuccuaauugcugaugagagcuuccuggccaccuaagcugucucccgcaucuacugguugagguguuuguguugggcaagucaaggguuaacucccauacaccuagggacuuugcauucccaucuacuccccaccccuuaguagccauguaacuauuucuuuucuuuauuuuuugagauggagucucacucugucgcccaggcuggagugcaguggcgccaucucggcucacuacaagcucugccucccggguucacgccauucuccugccucagccucccgaguaacugggauuacacgaguguaccacuacgccugccuaauuuuuguauuuuuacuggagacgggguuucaccauguuggccaggcuggucucgaacuccugaccucaugauccgcccaccucggccuccuaaagugcugggauuacaagcaugagccaccgcaccuggcccauguaacuauuucuuaucaugugaaagcuuauaauauuuuuggaguucuggcuuuuaucagugcuagaauaccaacuguuuuauauucuuuaggauugaguuuaucagguagaaccacugugcccauguuuguuccaacuuuacaaacaguucaugaauucccagucauuaauacauuaaccaguguguuucccauugcauuaguuuuucucuccauugguuuuuagaaauauuauagaaccuauagcuuuaaugggcuaugcuucccucugguguccuaauaaaauacuuugugucucuuauaaauuguuccacuugugugucaguuuugacuuguuuaaaaauaguaugucuaguugauugaacaaaucaagauuauaagcagagcagaauaaaaggggcuuuacugaaaugucuuuccuaauucccaaagccaaaugcucuuccucuccuugaaauuuauccccuuuagaaucugucuuguguuuacuuggcacuugaaucaaacuucuuucuucugugugugauaacauuuucuccuaaucccugcacucccccccccgaccccuucccccauccccugcuccuaacauuuuuuaugugggucgugacuugucuaagccauucuuuguaauccagacguagcuccaccuauccuugguggcugcuacauuuagagcagccacacaguuugggaagggaauaucaagagagccucuuggcuuuaaagagucagcugauagaauuguagcagguuuagugcuccaugagaauugacugaccagcuaagggagcccuuagacaaaguaaauucuaggguccaucucaagacagugcuaacucaucgcugcccaugcuaaaguugucuuuuuguuuuuccuagaaguuucaggcaccugcaagagagaccugcguggaaugucagaagacagucuauccaauggagcgucucuuggccaaccagcagguguuucacaucagcugcuuccguugcuccuauugcaacaacaaacucagguaagucagcccaaaacaagccaucugucuauaacuggaacucuagagggagucuuuggcuuuuagagcacuggugcuaaaagcuacugugcuaaugauauucuguugaaggcucuugaauaaaguaaaaagcaucauuuagugacaagucuuucauaccaaauaaugaugguguuuggaacuucuugguguauugauauguuaauuuacauguuaggaccgaagcuuaaauaauaugaguugcagguaaaccccccugugaccuaauuuaauagaauguuuucccuugguaucacagaaucacaaaguuaagaaaucucaagagguuacuuguuuaagcccuuacuugucuuaaccacuguauaaaugauaauaauggcaauaauaauagccccuggagagcaugucuuuuucucuauguugccucacuuuauuucugagaaaauaguuguuacauaucauuucuuccaaguaacucaaagugcaaauauaaaugugacaaaucggggaaacauuccaaauuaacucauuuuaaucauagagucuuacagaaggaaguaaccaagaugucacuuucuccagcuuuccuuucugagcaauccuuccuaaaauacucuugaaagauguuuuggcaucugugugacauuucuagcuauuagauagcucuagcuagacagcuucuccaaacaugcagccaaaguguaccucagucacuuccacucauuaguucuucugcugcccacuguguuaauuuuuuucuccaaagcaccuuuuuuuuuuuuuuuuuuuuuggauacagagucucacucuguugcccaggguggagugcaguggcgugaucucagcucacugcaaccucuaccuccugaguucaagcgauucuccugccucagccucccaaguagcugggacuacaggcgcccgccaccacacccagcuaauuuuuuguauuuuuaguagagaagggguuucaccauguuagccaggauggucuugaucuccugaccucgugauccacccgccucggccucccaaagugcugagauuauaggugugagccacugugccuggcuuaaagcaccuuauuucuuuuguggaagugcugccguuuuauacccccuuuaacauuugucacucuucagaaugguucguaacuuaagggaaaaaacuuuaaaaagauaaaacuuaucauccugcaagagacaccaaaucuccuaaaggcuugucuaggacugacauuagggaaaaacuaccuccugucaacuccucaccauucuucuauuaaucaagcuuauaucuagguguggauauaaggaucacaccuguaauccuagcauuuugggagugcccagguaggaggaucacuugaugccagaaguucaagacuagccuggguaacauagagagaccccaucugguuuuucuuuuugagauggagucucacucuguugcccaggcuggagugcaguggugugauccuggcucacugcaaccuuugucucccagguucaagcgauucucaugccucagucuccugaguagcugggauuacaggcgggcaccaccacgcccagcuaauuucuuucuuuuuuuuuuuuuuuccggagauggagucuugcucugucgcccaggcuggagugcagugggaugaugucagcucacugcaaccuccaccucccagguucaagcaauucuccugccucagccucccgagugguugggacuacaggcgugugcaacaugccuggcuaauuuuuguauuuuucauagagaugagguuucaccauguuagccacgcuggucuugaacuccugaccucagucagucugcccuccucggccucccaaagugcugggauuacaggugugagcaaccacgccuggccaauuuuuguauuucuuaguagagaugggguuucaccauguuggucaggcuggucucaaacuucugaccucaagugaucugcccaccucggccucccaaagugcugggacugcaccuggccggagaucccaucucuaugaaaaauuuggggaggcugagacugaggcuggaggaucacuugagcccuggaggucaaggcugcagugagcuaugaucauaccauugcacuccagccugggugacagagcaagaccuccacucaaaaaaaaaaacaacaaaaaauggcugggugcaguugcucaugccuguaaucccagcacuuugggaggccgaggugggcagaucacgaggucaggagauugagaccauccuggcuaacaaggugaaaccccgucucuacuaaaaauacaaaauauuagucaggugugguggcgagugccuguagucccagcuacucgggaggcugaggcaggagaauggcgugaaccugggaggcggagcuugcagugagcugagaucgugucacugcacuccagccugggugacagagcgagacucugucucaaaaaaaaacaaaaauggcugggcgugguggcucacgccuguaaucccagcccuuugggaggccgaggcgggcagaucacgaggucaagagaucgagacuauccuggccaacauggugaaaccccgucucuacuaaaaauacaaaaauuugccgugcaugguggcacacaccuguagucccaacuacucaggaggcugagguaggagaaucgcuugaacccaggaggcagagguugcagugagcugagaucaugccacugcacuccagccuggcgacagagcgagacucuaacaaaacaaaacaauacaaaaauuagccaggcgugguggcgcacuccuguaaucccagcuacucaggaggcugaggcaggagaauugcuuaaacuugggaggcggagguugcagugagccaagauugugcaacugcacuccagccugggcgacagagcgagauucucucaaaaaaagaaaagaaaaagaaaaaaaaaauauauauauauauauguauuuauauaccguuaagaauagaguuaauucaagcacaaaagcuugaugauggcuacccagaaacacugacuccaaaugaauggggucagcauuccaaaguggagaaaguuaguuucacuuacacagaaauuuuagcaaagauuaugacauuuuucauauaagaccagugcauauaccacagugauuugauuggguacagauugguacauuccaaggaagauuaucacucgcaaagaagggauagugaucugagggggucuuaucucuggugcccuuuggucuucauaauuuauagugaaaagaaagaguugcagcuacaugcugugugacccagguugcauagccacauuccucucaaggcucagaaugauuuaaaguuucuauuacuguugguuuuuuuuucuuuuuuuuuuuuuuuaagacagucucgcucuaucacaguggcacaaucucagcucacugcaaccucugccucccggguucaagugauucucccacuucagcuucccaaguagcugagacuacaggcaugugccaccacacccagcuaauuuuuaaauuuuuuguagagaugaauucucacuauguuggccgggcuggucucaaacuccugggcucaagcgauccucucacccuggccucccaaagcgcugggauuacaggcaugagccacugcacccaacccgugcuuuguguuaugauaagaaaacaaaugugcuaaaauggggguaaggaauuccuggucacugaagggcuuuuaaagaucuuuuucuuacuuggcaucuucugaaaauacuggaauugccagauuuuagccuccugguauaagugagaaugugaagauuugcuaaguuuaugcuuuuuuucuuuuaaugacagucuaggaacauaugcaucuuuacauggaagaaucuauuguaagccucacuucaaucaacucuuuaaaucuaagggcaacuaugaugaaggcuuugggcacagaccacacaaggaucuaugggcaagcaaaaaugaaaacgaagagauuuuggagagaccagcccagcuugcaaaugcaagggagaccccucacagcccagggguagaagaugccccuauugcuaagguggguguccuggcugcaaguauggaagccaaggccuccucucagcaggagaaggaagacaagccagcugaaaccaagaagcugaggaucgccuggccaccccccacugaacuuggaaguucaggaagugccuuggaggaagggaucaaaaugucaaagcccaaauggccuccugaagacgaaaucagcaagcccgaaguuccugaggaugucgaucuagaucugaagaagcuaagacgaucuucuucacugaaggaaagaagccgcccauucacuguagcagcuucauuucaaagcaccucugucaagagcccaaaaacuguguccccaccuaucaggaaaggcuggagcaugucagagcagagugaagagucuguggguggaagaguugcagaaaggaaacaaguggaaaaugccaaggcuucuaagaagaaugggaaugugggaaaaacaaccuggcaaaacaaagaaucuaaaggagagacagggaagagaaguaaggaaggucauaguuuggagauggagaaugagaaucuuguagaaaauggugcagacuccgaugaagaugauaacagcuuccucaaacaacaaucuccacaagaacccaagucucugaauuggucgaguuuuguagacaacaccuuugcugaagaauucacuacucagaaucagaaaucccaggauguggaacucugggagggagaaguggucaaagagcucucuguggaagaacagauaaagagaaaucgguauuaugaugaggaugaggaugaagagugacaaauugcaaugaugcugggccuuaaauucauguuaguguuagcgagccacugcccuuugucaaaaugugaugcacauaagcagguaucccagcaugaaauguaauuuacuuggaaguaacuuuggaaaagaauuccuucuuaaaaucaaaaacaaaacaaaaaaacacaaaaaacacauucuaaauacuagagauaacuuuacuuaaauucuucauuuuagcagugaugauaugcauaagugcuguaaggcuuguaacuggggaaauauuccaccugauaauagcccagauucuacuguauucccaaaaggcaauauuaagguagacagaugauuaguaguauauuguuacacacuauuuuggaauuagagaacauacagaaggaauuuaggggcuuaaacauuacgacugaaugcacuuuaguauaaagggcacaguuuguauauuuuuaaaugaauaccaauuuaauuuuuuaguauuuaccuguuaagagauuauuuagucuuuaaauuuuuuagguuaauuuucuugcugugauauauaugaggaauuuacuacuuuauguccugcucucuaaacuacauccugaacucgacguccugagguauaauacaacagagcacuuuuugaggcaauugaaaaaccaaccuacacucuucggugcuuagagagaucugcugucucccaaauaagcuuuuguaucugccagugaauuuacuguacuccaaaugauugcuuucuuuucuggugauaucugugcuucucauaauuacugaaagcugcaauauuuuaguaauaccuucgggaucacugucccccaucuuccguguuagagcaaagugaagaguuuaaaggaggaagaagaaagaacugucuuacaccacuugagcucagaccucuaaacccuguauuucccuuaugauguccccuuuuugagacacuaauuuuuaaauacuuacuagcucugaaauauauugauuuuuaucacaguauucucagggugaaauuaaaccaacuauaggccuuuuucuugggaugauuuucuagucuuaagguuuggggacauuauaaacuugaguacauuuguuguacacaguugauauuccaaauuguauggaugggagggagaggugucuuaagcuguaggcuuuucuuuguacugcauuuauagagauuuagcuuuaauauuuuuuagagauguaaaacauucugcuuucuuagucuuaccuagucugaaacauuuuuauucaauaaagauuuuaauuaaaauuugaacuuuucaa

SEQ ID NO: 192584 - RNA, 40425 nt, Homo sapiens
cgaccaaucgcggggaggggagggcguuagccagcguggcgcuggcucccggaauauggagcccugggcgcgggggcggcgugucaggugguugcggagcugguaaggugaggggaaggcaaggucaggggucacggcauuccgcucgcuggcagggaggggcgcggggcggcucgagggccugugucgggggucaggcuccggggcuaggaugcgacaccggcucgccgugcggggcugugaggggagguguggccagggagggccucaggcccagaguccaggacugauggagucgcgccauucagagaaagacccaaagaugggggcagggagggaacgccggaggucgcgggggucucgccccuuccccgccgcggccuaggacacauggcccagcucccagcugcaccggauggcgcgcccggccugugucggggugcgcugaccugcuucgacgccucgaaagaggccgacgggcacagggcaaggucuuucguggccucuucgucggcgccgcagggggccgggcugcucuccggggccucccgccgccccgcuucaacaaaagacucauuauaaccuaaccgacuucagggagcgccuucugugugaauagccugcauacgcggcucaguaauuguggguagauugguuuuaaggcuguuuguguagcucucagggacccucuggauuccaggcuccaaugagcaggguuuuucuacagggggauauugcacauauguaagugggcuggauggcucucccagcugugcguuucauguguccccacuuuuaaagcuaccgcuuaaaugugacaucucuugcaaaagcaaaaauuauauggaaggagaguuugcaaggggagauaggcuucuaaaaacuugcuggccucaauuuuagugacuguuggugaaaaauggagaagcuauguuuacacugacuucuggaacccgaagccccaccaguucgcaugauuucuuggcuuuguaaaucuuugagcauguuguuugccucuuucuucuuuuguuccacguacuuaaaauggggauugauaauaucagucuuacaggguuguugguaugaaauuaguuaauaaacaacaaaguacuuagaacucuugauguggaggaguuuuuguuguuguuaccuucuuuccccuuaacacuucuaaagaauucuaaccuuauuacuuauucuuugcucagagucucaugacuuaucaccagugaacccgccggccuauacuuuccauugacaucauuaacuuugaucugaggguauaguguaguuauaugugacuagaggauuucugcugcguguuuguuuuauuaaauacgguuggaaacuaucauuauacuaggucauuuauugugauaccuguguuggguaaaugaaaccugaaaccuucggcuguuuauuuuuucauuggacaguauuucauugacagucuugcuuggccuacucaguuuauuuuggagccaguacuaaaaaggccaugauugcagcauacuugguuucucauguuuccggaauggcagugggacucgggaggggaauuucuggguagccuggcagcacuucuuguuaaggaauggggaagcuucuuaugaaucuaaucuuacucuaauguuaggaaaucagcaguggucccuuggauuacucuacaaagcuaguaggcagcuuugguucaguuaugacucagugaagguuagagaauuauaucuacaaaguaggaucuuuuucuuucuuucuuucguuuuuugauacggaguuucgcucuuguugcccaggcuggaauguaauagcgcgaucucggcucacugcaaccucugccucccggguucaagcgauucuccugccucagccucuugaugccuggcgaauuuuuuuuguauuuuuaguagugacgggguuucaccauguuggccaggcuggucuggaacuccugaccucaagugauccaccuguaucggccuuccgaagugcugggguggugugagccaccgcgcccugccagaucuuucuuguuugacuuucauugcuaagaauuugggugaguguuguugaaucaaagacaucuuuauucucugccuccucaccaugcacauacguacaaaugucugcugacagauaucugcccuuccuauggccuuaaaaagccuucucauauucucguggugcuaucugggauacaccaguggaagacugcuuugucuucuaauucuucccuucaaagaagcggcuauuuauacacauagcauuauuaggaacuagucagaaaaugagaaacuuuaaguuuaugaaaaaaaacauugcuuacuucagcugcaugcuggccaaauuuaguugaagugcaguugguauaaguuuaguuguuuaguuuuggaauaagagaguucaagacuuccccucccaccccccacaagacaaggucuggcucuguaacccagguuggagugcaguggcaugaucacagcucacugcaggguugaccucccaggcucaagugauucuccugccacagccucccuaguagcugggaguacaagugcaugccaccaccccuaauuuuuaaaaauuuuuuuguggagauggagucuuacuagguugcccagguugucuugagccccugggugccagccaccgugcccaaccaguuuaauacuucuuuaggauuuaaaguuggaaguuggccugguaagagugaaggacaaugucuuuguaaucuguuuuucccugagaggcaugggaaugacaccuuuaaagaacugaguguguuugaggcagaaagggaagucugcugcccuaauauugucauuauuaucaucucucugaggcucuguaguuugaguaaaacauucugggaaaaaagguaggggcauuugaaugagcggaauauaaugaauuagaagaugcagaccaugucucacuuacuugcugccauuuauucuuuauuuuuauauuuuugagacagggucucgcucucuugcccaggcuggagugcagugguucagucuugguucacugcaaccuccacauuccaggcuuaagcgauccucccacuagagccuccugaguugcugggacuacaggcuugcgccaccaugcucagcuaauuuuuaauuuuuuuguagaguugaguucucacuauauugcccaggcuggucuugaacuccuagguucaagcaaucuuccugccuuggccucccaaagugcugggauuacaggcaugagccacugcgcccagccuugccauuuauucuuuuuauaauuuaacaaauauuuauggagcaauuuacauuaauuggccccuugagacacaaagaagagccuucaaggcaucaucaggaauauucuagauacaauaaaaugacauguauauaauaagguauauuuuaaugaaaucauaauggaauauaaaacaauuggccagcaaugaucaaaauggccuaacuucucuuccacuuuuaauuucagguuaaaguaauuuauauuuuuuggcauaaggaacaaauuaggguuuuuagucuuguuuuggugcuuauugccgauaagucauuuugugucagguuuguguuuguuuuggucucaucucuacuaagcugauagcuguuaaaacuccuaggaaaugaaagaagaaagcuacaaguuaauuauuaaaacuuuaccagguuucaaagagcagaaagaggcuuguuaaaggcuggagaaucuuguaguauauauugucuuaauuuuucuuugcuuuuaggaaaagaaacuuggaggacaauauuuacuuaaaguuguuaaggucaaucuacaucauuugggagccaauauccaucauuaggaaaaauggguugaauguaaucuaaugaaaauucuucauauuugccagagaaaagcuacuuaagugugaggacaaaacauauuuucugaggcaagaaguagguauaggcugguuuaauaggggauuuuuuuuuuuuuuuuuuuggaaaaaaguaauuuuuuuuuuuuuuuaauggagacuggguuucuugcuauguugcccaggcuggucucaagcuuuugggcucacgcaauccucccgccucagccucccaaagugcuaagggauuacagaugugagccaccauggccagucuaauagggaauuuucuuauuccaauagaaaggggucuuugaaauuguucacagagcuuggcauuguguuccaugauagaggugucagaucaggaggccagguuugucccccaaaaggaaacacacugcuguaaacuucugguuaggaggaaguuuagaggaagcucacacagaguugggaagaacaaagacgaagcuauagucacuggaaguaagacuuuagugacccugacuugugagcauucagggagauuuggaagcugguuaagccucaagagugcugaugggagaaggugaagaguuguauuuaauggguaccagccccuucuaauucugaugucucugguugaugugugauauuuuuguuuaaaagauaaguacuccuugacagccuggccacauuucucccaacuguuaucguuuuugacacccaggcagcugguuucauuaucagcuguacucuuccuccuuacaucuuccuccccccuccucuucuugcuuccuaacauuuucuccacuuucucuuuuucuuuuuucuuuaucuuaagauggucucaaugucagguuuuucauucaacuacaaaacacuuaaaaguccagcucaggugagaaacagcaaacuugguguugaguugaaguugugguugucuuuuuuuuuuuuugagacagggucucacuaugucacccaggcuggagagcaguggugugaucucagcucaccgcaaccucugccucccaggcucaagcgauucuccugccucagccucccaaguagcugggauuacaggcacgugccacuacugccuggcuaauuauuguauuuuuaguagagaugggguuuugccauguuggcaaggcuggucuugaacuccugaccucaaaugauccaccugccucugccucccaaagugcuggcauuaugggugugagccaccgcgccuggcccgaaauugugguuuuguaaguuaaauaggaugucuccaauuuugagauuauuacuagggcaugcaaaguaugguuuggugucuguaggggauugguuccaggaccucacucacaugcauaccaaaauccugggaugaugcuuaagucccuauaaaaugguguaguauuugcauuuaacuuauguacaucgucccauguacuuaaaaucaccucuagauuaguuauaucaauuauaaucccccucuuuuucuucuagacagggucucgcuuugucauccagccuggagcguaguggugcaaucaugguucgcugcagcuuugacuuccugggcucaagggauccucccaccuuagccuccugaguaguugggacuacaggaguguggccaucacacauggcuaauucuuaaauuuuuuguagagacaaugucucacuaugucgcccaggcuggucucaaauuucugggcugccucagccucccaaagugcugggauuacaggugugagcaacugcacugggucuauaauacuuaauacaauguaauugcuauguaaauaauuguucuguauuguuuagggaauaauaccaagaaaaaaaugguguauauguucaguacaggcacaagcaaccguuuuuucccccaaaucuuuuugaucugcaguuguuugaaaccacaaauguggaacccaggguuacagaggccugacuguaucucaguggccauuaugccagagagagagagagagacugguucauguuaagcgcauuguauaauagcagcucuguuuguacuuuauaaacugaguguguuuguguggcuuuugguugaagacauucuaauauuacccacuugaguagaggggauuagaguuuugaggccuuuuucuaaaaugaauacuuaccacaggggcuuuucacuguuuaccaugaaguacacauaaucagucuucaaccugacuuuuuuuuucuguguaucauuuuauaucaaauucauuuuaauaagaggaaaacaggauaaacuuacuccaguguaaaaaauaauaccucacuugagcccaggaguuugagaccagccugaguaacauagcaagaccccaccuuuacaaaaaaaaaaaaaagccagcuguggugguacgugccuguagucucagcuacuugggaacuugggaggcugaggugggaggaucacuugagccugggauugugcaacugcacuguagccugggaggcuagaaauauguaaauaauuguucuguaagacccugucucaaaaaauaaaauaaaaaacaauaccagacuuuauaccuucaagaacaauuuggaaauucacaugucuauucuaagcuguuucuuuccccacaccucgaaugggagcagauugaguuuuagaacuaauugggcugggcaugguagcucauaccuguaaucccagcacuuuggaaggcugagguggauggauccuuugaccccaggaguucaagaccagccugggcaacauggugaaaccaugucucuacaacaaauacaaaaauuggcagggcauggcacacgccucuagucccagcuacuugggaggcugaggcgggaggaucacuugagcccaggagguugaagcuacagugagcugagaccacgccacugcacuccagccugggugacagagcaagacacuaucucaaaaaaaaaaaaaaaaaaaaaguuggauggauauuuuugauagacucagaaaaugcugcuucuucaugaccuagaauggaaaaauagagggagaguaauaaucucuuauuuuaaaaaagugauuaauaaccuuccucauuaaaauacauaggguucagaaaauaauuagcucuguuugagcugcuagaauauuucagaaaguuuuguugacugucagucauccaaauggcaggagcccaccuucaugaagagcaccugguacaacaagguguuguguuaauaauacaguaaugguuuaguagaacugucaaguacuuuggccuugaaguagaccauuagggaaaagagaauuuuagaagaaucuagaaaccuuuucauuuucuuuaggacaaauauaauuuuuuuaaaaaaugagaauucuuuguuauucucuaauaaacacuuugggugucgcuaagccuugaucugugcaccuagcaguuucucuuuugucacuagcaugucucuggcacugaacagugccugaggaagaaugaacugaacagugucaagaggaagagguggcuuugccauguagcuugaacgcauucuugcuagcauuuauuucaucaguuacuuccaugaagacaccuuucuggcugcuucuaugaaaguuuuuuccuauuuaauguugucuuugauuuuauugagaugaggaaggugaugaaaaaaaaggaggaaagaauuaagggacuguauuuaaaaacauuccucucuaaaccuacaauuaauuuuagggagaccuuuucagcuguaagacuagugaaaugguuuugaguaccuuuauucucuauaggggaauuuuauaugaaaacgaauuauuucaaacccaaacuauuuauuuauuuauuuauuuguuuaugacagacagggucuugcucuguagcccaggcuggggugcccugaucacggcucacugcagccacaaccucccaggcucaagcagucugcccaccucagucucccaaguagcacgcacuaccacacccagcuaauuuuuguauauuuuuuguagggaugggguuuugcccuguugcccaggcuggcauugaacucugcucgccuuggccuuccaaaaugcuaggauuacaggcuugagccaccgcacucggcccaaacuuuuguuuuaaccguagauuaaaaaaaaaaaaguugaaguuguauauauuaauacucaguauuucaaacuuucuuaggggcaguuuucuguuuuguguuuuuuguuuuuuuuuugagauggggucuugcuugguugcccaggcuggagugcaguggcaugaucucggcucacugcaaccuccacuucccagguucaagcguuucuccugccucagccucccaauagcugggauuacaggcacccacaaccacgcccggcuaauuuuuguauuuuuaguagagacgggguuuugucauguuggccaggcuggucucgaccuccugaccucaagugauccacccaccuuggcuucccaaagugcugggauuacaggugugaaccaccccacccagccaggggcaguuuuuaaaacagguuugggcuauccaaauuguucuuccagaguucuuauaaaugcuaagagaauauacagaauuacuguuaauuagauguuagaauuuauuauagcuaguauguguuuugggggguaacuuaauuuucauauaauuucaaacuugcagaaaaguuguaagaguaguaccagggaauggacaauuuucaagaaaaugacagugguaagcagugggugccuugagggaacacggagaagccacuuaagccaaauuagggagucaggaaugcuuuccugagaggggauuuuuaauauuuugcauuuagguggcacuaagacaaacuaguaguaaguuaggcugaaggcaauaaauaccugccaauuagacagcuguagacuucugauuaucuauugcagaagcuuuaucagagaguucaacugaacaucccuaaaauguuuguugagaagcugagugaaucuauaugaccuugacauuuuuuauaaggcaaauaauacauguaucugguaaaacuucuuuuuaugugcaaaagguauacaguguauauucagugagagguuuucccuucacaugaccucauuugggcucuccuacuccuuccuucucucagggauggccuuuauuaccaguuuuugguguguccuuuggagauuguacguguacguguguguuuucucuuuuuucuuuuugcuacauacaugauagcaugcugcucaacaaauuggucuuuugacuugacaacauguaauauuuuagagauuguauccuaucuauacaugauagaucgucuuauuuauagugguugcaugguauucuguccaaugaaugugcacaguuuauucaaccaguccucuacuaauaucaagguuguuuacagucuuuucauacuacaaacaaugcugugggaaauauccuuguacauauuuccuugaugaguacuuuuugcuuuuuuuuuuuaaagaauacauuuuuaggaguaaaauugcuagaucaaagaauauguagacuuuugaaauuuuagacagaaaauaaaauuuuguuagcauuuuuaucuuguaaaacagucuuacaacacuuuuuuuuugagacagggucuugcuuugucacccaggcuggaaugcaguggccugaucaacacucacugcagccuugaccucccagacucaggugauccucccaccuuagccucccgggacuacagacgcccaccaccacacccaacuaauuuuuuuuuuuuuuuuuuuuuuuugagacagaguuuugcucuugucacccaggcuggagugcaguggcgcgaucucggcuuauugcaaccuccgccucccagguucaagcaauucuccugccucagccuccccaguagcugggauuacagguguucaccaccacacccggcuaacuuuuuuuuuuuuuuugagauggagucucccccugccacccaggcuggagugcaauggugcgaucucaacccacugcaaccucugccucucagguuccagugaaucuccugccucagccuccugaguagcugggauuacaggcaugcgccacuacacuggcuaauuuuuuguaucuuaaguaaagauggggucucaccauguuggccaggcuggucucaagcucucgaccucacgaucugcccgccucagccucccaaagugcugggauuacaggcgugagccacugcaccuagcuuuaauuuuuguauuauuaguagagaugggguuucaccauauuggccaggcuggucucgaacuccugaccucaggugaucuaccugccucagccuccgaaagugcugggauuacaggugugagccaccguguccggccuccaccuagcuaauuuuuguauauuuuguagagaugggguuucucuauguugcccaggcuggucuugaacuccugggcuuaagcaaucugccugccuuggccucccgaaguguuaggauuacaggcaugagccacuacagccagccagucuuacaacuuuuguuagagaaugggauaaaauaggcugggcaugguggcucacgccuguaaucccagcacuuugggaggcugaggugggcagaucacaaggucaggagaucgagaccauccuggccaacacggugaaaccccgucuuuacuaaaaauacaaaaauuagccgggcaugguggcaugcgccuguaaucccagcuacuagggaggcugaggcaggagaaugggauaaaauagucauauuacauuuaaccaugagugccauuuuuuuucugucaauugcuguucgauaggaagaaacuuaauggguuuaagagaaggugacacuuuaugguuagggguaagcuggaauaucaaagcaauguuaaucauaauugugaugguuacuuaucaaaguauugcuggguugauucuaguuguuuguguccuaacucuggaucuuuuccuuaaugugacgaaguaacugaaacaaccuggugcuacagcccuggagagcaaaacugucuuaauauuaacuuacugcuuccauaugggucauaaauuuucauggagacuugaaugcugugcauaacuggccuggcccuuucuauuccucccuaguuuuuuuuuuuuuuaacuauuuaauuauuuauuuuuuauaagauggagucuugcucuguugcccaggcuggagugcaguggcgcaaucucagcucacugcaaccuccaccucccagguuuaagcgauucucccgccucagccuccugaguagcugggauuacaggcaugcaccaugaugccuggcuaauuuuguauuuuuaguagaggcaggguuucuccauguuggucaggcuugucuugaacucccgaccucaggugauccgccugccucagccucccaaagugcugggauuacaggugugagccacugcgcccggccccucccuaguuuuauuaauuuuuuuuuuuuuaaugagacggagucuugcucuguugcccaggcuggagugcaguggugcaauauuggcucaccgcaaccuccaccucccggguucaagcgauucucccgcuuuagcguuccgaguagcugggauuacaggcaugcgccaccacgcuggcuaacuuuuguauuuuuaguagagaugggguuucaccauguuggccaggcuggucucgaacuccugaccucaggugaucugccugccucagccucccgaagugaugagauuacaggcgugagccaccacgccugaccucuuuuauuuuauuuuauuuuauuuugagacagaguuuuacucugucgcccaggcuggaguucaguggcaugaucucggcucacugcaaccucuaccuccuggguucaaacgauucuccugcuucugccacccuaguaguuggaauuacaggcaccuaccaccacgccuggcuaauguuuguauuuuuaguagagacgggguuucacccauguuggccaggcugguauugaauuucugaccucaggugauccgcccacuucagccucccaaaguggugggauuagagacgugagccaccgccuccggccccaaguuuuauucuguaggcacuguaaugaaacauguaguuuguugacuaaaagcuuuguugaaaaggcuggagacuggaaucuagaauuuguuuucuuucuugaaauaauucauucuugagauuucagauagaagacgaaacuuuuuguauuugaacggcucuguauguacuugguauaggaaugaacuuagaauaucacuaauaauuauuuaaaauuuuaucaugaaauauuucugucuaaaaauauuugcagacuacaguccugggaagaucacgcuauuaccuuaauuguuugcuuuuaaaauauaacuuaaaagccuauuuuggugcuugcuucggcagcacguauacuaaauuggaacaaucaagagaagauuagcauggccucucugcacaaggaugacacgcaaauuugugaaguguuccauauuaaaagaaaaauuuuuguccaggggcaguggcucaugccuguaaucccagcacuuugggaggccgugguggguggaucaccugaggucaggaguuucagaccagccuggccaacauggcaaaaccccaucucuacuaaaaauagaaaaauuagcugggugugguggcacgugccuguaaucccagcuacucgggaggcugagguaggagaaucgcuugaacccgggaggcggagguugcagugagccaagaucgcaccacuacacuccagccugagugacggagugagacuccaucucaaaaaaaaauaaaaacuuuuaaggccuguuuugccuauucuggauaaaaaucuuccucagauguagacgagacauuucugugucuucuuuuucuucuuuuuuagacaaggccucgcugugucacccaggcuggagugcaguggugcgaucauggcucaccgcagccuugaccccagggcucaagcaguucuccuaguucagucucccaaguagcuggcaccacagacaugcacuaccacgcccaggugauuuuccagugccuuaaacagugcccagcugauuuuccagugccuuaaugauauuaaucaucauuacaaaagugauuuacagccuggccaacaugaugaaacccugucuguacugaaaaaaaaaaauacaaaaauuagccgggcucgguggugggcgccuguaauccuagcuacuucggaggcugaggcaggagaaucacuugaaccuaggaagcagagguuguagcgagcugagaucaugccauugcacuccagccuaggugacaagagugaaacucugucucaaaaaaaaaaaaaaaaaagcaauuuaauucauucagcucauuuugaucagggccacaauuggaaacuugaguuauuauacuugcaguaauauucucagaacugauugacgcauaaggaaggacuguuugccucauaucaaauagcccaagacuaauugauguacuugaguuuuuugauuccucagugugccaaguuccucuuuuccuggaagagcuaugcauaguuccagaucugauuugugguuuccaauuuauuguggguuaagacaaucugauaacauuaguuuguuacaauuauauguaaaacaaaaguaaaaaggcuuugccgggaacgucggggcugugcugugauuggaauccaagugaguacugcuacucugaguggucaaauauuuaaaucccauuuaggugaggugcuauugucauugacugaaagagggguugaauuuagucaguauuauugggggcuguuggcugauguuuagucaucugguggcuuaaaaccugacaggagacacauggcuaguuguccguuguaauauaauacuuggcauuggugacucuagagaggaaggauuauguuuuccaaauuagcagguggugguauauaugccccagaagacagaugaaaccuaaaaagaaaagaaaagcuccuuucuggucugaauucuguaauucuauaaguacagaauauguugguagauagaaagauuacccaaaaccugaaacagcaaguagaagauuguucauguaggaacaacauauaagggacaaggguggaaaaaagacuagauuuaagcaguaaaagaucauuaagcgaggcuucaucacuucuucaguaggacaguuauuauugggauucaaagaggggcuuaucaaugaauacuauguuguccuuccccuucuaaauuugaaaucaacugagaaguagauaagaagauugaaacauuuuuuuuuuaauagccuuauugguaaggcucaauggagaauaugccauagaucuguucccaagugagcuugcuaaaauccucccucccaauuaaacuuaacaggaugauggacaucuggaacuuccaccccaccccugacuccacccgccccacugcggguugcuuaguacaggaccuguagacaaaggcuggcaucccacacgcuaugcuuaauccugcuggugcuucagcucucuuggagagcuugggaggggcugggccacgggugacuaguuucuucuaguugucagaggguugaggaaugaggucuagaacauuauggcugcagacuuuacuuucuuaggaagauuugaggcugccaaauaguggccuuccacuaccaguaugcuuguauggugcuuuuuccuacccuuucuagaagauugaaccaugagcuuaaauuacauauuuuagaccaaagagaauuacagauuucuguccuuaaaaacucauaaaauaggcugggcgugguggcucaugccuguaaucccagcacuuugggaaguggggugggcggaucaugaggucaggacuuugagaccagcguggccaacauggucaaaccgugucucuacuaaaaauacaaaaauuagccaggcaugguggcacacgccuguaaucucagcuauucuggaggcugaggcaggggaaucgcuugaacccaggaggcagagguugcagcgagcugagaucgugccacugcacuccagccuggacaacagagugagacuccgucuaaaaaaacuaaaaaaaaaacaaaaaaaaacaacucauaaaauagggggaaaugugucuggcuuuagacacuugggauaauuuggaggcaaaggcagagaauggauacuugccuagcagccucuguguagaugcuuauuaaaaaaguauuugccuggccaggugcguuggcucaugccuauaaucccagcacuaugggaggcugaggcgggcggaucacgaggucagcagaucgagaccauccuggcuaacacggugaaacccugucucuacuaaaaauacaaaaaauuggcugggcgugguggcgggcaccuguaaucccagcuacucgggaggcugaggcaggagaaucacuugaacccaggaggcagagguugcagugagcugagauugcaccacugcacuccagccugggcgacagagcaagacuccgacucaaagacucaaaaaaaaaaaaaaugguauuugcugucucacuaaaauaccuccuguucaauuuguccaccacccccugccauccgugaaggguuucacagugaaagccagaaagccugcuagacacauucuaaaagagcuguaacacuucaauuugguuuugaagucuugccagcaaaaucuugacuaagacuuuucuuuuuuuguuaaauaucugucagucauauucugaaaacuguaauuauuuucaagguuaccuaauucaguagaaaaauuacucuuuucauaguaaggauucagucauacagaguaacaaacugcugguucugaacuuguuaguuuguucuuccuaauucuucucccucacuuuucuccuuuccagaaucauauucuaagaacucagccacucagguauccaccauggugcuggguccugaacagaagaugucagaugguaauuuaccgcuuuguguuauugucuaauuuuauuuguaauuagguuuauguugguaacagaaauuuaucauauuuuuccucuugucaucaucugucaucaucuauucuaacaacuccauucaaaagucaccaucuggugacuuaggcuguaaaugaaaauggauuuuuuuuuuuuuuuugagguggagucucugucacccagguuggagugcaguggcacaaucucggcucacugcaaccuccgccucauggguucaagugaugcuccugcuucagccucccgaguagcugugacuaaaggcacacgccacaaugcccggcuaauuuuuguauuuuuaguagagacaggguuucgccauguuggccaggcuguucgcaaaugccugaccucaagugauccgcccgucucagccucccaaagugcugggauuacaagcaugagcuaccgcgcccauccugaaaacagaauguuuuuuuuuuguuuguuuguuugguuuuuuuuuugaggcggaguuuugcucuaguugcccaggcuaguuaguguucaguggcacugugucggcucacugcaaccuccgccuccccgguucaauggauucuccugccucagcaucacgagcaccugggauuacaggcaccugccgccacgcccggcuaauguuuuuguauuuuuaguagagaugggguuuugcuauguuggucaggguggucuugaacuccugaccucaggugguccacccgucucggccucccaaaaugcugggauuacaggcaugagccacugugcccggcccugaaaacagauuuuuaaccagagaccugcuucguaucuuuuuuacaauucugaguugagccaagauuagcugaaauuugguuucuggcaguaaugcuugcaagggcaauguuauucccagacccaggauaaaaaccucuggaguguuuuggcuacucaugaugcuuccugguguuucagauguguauggagcaguaaaauacagggcgaguaccuuacgcucuguauuugauuggagcuucuugagugcuuugacuauuccuuccuaaaucugagcuucuuuggaauuucuguuccuuuucuauaaauuucuucauuaauuuaaagcugcuuaauuaagaugauaugagucagcucccuauggaaagaaagcucuuauuuguuuaaauuagagguuguaaggauuuauugcaaacacagagauuagagcuuugugauucaaaauagccauuugauggcugaagcaaacuaggcucuguguauuucuggcaggguaucccuuuucucccagaccuucugcuucccaauauuuaagauugacugcaaaaugcagaacucagggaaacgcugauaucagucugagaugagcccugccaucacgagggugccaguaccccgugaccggcggcacuuuacugcaagccuuagucagaguacaaaggguuccugcuuggugguuuugcugcagcuucagaguuuagccugaacuguggcaggauuuuguaacuugcacauuuuuugagaagucugauggagguauaauguccacggucgauuauuugaguaaguccuaccaaauauaggagguggggaggacauuucgcuagacaggccuaguucuuuucuuuuaaaagcuaggauuuuagguuaccaggagcuggucugggaauaugauauuuugagcccauaugucaguguuuuuagaggaaaaugaaauggcucuaaaaauucccaaguaggaguagaaguguggaaguaggaaaaccauugugaguuaaaacugaucuagagaauugagugacugggggagggggagggagauaacuuuuuuaguguaggcuaaauuuuuuacuuccugaauuuuuaaccaugugaauguauuacuuauucuaaaauguacauuaaaaauaaacuauucaaaauaaauugagcuagagucagguuggucucuugugcauuuagauauuaaacuauuuaauuucaguauacuaaggaugaauuguuaguguauuuuguucauuuuuuacuaauuuauuuucaaaucuguuaauucagacaguguuucuggagaucauggggagucugccagucuugguaacaucaacccugccuauaguaaucccucucuuucacaguccccuggggacucagaggaguacuucgccacuuacuuuaaugagaagaucuccauuccugaggaggagguuaguaucagguccuuggaggagaacacuauugucuggggaaaaccugugagugaaagaucugcuggauggcucaaguucagcagccucagguuuaauuuuggcuggcaaucucugaagacuauaucuauauaucuauauauauauauacacacacacacacacacacacaccccaucuauaucuaucuaucucugucugucugucuguccgucuaucuaucuaucuaucuaucuaucuaucuaucuaucugucuaucuaaucuuuuuuacagacagggucuugcucugucaucuaggcuccagugcaguggcacaaccauagcccacuguagccuugaauuccuggggucaagugauucucccacuucagccuccccaguagcugggacuauagauggcaugccaccaugccaggcucauuauuuuuauuuuuauuuuuagagacagggucucacuauguugcccaggcuggucuugaacuccuggccucaagcuauccuuccucuuguuuguugaugaaaaagagucaaacucuggcugagcccaggcucacaccuguaaucccagcacuuugggaggcuaaggcaggaggaucacuugagcccaggaguuuaagacccgccuggccaauauggcgaaacccugucucuacaaaaaauacaaaaauuagcugggcauggugguaugcaccuguagucccagcuacucgggaggcugagguggaaggaucacuugagccuaggaggcagaaguugcagugagccaagaucaugcuaugguacuccacucuggguaacagaaugagaccuccucucaaaaacgaaaaccaaaacaaaacaggccaggcgcgguggcucacaccuguaaucccagcacuuugggaggccgagaugggcagaucaccugagguuaggaguucaagaccagcuugguuaacauggugaaacccugucuuuacuaaagauacaaaaguuagcugggcguaguggugggugccuguaaucccagcuacucgggagacugaggcaggagaaucacuugaaccuaggaggcagaggcugcagugagccaagaucgcgccacugcacuccggccugagugacagagugagacucugucucaaaaccaaacaaacaaacaagagucaaacucuguaaaauguuuaaagagguuuauucugagccaaauaugagugaccaaggcccgugacacagccccaggaagucccgagaacaugugcccaaggugguuggguuacagcuugauuuuauacguuuuaggggucagaaguuacaggcagacaucagccaauauauuuaagauguacauugguuccaucaggaaaggugggacaacuugaaguggggagggggcaccuuucaggucaaagguggauuuaaagauuuucugauuggaaauugauugacacugggugcaguggcucaugcauguaaucccagcacuuugggaggcugaggcggguggaucgcuugagcccaggaguucgagaccaaccagcuugggcaaugugacaagaccuugucuccaaguaaaaaaaauaaaauaaaauuaguugggugugguggugcacaccuguggucccagcuacuuuggaggcugaagugggaggauugcuuaagcccaggaguucaagaccagccugggcaacauggcaaaacccugucucuacaaaaauaaaaauaaauaaaaaaagaaauugguugaaagaguuauuuucuaaagaccuggucuaaaaugaggggcuguggagugucuaaaaugagggguugugaagaccaagguuuuuauuauguaggugaagccucuagguaacaagcuucagagaaaauagauguaaaugucuuuuaucagacuuaaaaagguaccggacuccuaguuaauucucuccgggaucaggaaaagaccugaaaagggaaggagauucuauauauucuagguuuugcucauaagagacagcuuugcagggucauuucaaaauauacaaagaaauauaucuuggaguaaaauacuuugauuucuuucagggccuguuaucugucaugugaugcuaugcuagagucagguuggaauuuagcauguuauugcuacaaggaaucuguuuugucaguuuuaagaucucugguuuuuguuuguuuguuuguuuguuuguuuuugagacggaguuucacucuugucgcccaggcuagagugcaauggugcaauccuggcucaccgcaaccuccuccucccgcauucaagugauucuccugccucagccucccgaguagcugggauuacaggcaugugccguuacgcccaccuguuuuuguauuuuuaguagagacaggguuucucuacuaaaguguuggucagacuggucucgaacucccaaccucaggugaucugcccgccuuggccucccaaagugcugggauuacaugcaggaaccacugugccuggccaagaucucuguuuuaaugcuggucauuugugucugaauuccaaagggacgggaguauaaugagguuugucugaccccucccucccaucauggccugaacuaguuuuucagguuuucuuuggaaugcccuuggucaagaagaggauccguucaguugguugggggagcuuagaauuuuauuuuuguuugcucuccucagugucccaaguaguuggacuauaggcacacaccacacagcaccacaccuggcuuguuuccuuuuuaaaaugguggcucuuguccuuuuugggaaguguuugggcacagagguacugauacuguuauucugguuuuagaauaagaggcugauggaaccugcagguaagggaagagcuuugacuuggacagagaaguggccagcuucuuaauaaaaaguggguaagauggaggugaaacuuggacacaugcaauaucugacauuguaaauccuuuuuucuugugaggcuggauuuuguugcuucauaugugauaacagaccaauuauaucaguaguucaauggugauguucaguuuaaucucuuuuccucucuuguacaguacucuuguuuuagcuuucguaaacucugggcuuucaccggaccagguuuucuuaugagcauugccuaccuggauccaggaaauauugaauccgauuugcagucuggagcaguggcuggauuuaaggugaacaucuaguccuaccccuguccuuuuaagcacauaauacacucucacauccuuuucuccacccugcauguuggauaguagccucaggggcuacaugcagauacuucauuggcaguggcucuuauguguaaaguacuuuccauuuggucuuauuuuuauccacauaguuuccuugaacaaaggagaaacuacauauaggagaaacugaggcucagaaagguacaaggugacuuagcaggucaugugcaaaaucuguuauagaacucaagucauuugauucuugaccugggcucuuuucugaaugcaguauuuaccacucauguugccaaacaacuaaacaaacaaacagacaaaaacucaguuguucaaugaguguuacaggagauuuuguucuucuuaguugcucuggauccuucuguuggccacccuuguggggcugcugcuccagcggcuugcagcuagacugggagugguuacugggcugcaucuugcugaaguaugucaccgucaguaucccaaggugagcaauguauuguccuguuugucucucacccaugccauaggaaucugugugucuggcgguaugugcuggccucauucuauagugagacagucaaggacuugggggucaguggcccugaagacagacgguaccaacggaaauacuguagcuccuccugcugccaggccauguuuucccccucuuucaaaaucuaacuugagacucgcauuuccuagaagguuuucuuagaaaaacuguguuaccauucacucuggcuuccaguaucuagcaaugcccagcccaaggggaggaggaugcucucucuaagcacuuuuauucauaccuccauguuacuccaucaguuugcauuuuauauauguucuuuuuuuguuugacuuugccaucacuuugaaaaaguaauuuuuuuucuuuuuaguacaaacuauauguggcaagaucuuuggauuugcuaauaauuauuuuucaguuuccccucccaccgggggcuacacuguccucugcagcuucuucuggacauuuugggccuuucuuaccguugccuaaggcaagaaugaacacuaugucuggaagauauuuuuaacuuaguuuugucucuuguuuuguuucuuuuccugggugugagcaaaaaguauccuuaucugcuuuucaaaaaaauaaaaaaaucuugauaauauccccauuuacucugaugugauuauuacacauuuuaugccuauaucaaaauaucccauaugccccauaauauauacaccuacuauguacccauaaaauuuuuaaaaaacaaacaaaaccuugguaauuuauaauccuucuagcuucuuuuucuuucuuucuucuuauuuuuugagacggagucucacucugucacccaugguggagugcagugaugugaucauggcucacugcagccuugaccucccaggcucaagcgauucucccaucucagccucccaaguagcugggaccacaggcgagcacgaccacacccagcuaauuaaaauuuuuuuuuuuuuuuuuuuuguggagaugagguauugcuauguugucuaggcuggucucaaacuccugggcucaggcaguccucccaccacagcuucucaaagugcugggacgacaggcaugagccacugcaccaagccuagcuucucuuucuucauacacguuaauaguuauuuuguaauaauaauuauauauauauauauuuguuuguuuguuuguuuuguuuuuuuuuuugagacagaaucucacucuguugcccaggcuggaguucagaguucaguggugugaucucagcucacuacagccucugcuucuugcagugaggcgauuccagggauucuccugccucagccuccugacuagcuuggauuacagccacgugccaccaucuggcuaauuuuuguauuuuuaguagagaugagguuuuaccauguuggucaggcuggucuugaacuccuggccuuaggugaucugccagccuucgccucccaaagugcugggauuacaggcaugagccaccgugcccagccugcuuuuuuguuuguuuguuugagacggaguuucacucuuucacccaggcuggagugcaguggcgugaucucagcucacugcaaccuccgccuucaguuucaagugauucuccugccucagccucccgaguagcugggauuacaggugccugccaccaugccuggcuaauuuuuguauuuuuaguagagacgggguuucaccauguuggccaggcuggucucgaacuccugaccuugugaucugcccaccucggccuuccaaagugcugggauuacagacgugagccacugcgccuggccuuguuuugguauuuuugagauggagucucacucuguugcccagccuggaguacaguggcgugaucucagcucaccacaaccuccgccucuuggguucaagcuauucuccugccucagccuccugaguagcugggacuacaggcgugcaucaccacgccuggccaauuuuuguauuuuuaguagagaugagguuucacuauguuggccagacuggucucaaacuccugaccucgugaucugcccgccuuggccucccaaagugcugggauuacaggcgugagcuacugcgccuggcucugcccuuuuuuuuuuuuuuugagaccaagucucgcuuugucacccaggcucggguacaguggugugaucuuggcuuacuauaaccucaaccucccagguucaagcgauucuccugucucagcuucccgaguagcugggauuacaggugcgcaccaccacacccagcuaauuuuuguauuuuuaguagagacaggguuucaccauguuggccaggcugaucucaaacuccagaccucaagugauccacuugccuuagccucucaaagugcugggauuacagaugugagauacugugccuggccuguuuuuuugagauaggaucuugcucuauuacccagacuagaguucaguggcacaaucauggcucacuauacccuugaccucccaggcgcaagcagccuuccuaccucugucucuugaauaguugggaccacaggugugcaccaugauacccagcuauuuuuaaaauuuuuuguagagacaggguuuugccauguugccaaggcugggcuugaacuccugggcucaaguaauccucccaccucugccucccaaaguucagggauuauaggugugaacuaccaugggugaccugacaaauuuuuuggaugcuagcuaucuggagguguuuuuuucuggcuucagugagucagcauaacuaaaucugauuuucagcuguauuguuuggccagauaaguuucugacuuuguuauaugccacccaguuccaaccaucuucccuugaguccuuuugcauacgugggcauuauuauuacauuaaaggugacuccaaccuuuucuguuguugugguggugguuuguugagacagucuugcucuuguuuguugcccacucuggagugcaguggcaugaucauagcucacugcagccuugaccacuggggcuuaggcuguccuccugccucagccucccaaguaguugggacuacagguguaugccaucaugccuggauacuuuuguacuuuuuuuuuuuccuauaauuuuuauuuuagguuuggagauggauacaugugaagguuuuuucuuucuuucuuucuuuuuuuuuuuuuuuuugugaaagcaaguuuauuaagaacguaaaggaauaaagaaaggcuauuccguaggcagagcagucacaugugaagguuuguuacauagauaaacacgugucauggggguuuguuguacauauuauuacaucaccccgauauuaagcccaauacacaauaguuaacuuuucugcuucucucucuccuuccacccucccccaucaaguagaccccagugucuguuguuucugucuguguguucauaaguucuuaucauuuugcucccaauuuuuauacuuuuuguagagaugggguuuugccauguugcccaggcuggucucaaacuccugggcuuaagggaucuacguuggcaucccaaagugcugagauuacaggaaugagccacugugccugguccaccccaaccuuuuuuuuuuuuuuuugagauggagucucgcuuuguuguccaggcuggagugcaguggcgcaaucucagcucacugcaaccuucgccucccggguucaagcaauucuccugccucagcccccugaguagcugggauuacaggcaugugccaccaugcccagcuaauuuuuguauuuuuaguagagacgggguuucgccauguuggccaggcugaucuugaacccuguccucaggugauccaccugccucagccucccaaagugcugggauuacaggugugagccaccgcgcccagccugaccccaaccuuuucauguuuguuuugucuucccagcuauggucaggauagauauguucuucugcaaucauuuaauauucuuucuugacccauauuuggaccguauuagcauccuuauucuccucuaaacuuuuuaggauuguuuuuaggaaauuaaguggaaguuaguaaauggcaauuauauucuucucaaguagaaaggaaaaagaaaaaaguaagaucaauuacugccuugaccuucguucacagguucugccacgugguagcacacuuuuccuucuccaggugagagccacagugcagugaucggccaaguggaggcacguucugguauuucuucucuagucuggaggcuuauaaaggacuguuuaugguuuagugccaaaaugugaauuccaaauuguggaggaauuuuuuagaaaugauuaaucagaaccgugucuuucuacuguuugauguuuaggucccacgagucauccuguggcugaugguggaguuggcuaucaucggcucagacaugcaagaagucauuggcucagccauugcuaucaaucuucugucuguaggaaggugagggguuuuccucuagaaagucaucaguguuuugcuggauuuccaagcagagauaaaaacaaaaacccaauucauuuuuaauuuugaagacucaacucaauuguuauuucuucuguggaaccuuucuggaaacaauuucuucuccccugguagauguagacucuacaucuuccguuucccaugguggguuaugcuuaccuuuauuagaauguguggcguuuuguaucgcaauuauugauuuguaugucauuuuaucccgcuagauacuaucuuuuuauuuuauuuuauuuauuuauuuuuuugagacagagucuuucuccgucacccaggcuggagugcagugguaugaucuuggcucacugcaaccuccgccucccagguucaagcaauucuugugccucagucuccugaguagcugggauuacaggcaccugccaccauguccagcuaauuuuuguguuuuuaguagagacgggauuucaccauguuggccaggcuggucucuaacuccugaccucaggucuaggaaugcccgccucagccucccaaagugcugguauuacaggcgugagccacuacacccagcccccacuagauacuaucuaucuaauccuauaaaauucuaucugucuaacuccaugaggguaagacccaaacuuuucagcuuuguauccuaagagugacauaguagacucucaaaguuuaaaugaauguaauuaaguugaugcuguuacccuacuuuacccaaggccuaguuuucugccauugucccuccucccucaaguccuagcuucuccaaguguucuuuaucuggagagcuguugggaagagaguguuuuucaauguuuccuuucuuuccgucucucugacuuccauaucucaucucugaccuagaauuccucugugggguggcguucucaucaccauugcagauacuuuuguauuucucuucuuggacaaauaugguaaggagagcgggaaugggagggucaaaggagcugcucucugucauguggcagauggggaagucuaccuucucugagcucacugcugccuuuuuuccuuuaggcuugcggaagcuagaagcauuuuuuggcuuucucaucacuauuauggcccucacauuuggauaugaggcaagugguacaggauauucauuagcuucuuaaaauaaguuuuugugguuuuuuuuuuuagccuuuuauuauaaaagacaguaauaaugcuaguaugauucacuuauaguggguguaucaacaaaaagccaauuuuucccugggccaauuuuaaaggaauaugaucuauagcaaagauuagcaugcagaaaggccugcaggggcucccagguuuaaaaugacuagauauuuuagggcuuuccagacuagauucuuuggucccaaguugaccaucugacaacagaacagccauggauaguguuaauuaaggaggggguugcaggguuauucuuggguguuaacuuacaggaguucugcuuuuguucauccugguuuauauuaauugcagcuugaacuuucccaauauuaaaacaguuaaugaauuauaugaaauauacuggauauuuccugguuugugccccaacccagaaacuccuuagagucacuaauauuauuugcaguacuagcaccuuucuuuguacaauucuuauaaacugauuucugcuuacuggucuggcugaacuuuaaaaaauauauguaaucuauggguugauuaugccucuuggccuaaggcuuccaagagaaauacugaaccggggaagaguauauaugagaguguuuaaggaugagucucucauuacacacguacuaguggcaaacagcaaaugauuuuuaaaugaacaugggugaacagaaguaugcucaguauggauaauaaaaauugauucuauauucuuuuuuaauuuuuagauuuuuauuuauuuauuuauuuuugagccagagcguugcucugucauguaggcuagagugcagugggugugaucuuggcucacuugcagccuccgccucccagguucaagugguucuugugccucagccucccaaguagcugggauuauuggcguguaccaccaugccuggcuaacuuuuuguauuuuuaguagagaugggguuucucuauguuggccaggcuggucuugaacugcugaccucaaguaaucugcccaucuuggccucccaaagugcuaggauuucagcugugagccacugugccuggcccugguuguauauuuuugagccuuguggaauuacuaauaaccacaagucccuuagcagcuuuuucuuuuuucuuuucuuuuuuuuuuuuugagauggagucucccucuuucgcccaggcuggagugcaguggugcgaucucugcucacugcaacuuccacccccagguucaagcgauucuccugccucagccucccacguagcugggauuacgggugcccgccaccgugccugguuaauuuuuguauuuuucguagagacgggguuucacuauguuugccaggcuggucuugaacuccugaccucaggugauccacccgccuugaccugcuaaagugcuaggauuacaggcgugagccaccaugccuggccuuuuuuuuuuuuuuuuuuuuuuuuuugagacagagucucacacuauugccuaugcuggaguucaguggcacgaucucagcucaccuccugggcucaagugauccuuccaccucagccucccuaguagcuaguacuauagguaugcaccaccacaccgagguaauuuuuguagagauaagguuuuguuguguugucaggcugcucuugaacuccugggcucaagcaaugcgccugccuuggucuccuaaagugcugggauuauaggcgugagccaccgcacccagcccuuucuuuagaaauuaauuauguaucauacacaucuguuucauauaucuaagauguguuguaaacuauccggauacucagucuugaauucucuggccccuaauaguaagccccuuauguugcuugguccuaugaugauucuguauuccucauuaucuuagguaguugcagaagaaaagauuuuggccaggugugguggccuguaaucccagcacuuuggguggcugaggugggaagauugcuuguucuugggagauugagguuucagugagcugugaucaugccacugcauuccagccugggugacagagcaagauccuaucucaaaaaauauaaaaauaaggaagaaggcauuguaagggauaaaggaugcuaacuguucccugguacuauguuacucccguuucacguuccuguaaaggcuaaucauuguuauguugguauguaguauguuacagugaaacccagccagagccagguacucaagggcauguucguaccauccuguucaggcugucgcacuccacagauugaacaggcugugggcaucgugggagcugucaucaugccacacaacauguaccugcauucugccuuagucaaggugagcaaggcccuuaucuccuucaccuccuagacaguucaugggaucuuuuccuucaauugcaagggacacaaaguuaguuuacaauuauuaggaccaugaaggagcaagguauuuuccaagccuggacauuuauaaacuccauauacuuagaugcuguuuuuaucaccaaauugaccagagauuacuaacugcauaaagcagguggggcuaaaguucuuuuuuuuuuuuuuuuuaaauugagauggagucucacucuauugcccaggcuggagugcaguggcgugaucucuacucacugcaaaccucucccucccggguucaagugauucucgugccucagccucuugaguaccugggauuauaggcgugcaccaccaugccuggcuaauuuuucuauuuuuaguagagaugugguuucaccauguuggccaggcuggucucgaacuccugagcucaagcaauccacccgccuuggccucccaaagugcugggauuacaggcgugagcuacugcacccagcugggacuaaaguucuucauaaaagguuggaagugcaucaagucucuuguguuuaaauuucaaaagcucgaguggccuuauggaggucaggaguaaaggagcccaaacaggcuuuuacugucaguauuauguaauaguuugcugggagauuuuagaaaccuuuauaaauagguauaugcacaccuuaggacugaaaucaggucguuuuuauaggucagugguccuuccagccacugagaguaacugagagcucaguagucauuuagucucuguucccuauuuggggaauguacaguucaacgaaagggcaugaaguucuuuuuucuccccccauaugaaguucuuaauugcucagugaacuaggauguaggugaguguuggaucucucacuuuucgucuggucaacuuuuguccccuaaaucucucagcugacuccaaacuccugaaaugucacaaggaaacuuguucuaacuggucaaaaagugacugcuguuguuaucuuucuagucuagacagguaaaccggaacaauaagcaggaaguucgagaagccaauaaguacuuuuucauugaauccugcauugcacucuuuguuuccuucaucaucaaugucuuuguugucucagucuuugcugaagcauuuuuugggaaaaccaacgagcagguggugaguaagccaggguuaugggugguagugaaugugaggguaaagugaagacugcaaugggauggggaaggaaaauaccucauccuaguguuaauguucaggagaaauaaucucuagcuucucgucugccccccaaaaucacugugcaccagucagagucuacaguauggggcugaccaagccuggacccucuuucucagcuuuuguuugggaguagucaacaaacagaaaacagaaacugugaugaugacagacuuugucuugucauuuugaauucuguaucaaucuugauuucugauuaccuauguaguguuuuuuuugagacggagucuugcacugucauccaagcuggagugcaguggcacagucuuggcucacugccuccaccuccuggguucaagcgauucuccugccucagccuccugaguagcugggauuacaggugccugccaccacacccagcuaauuuuuuguaauuuuaguagagaugggguuucaccauguuggccaggcuggucucaaacuccugaccucaagugauccaccugccucggccucucaaaguacagggauuacaggcgugagcuccugugccuggccugccuguguaguuuugaucaccauuuguuucccgucuauggaaccucugacuccucugucugcuuugacugaggauucuauucuggguguucucucaugucugaagccuucuucagagccucuccucuugucaucauuuaaaguaccccagcguuuguacauuauuaccaugcacacuguaacucaguaaagauuuuugaugaccuguggguguagaaggauuauagaggaagauccuagauaacauugcugcuagucucugcccacaucacagcauauguccaguguuuucccuccagccuaccucuuauagaugauuguguaugauauguaggagagcucuuauuugguccuugcuucugaaacaaaaguugcuguugaauugcuuuggguucuagguugaagucuguacaaauaccagcaguccucaugcuggccucuuuccuaaagauaacucgacacuggcuguggacaucuacaaagggguaagcauguuuggauuugugaucuuuguuccugaaucaguauuuuuagcauaguauguggucuuuuuugugacuucacuucagauaugagcauaucuccucuggagugucauuuauuucagaguuccagacaccagacaagcauuuuggauuaaaugggaaggaauagaggaucaguugaaaagauauauaauacaggccgggugcggugguucacgccuguaaucccagcacuuugggaggcugaggcggguggaucacuugagcucaggaguucaagaccagccugaccaacauggugaaacccugucucuacuaaaaacaaaaauacaaaaauuagcuggaugugguggugggcaccuguaaucucagcuacucaggaggcugagacacgagaaucgcuugaaccuggaaggcagagguugcagugagccgagauugggccacugcacuccagccugggcgacagaauaagacucugucuuuaaaaaaaaaaggaaaaaaaagaugcaguauacaccccagcuuuuuuuuuuuuuuuuuuuuuuuuuggagacaaggucuugcucuguugcccaggcugggguacaguggcucgaucauggcucacugcagccuccaccuaccugguccaagugauuuucccaucucagucuuuuggguaaugggacugcaggcaagcaccaccaugcuuggcuauuuuuuuuuucuuuuugagauggaguuuuguucuuguugcccaggcuggagugcacuggcgugaucuuggcucacugcaaucucugccuuccggguucaagugcuucuccugccucagccucccaaguagauaggauuacagguguguaccaccacaccuggcuaauuuuguauuuuuaguagagaugggggucucuccauguuggucaggcuggucucgaacuccugaccucaggugauccaccccccccucggccucccaaagugcugggauuacaggugugagccaccaugccuggccuuguauuuuuuuuguagagucaggguauuugccauguugccuaggcuugucucaaacuccugggcucaagggauucuccaacccuggccucccaaagugcugggauuacaagcgugagccacccuacccagccccaagaaaguguucuuaguaaaguguuuuuacuggagucucucaguucuuuuaugcugguuacauugugauccuccaacaguagaauauauaguguguagcauuucaccaauuuauuugauauuucccuguacuucuauugccauuuuccagaauaguguguaaaggaauauaauuuggggaaagugguguagaccucuuuuuuuuuuuuuuuuuuuuuaauauuuaagauggagguuuaggagcuuggagaagagaaaggacuaggcagagaaacgaaggagcauccaguaaaguuuagacugaaagcuucuggaaugagguccagacuugagccuagcuucuggcacagugcgcagcacagcacuugguguugguggugcauagcaaagaagggagaaaugccacagggaacugcuguuuuggauauugucugagcagauuauugccacaaucauauccuuccucuuggccucucacaggguguugugcugggauguuacuuugggccugcugcacucuacauuugggcaguggggauccuggcugcaggacagagcuccaccaugacaggaaccuauucuggccaguuugucauggagguacgugcugguauaggauagagggagauaacacaacccuuuuguuacuucuucuucuucuucuuuuuuuuuuuuuuuugagauggagucucacucgucgcccaaguuggaguguaauggcaugaucucggcucacugcaaccuccaccucccggguucaagugauucuccugacucagccucccgaguagcuaggauuacaggcucuggccaccauacucggcuaauuuuuuguauuuuuaguagagauggcguuucaccauguuggccaggcaggucuugaacuccugaccucaagugaucuacccgccuuggccucucaaagugcugggauuacaggcgugagccacugcgccuggccccuuuugucacuucuuaaucccauucuucugaggucucuccugaaccuccccaaaacuuuuuuuuguuuccuguugcagacagucaucugcuccuauguuuucuuccagggauuccugaaccuaaaguggucacgcuuugcccgagugguucugacucgcucuauugccaucauccccacucugcuuguugcugucuuccaagauguagagcaucuaacagggaugaaugacuuucugaauguucuacagagcuuacaggugaggaggaagcugaggaaacacauccuaguuauucagguagcauuauguacugcccuuggguaccaagccuagcugagugcuggggggauauugagaggaagacagaggcaugguuguggucugcaguaaauguauaugaaauccuuggcaucuaaaaggauuuuagaaaugguugguuuuuuaaaccuguugaaugggaacuaugaacuuuacuuacauaugggacacaaaauuguaguucauuaaugcaagcaaacauuaaaugaacauauaggacacugugcuagguccuguggagguuaagaagacaagucacauacaaagguuuguaugcuagguuaaugacagcucugcagaauucagcauaaugcccaagcauguugggaugauaggaauaauuauuucucauggaguaguugaggcagcauuuauguuucccuuucauuaauugugcuguucucuagggugauacaaggacccauaguaaucccaucugaucuucuuucuuuuccagcuucccuuugcucucauacccauccucacauuuacgagcuugcggccaguaaugagugacuuugccaauggacugugaguguacuccucuucguucccaaaggggaugcugauauggggaaaggguaucuucaugcaguaggccagucagacgugagacacagagggaagcgauaugcuuugagaggugauugcuagcugcuuccucuuuggcuuagagaauggaaacugugaauauaguaaaggaagagaaagcacgucuuucauaugaaggggagagaaaguucagcuuuuacagcauaacucuucagcuucagccacugaaguuugaggcaccuuaauucuuuguuaaaugaucuuaacaaaaaaggcauaaguuaguaccuuuuauauauaucuuuaaaggauaugagguaucugaagugacuuguugcauuuuugggaacguuaauaaaauggcucauugcguuucuaggccuuguugcaucucuagggacuuaaauauuagggauuauuuguuggugucuuuuccccccucuuucucccugucuaccaguaucuaacuuugggugauuuaacuuagacuuaugaagaaucauuuuuuuucaaauuaagaacaauuuuuccauucauuuugaacugccucuaauucccauccuguuuccuuuucugucuguggccaaguuggauuauuccaucagugacugugcugauuucuuuuacagaggcuggcggauugcaggaggaaucuugguccuuaucaucuguuccaucaauauguacuuuguagugguuuauguccgggaccuagggcauguggcauuauaugugguggcugcuguggucagcguggcuuaucugggcuuuguguucuacuugguaagucuagccuggaagagcaggggcauagguaucagggaugguugaggugggguucacugacauucagaaaugaacagacccaggcugggcacaguggcucaugccuauaaucccaguacuuugggaggcugaggcgggaggauugcuugaauccaggaguuagagaccaaucugggcaacauaguaagacuccaucucuacaaaaaaagagaaaugaacagacccaaaagagcacauaacaaucuaccuccaggugaucgagacaauguauauggaauugucaaaucagcuguuuacaaaauaauauuucuaaccauaaaauucacuuugguuacuaagauuugucauuuuucaauuucugucacuucuguaguuuccauucuuaguaauuccuaacaagagaguauaguauguuugaggaacuaaaagaaggguagcaguacagagaguggagaacgguacaaaacagagguggagaauagggcaugcagugugauuuagagauucggggugggacacauguggcacacagccccacucagcuccaucacuuacuagcuguccaaggaaauaauuaaauagugauagucuccccuugacucucucauucuagagucauuuuuuaaaaaucaugguuauaaaacuauagcuacaugaaaaagguauguaaaauuuauauuucaauuauaaaaaauuuuuuaagaagucuagaauuauauaaaaauggcaauauaguuguuguaggaagcuaggauuauagauauauucuucucuauuuuccaaaucuucuuuagcauugcuuauauuaaugaaaaacagccaaaauaacaacagauccauuucccuguucuauacagguuucuuugaaaagacacagggguuagggauaaggaauaguagaauuuauaccauuuuugcugcagagaauggcuacagauggaggcuggaaaccugcuguuaaucucuagaacacuuccccacaccagugugccacacauuagauacuuuauuaagaaaaucacuucaguaaauguugaaaaauuauuuccuagaucucuucuuuuuuucuucccaauaaacuuugugcacacaaagacuguacugacccuaugaucuaggaacuuaacuucaaggaaaaccaaguaacugaauguguccuugacaggaauuguuuuuaaaaauucacuauagaaguuagggggauccuuucagaaugcaaauuggauaugaagaugccaguuuguccucagucagccuaaggcuaaugagcuuguugaagacccauuauuauuauuauuuuugagacagaguuuuucucuaucgcccaagcuaggguauaguggcaugaucuuagcucacugcaaccucugccuccuggguucaagugauucgccugccuuagccuccugaguaguugggacuacagccaugugcuaaccaugccuggcuaauuuuuguauuuuuaguagagaugggguuuugccauguuggccaggcuggucucaaacucuugaccucaggugauccaccugccucagccuccugaaguguugggauuacaggcaugagccaccgugucuggcuugaagacccauuuugagaggagagggcugauucuagaguggguuacuguuguuuaacuucaaaacaggaacuucauagagcagcuuaggagacuacaccaauuguauuagucuguuagucauucuuaucauggggaggacugaggaaaaguggacuuccgagaacuuacaguuggguaaaagaaacaaacaacaggcuggacgagguggcucacgcuuguaauuucagugcuuugggaggccgagccaggaggauugcuugagguuaggaguuucagaccagcuugagaaauauagcaagacaccuugucucuacaaaaaaaaauaaauuagcugggcaugguggugugcgucuguaauccuggcaacucaggaggcugaggagagaggauugcuugagcccaggaauucgaggcuucagugagcuaugauugcaccacuauacuccagccugagcaauagagggagaccuugucucuaaaauguaaaauaauaauaaagauuuuaaaaaaaaggaaaaccacagacacaaagcaguaagaacagagaaauucaauauuuaaaauaguauggacaaacuuuguugaggaaggcagcugauuuuuugaagggggagugggguugagagaaugacuugugcaacccuuggugguagaagaugggcacagcuggauguucaaggaagggagcagguuugcauuugagaagugcugugugagcagucauggcucuucaaagagccuggugagugaugaccauauuuugucuuucaggguuggcaauguuugauugcacugggcauguccuuccuggacugugggcauacgguaagcaucucuaaaggccugcugacagaagaagccacccguggcuacguuaaauaacacuggauuagucugucuucugcagguagccaucagagccaguguguuucuaugguuuacugugugaacauagccaaaaguaugugccguugcacagacuguguuuaugacucaaccguugguuggaaaagacuuuguuucauguguauuugaaagauggaauuauuuuuuccuuccugaccuaaccuuagaacuggauuagggugggaucuuugaaaagcugacauuugcugcuaucauuccaacacuaaauucuuaaguaguugcccaagggccagcucaguuuauccuucggagagacaaggauaugcaugauucuuaaccaggcuauauguuaaaaaaaaauuggaaaaugcaauacauuuuuuauuauacaaacuacagaaugaguaugcaaguuuuauuuaucaaaauguaauggauuuuuaaaggcugagaaauuuuccuuauaccuaccuuuucaguuauuuuaauuauaccaaauuaucaacuagaauagcuucauccauaugaaauauaaaaugaagagacaccuagcucuaucaggcuuaggauucuuugaacuuauuuccacuuuaauuucucaguggaaguuaagaggggugagaaaacaaagaaggggaaaaacugacaacuaacaaaaccagcaccacaucgcuagguggugcuuacuaauuaccuucucaggauuuuccucagauugaaaagcuuaugaggauuucuugggagucuuaauaaccugccuguuaguacagagcuuuccugaugauauuuacucuugagcacaugugguuguaaaaccuuaacuuucuuucuccaggaggguggugauagaaacagaugguaguauuuaugaacugauguucucgugaaauguugaggguggggagaaaagacuuuaagggaggagagccaucuauuuuguuccuaaagccaccucucagcagaaucgucauguuuuucugaugcaccgcucugcuucaugcccaagaugacuugcgaggcaaucucaggagcuguggacuuaaccguugcaaagcacacugucuuucucagcguucucugcaagucaguagguguuaguaugguugcaaaguucacugucucagcaaaguugaacugggcuaccucucuacagcuguuuccucagagggaaaaaucuugagaccagaugguggagcucuggagucagaggaaaugggugucuucagcacaaagcugcugcuuuuacuucagccacuucugacauuuuuacauaccgagccugagauugugugauuaucucaaaucaaaucacuuugauggagauaaauaaucaaaacuguuuuauagucauugauuuggugagaacaguaauggaaaaugguguugaaggacuucucauuuuuggagcuuuccuuccagaguccuggcugauugguguucgcuguucaucugagcccccaaaagcauuauuacugauacuugcacacagucaaaagcgcagacuggauggauggucuuuuauaaggcauuuaaggguacacuacuguguuucacugaccauacauuuuucuuagccccucaaguaauauagcacagaguuaugaaugacaauuccccuaaccauuccucuucauaucugccucuuccccuuaccaucguaauucuccaaacuggucauaaaggcacucugugaagauauuggggacugacaucuuaagcucucaccuggcugcaguaggaaaggccaaacugacgacaaaaaaaaaauucuuuauaaagaugauaugguaacauguaucuuugcccugggucuggguggguccagucagucucagauuuacaagcauuuaggagccuagguaaaagcugcuaguauucuuuuaaaaguuauauuuaugacuugcaaugauagaaaacuccuuccaauuaaauggcauuuuauaauauuauguguguacuucacaguguuaaaaauacccucauacguuauugcauuugaucuucacagaaagugcauuuuaaccaguacucugggugcaauaaauaauauguagaaauuuaaguccuccaauuccagcauauccagugaguuuugacaguguguuuauguggaauguuuaaggauauacaauuguacuuuauauaaauugguucuuguucuucuuaaaugugacaugaaauaauugugcugcuacauuauacuggaaauuaacaggggaaaagggaagagcucuuggcucccuugagguucugcuagugguguuaggagugguuacaacugagcuuuuaguaaccauuuaaccguauguaaacuugguuucuaauuaaaaaaaaauuucuuuuuccaa

SEQ ID NO: 192585 - RNA, 25070 nt, Homo sapiens
ggccucugcgccaaccccgcgcgccacccgcggcuuccuccgcucgggguccucguucggccucugcuggccuccgcgacuccgcggugcccgcccccguugaguucaaaaggacgcgcggagcggcgccggcccuucaccagcagcccguccgacuggaaaggugagcacgagggaagggcgggggcgccggagagccgggucgcccacauucgccgcagccaccucggccguggcaggaaccgaaacccggagcggccgaagcucagcgcuccgcuggggcagagggucgcggcggcugggaacgccgcuccccgacgcaccggccgcccccagcgcagcgcgcuccgcggggugcugguaacgcggggggcucggggcgggggcggggacgggggcggggccgcggggcgaggaccaacccagcccgucgcguccaccccgcguucgcaggggcgucgaggaucuccggggcgcggggcgcgggcuggggcccagugaggcuuggcaggcugugcgcggaccgcgcccuggacggcgaaagcaggcccggagggggcggccaguccggcgucccagcguccgaggcgagccagaaggcggcccacggccgucgccucccggucccggcccggcuacugcgcugcgcccacuccgcucuggagccugggcgcggguccugaccuucccggcccucuccugacaccugguggauggcgucaccagaacuccuagcuguggaacccuaggguaccuguuaccgcgcuuuggcgaaacuggguucgcugcugauuugcgaaccuuugccugacuuucucaggccuugagagaucuaaguaaauuugguggcccauugaaaggaccuggagagagcguaugaagguaacaccccgucaaacugcaugcggccucagaccugcuccuguggagagcuguugguaccuggagccugaggagauauucagggaaaccagaagaggacaagagaaaaaggggaagggacuugggagaaccuggcaccagaggcuuuccugggacuuccaggacucaaagccauaggggcccacccgcuacauuccugucuuugccccucuuccuacagaucugccucuucuccaagaaacucaaccacuagugacaaugaccagccuccugacuacuccuucuccaagagguaggugaaggccuuuccuaaucccagugagaaagaauuguucaacauccccuuccccagaccaguccuggaagccucagcccaggugggaagacucccaccucucucugccugccucacacaggaagggccugggaggaagcaggaacuagagugugccccuuaguacgguuuuaaucugaagucacauggacauggugacuucacaaaucuuuguaaccucgguuuaucaaauaauuuuaugucgguaaucccaggacuuugggagacugagacaggaggaucucuugaggcuagguguuugagaccugccuggggaacauagugagaccccauugcuaauucaaaagaaagaaagaggccgggcgugguggcucaugcuuguaaugccagcaguuugggaggucgaggugggcggaucaucugaggucaggaguuugagaccagccuggccaacauggugaaacuccaucucuacuaaaaauacaaaaaaauuagccaggcgugguggugcacgccuguaaucccaacuacucaggaggcugaggcaugggaaucgcuugaaccugggaagcacaggugagccgagaucgugccauugcacuccagccugggcaacaaagugagaccggucucaaaaaauaggaagggagggaggaaaggaaaggaaggaaggaaggaaggaaggaagauuauuguauaagccuaaaggaagggcuuuacauucaucugucuaauaauuuauagcuauggcaaagaauguagcagaaacccuuguaauuaaauguggaaaaggaaucuucaaagauaacagggaaaucauuuuuuaaaaaccugcuaaagauaguauugcuaaccucuaagcuccgguuucaucauucacaaaauagggaaaauaguaccuaucuuaugauuuaugaagauuaaaugagacaacccauauaaaacaccuagaagaguguguaguaucucguaagcacucagucacguugguuauuagcacugaguacuuguuagaaacccaucuuucccuugaaagugauuuugcuggcuuucucauuccacuccucuggugauacagacccagcaucaaaaccccauuguucccugaaggugugcggaggccgggcacuacugcucagcacucugagaauggaugcccaccuuuuaguucaucaucaggcugggccggacaaacuaucaguuauuuauugacuguuuucagcaugugcuaguuagggagagagaggaacaaacccuugguuggucuauacaccuuugucuuccuauacacagucacauuugucauuaggacaggcauucucugcuuuuacugauguggaaacaggugagugacaccaccaguggaagucuaagacaguguccucugugacugguaaugcacacaauucagacuuuuaguugucuggugagaagagauaaaagagagaaauggccagguaugguggcucacgccuguaauuccagcacucugggagguugaggcaggcagacugagcucaggaguucgagaucagccugggcaacauggcgaaaccccaucucuacaaaaaaauuuaaaaauuagccgggcuuggugguagacaccugugguuccagcuacuccaaaggcuuaggugggaggaucccuugagcccaggagauggagguugcaaugagccgagaucaugccacugcacuccggccuaggugacagagcaagacccugucuuaaaaaaaaaaaaaaagaguuagggggacacggaguggggggggggaauaggucagcaaaggcuucaugggugggugaggaaggggaucugagucuugcccuugaaagacggacaagguucauacaggcaaaggggcgcagcagguaucuuagagaaacguagaauaccuuuuucguguguaccugcucuagauaaagguagaauaccucauaccaugugugaagcuacagagacgauuuacccuggaggauguucaggaagcgggugggcagaggaccuccagaauaauccugcccacaagggaaaaaaggugauaccuuggcagcuagcugagggauuagaaccuuggcaagggggagcuguuuacauuuuuuaaauuuuauuauuauuauuuuugagaccaagucuugcugugucacccaggcuggaguacaguggcuuaauuucgguucacugcaaccuccgcccccuggguucaagcaauucucccaccuuagucucccuaguagcuggaauuacaggcgugcgcuaccacgccuggcuaauuuguauacuuuuaguggagacaggguuucgccauguuggccaggcuggucucaaacuccuggccucaagugaucugcccuucucggccucccaaagugcugggauuacaggcucaugccauuuuuucuuuuuuaaaauuuaugguaaaauaaacauaguacagguauuaccauuuuagccauuuuuucgcagacaauucagugguagaguaguccccgcuuauccacaggggauucauuccaaaaaccccaguggaugccugaaaucucagauaguacugaaccccaucuauacuguguuuuuuccuguacauacauacuuaugauaaagcuuaacuuguaaauuaggcacaguaagagauuaacaauaauaauaaaauagaacaacuauaacaauauacuguaauaagaguuaugugaaaauggucucucucacuuaaaaugucuuauuuacuauagaucuuagaaaccucaguacacaguucuuuuuuuuuuuuucuuaagucaagaacuuucaccuuuucacuuaaaggaagcacuucuuguuggcauguccaaauugcaucacuauucuugugcuuuggggccacugucauguaaaauaaggguuacuugaacacaagcgcugugguacucuacuaagcguuuauagcauggacacaaaaggaugauucacuuuccaggcaggauggagcagggugugagauuucaucacgcuacucagaacgguacauaauuuaaaauguaugaauuguuccuuucuggaauuuucuuuuucuguuaaauuucuauuuaauguuuucggacugcaguugaccacggguaacugaaaccuaggaaagcaaaaccgcagauaagaggggacuacuguuguuuuuuuuuuuugagacggagucucgcucugucacccaggcuggagugcaguagcgccaucucagcucacugcaagcuccgccucauggguucacgccauucuccugucuuagcuucccgaguagcugggacuacaggcgcccaccaccacgcccggcuaauuuuuuguauuuuuaguagagacgggguuucaccguguuagccaggauggucuugaucuccugaccucgugauccgcccaccucggccucccaaagugcugggauuacaggccagugccuggccuggggggacuacuguauuaaguaauucauguuccucaccaccauccaucuccagaacuuuaccuucccaaaccgaaacuugacacccauuaaacacugauuccccauuucccugcaaacaccguucuauuuucugucuauguaaauuugacugcucuagguacuucauguaaguagaaucauacaauagaccuuuugugucuggcuaacuucacuuagcauaauauucucaaaguucauccauauuguagcaugucacaauuuccuacuuuuucaaggcugaauaauauuguuguauguguauauuacauuuuguuuauccauucaucuaugauggacaguugaguugcuuccaccuuuuggcuauugugacugaugcugccauaaacauggguguacaaauaucuucuugagacccugcuuucaguuguuugggauguaugcucagaaguggaauugcuauaucaugugguaauucuguguuugauuuuuuugaggauccaccauauagguuugcacagcagcugcaccauuuuauauuccuaccagcaaugcauaaagguuucaguuucucuacaaccuugccaacacuuguuacuuucuguuuaaugguagucaucauauugugugugaagugguaucucauugugguuuugauuugcauuucccuagugauagugauguggagcaucuuuucauguacuuauugaccauuuguauaucuuuggagaaaugucuauucaagucuugucccauuuuuuaguugauuuguuuuguucuuguucaguuguauauuuauauccuuuaaaaauuuuuuuuaaaaaauugaucguugaaucaguccucucucucuuucucuuuuuuuuuuuuuuuuucuggcgauggagucuugcucugucacccaggcuggauugcaguggcaccaucucggcucacugcaaccuccaccucccggguucaagcaauucuccugccucaaccuccugaguagcugggauuacaggcacacgcugccacacccggcuaauuuuuuguauuuuaguagagacgggguuucaccauguugcccaggcuggucucaaacuccugagcucaggcaauccgccugccuuggccucccaaaguacuaggauuacaggcaugagccacugugccugaccuuuuuuuuuuuuuuuuuuuuuuaagagaugggaucuuacucuguugcccaggcuggagugcaguggcacaauccuggcucacuacagacccaaacaucugggcuugagggauccucccaccucagacuccugagcagcugggacugcaggcgugcaccaucacgcccagcuaauuuuaaaauuuuuuguagagauaggguuuugcuauguugcucaggcaacucucccggccugaagccaugcuccuuccucugccccugaguuguugagauuauaggcgcaagccaccucaccuggcugcauucuugauccagcgagugacaugagugaaguagugauuuaggacagucuccuauccacuggguccaagcaaguguaaguucagagacagcaauagacaaaagaauagaaaucacagauaggaagaaagcuuauacuuuaaaugaugggaucacuaaaggccagcucuucucuucuaccccugucuugcauuucucuucccccaccuucccaccuauuccucccucacagucuauaaagacuuccuagagaagauauccuccaggaaccuugaaaggaagggccacauuaugacuccugagcccugggcacuucugucuuugugggcuccuccuucacuuaaaaaaauauuaaaaaucauauuuuacaacugcaucaguguaaggaagaauauaauauaauauaauuaauauuuauaauuaguaauugaauggcauaacaaccuuaauauuucuuugaccuaaaauuuuguuucuuuuccuucuucuaauuauaaaagaaaugaaaauuauuuaaaacauuuucaugggccuuucgaagcauugugggcccagggcacugugccuguugugccuagugcauaagucagcccuauucgaaguagggcagaguggaacugugccuugugggcuuugcccaccgugccagguaaagcucaucucuugccaccaaaugaucacaccagcuaccgccuagguuguccucacccuguauuagacacuuagcauuuuucuuuauuuuauuuuaaaaauaauuuuuuguagaaauaaggucuuacuguguugcccagucuggucucaaacuccuggccucaggugauccucccaucucagccucccaaagcagcauuuuucauugcacuuauuccucaccacaacccaaugaaacaaguuuuagucucauuuuacggaaggaaaaacugaaguucaggggaguuaaggaauuuucuuuucuuuuuuuuuuuuugagauggaauuucccacuugucacccaggcuggaguguaguggugcaaucucggcuaacugcaaccucugccucccggguucaagcaauuuuccugccucagccucccgaguagcugggacuauaggcgcccaccacuaugcccagcuaauuuuuguauuuuuaguagagacaggguuucaccauguuggccagacuggucucgaacuucugaucucaagugauucacucaccccgaccucccaaagugccgggauuacaggcaugagucaccguuaaauuuucaaagauuaaaaaaauuucccaaggucacacagcuaguaauggcagaggcaggauuuugcgccaagucugauuuacugcaagccuguguucuuucugucaugguguacugcucccaaggucucacuccacccaacuggcuggugcacaugaaagagaaggcagaagaaagggggccgagucccaggguggcuucccauggaaagaacucggggagccgcccucugcugggcaggucuagagcaaauaaguaggcuggcagacuuagguggcaaaagaucugaugccucagugauaagagauuuagcucaagcugggaacaaggaccacaaagaagccagccaguaucuggguuaacaaaaaaaagaguaagugaacagaauagaucuugaaggucauuugcuauugguuaggacuuggguggggccuucaaucuuaugaaccugagcagggaagguuuggaaagacuguagugcuauuuaauaauuauuccuuuguuuggacaaaaaaaugggguagaaacgggagagaaugggggaaaagcuauaagccauuuccuccuuuuaugccagcuuuccugaacuuaguuuauuuuguuguuguuuguccuuuuuuucuuuuuuugagacagggccucaguuucacccaggcuguagagcaguggcucaaucacagcucacugcagccucaaccuucccagacucaggugauccucccaccucagccucccaaguagcugggaucacaggugcgugccaccaugcccaguuaauuuuuguauuuuuuguagagacaggguuuugccauguugcccagguuggucuugaacuccuggacucaagugauccucuggccucagccucccaaauugcugggauuauagguguaagccaccuugccaagcauguucuuuuauuugaaagguaauacaugccccucagagaacagcuuucuagaccuuuucuauguacaaacauauauaugcauauuuauaggguuuuuuaaaguuacuuaaaaaaaaauacacagagagacaggggucucgcuauguugcccaggcuggacucaaacuucuggccucaagcaauccucccaccucagccuccaaaagugcugggauuauggguguaagccacugcacucugccaauuuacuuuuuuuuuuuuuuuuaaacaaagaugcaguccuacuacauauaccaccuggcaguuugcuuuuuucaucuaaccauguauccugucccaguaauauuguagaucucauauucguuuuagcaacuguuuccacaauggauggccuguaauuuauuucaucauuccucuccagauagacauucuaaguaugucuggauuuuuuauuuuaaaauuugauuuuaaugagaauucuaauagaacacuuuccauuuauaaaaauucaaaaauuaaggcugagagggguucugaugcucagcuaguucaacuaaccauucuguccuagaauucucucuccaagaugcuacguagcuuuuguccaguuuugcucuuccuucuguuggggagacaucugucuuucccaguuucugcuguuaguucucuuguacaggucaugccuuggcauauuagaagacagaauucaagcucuaggcucccuuuuuuuucucugggcuuucucuugcaagcuuuccuuaucugacaugguuugccugcucacuucaaaauugugacacccaggccgggugugguggcucaugccuguaaucccagcacuuugggaggccgaggugggcaaaucacaaggucaagaguucgagaccagccuggccaacauggugaaacccuguguuuacuaaaaauacaaaaaauuagcugggcauaguggcgggugccuguaaucccagcuacuugggaggcugaggcaggagaaucgcuugaaccugggaggcggagguugcagugagccaagauugagccacugcacuccagcccaggugacagagugagacuccgucucagaaaaaaaaaaaaaaaaaaauuaaggcugggcacgguggcucacaccuguaauucuagcacuuugggaggccaagguagguguaucacgagaucaggaguucgagaccagccugaccaacauggugaaacccccucucuacuaaaaauacuguaaucccagcacuuugggaggcugaggcggguggaucacgaagucaggagaucgagaccauccuggcuaacauggugaaaccccgucucuacuaaaaauacaaaaaaaucagcugggcgugguggugggcgccuguagucccagcuacucgggaggcugaggcaggagaaucgcuugaacccaggaggcagagguugcagugagccgagaucacgccgcugcacuccagccugggccagagaaugagacuccgucucaaaaaaaaaaaaaaaaaaaaaaaauuggccgggcgcgguggcucacgccuguaaucccagcauuuugggaggccaagacggguggaucacgaggucaggagauugagaccauccuggcuaacacggugaaacccugucucuacuaaaaaaauacaaaaaauuagccgggcgugguggcgggcaccuguagucccaacuacucaggaggcugaggcaggagaauggcgugaaccugggaggcggagcuugcagugagccgagauucugccacugcacuccagccugggugacagagcgagacuccgucucaaaaaacaacaacaacaacaacaacaaaaaaaacaaucagccggcugugcuggugcacaccuguaacucccagcuacuugggagguuaaggcaggagaaucgcuugaacccgggaggcggagguugcagcgagccaagaucugucgugagcagagauccugucucaaaaaaaaaaaaaaaaaaaaaaagaaaccaugacacccagaugaacucagcagucuaggcgugguacaaaguagagcaguacuguggccuccauuauuagaccauauuuauauugcuggugccuaaaauaacagcaaucuuuaauuuuuuaugauuauaaaaguaauucuuuaucauugugagaaauucggaauauaaaggaaagcauauaaaacaacauaaaauucaggcacacaccuguaauccaagcacuuugggaggccaagguggcaggauaccuuaaggccaggaguucaagaccagcgugggcaacauagcaagacucccucucuacaaaaaacuuuaaaaauuagccaggcaugguggcacacaccuguaaucccagcuacucaggaggcugaggugggaggauugccugagcccaggaguucaagguuacagugaucuaugauugcaucacugcauuccagccugggugacagaacaagacccugucucuaagaaaaaaagaagaaaauuaaaaucauugggaauuccacaaccuaucuguaacuccugcugcuguuuuggaguauauccuuccagugucagugguuuuuuuagggacccccccauaaguacuuuauauaugauguugcuaagccauagcuuccccauucuuugugaguaguuggcuuccugaaccuaagagcaaggaauguguuaaauucucaucuuguucaguuuggugcauuucuucagucauuugaaaugugucuguguuuaucaguuuacuaguugccccucuagcuuugaagccuuuaacaaauuugucagggcugggcgcaguggcucacaccuguaaucccagcacuuuguguuguucaggcaggaggaucgcuugagcccaggaguucaaaacuagccuaggcaacacaguaagacuccaucuguacaaaaaauuuuaaaauugucgaaucuucccugggucugcaggaucugcauuuaccccaagggcauucagcucagccuuuguagaaggcaccaauaaagcauaagaccaaaaauauguauguauauaucuugcaaagaauuugaaguucaauauauauuuuuugagacagggucuuacucugucagccaggcuggcaugcaguggcgcaaacauggcucaccgcagccucaacuucucagacugaagugauccucuagaauccuccucaggguucaacuaucagguuuuuuuuuuuuuuuuuuuuuuuuuuugguagagacagggucuccccauguugcccaggcuggcuuugaacuccugggcucaagcaguccuccugccucagccucccaaauuguugggauuacaggcaugagccacugcacccagccuuggacuuucuuauacuugcuuuaugauuuaauauuuuuauuucaaauuacauaaaggccuuauuuuggcccuugcaugauuugacauaacuaucaauucaaaaaggacuaagguuaaaccacagugaaagagucucugucuagacuggcaucacuucaucccuuaacaacccauuacugccucacuuaggccuuauagccaggcuguauuucucugccuuguccacaaggauauuauaaauaaucuuuucuuuucuuucuuuuuuuuuuuugagauggagucucacucuuguugcccaggcuggagugcaauggcacgaucucagaucacugcaaccugugccucccagguucaagcgauucuccugccucagccucccaguaguagcugggauuauaggugcccaccaccaugcccagcuaauuuuuauuuuuaguagagaugggguuucaccauguuggccaggcuggucuugaacucccaaccuccaucaccuuaggugauccaccugcccucagccucccaaaaugcugggauuacaggcaugcaccacugugcccggccuguaaauaauguuguuguauguuuucugaugcuauuuacucuugcagcaccuucaguucuccuuaagccccuccuacccucacucucaacugauuaucuuacauccuauuuuguaauuauuaauuaauuuauuuuuugagagacagggucuguuaccuaggcuggagugcuauggcacaaucauagcucacugcagccuugaacuccugggcucaaggaauccucccaccucagccuuccaaauugcuggacuuacaggugugugccaccaugccuggcuauugcuuuuauuuuuauuuuuauuuuuuuuguagagauggaggucucacuauguugcucucagccugaucucaaacuccugaccucaagcgauccucccacauuggacucucaaagugcugggauuauaggugcaaaccacugggcccaguuaagaucuuacuuuagaauggguaggcugggcacaguggcucacaccuguaaucccagcacuuugagaggccaagacaggcagaucaccugaggucaggaguucgagaccagccuggccaacagggugaaaccccaucucuacuaaaaaugcaaaaauuagccaaguguagugguggguaccuguaaucccagguacucgggagacuaaggcaagagaaucauuauaaccugggaggaggagguuacagugacccaagguggcaccacugcacuccagccugggugacagagcaagacugucucaaaaaaaaaaaauguauacaaaggucucacuauguugcccaggcuugucuugaacuccuggcccuggccccaaacaauucuccccacucggccucucaaagugcugggauuauaggcacaagccacugggcccaguuaagauccuauuuucuugagcaaauuaaaguuaucagaagagaacugccaaaggcucgcacccucaccaucaaccugccaccugcauuugugcccauauacucugcuuuuccuccuauuccaauggcacugucucugcugcugucugcagccagccccccagccccucugugcucuagaucucaucccuucaaggacucuugugcaucaucaauugugccucucaucugggucauucucaucuguaugcaaacaugcuggcauuucucccaucagaaaaacaaacaaauuugaacucccuuuccccuccagucacagccuuucucuacucaccuuuacagagaaauuuuguguaagcauuuauuuauauucugccuucaguuccucuccuuccauuucuuccuugaacccacccuaaauuacggguuuguauccagcacuucaccaaaacuucucuuguaaaggucguuuaugaucucugcauggcaaaagcuguuuggcugcuacuccccagucuccuugggcucagucuuggguucucuuuaucugcacuuacuccugggugaucucacccagucuauggucuuaaauaucuaaugacuuuucaaccucuaguaccauauauaagaauauauauauauaucuuuuuuugggugggggggagguuuuguuuguuuguguuuuuuuuguuuguuuguuuguuuguuuugagacggaguuucgcucucauugcccaggcuggagugcaauggcacgaucucagcucgccgcaaccuccgccuccuggguucaagcgauucuccugccucagccucccgaguagcugggauuacaggcaugcgccaccaccccggcuaauuuuguauuuuuaguagagaugggguuucuccauguuggucaggcuggucuugaacugcugaccucaggugauccgccugccucugccucccaaauugcugggauuacuggcgugagccaccgcgcccggcuuguuuguguuuuuuuaaauagagcugaggucccacuauguugcccaggcugcucuugaacuccugaggucaagugauccucuggccucagccucccaaagugcuaagauuacaggcgugagccaccgcaccuggccuccaaauucuaaucuucauaucugaacuuugauaucuaguaagcaaucauguuucuuccaaauuuguucccccugcaggcuuaccccucucacauaacuccaugccuucacccuugacuccaccccacauccaauccuguccgucuuugcuucagauuauauucagaaucucaccacuuucucacugagcugcugcaaaagcaaucaaugcugucguggaaauuagaaaaagggguugggcacgguagcucacaccuguaaugccagcacuuugggaggccaaggugggcagaucacuugagguuaggaguucaagaccagccuggccaacauggugaaaccccgucucuacuaaaaauacaaaauuagccaggcaugguggugcaugccuguaaucccagcuacuugggagucugaggcaggaaaauugcgugaacccgggaggcggaggcugcaauaagcugagaucacaccacuguauuccagccuggacaacagagcaagacccugucucaaaaaaaagaaagaaaaagaaaaaggcacaccuuuuggcagaugcaacugugcacuugugcaggguacacccugcuucugcacgugugccaccuucccacagccuauuguccacacuguagucagagggauccuuucaaaucaaucccuguuucaaucauguauugcugcuggaaggucugcuagacuagaagggccaaaauggucucccucacaugucuggcagucagcugagccuggggugcuugguuuuccuccauauggccucucauccucuagcaggcaggauugggguuccucucaacaugguggucucaggguuucacaaguguggucuuuggaaaucaggccccaccucagaucuccugaaucagaaucugcauuuuaacgagaucuguaggagauuguuaugcacaagaaaguuugagaagcauugcuuuaaaacacaaaccuaggccaggcacaguggcacaugccuguaaucccaacacuuugggaggccaaggagggagaaccauuugagcccaggaguuuugagacgagccugggcaacauagcaagaccccgucucuccaaaaaauaacaaaauuagccaggcguguuggugcacgcuuguauucccagcuacuccagaggcugaggcaggaggaucgcuugagccugggagguggaggcugcagugagccaugaucauaccauggcacuccagccuggaggacagacugaggcccugucucaaaaauaaguaagugaauaaauaauaaaaaaaaucugaucagucucugcccaaaaaccuguaaaagcuucccaccucacucccugaaaaagcccuuaccuuggccuacaaggccuguguuguacaggccuccuugacuuucucugcuccuccucuccccguuacucccacucaggggccuccauacugugcauuuaacaggccaagcaugccuggccccgggguguuuuucagugcuguggacagcccucccaugaacuugcuguccccucugccuggaauguuccucaaucagcucuuugcaugacugccucccuuaccuucuuuaggucuucacucaagucaccucaucaguaaagcuuccccugacaaccuucucuaaaaccacaacuccaaccacaucccagcuuuccauccucuuuucugcuuauuuuucuacauagcgcuaauuaacgucuaauauagcauaucuuuuacuuauuuaauuauuuauuuuuacuuuuuuuuuuagauggagucucucucugucacccagguuggagugcaguggugcaaucucggcucacugcagccuccgccuccuggguucaagugauucuccugccucagccuccugaguagcugggacuacaggcauacgccaccacacccagcuaauuuuuguauuuuuaguagagacgggguuuugccauguuggucaggcuggugccaaacuccugaccucaugauccacccgccucggccucccaaagugcugggauuacaggcaugagccaccgcgcccggccuuauuuuauuuauugucugucuucccccucuaaaaauguaaauuauauaaacagaggguuuuuuaauugugguaaaauuauacauaacauaaaauugaccauuuuaaccauuuucaaguguacaguccagcaguauuaaguacauucauguuguuauaccuucaccaacaccacuaugcaucuccagaacuuuuucauccucccaaacuaaaacucuauacucauuaaacauuaacuccccauuuuccccuucuccagccccuuacaaucuccuguaguacuuucugucuuaugaauuugauugcucuaagcacaucauauaaguggaaucauacaauguuuguccucuuuuuuuuuguuugagacagagucucgcucuuucgccugggcuggagugcaguggcaugaucuuggcucacugcaaccucuaccucccggguucaagugauucuccugccuuggccucccaaguagcugggauuacaggcaccugccaccacguccggcuaauuuuuguauuuuuaguagagacgggguuuuaccacguuggccaggcuggaauguuuguccuuuugugccuggcuuauuucacuuagugucauguccucaagguucauccauguuguaguauaugucugaauuccuuccuuuuuuguuuuuuguuuuuuuuuagaauuuccuuccucuuuaaggguauguauauaccacauuuuguuuauccauuuaucuacuguuggacauuuggguuauuucaccuuuuauuuagcuauugcauaaugcuccuaugaacaugauauacaaguaucaguugaaguccauucauuucuuuuggguauauaccuagaagugggauugcgggaucauacccacccagcaaugagauugcuggguaauucuguuuaauccuggcaggaacuuuaaagguaaggguuuuugccuguguuguucacugauagaagcccagagccuggcacagaguacacacucaguaaauucuuguugaacuaacuguuuaauuucccugucuaggaaccuggaaucucagucuaagaaggcugugcagcuuaucugacccagcuugcucucaguagucccauucugacuucuaaugcuugcuguuucgaguucaaagccccccaaacaggccguaauaguguguucuagaacuuugcuggggagucacaucaagcucaccauugcuuuauggacuccaccuuccuuccauggccccuucagguucccgaccccuuucucuuucucagaagcuccuaugucaccaacagaaaucccauuuacaaguucuugcagugccuuuggcugucauaucuggucccuuuuagauuagucuggugcuugcuggguuucuuugcuucucuugagcucacuucccccauguccccaaaggcuccacugcuccuuagugcaaaaaaaugauucucuuugauaggaaacagaggugaaaaggccugagggaauucugcuuucucuguuaccuccaaccugaccccucaggcccaaagaagccuagcuuuuucuuuguucuuguugcaaauauaaugcuuuuuaaauuguccuucggggggcgauguggcucacgccuguaaucccaacacuuugggaggcugaggagggcggaucaccugaggucaggagucugagaccagccuggccaacauggcaaaacugucucuacuaaaaaauacaaaaauuagccgggugugguggcacaugccuguaauuccagcuacuugggaggcugaggcaggagaauugcuugaacccagggggcggagguugcagugagccgagaugaagccacugcacuccagccugggugacacagugagacuuggccucaaaaauaauaauaauaggccgggcacaguggcucauaccuguaaucccagcacuuugggaggccgaggcgggcagaucacgaggucaggagaucaagaccauccuggcuaauauggugaaaccccgucucuacuaaaaaauacaaaaaauuagccgggcguggugacaugcgccuguagucccagcuacucgggaggcugaggcaggagaaucgcuagaaccugggagacagagguugcagugagccaacaucgcgccacugcacuccagccugggugacagagcgagacucugucuggaaaaaaaaaaaaaaaucugauguagagucugccuucuugucaucguuuaaauauugagguaaauuucuuugcaccuuucuucaucugcacuuucugcuucaccagauggcuucauauaaguggaaacugaccaauagcugcaucgcagcaaggcauucuguagaauuuuuuucuuaaggucuuccuguauggcuaaaauauucucuaguugugagaaagcuugcuucugaucauguuaaacauuaaagcuaaagaggguggggaguccucugaaccucuuuugguucuaggggcugcucaauuuaaaaaaauuaaagaauagauaacugaaaauaaacuaaaaauaaagaagucacauauaaaccaacaugacuucugcauuacacugacaucguucccuuaaguuaccuaucaccagugagccaguucauguuaaagaagcacuuuguagcacaacugucuguauuuaauugugaucaucugguuuccucccaccuuuauucuuuuuuuuuuuuuuucugaaacagggucucacucugucacccagacuagaguacaguggcacaaucacagcucacugcagccuggaccuccugggcuccagugauccucucaccucaaguuuaccgaguagcugggacuacaggugugugccaccaugucuggcuaacuuuuuuuuuuuuuuuuuuuuuguagagaugggagucuggcuauguugcccaggcuggucuccaacuccugggcucaagcgauccaccugccuuggccucccaaggugcuggaauuacaggcgugagccacugcacccagccuccuccauauauuauuuuuaaaaaacaaauagagauggugucuugcuauauuguccagauuagucucaaacuccuggccucaagcaauccuccugccuccgccucccaaaguguugggauuacaggcgugagcuaccacacuaaaccuaauguacaaaguaaguuacuguugaugauugaacacaaauuacucaucuucaagcuucugauauacauuaaucuucucaaugcuuuguacauccuaaauucucaaaauguuuaaagaaagcaaaacuaggaacaacuguauagaacucuagauccaugguaggaagauggauugcagcccugggcgauuuggggaggaaagugcauggugaaaugugugaagucaugaccagguagauaaacuucagggcuucccuuugaugggagucacaguguuguauaaccuaaucucagaaguuacaugccaucauuuuugccaucaucuguuaaaagcaagucaccagguucaacccauauaccagaggagaggcaugcucaaagaugucaauaccaggaggcagaaaucauugugagccaucuuagaagcuguacaccacacucccauuucacaaaucaagaaacugagguacugccaggugugguggcacacgcuuauaaucccagcauuuugggaggccaaggcaggaagauugcuugaggucaggagguugaggccgcagugagccaagauugcaccauugcacuccagccugagcaacauagugagauccuugucucaacaacaacaacaaaaaaaaaacaaaaaaaaaacacaacaacaacaacaaccagguucagagagguuuaguaacuuccucaaggucaccuaguaauaugcuuaggcaggauucaaacccagagcaacucucccuuuaauuaauuuauuuuuuugagacagggucucauuacucuguugcccaacaauucaguaaugcagugcuggcucauugcaggcuuaacccccugggcucaagcaaucuucccacuucagccucaugaguaucugggacuacaggcgcauauuaccacaccuggcuaauuuuuacauuuuuuuuuuuuuuuuuuuuguagacagagucuuacuguguugcccaggcuggucucaaacuccuggccucaagcgaucuucccaccuuggucucccaaagugcugggauuacaggcaugagccaccaugccuggcccuuuuaaucacuaagcauauuaacaaagucaccuuaaauaauauuuaaguaguagcuacuauaugauguuuacauguucucucauuuaaucuucauaauagaacugcaauguugguuaauauaguuccuguggguaacagaugagaauggaugaaugaauccauauguauaggcgaggcacaguggcucacaccuguaaucccagcacuuugggaggccgaggcagguggaucacucgaggccaggaguucgagaccagccuggccaacauggugaaacccugucucuacugaaaauacaaaaauuaacugggcaugguggcacacaccuguaaucccagcuacucaggaggcugaggcagaagaaucgcuugagccaggagguggaaguugcagugagccgagauugcgccacugcacuccagccugggcaauggagcaagacuccaucuuaaaaaaaaaaaauguauaacuguucuagacaaacucuaaaaccauuuuuccucagcucucacaacaguugacacagaagacuucugugaccccaaaauauuugagaauuucucugcaccagcaagcaagcaagcaguuccacagcagacaccaagagggugucuuccaauucaauucugacacuaucuaccuagagauagugucagauaccacaggccaaggucugggcccccaaggcugcagcucccuucagacacuagucacaaguccaggcuccaaaacuugugaccaaccagcuucaaguuggaguucccaccccugccaaccccugcuuuggaguucaauuaauuugcuggaguagcucacagaacucagggaaacaauguguuuacugguuuauuauaaaggacauugcaaaggauacaaaugaggacauguguagggugagguguggggaggggggcggagcuuccacgcccucccuggugcgucacccuccgggaacuucugcauguucagcuaguuguuuuugggguuuuguuuuuguuuuuguuuuuggauggggucucauucuaucccccagguuggaguucaguggcgcgaucucagcucacugcgaccuccaccuccugggcucaagcgauucucauuccucagccucccaaguagcugggauuacaggugcacaccaccauacuuggcuauuuuuuuuuuuuuuuuuuuuuuuuuuuuuuugugguauuuuugguagagacaggauuucgccauguuucccaggcuggucucaaauuccugggcucaggaaaucacccacccuggccucccaaagggcugggauuacaggcaugagccaccauguccagccauguucaacuaugcggaagcuuucugaggccaguccucuuggguuuuuaauggaagcuucaugaugucagcauucccuucccaaauucucccucuggaaugaggaucuuaugacccacuaugggaaaggcagaggaagauuagaguccugccuuggggcaggugaagggaagggcaggagaaggcuggagagaugcuguuuccugaggcccgcuccugcggugugacacacccacaucauaacacaaggcuaacgggcugugggaauuaggagccaggaacuggaugaaaaccuagagagagagagagagagagagagagagagagagagagagaguguguguguguguguguguguguguguguguguguaaaacaccacaguaaccauucgcccaaggccagagugguugaggguacuaccauuccuagacaaagaggggaccagagagaaagguuuggccuggccuugggagaggaagcgcucuggacagccugccucugcuuucuguauugcaagaugaggaugguucaucaggcuccccugggcccgcguggaaagacccuucaacacucuuggccccucuuagcauaggcccaccagaccaccacugauacccucauuucacuugcuguggauggaaaccugaacgugucaggcacuggacgggagucaugcucacaccgcgcucgggccacgcuggccuuugaguccccuggucucagagcuuugacccaggcucuucucucugccuagaaugugccccaucccuguuacccgguaaacucuuaccccugcuucagcucccaggucagauauuccucccuuggggggucgcuucuggcuggaagacuagaucaggccccucggcugcacacuuuccuaagugcacuuacagcagcuccucaccgugcaagcuguggggugcaguggagggugagccucgggaagcuggccgugucuguuuugcucgaccuuucaucuagcacagggccuagcaaagaggaggcagugggugaguguugcuguuuaugggaugccagucaggucggggugccuccuguggguguugccaggaucagccagcugguuuuccccaggagaccucuauccugcaguaaccucuacauuaaaaugcuaauaggaaagaauggaagggcuuccugacuuccuguguaaacacuuaaaagggacuucuggagaccacucauuuugucauguucugucccuggguaaugacuuuagggugggacuuucacgcucugaaggauaaauaaacccguagcaggagggggugcaggaucuauuuuaggguagaggagaggccuguuucagaaccuuucaaauugcagggccuauccuggaaguguagaaaaggguuuuuaauaggagaggagcacuauuucauuauguuaaaauaauguuuacaaagaauuaguaagaaugcugcaagaaaaugcacaugcuauauaauauaauguaaauauauacacauacaacucauuugaucucacuuauuguaaaaauaugcauuccuaauaauggcuuauccuacugagugacuuauuaaaugucacaacaacguuuuaaaguagguacucuuaccuccauuuugcagauagagguuagguaauuuucccaaggucacacagcuaguaaaggacagaguucauauuugaaacccagucugucaggcucuauagccccuacucuuaaucacuauauuaugcagggagaaauccaucaacauauugucuuuggguggugguuuauuuucuucuuuauucucuaggauuuucuauuuggauauacucuaggaguuaaaugauaaacuuuugaauagggaagaaggugggguggugaaauuugaaggccaaacauaugcuuucaaacaaaagaauucacuccauuuccuuuuccacuuuucuacauuuuccagaagaacugaugaccaccccaauuuuacagcccacugaggcccuguccccagaagauggagccagcacagcacucauugcagguaauagacucugagccaacuccaagggaccuucuggaucaagggcaucucucuccagagggagccugaccaaauccauuaaugggcucacucuggcuuguaaguuauauuacacacacacacacacacacacacacacacacacagccauaaaagacucggaggcuucugucagaggcacuaccaguaaaugacagguugggagguggccgcaaauagauaugcauacggacguuacacuugaguacguggguagggacgaggauauaugugguugguugagugggugaggaagagggggaggaucagauaaaccacuuccuguuaggauaagccauuuccuguucccuccuucccguuucuuuaagaaucaggaacugguuugggaggcaguucaguuuugucagaaaucaaaagcauguguccuuagcuuaagcaccaggagacuccagcuauuaugugccauggaaauugggguuggugggggaacauggguuuggauggaaguggacacuaguuaaugaaaacaagaggaucuuuacgaaaacagugacuaaaucagaugacuccaggaacuacugagacauccucaauccugaaacaucucuacauuuucccucuccuuuccaaguuguuaucaccguugucuuccucacccugcucucggucgugaucuugaucuucuuuuaccuguacaagaacaaaggcagcuacgucaccuaugaaccuacagaaggugagcccagugccaucguccagauggagagugacuuggccaagggcagcgagaaagaggaauauuucaucuaaugacucccaggccccaaggagcuuauuccuggcuccaucgcuaacacguugacugcuuauuaugggaaaguuuucucugaagccagggagaagcauugauugaugugggcaaauccaagcuccagccaggucgcagucccaaaugccgacaucacugacuccagggaccagggacauggagaaagcuguuuaugauaucuuuaaccaggcccucuuacuagagcugguguuugugacuggccaacaagauguggcuaugccaggggacaucugaguaugugcccagucaucuuuuuucacagguugaagggagagaaaagauuuugaguuaaggucauuggcugcucuacucuguccccuaccuggucaccuagugauagccccaguggagauacuguccauacaaggucuucccagaggcuggauaccacaguaaaaggccaggccaggagggguaggagacuauggagaucuuaccuccugauaaaugugcuacacccccuaaucugagcccuuccuuuccguguuccccaacaaccucaugcuuacgugauuuuuauucaaauuaaaaauuuucauugcuacagaaauc

SEQ ID NO: 192586 - RNA, 145752 nt, Homo sapiens
uuagcccuaggauuugguuuuacagugacauaaauaguacaagccauuugggaucaaagucucccccauguacuggacacagagcagcauuaaauaguucaucuugcaaaaugugcaacaauggcuguauguuagagaugucuguuaaacauauacacgcaacggauccaucugcuuguuggauuggguuuguuuuuuguuguuggugguguuagucaauuaguugguuguuucccuacccagaagguguaugaaggacuuuuaagaacucaaagaauuguagccgguauggaacucuuaccauuuucuccaaauacagugaacggugcagggcuggguccuguccaaaggcugacccagugcaagggacuagauuaguaguguccugugguguauggaucucaugcaugacuucugaucacggcaugccaucaugcaaaucauuucuacgcauugaacgagcacaauguuuggaaucggccugagcaaguccuccucagccugaagaaaccugauuguuuucccccacccaucuccaaaccacgugaagcccauguggagaagaugcgcuuuaugucaaagaaacugacaauuaaaugacaugggcuaaaugugaguguguguguguguuuucuuuuugcugcuuagcuuaacuaauguaagaaugcaaauauaguuugcaugaacaaacgaacuuuuaaagugaugcuuucugcuucugagaaucaauaaaaugaaaaaauaaaauccauuuggcugcaacggaaauaugcuggucccggcagccucucuucuguuucuguaucugguuaguuuuguccuaaguugcauugacugauguggaacaugcaguaaccaccugcccaagcauuagaaaaucuguaagucuagggagcgggguccuuugcccuuggcaggucacugcucaagaugcagcuguguuacgugguaagcagacgacguuugguauagaucuucagguuagagucuccacagcuguucugcauugauaauauucaggaaguuuguaaacaaucuuucacuugcgaguuuuagaucuguauaauacugaauuuuuguucuccucuaacacuuggauucucugaccucuuuuugucuuuuggcucuuucccuucuuccuuccucugcccgcugcuguuucuccuuuucagguuuaguuacacugucauaggacgggagggaggcuguagauggggugcucucuuuuuucucccggugugugccuccauucuccagcuuauuagaaguugucuuuuugcagaugaagccccgccuugccaaauguccccgguaggcacgcugcaggaccacugcagauaccuccuccugcuugcgacgcagugugguugugauuggcucguaagacacuuuggaaggauuggaugccacgaaccgcucuuccaucugcugccgcaggauguccaacuccccgcuaucucccaggacccgcuuggugaaggcaaaaaggauguccaagcaguggaugcgauccccgcucaccauuggcagauccauagcgaugagcucaaugguauugggcuugggcacucggagaggaugcuccaaggcaucugcaaagucugccagcuuacaguacucaaugaacuggguggcaucggggucgaacuucucccagaucucauagaaggucucaaagucauccucacucagagggucugcacuuuccucuguggcuacacugaaguucuccaggaugauggcaauguacauguucacgacaauuaggaaagagaugaugauguagcuuacaaagaagaagaugcccacugagggguucccacaaucucccuuaaagccacucccuggguguuccuuaucuaggcugcagucaggggggcgguuuaggaugggcagcagcaggccaucccaaccagcugagguugugauuugaaacaggcagaucaugcuguugccaaaugucucaaaguugaacaugucaucgauaccagccucgugcuucacauaugcaaaauuggacaucccaaaaauggagaagaugaacaugaccaggaagagcagaaggccgauguugaacagggcaggcaaggacaucauuaaggcaaagagcaggguacgaaucccuuuggcgccuuugaucagacgcaagaugcgcccaauacgggccaaucggaugacucggaauaggguuggggaaacaaaguauuucucaauuauaucugccaggaacauuccuaagaagaggaauagaagaaguuauguuauugagaugggagacacccuuucucuuuauuuuuuuuaccuggcauuguggaacccuuagguucaaagggcuuugcagaauaagugccuuacuauucagucugaacucucaaaaagugacauuuuggcugggcaugggggcucacgccuguaaucccaggacuuugggaggccaaggcagguggauuacuugaggccaggaguuggagaccagccuggccaacauggugaaacccugucucuacugaaaauaaaaaauuagcugggcaugguggugcacaucuguaauuccaguuacuugggaggcagaggcacaagaaucgcuugaaccugguagguggagguuguaguaagccgagaucgugccacugcacuccagccuuggugaaagaccaagauucuugucucaaaaaaaaaaaguaacauuuuaaacauauagaaaaguaaacaauaaaauagacaccuaugugccuaacacacauaacuaacacacacauuugucuuuugauguuguuguuuuuuguuuugagauggggucuugcuauguugcccaggcuggucuugaacuccugggcucaagugauccuccugccucagaccuccugaguaacuggaauggaacacagauuuaauagaggcuagcauuuuaccaauuuuucuuccucuuucaucauucccagaugaagcauccacaaugcugaagaugguauguaucauucuagugugugccuuuauagauuuacuauguaagaaucauauauauauauauaauuuccuacuaugguuaggaaauuauacuguuucugucuuauuuauuuauuuuaaauauuuuguagagaugggggucuugcuauguugcccgggcuggucuugaaugccuggguucaagcaauccgauccucccuccucaaccucccaaagugcugggauuacgggugugaacugccacauccaggcuguauuugucuuaugagguccaucuauuuaggucucuaccuuguuuuugagauuuaacauuacaauugugagacugaucccucauguugaaauaauuuuagauuacucauucuaacaauugagugguagucccuuuuaugaauagguccucauuuacuuguuuuucuacucaagaaugauuagguuuuuuuuccagauuugugcacauaugauuuuccaagaugauacugauacucuccacaauggaaucaaauuuccauauccacaaacaauaaaugagagguccuggcuacaccucauaaccucauuauccuuuaacuuugaugucuuacuuauucucuaaugcuagcaauuuucaaaguaucuucuucuuugcucugaaaaaacaucuuugguuucccauagcccuaccucccuagucuaccaaacuagccuagaaaacuaaagggacucucaggagugacuuucaacucugagcugauagauuuugugcugcaagucgugaaucagaaaccaguaucaggcugggcgcaauggcucaugccuguaauccagcacuuugggaggcugaagugggcagaucacuugaggcuaggaguucaagaccagccuggccaacauggcaaaacccagucucuacuaaaaauacaaaaaaauuagccaaguguaauuccagcuauucaggaggcugaggcaugagaaucacuugaacccaggaggcagagguugcagugagcugagaucacgccacugcacuccagccugggcgacagagugagacuccaucucaaaaaaaaaaaagguacaaaaauuagcugggcgcgguggcgcaugccuguaacccgagcuacucaggaggcugaggcaggagaauugcgugagccugggaggcagagguugcagugagcugagaucacaccccagccugggcgacaggcagagacucugucuuuaaaaaaaaaaaaaaaagaaaagagaaaaagaaaagaaaccaguaucagcagguaaagaugccaaggcauuaggauauaaaggcagaaggugaaaguguacaaaucggagcgccuuuuucuaguuauauucguccagggauucaccucaaccaggccacuuguucuuuaaagcuacagagcaaugaggggacccaaaugaggggccacagaaggaagggaguugaaaagucugggaaaugacaaccgaagggaaggcacugacauguucucuucguucaguaccuucucuugccguccaggcacuaacaagacaaugggagcuucagcugacaugagggauuuaauuuaaggaaacauuucucacucauaagaaugcauaaacacuggggcaguuaacugcagaaggcuauagaauccccuuugaagaaucuuagcuuuucaggaaaagacaagaugcgguaaguucagcgagcgggucaaguaaccucuuggagccucuucaggagcuagaauuccaugggauauuugagccuucaagaaaaucucuaccuuagccaggacccacccaugaugauuucucagcuucucaauuaaaucauaaccagugaccaaagaagucagguuauauaauauauauucaaguauaugugauacuugcagcccauauauggugggcaaguagggcuucagagagaagaugauggcugagguagguuuugaaggaugaauguguguuuguccccauagaaaaagggagaaauggggcagacaguaauguaggcaguagaaacaccauuuaagggguacuguaggugguuucagagcuaguuuuaccccaauuccuugugaugguuaauauugucaaccugauuggaaugaaggaugcaaagcauuguuucuggguguugccagaggagauuaacauuugagucuguggacuggcagaggaagacccauccucaaugugggugggcaccaucuaaucggcugccaacucggcuagaaaaagcaagcagaagaagguggaagaagcugacuugcugagucuuccggccuucaucuccucccgcgcuggaugcuuccugcccuggaacaucagacuccaaguucuuuggcuuuuggacccuuggacuuacagcagugguuuuacaggggcucucgggccuuuggccacagaccaaaggcugcacugucagcuucccuacuuuugaggauuugggacucagacugagccacuacuggcuuccuugcuccucagcuugcagauggccugcugugggacuucaccuugugaucaugugagaucacaucuauccuauuaguucugucccucuagaaaacccugacagauuuugguaccaggagugggucuagaggaacagaauuuuaagaauagauuucuuuaguugguuuugggguuucuggaguuggcugcuuaaucugauuagacccaaaaaugcuaaggacucuacuucugauaguauggagaacacugauagucccuggugugaacuguuuagagaguuaugcaaaauagauggcauuugauauuccugauucgucguucuugagaggcaaggaguuuagugacucuguacguaauacauuugaccauauguggagaaccaaggaauauaaugaaguugguugguucuccuaaguucacuggagaaaguaaugaaagaaaaggaugagcucagggauucuaacucccagcuccagagcacauacugagccucaagucuucuaagauuucccugagucuuaucuccuguagacaaagggcugaauuugcggaaaaucagacacaaguucuuaccacgcaaguggcuggccugcaaggaaaggugcaugcguagccucccuagguaucuauuguuaaagugagggcacugauuggaaaagaaugggacccugcgacuuggaauagggaugugugggaggacccugaugaagcuggggacacugagcuuguaaacucugacagccuuuuuugccagagaaaacagccuccucacccccagugguggcaauaucccuucccccacccaggcugccaccagccuuuccacauuugucugagauuaacccugcaaugcuugaggcaacaguggucuccccugaagcaagacaaugcugauucucuucugaacccacccccaacaccccuguuuguuucuagaccuguaacuagacucaagucauggcagcucucuagaagugagguucagagugugacucacgagaugagcuacacuccaaaagaacugcuugaguuucuuuuuuuuugagacagagucuugcucugucacccaggcuagagugcaguggugcaaucuccacucacugcaaccuccaccuccuggguucaagugauucucgugccucagccuccggaguagcugggguuacaggugcaugccaccaugcccggcuaauuuuuguauuuuuaguagagacgggguuucaccauauuggccaggcuggucuugaacuccugacgucaagugauccgccccccucagccucccaaagugcugggauuacaagcaugagcuauggcgccuggccugcuggaguucucuaauuuguauaagcagaaaucuggagaacagguaugggaauggauauuaagguugcaggacaacgguggaaggaacauaaaguuggaucagguugaauuuauugauaugggcccacuaagcagggauucuguguuuaauaucgcagcucggggaguuaaaaagguucuaauaguuuauuugcuugguuagcugaaacguggaucaaaagauggcccacugugaguaagcuggaaaugccugaucucccuugguuuaauguagaggaagggauccaaaggcuuagggagauuggaaugcuagaguggauuagucaccuuagaccuacucaucccaacugguaggguccagaagacauacccuuaauagcuugcaaaacagauuugugaggggagcaccugcauccuugaagagcucugugauugcucuucccuguaugccagaucuuacagugggaacugcagucacuuaacuggauaauuuaaaugcaaugggaauaauuggaucccaagguggcaggggcugagugggggcacucaacugucaaaggcaaggugggcguagcuaccauaauggauagcagaggcaaagcagcauucagaauagucugauuaguguagagcucuggcauuggcuaauuaaucaugguguuccuagaagugaaauugauaggaagccuacuacauucuuucuugauuuguguaagcagaaaacuuccaggucaaguggacaaaaggcuaauuugaauuauaaaaauagagaaucaugcccccucaaccaauuuccagacuugaaccagcguacagacccagaauaauauuccccuugaauaaaggggaggccuggucccuuugaggaaggaccccacuacacuacugacaauuuauacugcuaaucuuucucccaugcuuccccaaggagaccuccggucuuuuaccaggguaacugguccccuuucggggacuacuggacacuggacacuggcucugagcugacaaugauuccaggggacccaaaacaucacugugguccuccaguuagaguaagggcuuauggaggucagauaauuaaugaaguuucagcucaggucugacuuacagugggucccggauucauccuguggucauuuucccagugccagaauguauaauugacacagacauacuuagcaacuggcagaauccccauauuggcugacugguagugugaggccuauuauggugggaaaggccaaauggaagccauuagagcugcuucuaccuagaaaaacaguaaaucaaaaacaauacugcaucccuggagggacuguggagauuagugccaccaucaaggacuugaaagaugcagggguggugauucccaccacauccccauucaacuuuccuauuuggccugugcagaagucagauagaucuuggagaacgacaguggauuaucauaagcugaaccaaguggugacgacuccaacugcagcugcuguaccagaugcgguuucauugcuugagcaaauuaacacaucuccugguaucugauaugcagcuacggauuuggcaaaugccuuuuucuccauuccuguccauaagguccaccagaagcaauuugccuucagcuggcaaggccagcaauauaucuuuacuguccuaccucagggguauauaaacucccuggcuuugugucauaaucuugcucgcagagaucuugaucgcuuuucccuuccacaagauaucaugaugguccauuacauugaugacauuaugccgacuggacccagugagcgagaaguagcaaacacacuggacuuacuggugagacauuugggugccaggggaugggaaauaaaucagacuaaaauucagggaccuucuaccucagugaaauuucuaggggcccagugcugaggggccugucaagauauuccuucuaaggugaaggauaaguuguugcauuuggccucuccuacaaccaagaaagagucacaacgccuagugggccuauuuggauuuugggggcaacacauuccucauuugaguauguuacuccggcccauuuauugagucaccugaaaggcugccaguuuugagugggguuuagaacaggagaaggcucugcaauagguccaggcuguugugcaagcugcucugccacuugggcuauaugacccagcagauccaguggugcuugagguaucaguggcagauagggaugcuguuuagagccuuugguaggcccccauaggugaaucacagaggagguccguaggauuuuggagcaaggcccugccaucuucugcagauaacuacucgccuuuugagggacggcucuuggccuguuacugggcuuugguggaaacugaacguuugaccaugggucacccaguuaccauguggccugaaccgccucucaugaacuaggugcucucugacccaucuagccaugaaguugggugcgcacagcagcauuccaucgucaaauggaaaugguaugcaccugauugggcucgagcagguccuaaaggcacaaguaaguuacaagaggaaguagcucaaaugcccaugguccccacugcugccacccuaccuucucucccagagccugcagagauggccucauggggaguucgcuaugaucaacugacagaagaagagaagacuagggccuaguuuacagacgguucugcacgaaaugcaggcaccacccaaaaguggacagcugcagcacuauagccccuuucuaggacaucccugaaggagagcacugaagggaaaucuucccagugggcagaacuucgagcagugcaccuggcugugcacuuugcauggaaggagaaauggccagaugugugauuauauacugauucaugggcuguagcaaaugguuuggcuggauggucagggacuucaaagaagcaugauuggugacaaauuuggggaagagguauguggauggaccucucugaguggucaaaaacugugaagauauuugugucccacaugaaugcuuaccaaagggugaccucagcagaggaggcuuuuaauaaucagguggauaggaugacucauucuguggacaccacucagccucuuuccccaggcaccccugucauugcccaaugggcccaugaacaaagugacuauaguggcagggauggagguuacgcaugggcucaccaacauggacucccacucaucaaggcugaccugguuguggccacugcugaguguccaauuugccaguagcagagaccaacacugagcccucaauaugacaccauuccucggggugaucagccagcuacuuggugguaggcugcuuauaucggaccucuuccaucauggaaagggcagcgguuuguccucaccagaacagacacuuacucuggauauggguuugcuuauccugcaugcaaugcuucugccaagacuaccaucuguggacucacggaaugcauuacccaccaucaugguauuccacacagcauugcuucugaccaaggcacucacuuuacagcuaagaagugcggcaguggguucaugcucauggaauucacugguguuaccauguuccucaucaucuugaagcagcuggauugauagcaugguggaauggccuuuugaagucaugauuacaaugccaacuagguaacaauacuuugcagggcuggggcaaaguucuccagaaggccauguaugcuuugaaucaguguccaauauaugguacuguuucucccauagccaggauucauggguccaggaaucaagggguggaaauggaaguggcaccacuccccaucaccccuagugaccggcuagcaaaauuuuugccuccuguuccugcgacauuauguucugcuggccuaaaggucuuaguuccagagggaggaaugcugucacuaggagacacaacaaugauuccauuaaaccugaaguuaagauggccaccuagccacuuugggcuaccucuaagucaacagucuaagaagggaguuauaguguuggcuggggugacugacccagacuaucaagaugaaaucagucuacugcuccacaauggagguauggaagaguaugcauggaauacaggagaucccuuagggcgucucuuaguauuagcaugcccugugauuaaggucaaugggaaacuacaacagcccaauccagguaggacuacaaaugccccaaacccuuuaggaaugaagauuugggucacuccaccagguaaauaaccacaaccagccguggugcuugcugaaggcaaagugaauauagaaugaguaguagaagguagucaucaauaccagcuacgaccacgugaccaguugcagaaaugaagacuauugucaugaguauuuccucauuuuguuaagaacauguuugugcauguauacacuuguacuaggaaaauaucuucauuuuaguucuuuucuuuuuccuuuaucaugugacguaagauuuguugacuucguaucagcauuuaaguguuguuaacuuuauguaauagcauucagguuaaggauuagugcgcuucugguuguaugaaggauagcuguauuauguuaggcguaauuaggaccuuauuauuguauuuauuuggagauuaaguaugauuucaggagauguguauggguucaaguuggcaagggguggacuuguaaugguuaauauuaagugucaauuugauuggacugaaggaugcaaaguaucguuucuggguguuaccagagauuaggcuggugcaaaaguaauugcaguuuuugccauuacuuuuaauuugagucaguggacugggagaggaaggcccacccucaaugugggugggcaccaucuaaucggcugccagcucagcuagaaaaagcaggcagaagaagauggaagaagcugacuugcugagucuucuggccuucaucuccucccgcgcuggaugcuuccugcccucgaacauaagacucugaguucuucagcuuuuagacucuuggacuuucaccagugguuugccaggggcucucuggccuuuggccagaccaaaggcugcacugucagcuucccuacuuuugaggauuugagacucagacugagccacuacuggcucccuucagcuugcagauggccuaucgugggacuucaccuugugaucgugagucaguucuccuuaauacacucccuuucauauauacaucuauccuauuaguuuugucccucuacaaaacucuaauacauuucuuacuuuaaaaagaugauuucuauacuuuuguuucugaacaaauuaauguuaauaaaaauccccaucaucaaaaacaucuuccucuuuuuagaguaccauuugaaaauaggggguaugauuuggucuguggauuuucugugucacucaacgauaaguggccaggaaaguuucaagagcaguggacaaggguagcauuguccaaaguguguuuugugagaaauuaggagaauggacuugaggccaggggcugggcuugaauccccacuugcucacuuaccagccacaugucuugggaaccucucugugccucaguuccucaggauucuuagagguuuguugagaggauuauaugaauuaacauauuuaaagcacuuauuaugguaccuggcacauaauguguuccauuuaaaugugagcuaucauuauuauuacugaaaaaaaggaaacuggucuaauaaaggugggaugcuauguuacauuuaaacagaauucuuuauuuuugagacuaggucucucucugucaucuaggaaguguaauggcgugaucucagcucacugcagccuugaccucccgggcuuaaacaauccucccaccucagccucccaaguaacugggacuacaggcacguaucaccaugccuggcucauuuuuuuuuuuuuuuuucagagauagaguuuuaucauguugcccaggcuggucuugaacuccugggcucaaguugucugcccgccuugccucccaaagugcugggauuacaggcacgcgccacugcacccggcccagaauucuuuaccguaggauuuccaagagaauucaguaaugugcacugugaauccucaaaggaaaauuaaaggcaguguuaccuaaaguaauucccucaugagauucuuuucuugaggagaaaugucuaggauuaguguuccacauaucaacacacuuuuggacaugcugcucuggaggacagaacuagaggguggcacaggccaaggggagaccccugccuucugguaccuuauaaccacuacacuaggcccagcauggccgcuggagcucuggggcuggucccaugggucucgagcacucucucuaguguaaaugagucaaacuuaccuggaaacaaggcugaguuuuaucacaaaagaugccuuucaggaaggcaaggaaacauuuugggagggcaaucaacaggguggcauuuccuucugccugccugccaggacaucauccccccacacuuuuagguugaagcaaaaugcacacagucacuguuaaaaaacuuggacuuugggaucaacucgaguuaugccuccaccaccuccuagcgaguggcuguggacauguauacaguccagauaauaaagaagcuugcuuccugggauguaauaagaaucaaaugagauaacacaggugaagaaacucucaaacuguaguuggcccacaguaaaaucucaguaaacaagcccugccaguaacagcagcacuaccauggccaucaccaccagaacuuaccuagacuauuucauuaauggccaacuuagcaaucauuccuucuuucauuuuauacuucuauugugcuacauuuuuuaaugacaacuuucuuuuaccuucccuguuagacuuuaaacuccuuaaaagcaagaaccaaucuucuuuuuuuuucuuuuuucccugagccacagaauuuauaauccaagacuaccgagaacacucaguagaaacucacugaccauggaaccugcuaggcaggcccccgagaugacucaggggcacacauggacuuaagcuaugaggguaucuugccugcacuucagaccugugucauucauuccucuccugggaaaucucauccucacaaucagucagguccccuuuccccucgccuacuuccccaaccccacucacccacaauggagaggaugacuaccacgaagucgaagauguuccagccaauggugaaguaguagugccucaacgcaaacauuuugagcacacacucacaggugaagaagauaacaaacaccagguuaauccaguagaggauguucuccaucugcuugcuuugagugucugucuccaccaucauugucaccauguuaaggcagaugagcaucaugauaacaaugucaaaggcuugcugagugacaaaaucaaagacgauuccuuggauuuuguucuggggaggaagggaaggaaaagauaaaagauucaugaaaaccuuuccaagccaaccuauggaagcugucacccugcuaaucgagguacccucucccuccuuuucuguaauacuggucagcucugcugcucuaucaggagcauggauggagaccaacaucaauauuaccucaccaagagcuuuccaaaguuaccagcuucucucuguuuucuguuuguuuuucuugagacacagucucauucuguugcccaggcuggagugcaguggugcgaucuugacucacugcagccucugccuccuagguucaaacaauucucaugccucagucucccgaguagcugggauuacaggcacacaccaccacguccggcuaauuuuuuguauuuuuagcauagacgggguuuugcuauauuggccaggcuggucucgaacuccuggccucaagugaucugucuuccuuggccucccaaaaugcuaggauuacaggugugagccaucaugccuggccuuucuuucuguuuuuagagacgggucuuacuguguugcccaggcuggagugcaguggcuaugcauaggcgcgaucauagcacauagcaauucaaacuccuggccucaggugauccuccugccugagccucccaauaagcugggccuacaggugugcaccacuauacccagcugacccacuucucuuuugcgucugugacaccacacacucuggcugucguccuacuuacccagcugcuccuuuuuuggucucaucugccagccauuucuucucucaaucccuucuuucucuaaauuuuugcucuaugagagcucaucuauuccugcugcuuacgugauaccuauguacuuaugcuuaagcuuuucuucuccagcccauaccuuuccucugauccugaguugcuuucuugccacuucuucuugaugacucauaagcaucucaaacuuaccauguccaagccucucacaguuaaguccaaagcagagccaagucuguucccugccccucacccagcuuguuccucucaucucaauuauucauccaggcucucaagccaggaaucugggcaucaucuuugucucuuucuucucccucaucugauccacugaagggccuguugauucuuccuccaaaauuauaacuuggguucauccacuucauuccauuuuuauuggcucuaugcuaaccugagccaccaucaucucucaucuggacuuguauggccacuuaacuggucucccacuucuucucuugcccucauccaaugcaguccucauauaauagcaaguguaaugauuuaaaacaaauggaucauggccaggugcgguggcucacgccuguaaucccagcacuuugggaggccgaggccucccaaaauugaucacuugaggucaggaguucaagaccagccuggucaacauggugaaaccuugucucuacuaaaaauacaaaaauuagccgggcaugguggcaggcgccuguggucccagcuacucgggaggcugaggcacgagaauugcuugaaccugggaggcagagguugcagugggccgagaucacgccacugcacuccagccugguuaacagagagagacucugucucaaaacauaaaacaaaaaacaaauggaucacaucauuccccuacuuaaaaccuuucaagagcuucccacugggcuugcaacacaaucccuauuuguuaaccuggcuuacggggagacaccuggcacagucugacucugcucaucaaugucccuccucuggcucgccacccccuggccacacuguuuucugcuucuggggucuuguguauucugccaggaaucucuuuccccagcucuuugguuccaucuuuuuuuuuuuuuuuuuuuuuuuuugagauagggucucgcugucuuccccaggcuggagugcaguggcaugauauagcuuaccauauccucugcagcccugacuccuggacucacgccauccucucaccucagccuucucaguagcugggacuacaggcaugcuaccaggcucggcuaauuuuuuuuuuuuuuuuuguacagaugggguuucacuguguugcccaggcuggucuagaacuccuaggcucaagcgaucugccugccucuagaucccaaguugggauuacaguaugagcuaccgugcccagccaguuccuucucauccacucaaguagacccuccuuagugaggcuuucucugacuacuauauuaaaguagauccaccacuuauagcccucuaguuaauuuuuuuccuacaaucuuccacauuuuauuguagcuguuugcuuacuuauuuauuaucuaucuccccaacuauuauaagcuccaugacagcagucuaccuuuuguucaucacauaaugcuuagugcacgguacauaguaaagacugauaaauauuugcuaaaugaauguuaaucacucuuuauuaauguuuccuacuuuuuaaaauauuuuauuuuauuuuguauuuuuugagacagggucccucccuauugcccaagcuggaguacaguggcacggucauggcucacugcagucuuggccuccaagcucaagcaauucucuuaccucagccuccuacguagugaggaccacagguacacauaaccacgcccagcuacuuuuuacaaaauuuuuuuguagagauggggucucauuauguugccuaggcuggaaguuauauuuuaauguggaagaaaauacacucagguucccauauggaaaguacuaaacagaacuuuagaaauguuaacccuuuucuauucccuuuagucccauuucuaucacaaaaugaaggcuuaacaucaaggaaauaaaaaaccccaaauguucucuuucuugagauuccuugcuuuuuuguuuguuuguuuguuugaaguacugagauacuugggcuggugcuuauuuccaggauuacuuuaacuuggugguuuucaaucugcccugcaaagcccuagaauuucuuuuccuucaaaaguugaugcgguagauguaccacgugcggcgugugggggugaggggagaaaacguucuggaacuauaacucuugauucaaacauagucacucuacuuuuauuucuacaaauuagauuaucagggaagcuuuuguauuaaagguucugcuggguuuuuuuggugguguugugucuguuuuuuaaaguugcuaaauggaaguuacagaagaaggaacuuugggccuggcuuuugggggugaugucccauccaaccggauauauggaaucaggagcaggguaucuccuucuccuucucugaaacaagacaaccaucaccaauggaacaauggagcagaaucucagcccccuaaucuguuuuauaaaaggcucagcucaagagaggcaaucagggcaccagacucccauaguuuuacccucuucugcucccacaaauaaccagaagcaugauuuuaacuucuagauacauccugcaaagacauccuuauugagcagagagaagcugaaaaaauuaugaccaaauccuaucuugaacuggcaggaaagagagcaacuuuauuucauuuucucuuguugacuuuugguugucucuaaaaacaucucucuacuagggccaaagccaaugugguucacaugcugauucuugguggcugcccaaggaaggcucagaggauaggucgaggauugauguaaaagcccccaugccuuaaucccuguucuucugcuguccuauucagaucuuuuggauggguggugaggagaggauuaggcacaaagcagccaaucacuuaccuuuuuccuuccuuugcaguaacucuacuaguacuuuuccuauauggguucucaccaaggccucagccugcacaaugcacuuaccaaggggcggggaauagguuucuguggcuucuuugagcccagcuuuuucauggcauuguaguacuucuucuguucuucggucaugaagauguccugaccuccgaaguaaaggagggaagaagaaaacagacaauuacaacuggcucucaacaugcuauggguuuggaccuaagguucaauacugagaacugaggggagaccuaucccuuuccuuuguagcuaauagcugucccagagugggguagacccgcgauaaucauucagcucuaaagagauaccugccuuuguuuuuagcucaggauuucuaagaucuuccagucccaagguagaaaggaaauggacuauccaauuauagacccucagaaaggguaaacuugagagcagugacucugaaggcagucauaucucagagucucauuuucugggggccagcuuuccugauacauucuagaaaacacauuuuagaauaaaaagaucuuuguguccuggcugauagccaauuuauuuuagaugauacccaaaauuuggaaauucuggugcaagaaagcaauuuggagggugucuuggaguaugcugggauagacuugacuuacaaaaugagcaacgagcaauuuuuucaauuugcuuuguaaaacuuguuaaccaucuagaacaaguaaggaaguaaacuuuccaaaggugggucucucaaaucccaauuugcuugugcucagagauugacuagauaaucacaagucuagacaguuucuacuucuugcgauagcuauucaucuguuucuuuccuuuucaucucuguugcucgacugcacucucugaccuaccugcuucuggugggagaccaagaccaguaauaggccucaagaauaaaagacugcuaguaagugugguaaacuacaugcugcaaaauccagccccgaacagaaagaguggguuggggcuaacguaugggggccagggucacagugagcuaacaauauagauuuuagagaaagaaagagggacauuuucuuucuagagauagggacaaaggugccucuuaucugggcugacuuccaaccacuggcaaugaggggaggagaccuaucuuuuucuuuuguugauugaaguuaucaaugaugacaccaaugaacagguucagggugaagaaggagccgaagaugaugaagaugacaaaauagauguacauguagauauuguccucauacuuaggcugcucaucaggcugucaaaggacaggauaaaaggaagagaaucagcuccuaguuuggaguuugacacgccaaggccaucagccguaacugugaccauuugagcugcuaaacaucuuggggugggagagcccuagauucuuucugccugccuccuucucuacacuggcauggccugccuugagaggacacuagucguccucugacucauguggagaacaugcaaaucaugaggccacagggagggagggcugucugcuaggagccauacuuuugcuaugaagcaggauugaagcauagacagcuucacuggggccacguaaaaaaucaacagucuaaucaucgggggccaauguaagagagugaugacuuacugagacgaggaaaaugaucuauaaucaauaacacaagcaauaaauguuccaaagagaaacgucaacuccuccauuccuucaucccuuccucuuucuuggugggcucgguauaccaugcugcuugcuuuccagccaucugagaaggugguauuuucgccauguacauccuuaccuuccgggaaucuacagcugcauacaugauguccauccagccuuugaagguugccuggcaaacagagucagucauuagacggugccuauaaagggaguggaugggagucuaggcaggggucccaaaggccaggcuuagguucagugagaacacagaacagggguuugggugcagccucccuuggacacagaauuuucuguuuguuacuacaggucccaggagggcuuuguuccugaaaauaacaacaaaguuuggcaaauaaacauguugaaaaugguaaugggauuaaggcuuuacgaaaggacucaaaaacaugggccugagaagccugccuaaaguuagggaaaacuuuuaugagugaauggcaggaaucuacugaaaaugcuuggaacuuagcauuccauuccacugaggaaucauuuuuuaaaaaggugguaagcaaaaaaaaaaaaaaaaaaaaagguguuaagcgauggggguuggaaaaacucauaguuggauuuaacagaaaaacaagaucagacuuacccuuuacuaauauacacauguauagccuauguaguagcaauaccagcuuuauccuugacagucccuucccaauucuacuccuucagucuacuauaucuagacugauuuuggaaacaaauauggauaauccauguacuauucaccguguuuuauguacucaaccagauucuaagguuuuuucagggcacaggaaggucuuuauucaucugagggcccuaguacuguacugucaagcacagcaucuugcauauggcagggacucugugacuaccauguuugacuggcuuguggaugugcacugguuuucuggagaugcuccaaugcggauucaauuuguggguccaauuuuuugaacugggauacaacagcaaaaaagcuuugggguaggaaaaacuacaguucauuccaugaacuuugccuucuacuaugaguugacagugagugcuuacuauauguaagguuagguugagagcuucaucuguuauugcaguuagucucccaagaacuguaugauauaggcauggaaauauaguaacaaaaauacuuaauagcaauuuucauuaauuaagcaugguuauaugcugggaauugugcuaagaaauuuuuaaaaaucacaaauccucuuaacaaccaugcaaagugucauuaucuauauuuaauagaugaagaaacagagaaucagagaggcugaauaauuuguccaaaguuacauauccaguaaguaucagaguauguucaaaucuauaacagucuaauuucaaagccuacgagcuuucacugcauuauguugucuugucacacauucugaaacacuggugagagaggcagugaaaacuaagcacgaaagaaugaaauuaggcaaaagaaaauuaucuagauaguuaaauccuuccuuacugugauacauuaaucugauaccuuucucugggguggagcugaggugaguguggcaccaaggcacugccaugguuuuuuccuaaguuaacuggaguguggugaguauguacuauuauuuugcuccaucacaauugccauuacuuuuuugucuaugugcuuaucuugauuuuuuuugcccuuaacugcacucucugaccgggaagggaagaugaucucucugccacuuuauuacacugcaggaaucuuuauuuguugcugggcacagcucuguuccugagcacaaugagagauuuccuuugagugagaucuuguagaagucagagaauacucaggaaagguaucucucugaaacugguuuggggaacaauacuguuuucuuggacuuauugagaauaauccugauucuagaaguaggguugagaagaagccaaaugggauuugugcuagcugccugaauuucacagaacugaaaaaacaaaaacaaaaacacuacuuacuacuugaagaagggccagguauccugccccaacauugucaaaguugaucuucacguucuuccaucugaucucuguauuguuccccuccauaagcuuuucacauucaguuuuauuguugacaucuucaauuucaaaucggauuucagaagucucauuaaagcaguagugguacuuucccgcaaacaaguuaacucccaugaugcugaaaaucagccagaagaugagacacaccagcagcacauucaugauggaggggauggcgcccaccaaggcauucaccaccaccugcauuggaaggggagguugcucaguguuggguggaaaugagagcaagcacauuuuuugauuuccaggaggggaaugacauuguguggcuuguucuguauggaaacauuacauucccuuuggaauuagaguaacuggacagacugacaaguaggaccaaaaauuucuaagucuaggacuauauugaaggaauuuuaaaaaguuacaccuuuauuuugacuaacacaaauuccccagccaagcugaccuaggucuucuuuccuaugcaucagccugggacugaaaaauuauuucuuaguccagucucccucuuccucaauucauaaaauaugcccaaugggaaaauaugaguaacuuucagcuugcuaguugccuuucaacagacauucccccucugaaaaacaagguauaauuguucaaaaucacagagaacuacccguugugguuaauagagagccaguuaacaguacauaaugucucuuuuaugacuacgcaaggccaguuauuuuauuucaggcaauagcugagcaugcauauuuugcaggcucaagaaaaaaaaagcuauauucccucuaccaaacaguauaaaauaaaaucugaacagaugugcuuucacucaagguucauuauacuucuccagccuuuuuauucugacuuuguaggcuuuuaaaucagagucgcucccugcuuggcuaaugcugucgucucucugcucauuccagggcuugacuccacucaucacaguguauuagaaauagggaugacuuaagguuuuuaagagaguuuuggguuagaucauuacugcucuugaaacuaaaaaaauuggcauauuguuaaaaagucacugacuacaguaagcucaggaauaaaaaaaaagcaaaagaaaaaaaccccuuaggaaucaaaguuucuggguuguuuucaacuuugauuuugcuuuacaguaucagucagagcagcacacaauuuagaguuuaggguuuccuuaucuucugguuuugccuuagacugcauugucacucaucaggacauguggcugaucagagcuaccuguucuaucuuguguaaaaaaugcaaugauauucuucugcuaaggagucacucuuccuuuuagauuaaaauauucauuuuguguuucuccaauucauauauuagggccuuuagacugagaggcaguuauuucuuaauucuuagaccaagaaaucucuucuagaucugacagcucugucauuaaaguguuuauuacuuuguuuauuaaguugagcaaggaaagccaggauaucugaaaucuggaaaaucuucacuuuuuuuggagaaugauauucauauuuauuuauguuaccaaauuugucauguacccagauuugaauuuaccuccucauucuacaguugcucacccuuuggcgggagcaccaaaaagcaaugaaaugugcaaaagaacaggcaaaaggaggaugauccacaaauggaaaaauaauuucucaaacaauacgggaguagauuagguaaagauucaaaagcucaagucuaugugacagcauuucacagcagaccuuaggugggagaucgugacuuucuguuagaccauuacaaauguggcacaggaaguaggccccaaagacuugaaaccaaggcaugcugcuuuuuaaucucaauucagaaccuacuuccuccaggaacucuucugacuaugcuucuacucaaacccagucuaaccugucccacauacuauggguuacaguuaaauauggguuaauauuuaccauagggaagaaacauuaacgugaucucuuugaacuuuuauucucauaaaguauauagaaaauuuuacauauugauccauuugaucaaaugaaucaauauacaaaaauauucagagccuuuuucucugauaugauauaaaauccuauaaaauccaaaguuuuauaagaugcaaauguacuuuaaucauaaccagaggaaaacuuuuuauuuacuuuuuuugagaaagggucucacucugucgaccaggcuggagugcaguggugcaaucuuggcucacugagaaggggaggcccuucucagguucaagcgauucuccugccucagccucccgaguaacugggacuacaggugcgugcuaccgugcccagcuaauuuuuguauuuuuaguagagguggaguucugccauguuggccagguuggucucaaacuccugaccucaaagugauccacccaucccggccuccaaaaguucugggauuacaggcauaagacaccaugcccagcccagaguugauuaaacguacuaauaauucuuccuugcuuugaacauuagcugauaagcugcaauauguuaagcagaaacuauuuaacugugcuccauauguaaugaucauugugcuguuauucucagcaaccacugggcaagagaucauauuucuuauuuugaacucucacacuaaagauauauuauaaaugauaauucaaauuuccacugguagucacuuaaugaauuugauccucucuucucaaguucucuaguuacucuacauugccuuuaauuaucaugaaaucuauuauuguuaagaacuagacauggaaauaucacucaaagcuagguuuuaguaaucuauaaaaaguuacuuuuaucaauggaaguuuauacuuggcaauugauacaaaucccauuuaauugaugagaaaauuccaauggauauuaauucuuacaguauuuuugucuucucuauaaugucucggacauuauuguugcucaauaaauacuauaaaaucugucagcuggcuuuuaauaucuggcagagggaacauggcuuuaauggacaacuauguacugacaaucaacaaaaaugcaugcauguuucauggcacuaauauuauauacccucaaaaauuuaacagcacagcgaaaucuuuaaaugaagauuacuauggaggagagaaaagcaaagaacuacauuaaguauuccuuugccuauagcacaagugcuucaguuuuccuggucuuugguuugaggaagaagaggagacugaagucagugccccaggacaggcuugggucauaugcucccucucaagcgaagcucugagucuguaauuggagcagcacagugacaguugagcccaucugcauggaugguguucaguuuaugaagauuucuuauuuaaaauauucuaaagguaaucucucaaguguuggcauauagaagaaccaaaaccaaagaauaaaaaaaaaaugccccauagaaaaacaacauuuaaauaaaacauguguaccuaauucuguuuauuacugggggacuuacuauacgcuuagccaaauccaaucuuuucuucuugcaguuacucucccacagaagggcuaggaaacccacagggcaggaauggaucccugaucccuuuucaccuguccaaccagccauggucaauacugucuguuaguuggcuggagucaaucaaaugagguggcacucuuauuccaaagcuucccuuaaugcauuuauuguuuuaaauuccagcuuuggguucaaacuuguucuugaccauauuaucuuaccgaaaaaaaucuugauguagacgcuuuucaaauaaaacaucguaaugcuuuucaaauaaaauuaucuacuguuuugauuauucauucgggaccuccaagcuccuaaacuacuuucaaguugacaaaugaaaguuuuuaggggacuggaaacugaggguccaggaaagguacagaaagaaggggcagcuaaagggaagagguguggcucccaaaacggcuccugcauccagguuauucaaauaacugccucaugagcaaacuggccucagcggccaugaggacugcuucugucugccuggacaggagugacaguaaugagcaucuagauggaaauaguuaguaacaagcgucagaugggucagaugggcauuucuuuuguagggggauggggggauuucuucagguauuaccaaucucuuuuuggaagaucagggaucaccguaaggggaugcggaggagcucaggacaaguacugucuucaguggacuuuuuugguugcaucuuguccucaguuuuucagucaccaaaguggauuaucaacuuuauaacaaaaccaguauaguuuauuaaaacauuuuauuagcucccucuggaaaacaugcaaaggugcagggagcagagaagaacauuuuaaccacauuuucaaucucaccguggcugucuaaaccacugaaucuuguguaauaaacucucuuccuaaauuuagccugagcauagcaaugaccuuauugcgcacauucuaaaaccucucuuaucugugggacaaagucuuaaaaucccaaguuuuuugaaaaauuaaaauaaauuuacacuacuguggaacugcccuuccugcagaugguuucaggagaguugcagaaagcuuacauuuaguacaccaaacugugacugugcuacagaagaaacaugaauuuguugcaaaaagcauuugucuggauaaauuaacauaauaaaauucccaagucccaauuaaguuuucaucuuccuauacaacuguggguggcuucacggaguaacagccagggaucacagaugaggaaugaacguagcagcacuguccugguaucuaguuuuuccaaucggucuugcuucacguagacuaucguaacaguuuaauuuuuauucuuacauucugacguuugcacauuuaaaaauauauccucugguuugcucuccugcauguauucaacaucugaauugaagcgaguuuucuuggucucguuaaguauaacagaccucucucugaucaccacaggacaacuauuaccaccaaagccaguugccccuuugauuuuaagaaauugacuuuuuagugugugugugugcgcgugcgugcgcgugcacgcacgcacacgcacaauuguuuaaaccaaaagagacaagaaaauggcaccaagaaggcaccuuguuucuaaguugguagggugacaacaccuuguauuguuuuggguggaguaucaccaaagcaggaauaggagguaucaagaaauuucaggagaacuagcugauauucagucaucuagcaucauaccugguugucauuuugacaguguuaggggaccauacagcaugggcagagggguugggggugaggaaaaaagcuuugcuaucagacagaggcugccaguccauuugggacugggcugagaacaacaaggugcaauaagaggaaucugaauagaaagaaaagcauuucuucucccagggccaugccaaauucugcuccauccccaauuccaggccugccgucauaucuucaagcccauucucagcugcuuucucagugaccccaaggccacaguccccaccuggcugaugccccuacacagcacucucccugccugaagcuugugcuuuucagugggucuguggguuacaauuccccuucuuugcaccuggugauucucccuauuaaaucaacagcccagaaagccgccccgagugcuacagguaagccaggccaaaugagaauagccaauguuaacauguucugcgauggcauguuguuggggguggggccaauauuaaugugaugaggcagcuuaacgcaauuccccuuugcacggggcaggugugggggagagaguggaggaucaaaucagcagcugcaucacagaauucguguuugaaugaucuuuccaccaugugaucaguucuagcaugcuuaaacaguuuccacuggcaugcagaaggaucagcugcucuuaguaucuuacccucaucccuucaaaucgugauaaggcucuuaagggucucaaagcucuuaggguccuaagggacuuuauggcaccuaguuccgaguagcccagggcauuagcuauaaggcugacuaaagagaccuacacagaaacagaagagaaaaacaaaaacaaaaaagguaaccaaaaaaaaaaaaaaaaaaaaaaaaaaaaaaaaaaaaaaagaaagaaaacagagguuccagaguguuagaauaaagccccuagcacugcagacacagauugggccccccagguagaggaaguggguaacaccagcugccuauuucaacuugacucaaaugaccuggaaggaaaggugguugagaggcagaagaaaaaacaacagggaagagaaaaucgagaaggcgguagaacauacacacaaguuggaaaaggggagaggcugacaggagagggagagagugaggaaguuccacuggaaggagaggagccugaacagacgacaagagccuuacccucgcccuuuacagucucugcaggucccagaaguccccauuaaauuaagccagacaaauuuaaugguaccuauggaaaagaauacagauaaauacacauacuccacacaagcugcccccuccucagcucauucaccauuggcuuuccaagagggacaagcucuuuuacuccugguugacaaaaaaccauuuguuugagaaucugaugcgucacgacauuaacaacaaugaaaacguucaauaaguaccauggcugacuugcaguucccaagaacuguggcuccaugagaacucgcuuaagugaguucuaucucuaucuuuuaaauacauccuucuaucucucacuuuuaacuaaaauaaccuucugacuuuuaacuacaaccaggaccccuccauggccacaagaacuugggugagucuggacaacugaauccacacuuuuccuuauaauucucauucuuuccuuccagaacaguccaaaaugaauuauccucaggucugucauuuccaugucaaucuucuauaacuuuuaucauuagaauaacaguuggaagaauuauuggaaaacaaaauuugauagaugaggaaauugagacccguacacaagaauuugcccaggguuacacuggcaguucugcagccaagauuaaagaccuccacugccugacucccaggccaaugcuuuuucuuccacagacaggucacguccccagugggcagguuacacaacaacauuccaacaggacuaucuggacaauccagaguugaauauguugccguaccagggggaagaagccugcagaccuccaggcuuagacguauggucaaacacuuuccugcucugccagaggcaaacuuaccuuguucuaccagagcucucagagcaguuaccacgaugcuuucucaacaccaugcuaacuacauuuaugccuuccugggccugagcugagaguuacagaauuuuucaggggagagcagaccuaaaaauaccuuuaguuagucaaacuccagaauguuuggggucuggguuucuauuuuuuuuuuuuuuuuuugagacaaagucucacucugucgcucaggcuggagugcaauggcacaaucuuggcucacugcaacuuccaccuccuggguucaagcaauucucccugccuuagccuccugggugaguagcuuggauuacaggcaugugccaccaugcccggcuaauuuuguauuuuuaguagagaugggguuucacuguguuguccaggcuggucucaaacuccugaccucaggugauucgccugccuuggccucccaaagugcugggauuacaggcuugagccaccaugccuggcuggguucuggguuucuuacaacacaaauucuaggauagguuaagauauuuccaucaacagcucuuaaauucuuccuacugggaaguggugguugcauaucagcuuagcuuacuuaaauugaugauauuuuaaagaaaauuuagagaggaaaaaaaaagaaacaaucuacaaauuaguuucauuugcugcuuuuuaucucuauccuagggcuuuaauucuuugauccugugucugugaauugcacacacacaauuuuuaaaaaaaugaagacauuuauaauuaagcagcaugacuggcaggggguagaagcggaagguguaugaccuagcaagggucaggaugagcagguuuaaagguuucgauuuaaaaacagguauggccagguguuguggccgagguggguggaucaccugaggucagaaguucgagaccagccuggccaacauggugaaaccccgucucuacuaaaaauacaaaaauaaauuagcugggcgugguggugcaugccuguaaucccagcugcuuggaaggcugaggcaggagaauugcuugaacccaggaggcagagguugcagugagcggagauggugccauugcacuccaacguggacaaaaagagagaaacuccaucucaaauaaauaaauaaauaaauaaaauaaaaagggauauggaccuugaucuaugcaugugcucauaauccaccaguguaguuaucuucucugaagcccugggcaauguccaaagcaaauccggaaguaaauguugcccuauuaggcuacccuaauuuucaugaaaaggcagaugguccagaguucaaugucugccuaaacuaugguccacaaaagcccuaucuagaacauaguagcaccaacuaaucccuuucucuccaucuauccaucauuaucaauaagaauuuauauggagguaucuacuucccuauuauugccaagugcagccaacucuuaacuccaaaagaauugaaaguugccagauucuucaugaggccuuaauaaguauaucugaagggaagcuauucuuucucaaccaaguaccuggacucaacaguccccugggucagcuucaucuuacgaaacuuugucagguaaagauugcaagaaacuaagcuuugaguggcuauaggcaccauauaagguaagaagaucccagcucuucagggugggugacuuaucugauaacaaauaggcccacaguguggagaaugaaggaggaggucuaaaggccaauucaguggcuggcucuaaacguugcugggagauaagcuguuacucagcugauuaaucuggcccaggacaggaucaauaagggucuuaucuggguuauucuuuaguaguugagggcucucuuauaauccucugagucucuguuaagccccuccuggagauaauccuaacauugcuuaaaguauucuuuaaggaaagaaucaaaccuaaaacaaacaaacaaacaacaaaaaaaaggaauugaggagacaucaaauucagggcaucaagcugggcgccuuggcacgugucuguagucccagcuacucaggaggcugaggugagaaggcugcuugagcccaggacuuggaggcugcagugagccaugauugugccacugcacuccagccugggcagcagggugagaccuaccuaaaaaaauuuuaaaaaugaaaaaaaaaauaaauucagggcaucuaugguugcaggcuggaaaaaaagggggaaagacauuaggugauuuuuccaaaaugaugugaauauuuucaaacggggaauguuuucagcagucugaauucaggccaaggcaaguagucucugcaaguccccaccuccagaacugacaggcuugcugaucuccacauacagugggauaaauguccuggggaaaagaugccaaaauucuuuuacaggacacaaucuccaaugcagccaaggaccugagcaaaacagaauguuuuccuuguuugggaacucauauggauuauaaauaaaaggaauuaaccuuggaagucaucuggauaaucccaugacucugaaaaguacucacagcuuuaagaggcaacaaggaagaaugaaaaucaauuagggaaacaaaugcgaugaguaacagacucagacaucaagucaccaguggauggugcuaaguuaggaccuaaccuucuggauguucuaaaaugccaaagaaaucagacacuuuacucaaauggacaccaaaaaguccagcaguuccaacuguucaggugacaguccaagacuaauuguucauccacaauucaaaagcggcagcgauuggagccacugugauggccugggaauguccccccaccuagcacaagccuggagucaggacauaguugcuauggaagcuaguguaagcuccccaggggcugggaacaugcuugcaacaaggauaaccucuguuucuccuuauugcuucuggagcaauucuacacagauaauggcauucaacuauauuauuuacuaauaacuggcacagaggucuucacaggagccaguugggcaccacaguaauguaaugaucaagcaacccccaaaagcuagaggagcuuaugaauuagugucaguuggcugcaugccuguccuaugcucuuuacccccuuccaccuugcguauagccauaaaaaaaguuugugaaauaaaugcuggcuuggcacaguggcucaugucuauaaacccaacacuuugggaggccaaggaguuccagaccagccugggcaacauggugaaacuccaucucuacccaagauacaaaaauuagccaggcaugguggugugugccugcagccccagcuacucgggaggcugaggugcaaggaucgugugagcccaggaggcagaggcugcagugagcagagauggcgccacugcacuugaggcugggugacagaguaagaccucaucucaaaaaauaaauaaaugcuaauguguaggacuguuagugcuuuagcagcuuauuuguuuagcaggggcaugugggauaccugaucaauauccucaaauucuggguagcucacccuagggaaaagagaagaacguguucuggugaggguaggucaugguggggaagcucuguuucaaaucacagccuccccaggcagcugggaguaccaguuugaguucaggugucccaccugacgccagguaguccugaggagcuauugugaaaugaagacucuauggcacuugcccuuucuccagaaagagaacuggcccagucucacuuuggcucucugggucuuaucucaaucccauucuuuaagucuuagagcuccagcuuucugucugugggggguacagguccuuccaccacaggaugguaucaacaguugcuggagggaugcuaacaucucucgcugcgagggucucacguugguacccucuagggcugggguccucaccucauuuaggcauuucccaaaggcuggcuuuuugaaauggggaugcaacugagggcacagugacaguucugggaagggggucauuaaccauggaaauugcagacaauguauuggaaaagaaauccauuuauagagcagaaaucauggcucaguauugggcacuugccaucagagagauuucuaugcugcucuauccuggaucccagagguacucuacagguaguucaccaugcagccaaugaaaccugcauucuacaugaccagucuagucuccaccguucuacuuucuuggcacuuaacagcccucagaaggaaguaaauuuuccacaggcccugguccuacaaaucccauucauccuuucuuuaaaaugcugacuuggcugaaagaaagaagcuuuaguuauuacauagaauaagagaccagucaucauccuuaguaaagcugacaagggacaagugaugguggggugagaaagagaggaugucacuuccaaccuggaaaaaacacaggaggucauggccagcaaaccucggagauagucuuggaaccuggaggaaaaaaggauuucucaaguuucaugaucacuguagaauggcaacgugugggaagaaggggguauuuuauuucaguaugaacuccccucaccuaauaaacugacuuguuuggaugaguccgguaucaagacuugaguuggauggaaguguucaugggaauggucagcaggagagaccacagaucccacuaccaccuucgucccaacagcccccaucucauucucucaccccuucucccagccacaaaaagaagacauccugcuggccuggggcaagaacuuuccuguccccagccuaauaacaagggccuuugagaccagugauuccacuucuccuaaucucugaaucuaaguuaagccaaacccaccagacuaaagaguugguugguuagucccccuggagcaaaugcagggacuucagaguuccccuuccuaauaugaagaucucagugcuaugaaaggaacuuuacccacaccuacaucuacaucuugaucuauaaccugggcccagggcagcuacugccauuagaaaaagagagaccccuguuucuguguuccugcuggaaggggugggaaacagaaagcaagacaccuacagccacaaugaggaaguccagccaacaccaggcauuggugaagaacuugacgaagccauaggcuguccacuugagcaacaucuccaggaugaagauauaggugaagacuuugucagcauauuccaggauggugcggauggucuuucucugcucaauguagauguccucgaaggccuaaaagagaggcagcagcugccuaugacagugccuaaaggcaagcaggccacagggagcacugcuauccucagggagccgucccacaugggcuggccugucaucagcucccugucuccuucgcuuuacuccccgacuacacaggcuuuuuauguuuuaauagguuuauugagauacaauccacacaucauaaaauucagccauuuaaaauggcuuuuaguauauucagaguugugcauccaucaccacaaucaauuuuagaacauuuucauuaccuccaaaagaacccccacacccuuuagcuaucacccccuaaacccccaacccccuagcccuaggcagccacucaccuacuuucucucucuagauuuuccuucuuacggcugaguaauaguccaauauauggauauaccacauucuguuuauccuucaucaguugauggacauguguauuguuucuauugugaacaaugcugcugugaacaucuguguauggguuuuuagguagacaugcuuucauucucuagggcauaugcccaggaauggaauugcugagucauaugguaacuguuuaauuuuuugaggaacugccaaacuguuuuccaaagugguugcaucauuucacauuccuaccagaagcauaugaguguuccaauuucuccacauccucaccaauacuauauauaaaagaaaugacaaaaucuuuccuccuuuuaguuccuugacaccacaguauggguggagggucauacaggugggagauacucaggugaagaaaaucuuaucacuauuuuauuucuuuggcauucaugaaugggauaaucccuuauaugguggugugagcauucccaucugcagagugguggacuauacagguauggugccaagaggagggaauugcuaaagcauaggacaaccuguggagguggggaggaaguccucugugauacaaugggaagugcuugcucugaacagcuccagaagaauagaauuggguugucugcagcgucaccuuccaaaauggaggcacauggauaucaggugcuccacuuucucucuuuuuuuuuuuuuggagacggagucucgcucaguugcccaggauggagugcaguggugcgaucucagcucacugcaaccuccaccucccggguucaugccauucuccugccucagccuuccgaguagcugggacuacaggcacaugccaccacacccggcuaauuuuuuuguauuuucaguagagaugggguuucacuguguuagcugggauggucucaaucuccugaccucgugauucgcccgccucagccucccaaagugcugggauuacaggugugagacaccaugcccgguuaauuuuuuuuguauuuuuaguagagaugggguuucaccguguuagccaggauggucucaaucuccugacuucgugauucgcccgccucagccucccaaagugcugggauuacaggugugagcuaccgugcccggcuccacuuucaucaacaggcagugggggggacaggggucauggguuccacaguccuacucagggucucggugcaaauaaauccccuuugcucaaucaaaaaggcaacagcuuccaugucagguuuccccuuaaccccaucuguuggaaaucccuucuauaauccaagguaugugagaugcccaagacugaucucaugucacugagggcccuaauccccacccucuuuagucccauuguaaccacguucuaguuucuucuuggacauuuuagcuguggcuucauuuuguuauuuuuuuuuuuuuuugagauggaguuucgcucuuguugcccaggcuggagugcaauggugcaaucucggcacacugcaaccuccgccucccagguucaagcaauucuccugccucagccuccugaguagcugggauuacaggcaugcaccaccaugcccggcuaauuuuguauuuuuacuagagacgugguuucuccauaucggucaggcuggucucgaacucccaaccucaggugauccgcacgucuuggccucccacagugcugggauuaaggcgugagccacuggaccgggccacuuuguuauucuuaaaucucaugccuacuguugcacagggucugcagguacugaaccaaauauccuuugcuuaaucauuaagacaaauaaaaacugucaaaggugagcaguaaagaaaguucaaaaccuuuaguucacuacugcuuuauucuuuuuuguagagaugggaaagagaagagccaaaugaugggucauacuguuuagauuuuuguucacuagauuugaagaauaacaaugacagcaauaauaaaacgccuuucuccaaucacucggcuuagucugauccucucuuuucuuaagggcagagaccaugcugucauuuugggugccucugcggcaccucaggaaguguugugugaaugcucguugaugcaacaaguggcccaggggcaggcgggguggucuggcuccccuucacucagaucaguggcuaccaagccaucuuuuuugccuccuacuuuaauccugacaccuuccuguguaaaccuuccccuuacuucccaugguccucuuuucaugaaagcugucuucuucacccuugggcuugucuuuaauacacacugcugccucucucagcuuuucuuauucuccugccucacaagucagugaaacuucccaagucacugucaaaaucuuuaacacugaauuugggguuucucccuugcuauguuuuuuuuuuugcuuccagauuaagcuuugauuccacaccuacaugaaugugcccaccuucuuuaaauauacuucaacauuaugcauucuucaccuuucccuuaaggaaaguguguacugucucuagucccggcaguccucaaaacuauucaaccagcaagcaacucccucacaccacacccuguccaggucuccucaguuauaacccagcuaaaaauaaaagcaaaugccaagauaauuagucucagcaguggaggagccuguguguucagggccuuguauguuucacugauuaauaagcacuuaggacaaugugaauauaaauaaccuuuguaccagagaucugacucuaaacauuugcuaaugccauggguucucuaaauccaguaggcugugaagggacaguaaguggaggaauaacaccucccucccauccuggguaacugaaaagcaaagaacaagagaucugggguauuagguaagagagggaaguucauuuuaggggcugcuaaggaugggguaaaccaggcaguggggacacaugagagggacagugcuaagaggaucacaaugugaacaaguauggauucuaaucccacaggcucaaagcagcagccuaaagcacuuuaacagaucauucuucuugggaccacagccaaucuguuuucagagccacugggcuuuggccucagccuuuucccacuggcuucucuacacccuuccccagccaaucccuccucacacucuccccuggaccucaccagggcgccacugcucagcagaaucaugaagaugaugaaggucucaaaccaguugugcuccacgaugaggaagcagguuuuccgcaggauccaccaagacuugccuagcccuuccucgauguugaccuggcagcacuugaaccgcuggacacaaccuggcaccagcgggagaggcgggucagaccguggaaacgugccccgcccagaccugcccucuccuccaucucccaggcccugccaggugcugccccaccacacagccaggaggacaguggcugaaucagaaugucugauucagaaauggagaggguggcagggcuggggcuaugcugcaaaggcuaauggggcaaggcccucaggagucaagaagauguccuacaaagaagcagugagagggaggagaaaaggguagucaggaggcaggcacagccaugacagaacaggacauucuaauggaaauuuuugggcugaugccaagagaaaauggaugaugaaaagugugagaauagaaacuuguuauauacuugucagauacaaauaggggaaacaaucuaaguuuccuucaaaauggugggguggggagcaaaguucuugaagauagccacugagcugccccucacccaccacuagcccuggcacaacugugucugugagcaacacgaguguccccagcccauccgcuccucauccccuuucaccuucugugaagcaggcaucuggauccaaguauuccucaggcuguuccacagggaccucuucuacuucugguuugauaucaauggugcuuccuucagaggagcuggugucaucuaguuucuagacacgcaaggaaaagggagaucaggcagcucugaggcaacaugcccacuccacacugagaacucugccucugguggggaugaggggccagcucugacuccucucuagaauucuuacuacaacucgcgauaagcaaaccauauccacgggcccccaaaacuucuguccagaugggauauaacaucaaaaccuacucacggacggcaaugacccacccaaagcuaaaugcggcuauagguugguuucagggcuauaacucagaugaauggcagggaaguacucgagggcuuaucccagccucugacccagaugauccagaagugacacagguggguccaggaucaucuuaggauuccaccucauuuaggaaaggccuagaaugauacugggaugguggaauuaguucuccaaguaaauugguuauuccagaaucucucuaccaagcccauagcugaaccaauccccaaggcugacagcacccuguuugcucucacacaggaucaaggcuguuucuaggcugggaccuuacaucuuugcugccuucaggauccgacucgcugcuaacauccucuguguugagguucucaaagucagacucgcccacagcaauggguacccguacagucaaguugggguuguugaugaaggacaugugguccucaucaaugauguacuucuccacgcugcugccaaugccgcugguugugccauugccauucuucuggaagucaccauuccgguggaugucugcaccggugugauuggcgauacaguuggccuucuuuucauacaacucauccagaggcuucaccucaucagccucacgcugcuuaaagugggccugcaugaaggcgugcaccuuuaguuugguccaggccacacccuucuugauacggaucacugagaucuggagguuguucauuuccccaucgucaucuguggcagccagguugucugcacugaaggagcucaggagcaaggccagaaacagguucagcaccuaugccaguagcauuggaaaaaaggaacaaaugcagaaaaguuauccaucgaacucaggguugcaaacuggaagccaauggacuucacgugacagacucaaagaggcucuguuguguuguguuuggcccacguaguauuuuaaugcucauguuaccaggugggaauguguuugguuuugguuguaauacaaggaguuuagcaccucuuuucuugggucuuuuauaguuuuacauacauauauauguacccgaaaauauauuacuucucuuauaaucagaaaaaacaaaggcuguauccauuuuggaaggacauuuccccaaaauaaaaaggugaauauacauuacuggggagggucacaaaguguacagaugccacauauucaugagcagaguuugagaggacccacgucagaaaaaaaaaugaggcuugaagugccauccuuucauacaaaaaaccaagaagguagaacugaaauacacuucaugucaucauauuuuaagaacaaauuuuguuuuccuaacauuuauaaaaauaaaaucgcuuuagcaagacagugauggugacuuuuauauuuuuuugcauagccaaaugucaagccaucagauacaagcuuuauuuauuuuuguuuuaaucuccuauuuuacuacauugaacauuaagguuaauuaauuuauuuuuauuaagacuuacuuuuuaggagugggagaggugcucacuucuugauuuacacuugguccuuacuuugucauacuugggaagaagaguaaggcauacauuuuaggaggagauaacagucaugugcagagugggaggguggaaacaauaaaugaacuauaaguguucggauuaucugcaccauuuguagaguuaaaaaggaauaugguugguaaaaugcgggugaguuggagagggcuuugaaggccaggcugagggaucugaauuuuauuuaauuagauccacuacugguucuugaguaaaggagucacagaugaugacagagauuugaaagagucauucagacuaacuacauacagaggggaagggcagaaguuaggaggcuguuacaugcaugaauugauaagggucuggauuaggcuacagaaaucccaaaucuuagcaugcauuagaaucucagggagugagggguguggauguuuguuaaaaauauuuccuuagccuacucuaaagauauuuggauucaguagauuugguauacagccugggacuuggccuuuuuuugugagugaaacuuguguaauuaugaugcagguggucuugagaccacauuuuuauaaaguacugaaugaauuauagaaaugcaaaggaaggggcagaucuuagauacuaugaagaaagauauccacagaaauacuaugaagaaagaugcauuuaagacacaucagauauuugcugggaguggagagaaaagagacagaaaauacuccaaaguuauagguuccuagaaacuagaugggcagaaggacuacugagcaaaggggaaccugaaaagugucaucaggggguagugguaacagcugauauuuaucaagugcucagguaucuggagacagccauggggagaugucuuugagacaaauaagaacaggagagugaagaaaggguggcaaagucagggcuugaaaauguugaucaugcuacauaccgggaagccauuguuauagucacugaaguagugagaagacuagagggauuaggacugagggaaagguggcugggaauggagaauaggaagaauuaaacauuacaguagcuauuuuuuuuguaggucaaauggaagaacagaauaguuguagcugguucagaggcuggugaguaggagccuuuuacugucaugcuucucuguggcagaaaaaggaagagaacuaauguggaugagcauguuaagggacagauaagcuugucuucuuccaguccucuuugcccuacacuugcaggugggauuaggggccugaucuguaagauaguccuuucucaaacuuuaguguacuuuugagucacacaaggaucuuguuaaaaaugcagauucugauucaguaguucugauuuggggccuagaauucugcauuucuaacacacucuccagugaucuuguugcugcuaguccucagaucacacuuuaagaagcaagguguuaagaucuguuggugacucuucuaaagacagagguagaagagagcagguggacagaucaaaguaaagcaauaaagugauuugucauuuauauaaauuaaauaaaacucuaagaugguuuagagcaguggcucucaauggagggcaauuuugccccccagggacaucuggcaaugucugcagacauuuuugguugucacagcucucaggaugcuacuggcaucuaguggguagaggccaggagggacgcugcuaaacccuacaaugcacacgacagcccacaacaaagaauuauccagcccaagaugucaauagcaccacagaugagaaauugucguuaagaaaaaggaaggcuucuguaggcgaacgggcacagacuuuaaagucuagguucaaauacaagcccuauauuuauuugggaaagucacuuaauuuugcugaguuugcuuuccuaacucuaggaaaaggguugacaaguugugggggucaugacuaaguaggcacucuguaaguaucucucuccucuccuucauuuguaccuuaggguuucugggccaagaaagaauaaaaaucaacaaacaugacggguaguagaaggacuaagcaguagaaggacuugggcuucugggccagggguagaauauucaggguguagaacaaaaauaucuacaaauuaguacuaaccaccaaguugccaaucaccaugaccaucauaaagacaaugaggcacauggccuggccugccacuuccaugcagucccacauggucucaauccacuccccgcacaacacucgaaagacaaugaggaaggaauggaaaaagucaugcauaugccagcgagggaguucacaguccugguugaucuugcagacacacucuuuguagcuuuuuccaaagaguugcauccccaccacggcaaagaugaagacaauaauggccagcaccagugucagguugcccagggcacccacugaauuuccaauaaucuugauuagcauguucagggugggccaggauuuggccaauuugaagacucggagcuaaggaaaaaaaaaacccaaacaaaaaaauaaaugauacucaaucaauuuucucaccacauggcuaaaauaaaaacauaaaauuaggaagaucagauuaaauauauugagcacccuuggaaaauucccaggacugucuaacagugucucagacuaaauggggagaaacugagacauaaauaagggaaaacugauuaauuucagaguagcugaaaaaauuguaacuagaagccaggaauacugccuuagucccuuacuuuagaucugagucagucugcuuuuugaaaacccacauaugaacauaucccuuuccuacuaauuuucccuugacuucucacaggacaagugaaauaaaaugugauuuguaggaaaccaaaagacuaguaugggaaggacaguuuaaaaaaaaauccaucuccuuaaaaaagcaaacauuaaaaaauucuaaauaccuauuuugcuugccaauaaauaaucaauggcugauuaaaaaaaaaaccguugugauaugcuuggaauaacuuggaggaaaagcacaacucucaaacaggggcaguuccacauacaucagucaucuuaugaaaagagccuauacuggccaggugcaguggcucaugccuguaauccuagcauuugggaggcugagguaggcagaugacuugaggccaggaguucgagaccagccuggccaacauggugaaaugccgucucuaauaaaaaauacaaaaauuagccaagugugguggugcaggccuguaaucccagcuacuugggaggcugaggcaugacaaucacuugaaucugggagguggagguugaggugagccgagaucacaccacugcacuucaaccuggacagcagaaugagacuaugucuaagaaaaaaaaaaaaaagaaaagagccuauacuguuauucagaggacagaacuuuuaguaccugucaaucaugaaauaucuauauucuguaauaaauaaucacaagaucuuggcuaacagaguguuaauuauuuuuuauuuauuuauuuauuuauuuuugagacagagucucacucugccgcccaggcuggugugcagcaacgugaucucggcucacuacaaccuccgccuccuggguucaagugauucuccugccucagccucccagguagcugggauuacaggcgugcaccaccaugcccggcuaauuuuuguauuuuuaguagagaugggguuucacuauguuggccaagcuggucucaaauuccugaccucaagugaugcgcccgccuuggccuccugaagugcugggauuacagguguaagccacugugccuggcccagccugagaauuauaacgcauaaaggcuauggcaguguggccaauaaaauuauaauuaugagaucaucauuagaugucauaugcuaacaaauaacuaacauagaauguaauaggaauuuugguagaaggcaacagcacaauuuuaacuuuuuuuuaauugaaaaguuaucuuaucagagaguucaauauuuaccagguguuacccuauaugcagacaucugggccacucauauuguuuucaacagaguggcuuuuuaauuuauuaagaauauaaguucuaaggcuacucucaauccuuucuuuugucaccuagguaauaacuauucucaaaaaaguccacuguggacuggauccuaaccaaagaguaguaaacagagguuucaaaaauuuggcaguuauuugugacuuugacugagugaaaucucuguuuuacaaauaguuucacuuuuuccaguucuuucuuagaacugcugaauaucucaaugaagaaacuuuaaaccuuuucaguugccaagugcuuaucuucccaauagggagugaaaaacccaagccaauucuaaugccagggaagcaguagugaccuuugucugagugggauacccccaggauaacucaguuucucgaggaguuaaucaagauaucacuuacgcuuauguuuacggacagcuguuuugaagauaccauuaacuauucuuucagagucauuuuaagucauuaagaguaacuuaaacacuaacuucuucaaauacauuaauacaaacuccuuuuuagcuaaugauagagaaaauaaagccaauguucaacaacuaauuucaauauaauacagaugcuccuugacuuaugaugggguuaugucccaauaaacccauuuuaaguugaaacugcuguaaguaaaaaugcauuuaauauacguaaccuacugaacaucacaucuuagccuagccuaccuuaaacauguucugaacacuuacauucgccuacaguuggccaaaaucaucuaacacaaagcccauuuuauaauaaaguauugaauaucucauguaauuuauugaauacuauacugaaagugaaaaacaggacgguuguauggguacucaaaguaugguuucuacugaacgugcacugcuuuuuugcagaauguaaagcggaaaaauuauaaguugagccaucauaaguugggaaccaucuguauuuaaaaaccuuauuuuauucucauuuuuuggaagggcuaccaugacagaagaaaugaagaaagucaucuuugaacaaggagaaauucuugccauuucaaggagauguucagauuuaaaaaaauagauucacuagcaaacccaaauuagaccucacacugggccuugggggaguucauuuucuucaucuauugucuugggucuuauuuuucacuuaucaucuuagacaucucuuagauuaagcagcauuuucuaaagagcuucuuaaaauugauuucuguuugcuuauugauuuuuaacaacuaacuuccauaucagguauuuuaggaaaguuuuuaguauuuuaguagcuaagccaaauaacuggaauugggaguaaaauacagcuaauauauuuuuuaaaucaucaaauuaauuuaugcagaacucuuucuaguagcugcaagauaggaaauguuaaaagaaauuggagaaauauggaauaccaaucggaaagaucgcagcacugaaagccccuccacgucugcuagacucaguuccauuaaacugagggagacaauaaauccgucaaaaauguuccaaccuucuuggaaauaauaguagggauccauggcuaugagcuucaggaacauuuccgcugugaaaauuccagugaaaaccuaaauagggggaugcaggggguaagaaaaauaaauaguagaaagagaaugccuuuaucauuauuuuugaaaacaacauguccaagaaaccucaagaguuaaccuuaguuaaauucugcaucugaagauaucaauaccuggaugucucaugagcaccccaccugaugcaggaaaaucuuauucuccucuugaaugaaguccccagccccaaaguucccaucuuuguugccagaaccacucaauuuaaacucuucaagagugcaguugagaaaauaugcuaagcaauggcaauacuacaccaggcaacuccuuucaaagggucagcagucauuuugaauguauauaauacuugugauguuugcuuaaaaaaaucacucgcguuaugauuagaaaaauaaaguauuaaugcuaauuugacauuauaucuuaccaaacccagacauuugccacaagguguaaaagcauacaauauugccaaaaugugcaaaauauaggaaauaauaucuauaaucucaccaccuugcauacaacuaucauuuucauguauuuucuuucuguuuuuuuuuucaaauacacagguauuuugacagaguuggaaaaucauagaauacauaauaucuugggucugauuuuucacuuaucauuaagucuauccauguugcuacacgguucucccaacucucacucuuacugccuguauaaaauucuacuggcggcuggggaugauggcucacuccuguaaucccaaaacuucugguggucgaggcaggcagaucacuugaguccaggaguuugagaccagccuggacaacauggugaaaacccaucucuacaaaaaauacaaaaauuaguugggcgugguggugggcgccuaugguaccagggaccaggaggcugaggugagagaaucacuugagcccgggaggcagagguugcagugagccaaccuggagggcaguggaucaugccacugcacuccagcacaggcgacacagcaagcccuaucaaauaaauaaauaauaauaaauaaauaauaauaaauaaauaaauaaauaaauagugaauaaaauucuauuggguaaauacauccucaaagaauuuuccuauuguuggagacuucggugcuuccuuuuaauuuuuuucaauaggauaaucaaugacauaauaaauguuuuagauuuguagcuuauuguguguaaaaaugacaucuucccuauguuacccaucucccauuuuucugcugacagagugccugcacuucccgaugacuuccauauccugcaggcauuaggaggugauaugcaggaugaaagucaaaucccaugaaugccgguuuugacaaaaccaauaccuucauucuaggcuaaccauauaacaacagacucuuauugaauauuauguuuuuagaggagaggacuuauuuuuacaauagauuuaaaacugucauaauauauuaguacuuguaacuaccuguuuaccaaguuuccacaugaaacaguuuaaggaaaacugaagauauagucugagaacaaaauuaaaaauaguaaaaaauacuuagauuauagaugcuguuuggaaauauacugaauuaauaaacagcaauaaaaaaacagaaugaugacuaaaauacaucaaaauggauaaguggccuauagguuuucgguguucauaugcuuuucuguaguuccucauguuucuagauugaagaugcaauauucuaaaauugaaaaaaaaauuccacaaagagauccaguuaaguaaaaucaaaguucauaauacaaguuaagcaucuauagauggaacaucccucugagugaguucagggaaaguacagacagcucaucaaauccugacauacauuucacccuuaguguaaacccaucggagguuucuccacauagaaaugcuagccugccuaacacacacuaaguagagacuugauuuguuaucccacugguuccugguaaacacacaggaagugcucaugaagaagcacuggcugauugaccauggaauaucuauacugugggaacucugguuccuaagggaaaucaacaaugacauaguuaugugguguugccuaucaccaggaugaauggccccaggcauuagaaauugucugugacagaggucagccaccauguugcuucaacacaugguauguugccaucaguugggugugugucaaaauacaccuauaacuauuagcugugugaaggaauugcuuuuuuaaaaauugagaagagcagauuuaagguuauccuaugaugcucuuguuugcacugugauaugcuucucaaagaggagaaagggaagaauuacaugcaguguaucagcaauuauauauaagugucugcuaugguuugaaugugucccccaaaguucauguauuaaaacuuaauccccaaugcaacacuguugggcagcaaggucugauaagaggugauuaggucaugugaggacucugccaucaugaguggacugauguuauugcaggagugggcugguuaucucaauagugggcuuugugauaaaagcaaguuuggcccucucuugcucucucacuguuagcuucuucugcccuuuggccuucuaccaugggaugauguagcacaaaggucuucaccagguacuggcaccaugcccuuguacuuuucagucucuagaaaugucagccaaauaaauuucugucuguuauaaauuacccagucuaugguacucuguugugguaacauuacuuagacaguguuguucuccugaaugucaucaaauauucacuuuagaauuuauguucuuaugcagcaguucucaaaggguaguugaggauccuuagagucccuaaggcccucucaggaagcacaugguccgcucuuuuccaacuucagaaguaccccccaucugugguuuugcuuucugcaguugcaguuagcuaccaucaacuacaguccaaaaauauuaaauaaaaaauucuagaaaaacaauucauaaguuuuaaauugcauacuguucugaguagcaugaugaacucuugagcuguccugcucuauccucccaggaugugaaucaucccuuuguccaguguauccaugcuguauaaacuacuugcccuuuagccacuuagcagccaucuugguuaucagauucacaaaacccaguauggucaugcauugcuuaaugauagggauaauguguuguuggcaauuuagucauuguguaaacauuaaagaguguacuuacacaaaccuaggccuuauauauauauuuucauuuauauauauauauuuuuuaauauggaaaaccaaaugucccagcaccuuuacuuaacaucaaucauuucucuuacuugaccugcaaggccaauaucaaauggcauauaacaaguuuuuauauauguuccauuauaaucuuaugguaucacugucagacaugcagucugucauugaccaaaauguuguuaugugguacguggcuguacauauacacacacguauauauauauauacacacacacacacacauauacauacauacauguauguguauauguguguguauguguguguguauggcuugguacuaucugagguuucaggcauccacugggggccuuggaauguaucccccuuggauaagagaggacuacuguacauaucugugugaggcaagcuuuucuuccuauacuuuagcuaaaauaacauaucacaacagacugaauguagaaacagaaaaagagaaucuaacuaccuucuauuaaaccagacaugaggccaggcacgguggcucacgccuauaaucccagcacuuuggaaugcccagguggguggaucacuugaggucaggaguucaagaccagccuggccaacauggugaaacuccaucucuacuaaaaauacaaaaauuagccaggcaugguggcgggcaccuauaaucccagcuauucuggaggcugaggcagaagaaucgcuugaaccugggagacggagguugcagugagccgagauugugccacugcacuccagccugggcgacagagugagacucugccucaaaaaacaaaacaaacaaacaaacaaacaaaccagacauuaaagagacuugcaaaaugucgaacaaugccauucuuccaguuuuucuuaaaaaauauaguuuccccacaccaauauguuauuuauguucaugugugauagguguauuauugugauauuuauuuuacagauaggguguugcuauguuguccaggauagucuugaauucuugagcucaagugauccucccaucucagcauccugaguagcugggauuauagggaugagcugcaugucugguuaauuuuuuuauuuuuguagagauggggucucgcuauguucuagccaggcuagaaagcaauggcuauucacagccguguuccuggagcacuucggcaucaaauuccuggccucaagccaugcuccugccucagccucccaaguagcugggacucaccuagcuauauuauuguaauucuuuaauuacaaaaugaauguuuagaaauuuucucaguuuuaauuucaaacaugauaaauaucaauagacauagcacuuuuauuuaagaguauaaaggaguccugaucuccucagaauauucuauaaaacaaugguucucuauucucuauaaaauacucugaauucacagucaucauaucuuucuaguuuggguuuuguuguguuuuguuuuuugagauagggucuugcucugucacccaggcuggaauguaguggcaugaucauagcucacugcagcuuugaaauucuaggcucaaguaauccucucaccucggccucccaaagagcugggaugacaggcaugagccaugccuagucuaguuuggacuagccuguggucauaugccugauaacuuguaaugccaggucaacaaguaaggccuauauaguccuaagauugggguauauuucacuuuggcgucacuauggggucuggggagaagucacacaccuccuucagcccucauugcauuugcagaaaaaauucagccuuauuugaaagugacgagcgucuggcaugcuccucucuuugugcucagaaaagggcuugucagcuccuguucugcaguagauccucgcccaaaguuaaucaaguucaauuugauuaaaaguucuauguguacugcaauggagacaugaaaaaaaaaaugugaccaugaaaaauaaugguuccuuacgaacucagucgccagaauguaaguaacucauccugguuugccacuuuucacaccgaaaguccugcauccugcaucuccaguuagggugaucaacucguaccuguugacaaggacugucccaguuuuaaaacugcaagggcuuccucaggccucugcaaauuaaggugguugguuacccaaccaggaggggacagaacaauaacuaaaaaucaugugacaaguauuuaaaaagaaguauccauauggggcuauagaagcacagaugaaagaaaaaaucugaaaagaauucuuuuuagcugaaaaucuagguaaccuauaauuaagaaaugauaacauucauuuauguuuggugaaggaggaaaauaacuuucugcuuuuuugcuuuugcuuagaaucugagaacuuaaacuuauaugucagauuaaacccuagcucuucuuuccauccccuuccuccugaaccacucaguccugaaggcuguaggugggcaugccgguagagggaggcugcugcccagugcuggaaccccaggaagggcacggcccagcaaggagagucagacauggaggggagcgaggagguccaugcagggcagcaggcuggcaugggcugucugagccugugggccaaggagaggcauccgcuuugggcaacagucuaggaugggcaguuggaagugguaugaggcguggcuaccccacauagguguugaggcccaaguguggugggaggacguccacacuugagggggugggggacuuagcagagagagucagagcuuaaguaagguaaagauagcaucuccaggagaagaucccggagugggcugaggagggacucccugcaggggaagacucacaaggggugccagagccaggugagcugaugagggacucauguaggggaaggccugauguggggugucagaucccgaguggggugaggaaaguguccaaacagggagguggacagugagggugugagagcucaucagggugaggaggaugucgccuaguuugggauaaagucaaugggccaggugagaacuuccaggaguguucacacagacagauggcagcaugagcagggugacgagggguggccuggugagggguguuaagagucugugcaggauaaacagagcuucuaugucaggggagagucugguguggggugagaaggauguccaugcaggcgaaggccuacugugaggcaucggggucuaagcaggguggggcaaaccaugugugaguuggacugguguggguuccaagcugaggagugugagcagguguccacauggaggacacggcucgggugcugaagggguggggggcacccagagccuauacagggugaggaggguacccaugcuauaaaagguaacaguggcuuuuugaucaaauaaguauaccaaagauaguggcaacgagguuucuuauuguugcaggaguuacaaauacagaaagggagaaaacuagaaagaaucuugaaguguuggauuagaauuggaagugacaggaucaacucaugguuugcaauauccacggcuagcucaauauaaauagcucaucauguccuaagaggggcugcaugcugcucccauagcaauaugcauaccuagaucucagaucuccaccucuuccuuuuuuuuuaguuuucuauuuuguuuuagagauggggucucauuguguugcuaaggcuggucucaaacuuuaagcgauccuccugccucagcugauacucagccuagaucucuacuucuaaaugccauuuuuccacuaaaagacucagggcuucuugagaaauggcugauuccagcccuggggcuggaaaaacacgaaaguauccuggaauaccuugugguaccagaaagccaggaagugaagaagacaugugaaagggaucagaagccagcuugaaggaauuuccacuggccacaucagaggaagucuaaacaucaaauggauuguaacucagauaaaauagaaaaccauuaauccauacugauauaaauaaaggaagaaaucaaaaucugaaugaacaggaaauuuaaaucguuucaaauggucuuccucacaaauaccuauuaaguauacaguaaguccucacuuaauguccucaauagguucuugaaaacagcaacuuuaagccacaugauguacuauaugccauaggaacuuaacucuuguuuauaucaacuggccuaugguaaaacugguuuuguuauacaguauaucauuuagcuuaaagucacaguuuccaaaaaucuagaaccuauagaggauguuaaguggggacuuacuguaaauggaaaaagcguaacuucacagaugaaaagccuggcagacaccuccuuaaucaagugauuaaaugaacgucaccaguagugggacaaauggaagcuacaugccaacugguagauacaacgugaagaagauagucucacuuaucugauauuccuaccaaaaugcagaaccugcaucuaaucauaaggaagcaucagacaagcccacauugagggaauucuacauaacaaaugaccuguagucuucaaaaugucaagacaugaaagucaaggaaagacugaggaacuccuccaggcugaagaaaauuagagagauaugauagcuacauguaaugggguaauccuaaaacugcauccuuuuguuacagaggauaccacugggaucacuggcaaaacuugaauagggccugagaauuagacccuuaacuuaacucacaaucagggcuauaggaaaagccucacauuccaaccacaggacaaggucauacuuuacuucacaacauuguaauguaucaauguuaauuuccugguuuugacaguuauacuaugguuauguaggagaauguacuuguguauaaaaaauacacacuauaagcauuugggggugauaaggcuaugugauaaggcuuuuauuguaaaaaaaaaaaaaaaagaaguuuuuuguacuguacuugaaacuuuccuguaagauucagaauguuuaaaaagucaccucauaaacuuacuauuguauucaguuaguugcaaaaaaggcaggaaaagaaucauuacauuuaucuacuacauaacauagaggcuguauaagucacacagcuucccugggcuucaauuuccucuauaaaacauguggauuggauugaauuaucucuaagguucuuccuacuauuauuuucucuuuuggggaggguagaagaggcagggaucuucaauuugcagaagacuguucucaucuuucuuuaaaaacaucuuucuguaugucuacagacaaagacaacuuaacucacaauuagggcuauaggaaaagccucacauuccaaccacaggacaaggucauacuuuauuucacaagucagucucauuuuuuuuccauccucuuauucucagguucagucaaagccucuacccaauucuccaaaucuuugaaaauucuccuauugaauuauacuaacacaguuccuaagauuuauaagauacuuuuagcuaucccaaagacuuccauauagguucucauuuuaucuucccaaccagugauggcaugguauuaucuuaacuuuacagaugugaaacauuucuggacagaaaucaaugacuuauuuaagguuauacgauaucuaauaggaaugaaaacccaaaucuucugacuuccaauucuguguucuuucugccaaucucagcgcucguguugauuggcaacaaaguauaucuuugaguuucugguauuguccagaaaacacucaugagguccagcacguacccaacuuccuuauuuggcaucuccacucagugaauagacacuuaauauguccaaaacagaacucuugauuuuauacgucaagccaguuccuuugcagucauuccacuuuucccucaguuauuaaacccccacaucgaggcaccauucuugauuucuuuccuuuuacccucacaucuaguacaaaguaugcuggacuauauacuaagcucccuccccacugcuaauuguacauuuacuugccguuugaaaacccuugccaccuaagagcuuucuuauucuagaacuugguucuggguuggcuugucucauggaguuccugaauauuagcuguugaccuucucuuauuuccucuuuuuuuacugaugguucugagcaaagucuucugcauacuuacaauucuaauuuagaugucauccuaaaucucuaaauuuucaugaaaggaaaaauaacauuauuugcuagccuggucugacuggaguucuaguggggauaggugaaaaagccucucaaaaucccuugaaaaucaaagacugguucuguaaaaaguaaggaaaaguaaagauuuugagaaaaacaaaacucuacagggaaaacagaaccaccaacaucaacaauaaaaauuaucaagacauauuucuuguuacuuaacucuuggcuacuaaaaucaagcuuauaucuaaaugauauuguugacaggguuaaaauucugcuugauggccaagguacugugucagccagucacagcaugugcccacugacaggcaccuuucagagccagucagcagacuucuuggacagucugugggagugucccauuucaagacuccgggcauuccacuggacugcacacaaggguuuacaucauugcagagagccuggagcaugucaccaaccacagacauggagacuggaaagaucacagaaucaucuuggauguauaccagggaacacaaugggcuacaaaggaucucuuugccauguguuuugagaaugagaaaugaaaaugauauuguagugcucuaauaguauaguaauaggacuuaaggucaaaacugugugguguguggugugugugugugugugagagagggagagagagagugagagagcacacauaagagaaacugggcagaaaucaugcucaaaucauuaauaaacgguaauagccagauuuggacaugccugugguuaacaccuaaggaauuagggggcccaggugaccuaggggauucuuucucacuaauucuuuacuaucuaucaaaauucaauuaacuccugauuuuuguaguaaacaaagcacauaauccucaaaucacagcuacuuaauuucagaauacacacuuuguaaucuauuuuuuuuaaaacuacauacuuuaauggccuagaaguuggauuggagggggaaaccagccuugagugaaaacuuucccauaaauaguccccauuuagguaauuaaggccugacagagcaggcaaauccauaguuacauguaguguacuauaagagcuccccuauuuugugguagauguuacuuaaggugaaaggggaacugauuugcuggagcaaugcaggaaucaaugugagaaacagaaugaggaaaaaaaccagaaguacuuggcucaggcugcugaaaccaacccacuguaccaggccucccauucugucgccaacauugguuuucugccaauagcuccuaaaugacgucuucaaaguucugcagaaagaggaaagggaucacaacagugagcagaaaagcagcugguguccuggcauauguggaagcauuugucuuccaauuaacuauuacuuucuuuucaaagaaacuccagcuuucaguaccagaaaaagauauccuacaggcaaaacacauuccaauccuaauaucgggagacaguguuccaucuuaccagauuuccuacagccaagacauguucaaauuguggugucauaggauggugcuccauugccauaaacaguguauucaggacgaugcagauggugauggcuaaauccacaaaaggguccauaacuaucaaguucacaaucucuuucaguuuuauccaguagggguggcacucccagaugaggaaaguguuggcaaauuuauaccagcauggcgggcacuuucucugagacucuuccaguucuacaguaaguaagaacaaagauggccccucaaucacagcaagaaaaccagggggacacacuacucacucucagucauuaucacuguuauuaauauggaaucaagguuguuuugagcgcugacauuccuaaguguuuuccuucucucuaagguagagaggaagcaugauccacacaaguugccucccuguuaauaaugaucuaguuauaaaugaaacucaacccaucaguuaugggagucgagcacagaggucaagagcuuggccucucaggucugacucccuggccucaacuggcuugaaugcuuacaaguugugugaucccaggcaagguagcugauuucucugcucagcugccucagcuguaaaacaaggcauuuacuuuacagguuacaggacugaaugaguuugacuaaauuagaugcugguguaaagcagucacuauaguaucuggcacaggguaaauccucaauaaaugguagguauucuauuauacacuauauuauucaauuauugucagagaagccaucaaaaguauggacucaagccagacauauuugaguucaaauacuagcucagacacuugcuaacugugggaccgugaacaaguuacuuugauuugcugugagaauuaaagagcuaaaauauauacaaagugccccagaauacccuggcagauagaaagugccauggaaguguuugcuauuauuauuaucuucauuagcaggaccagcaucaucgaccaagccaccauguaaaacacaucugcuauguucucaaagaaguacaaguuacugucuccacccuuaacaaguuuacagcucaugguugaguuagaaauacaagucacacuccucuccccuuuucaccuuuccuuccuuguucugucuccuccugucuccuucuuucuugccccuuugcccuuuccugcucucauccuuugcuuuucucuuucuuucuacagcuucuuccuccuucccucccugggucaucaucuucuuuccuuuuucuuucucuccuuugucuuaucuucuccgucucuuuuagaaacagaaaguguuauugucaaacaagaucucacaugacccccaauacaugaaauacaccaggaauuucccuagaugaagcaggagcccacuuggauagauuucuuccucuccugaggcacuccccuagaaucccaggacucugauacacacagacugaaaaaucacuggacuagacgaucucaaaggucauuuccaaagcaaagauucaaaagaauuaucagauaucaaagacagacacucaacuggcaguuacaacaaucuagguaugaagcccuacauaacaaagcucuccucaaauuaagcaugaaauacaacugccaggauuacaaaauuccaaggacccugagcuaagaggaugcuuuuuaagaggugaacuuugaaaaccugucagaaugugagguauugauucuacaggguuggcuguaacagcuacucucucucuguucaauucugcugacacuaucaaaucauuuaaggaaaaaaaaaauucccuaacauuucaccaaaaccaagauggcugccuuaaauuagccuacguucccuuuuccaaccagcuggauggcgaugcuuuauuuuagacaaggugguuuuggcugaguuucugauugguucccugguugcuaagaaaaugguugccuugguuuuucagauuuaaggaccccuguaagcgccacgugggaggcugcgugggaaaggaagucugugaggaaaaucugcuguggcuucuuccucagagaacucccucccuuccuaagguaaauauaguuuucucccccaaaaaagaaaaugacaagguucucuuauuuccauaaauucuuacaguacauauuuggaaauuuaguuccguucccuuuuuuaucuccucccuucuccaaacgacuguugcucauuggcacguggagguugaagcugcgacugcucacauuuaugacaguugacacaauuguaauguuuuaaaaugaacuaggucuugagucuugccacacagcaaaaagggguuuuccugcccuacagggcaccaagaaaauuccucuagggauaccagacaucucuuagccacauuuacugagaagggaagauccucaggauaaacuuucacgccuacaaaaaguaagacaauguggagcuucaggagcuagaaaagaucauuuggggaauaagaaggcuuaucaagugacuuaugacuuugcaaacuguuacugguuccacaugccuggaauggcccaguauuuggcuugggggaauggguuaacaucuaggggugagauguccaaagguuugugggguuucucuuacuuugcuuuuggacauuuucagagagguuacuuugggucuuaaccucagggguacugggaauuguuuucagaaaggaccucacaauuucaccaagauaguggcuuugguagaccaugagguuucugaaggcaggagcuucccucaacucaguucaacaacuuuuaagcaucugcaaugugcuaggcaccaaggauacacugaugaagagcccccacccucacuaagguuacugccacacaggaaaggcugauaucagccaaguaacuauacugacacuugaugcuggucaguuaaauaaaagaauacauaaauaguggcagcaauagcuauggccaguuaccucuaggggaguuuuuggaauuguuuuaccugagaaucaauaaugucaaguacuuccuugauauuaaaaaucaauaaugucaaguacaucacuacuuccucuuucuuacuucaccacgaucuccccuucucccacagcuuuacugcuuugaagagugagacuauacuacucuaccuacaccccacgcccaguccucugaaauauccccaaagcuuauagcucugcuaguggugaacucuacuaaaugugcuggauccugguaagcauguuugcaauaggaaugggguggggcagagcaggcaggguuuucuaauuauugacaggauucuagaauucuccacugugguuucuaaacuauuagguaagucguagccugccucuuggguuuuaaauaauaauuauuuuaaucuuuggauuaaaauaaugucaaaguuuccuaacugaaagucugagagcaagaacuacaauucguucaaugcuggcuuuuaaugcuguagcaagcauuaaauacagagggaccaaugguuaaacagacauggauguuucauucccucuuacgugauuccggucagccauucauugcucuuugcuuauagcaguucugucccaucagcuucaacaaaagggucaaauacaaggggagagguuaggcggaaugccugagcaggaaauggcaggacagguauaacuaugugaaaaucagggcuuaggaaagaggacaaaaaacuggaauaauauuuuccuauucaggaacacaacuacaucugucucugucuccugagcuacccuuacaucuauuuuuuuuuuuaaugugugugaugguggguaaaggguggagaauaagcacagcaggacagaaagagaaagaacagggagaagaggcagaaaagagaauuuuaaaacgucccaaugguuuguauccaacucaguaaagggaugaaagcucuaaggccuccgaaaggagcccugcagcaccagcacuccuaccauucuaagcacagccaaugccugcuugacaaagauuguuugagcaucuacuuuugcugggaccugugcuaagccaaugcaguaauaaauaaauaacuguugcacuguauugauaguucugcuguucugaugucucuaccaauaauaaaaugcaccuguuggagguuguuaguuuuucuuucucaacugccacagauacccagagaaauccugucuuggucucuaugugaauaauaaaauuagccaaaguucuuaggcuaggauuucuuagcuuggaauucuuaggaccugcaguuauuugcccacaaucucaaaguauaagcuacaaagcuugaagauguucuaucagacaauaaccccgaugguaauuaaagaaaacaggaauaaacagagguuguuaaggcagaugaaagcaguuaauucauuuuuuuacuugagauauucucaaggucagucuaguuauagucucauucuuugcacauauguggggaaguaagcacccuuagagaauucuuuucuagggacucucccuccacugcaacccccuccccaacacacacacacacacacacacacacacacacacacacacacauacacacagaguagaaguggcacuggguuuaaaugacuaaaaaaauaacuugucucaaggauacugggaccauuuugaguuuuccugucucagggacuuugguuauuccaggcaucugcauucugaagaauagcaauuugaggccucaagaauagucuagaucuacaaugagacaacucagcuaaaucaacauaaauccaaugaagaagauaggugcagaauccaucagaaucuugggagaggaaaucugucacugaauuuaccucuaaagaaagcaugcagauccuggacuacagaccauaacuggagaggagcugauucuugcuagggggacuguggccuaauggaaaaucuucagguauuccucagcacgccagguugugucacagagaacccaccuaacacagagaacucaggcacugacagcaacauuacugcagacgugcuaugauucaacagcgguugcucuuucccuguggcauggagcacucaaaguaagaaggguuucaacuuaccuagucacacaucaaauuuauuuauggauauguggggguguuugaagagagacagaacuaggugcaaucaaaacgcacaguacauucuuccuuaagggaaaaccaaaagggcuguaaguaguuaaaaaggaaaaaggaagguauguuuugggguagagaccaugagggaaauucuaugauuuuguaucuuugcaguucuucagucuacauuccuuuaugccuuacagcaccccacugacuccucaugaugacaaugacaggggucuugagcuccucuaggucacucaugcagguccuuuccuaucucuuacguaccuguguacaaugcuggcagcauaucugaagcccauauauuugauucucugcauguaaauuuaggaagagaauuugugauucuaguuucuauauaggaauacguuccauuccuaaagcucagagacagucuuugcaaaacucagaccaagggacagggauuauauuuaccaugcacauuacauauuuauaucucagcgguuggacugacauuauagggcacauaccuucuacuaguguauuuguaacaacacucauuauacuguugauucuguccuuccgcccguaggaggcuaauugguccauggaaacuaaaagagauccagggccuuucuucuuaauuuccaccucaguuguagccuuuaaaaaaaaaaaaagaaaagcaaauagagugaguuaagucuauaaagguaaaucugggccuuacuugauacacaguccagugugugaucuucauuacagucuuuaacuuugauccuacaguccuauucacuucaagaaguagaaugaaaugaauuggcuaugguucauccuuauuucugugggugauaagaugaagucauuuaagucugugugaaucuacaaugaccccaagaaucuggcugggacccaaacaucucaccugguucauuccaagcauagaguagaaagaccagauccuccugggguacugucauccgaaguagacccugaguuuucugguccuaaucucaaauccacaauauuuggcuagaauugguccacaugacgaaguaagucaaauuuacuucuauuugaaauuucauuaaagucaagucccugaucacacuaaguauuauagaugcuguuucuuccuugaguaggagcaccauuauucuaauaaacugccucuuccaaauaccaaaucugggccuaacugaauauuagcaaguugaagaucugcuccagaucuccuacaagccauuguaagaaaguacagaaagguuuugcuaucuuaauuaaauauauuguauccuauguuuaucuugcccuuucacaguuuuaugaguuaaccugcaauguucaaauucccaauaaaaaauggcagaaaguauaaucagauuguuauaaaaaauaugauuacaugcuccacccuggacaauaacugguaugguagauuacagcaaaggguuucuucaugucccugacuuacguucuugugacuauuccacaucaguucaggcuuaaugggguggcuuaaaacuaauccagcucuuuaguaaccauguuguucacuguaccauaucacccauguagacuuggcucuaccuucuaagauggugaagguaagaggacagagacaaucagcagcccucagaggacaggggagauuguaugaggcuggagaagcauaugucugaucaguaagagaaugauccuagcuguuuuaaaaagaaaauaauuaccucuggagagcuacaucaaaaagcccaucuguucuaaacaucuucagauuuuaaggacugaacagaagaaaguuccuagcagauuacgauuuaucuuaucaaaguguuucauuagccuguagucccagcuacucaggugguggaggcggcaggauuacaugagcccaggaguuagagaccauccugggcaacauagagaccucaucucaaaaaaaaaaaaaaaaaguguuucaucagaccguuucacugauucagauuuggaucagugaccuuggggucuuguuuguuuuguuuguuuggcaaagcuacagaagaaauacaggaaaaaaaaaaccgauuucccugggaauuccuugcugcauuacuacacuaacaucuguguauguaagaaugacuuguggugguggccacaggaagaggcuuccugccuguggaaaaaggagagaagagcaggaaggacuuuguauugugguuugagugccagcauagcugcagaauagaacaucaggcaaaucucuaagguuuuuuguuuuugcuuuuugagagucugcucugucgcucgggcuggaaugcaguggcaugaucucggcuuaccgcaaccucugccucugagguucaagcaauuuucccaccucagccuccugaauagcugggauuacaggcauacacaagcacacccggcuaauuuuuguauuuuuuaguaaagacaagguuucgccauguuauccaggcuggucuggaacuccuggccucaagugauccucccaccucagccuuccaaaacgcugggauuacagaugugagccaccaugcccagcuaaaauuuaauuuuauuuaaacaaauacuuauuguuugcuaagugguguggauacaguggcgaacaacacauacaacauggucccuguccucuugauggguuucaccauguuggccaggcugguaucaaacuccuggccucaggugauccacccaccuuggacucccaaagugcuaagaaaucucuaaggcuuuuugcuccaaucccuggcuuccggacaacaugucuguacccaccugggaccugggggaacuugcugcccugaaggggaggauacaaaccuggcuggcuucaccaccugcugacuauagagcccuagggcccugagugaacacagguggcagccauguagugguuacagcgggccuugggcgagacccugugcugugcuggcuucaagucugacccagcagucucagcaguaauggccagaggggugcuuacaucaacacacuccaguucaagguggcucagcacagaaaaagagacuccauuuguuugggagaaagugaggaaaaagaacaaaucuuugucucguaauccagagaauucuuccagaucuuuauuauccaagaccaccaaggugguauuucuaugaaucugcaaaaaccacagcauuauuggacucggggcucaaauuccuucgaauaccuagaaagccuucugaagaaggacaggcacaaacaagcccagauugcgaagacuauaaaaaauaccuagcuugucaaugcccaaacaccaacaaacaucuacaagcaucaagaucaugcaggaaaacauggccucaccaaaagaacuaaauaagguaccagggaccaauccuggagaaacagagauaugugaccuuucagacagggaauucaaaagaacuauauugaugaaacucaaggaaauucaagauaacacagagaaggaauucagcauucuaucagauaaauuuaacaaagagacugaaauaauuauaaacaaucaagcagaaacucuacaguuggaaaaugcaacugaauacuaaacaaugcauuagagucucuuaauaagagaauugaucagacagaagaaagaauuaaugagcuugaagacaggcuauuugaaaauacucagaggagacaaaagaaaaaagaacaacaacaacaacaaaacgaagcacaccugcaagaucuagcaaauagccucaaaagggaaaaucuuagaguuauuggccuuaaaaaggacguagagaaagagauacggauagaaaguuuauucaaaggaauaauaacagaaaacuugccaaaccuagagaaagauaucaacauucaaguacaagaagauuauagaacaccaagcagauuuaaccaaaagaagacuaccucaaggcaucuaauaacaaaacucccaaaggucaaggauaaagaaaggauccuaaaagcagcaagagaaaagaaaaaaaaaaacauacaauggagcuccaauaaaucuagcagcuggccuuucagugaaaaaccuuacaggcuaggagaaagugguaaugauauauuuaaagugcugagggaaagaaacuuuuacccuagaacacuauauccggcaaaaauauccuucaagcaugaaggagaaauaaagaccuucccagacaagcaaaagcugagagauuucaucaacaccagaccuguccuacaggaacugcuaaaaggaguucuuccaucugaaagaagagaggauguuaacggcaagaagaaaucaucugaagauacaaaacucacugguaauaguaggcauacagaaaaacacagaauauuguaacacuguaauuguggcauguaaacucccacauaccauaauuacaguguuaugauaagccaauauaaauaauaacuacaacaacuuuucaagacauaguacaauaagacauaaagagaaacaacaaaaaguuaaaaagcagagggaugaaguuaaaguguacaguuuuuauuaguuuucuuuuugcauguuuguuuaugcaaucaguguuaaguugucaucaguuuaaaauaauggguuaugccaggugcaguggcucacgccuguaaucccagcacucuaggaggucgaggugggcggaucaccugaggucagaaguuugagaccagucugaccaacauggagaaagcccgucucuacuaaaaauacaaaauuagccgggcgugguggcacaugcuuguaaucccagcuacuuggggggcugaggcuggagaaucacuuaggagguggagguugcagugagccgagaucacaccauuguguuccagccugggcaacaagagugaaacucugucucaaaaaauaaauaaauaaaaauaaaauaaaauaauggauuaugagacauuaauaauauuugcaagccucaugguagccucgaauugaaaaacacacaacggauacacaaaaaauaaaaagcaagaaauuaagucauaccaccagagaaaauaaccuucacuaaggggaagacaaggaaggaagggaagaaguaaaagaagaccgcaaaacaaccagaaaacaaaugacaaaauggcaggaguaagucccaacuuaucaguaauaacacugaauguaaauaaacuaaacucuccaauaaaaagacauagaguggcuaaaugcaugaaaaaauaagacccaaugaucugcugccuacaagaaacacacuucaccuauaaagauacacagacugagaauaaauggauggaaaaagauauuccaugccaauggaaaccaaaaaagagcagaaguaguagcuauacuuacauuagaaaaaauagauuuuaagacaaaaauuauaagaagagacagagaucgcuaguacauaaugauaaaggggucagucuagcaaaaggauauagcaauuauaaauauacauguacccaacacuggaacacccaaauauguaaagcaaauauuauuauagcuaaagagauagaccucaggcuaggcacaauagcucaugcccauaaucccagcacuuugggagguccagguggguggguuucuggagcccaggaguuugagaccagccugggaaacauggcaaaacucugucucuacaaaaaaauacaaaaauuagccaggcaugguggugcaugccuguagucccagcuaaucagagggcugaggcaggaggaucacuugagccuguaagguugaggcugcagcgggcugagaucgcaccacuccacuccaaccuggauaacagagcaagaccuugucucaaagagaaagagaccucaauacaauaacaguuagagacuucaacaccccacuuucagcacuggacagaucucccagacagaaaaucaacaaagaaacacuggacuuaaccuacacuaaggaugaccuaauagaacaaauggaccuaagagauauuuacagaacauuucauccaaaggcuacagaauacacauuauugcccuuagcacauggauuauucucaaggacagaccauauguuaggucacaaauaagucuuaaaauacucaaaaaauuugaaauauccagcauuuuuuaccacaauaucaagcaucuuugaauaaaaccagaaaucaauaagaggaauuuuggaaaugauacaaacacauggagauuaaauacgcuccugaaugaccagugggucaaagucaaugaagaaauuaagaaggaaacugaaaaguuucuugaaacaaauagcagaaacacaacauaacaaaaccuaugggauacagugcaagcacuaguaagagggaaguuuaaagcuaucagcaccuuguugggagcaagccccccaaaaucuggccauaaacuggccccaaaacuggccauaaacaaaaucucugcagcacuguaacauguucauaauggcccuaacgcccaagcuggaagguuguggguuuacgggaaugagggcaaggaacaccuggcccgcccaggguggaaaaccacuuaaaggcauucuuaagccacaaacaauagcaugagcgaucugugccuuaagaacaugcuccugcugcaguuaaccagcccaaccuacuccuuuaauucggcccuucccuuaguuucccaaaagggauacuuuuaguuaauuuaauaucuauagaaacaaugcuaaugacugguuugcuguuaauaaauacgcggguaaaucucuguuuggggcucccagcuccgaaggcugugagaccccugauuucccacuucacacuucuauauuucugugugugugugucuuuaauuccucuagcgccacuggguuagggucucccugaccgagcuggucucgcgcaaguggcguccauucgugggggcucaaauccaggucaaaggguugcugaagcgaugcuuggaacagaaaacuagcuggaggacacccgaguacucuuaaagcaguccccauggugaguaagaaggggagcucggaugccucaggguaacaaugggacagggauggggucugguucguuucaccuuagaacuuuuucacacugauaaugaggaggaacaagagaauagugaaguaacagaagagguuacagagcagguuuauuugccagcuaaagcuaaaguggcaaaggaaggagagguucaucccuacccuucugcacccccuccuuauuauuuugaagaaaaugaccccccggaucuuucuuuuccggaggacauugggcaaaaaguaguugccccagugacucuucgagcggcaccucgagugacggcucuuaguucuauucaggcaggaauucagcaagcuauacgagagggugauuuagagguuuggcgguucccuguuagaacaaaccccccagaucaacagggaaauauuacagcuacauuugagccuuuuccuuuuaaauuacucaaagaauuuaaaaaagcuauucauacuaaaaaagaauguagaaaaaaucagcaagucaggccgccagauagaggaaaaaggaaaacuguugagucugaaauagguccaacauauaaaaaaaggaaaacacuggacuagucagugucacucuaaguuugauaaagaugggaaccugauuuugggaaacaccaugaggggccugucccgggccccauucuaaaccagggcauuuccagcucaggccauucccucaccccuguacaaugucugucccccaccacagccgguagagcugcaguagauuuaugcugcacaaaagcugugagccuucugccuggggaacccccgcaaaaggucccaacaggagucuguggacccuugccagcagggacaauaggauuacuucuaggaaggccuaguuuaaguuuaaaaggcguacaaauacauacaggagucauugauuuagauuacaauggggaaauucaaauuguuauaucuacuucuguucccuggaaagcagagccaggagagcgcauagcacagcuccugauugugccauaugugggaaugggaaaaagugaaauuaaacgaacaggaggauuuggaagcacaaauaaacaaggcaaagcagcuuauuggguaaaucaaauuacugauaaacguccuaccugugaaauaauuauucagggaaggaaauguaaagguuugggagauacaggaacggacauuucaaucauuucucuauagcacuggcuguccacguggccaauucaauccgcucaacugaacauaguuggaguugguaaagccacugaaguauaucaaaguaguuauauuuugcauugugaggggcccgauggaugaccugggacuauucaaccaauuauaacuucuguaccuauaaauuuauggggaagagauuuauuacaacaauggggagcacaaguucuaauuccagaacaauuauauagcccucaaagucaacauaugauucaugaaaugggguaugucccugguaugggacuagaaaaaaauuugcaugguuugaaagaaccgcuuaaaguggaaaaacaaaguucccaccaaagauuaggaaaucauuuuugauggcggccauuguuaagccuccagaaccuauaccuuuaaaaugguuaacagacaagccaauuuggauagaacaauggccgcuaaguaaagaaaaauuggaggcuuuagagaaauugcuugcugaacaaucagaaaaugggcacauagcgccaacauuuuccccuuggaauucuccaguuuucguaauuaagaaaaaaucagguaaauggagaauguuaacugacuuaaaagccaucaauuccuuuaacagucauagauuuaaaagacuguuucuuuacuaucccuuuagcugagcaacacugugaaugguuugcauuuacaauuccugcaguaaacaaccugcagccugcuaaguguuauaugaucacuuacaaaauucaauuucucgugcugguuuaauuauagcuccuaacaaaauucagacuacuacucccuacuccuacuuggggaccugaguaaaugacacuaccauugugccacaaaaaguaaccauacguagggaucaacuaaaaacauuaaaugacuuucaaaaauuacuaggggauauuaauuggauacgaccugcucuaggcauuccuaccuaugccaugaguaaucuguuuucuauccuuagaggaaauccuagucucacuagcccuuggcaauuaacaaaggaggcagaggcagaguuacaacuaauugagaagcaaguccauaaagcucaaauaaauagaacagauccagagaagacccuagauuugcuaauuuuuucaacucagcauucaccuacugguguuauuguccaagaacaggacuuaguagaguggcuuuuucuuccacauacuaauucacggacucuaacuccuuauuuagaucaaauugcuacaaugauagggauugggaaaacucggauuguuaaauuacauggauaugauccuggaaaaauuauugucccucucacgaaggcacaaauacagcaagcuuuuauaaauagucuuacuuggcaaacccguuuagcugacuuugugaguauucucgauaaucauuuuccuaaaacgaagcuguuucaguuuuuugaaauuaacuaauuggauucucccuaaaauaacuaaauuuaaaccaauugaagguguugagaauguuuuuacagaugggucucguaaugguaaagcuucuuauuuugaaucaaaagguaaaguuuuucagacgcccuauacuucagcucuaaaagcggagcuuguagcuguaauugagguauugacugcuuuugaaaugccuauuaaugugauuucugauucuucauaugugguucacuccacacgguuaauugaaaauucucaguuacgauuucauacagaugaacaaccgaugacuuuauuuacccaacugcaaauagcaguuaggaguagaaugcacccuuuuuacaucacugacauuagagcucauacaccucuuccaggaccuuugacugaagggaauuaaauggcugauggccuaguugcuauugcaauaucuaaugcuggacacuuugacaauucaacccaugucaaugccucuggucucaaaugcagauauagcauuaccuggaaugaagcuaaagcuauuauccagugaugcccaacuugccaaaugguacauuccucaucuuuuacaggaggaguuaacccucgaggacuguaaccuaacucuauuuggcaaauggaugccacacauguucccucguuugggagacuagcuuauguacauguauguguggacaccuuuucucacuuugucugggcugcaugccaaucagaagagucuucugcccguguuaaaugucaccuuuugcaguguuuuguggugaugggcuucuauuaaaacagagaaugccccaggcuauacuagccaagcucuagcuacauuuuucucuauguggaauauuaaacacauuacugguaucccauacaauucucaaggacaagccauaguggaaagaaugaaucucucucccuaaaacagcaguugcaaaagcagaaagggagagacagagaauacugaacccccacaaaugcaacugaaccuagcauuauuaacuuuaaauuuuuugagccugcccaaaggccagaugcuaucagcagcugaacagcaucuacagaaaccagcugcaaagacagaaacagaacaacugauuugguggacagagccaauaacaaaaaggugcgaaauagguaaaauaauaacuugggguagagguuaugcuuguauuucuccaggccaaaaucaacagccgauuuggauaccaucaagacaccugaaaccuuaucaggagccagaugccgaggaagagacuccaggaggaucccgaggaccccccgguugcagccaugucgagaccgaugcugaggaggaccccaacaguuacgagcaacacccgucaaccacagccacccaccuggggacagaucaagaagcugucagagauggaggaagaaaaccugaggaaagcgggacaaccagucacaaugaauaauuuaaugguagcuaugauagugguuaucaccacugucgugaguauuccuucaauaagggccgguaauaaugccuggaugcaaucacucuaugacacaguuacacaugcuuucugaucucgguauuuaccauaauaaaucugcuccuauaauugaggcauaccacccucaaaaaccuauuuguaaacaggauuggacccaguuagaaaaaaugaacguacuuguuuaggaagauugcuuugcaaaacaggcagaggugcugcacaacgauuccuauggaaucauuauuaauugguccccuaagggaauguuaagcuugaauugcaccucucagucugcgugccauggccagacuauguucagaugaucugaacaaacugaucacaugguagaaauaccaaaaaguacggcaaaaguuccuauuaucuggaaccauggugguauaguggcaccucaaccucaaaugauagggcucguugugggagcuaaacauaaggauuuguggaaacuauuaauagcucuuaauaagaucaaaauuuaggaaaaaauaaaaaccaucuacaaagacacucuacaaacuugccuuuggauauugcaaaauuaaagaacaaauauuuaaagcaucccaggcacaccugaccuuaaugccaggaacuggagugcuuaaaggcgcugcagacaaauuagcagcuaguaauccauuaaaauggauaaaaacacuuggaagcucugugauuucaaugaugacugugcuuuuaaucuacguuguuuuucuuuguauagucugcagaugcagauucugacuccugcaagaaguagcucacugugacaaagccgcccuugcuuuuaucucuuugcaaaucaaagaagggagacacguugggagcaagccccccaaaaucuggccauaaacuggccccaaaacuggccauaaacaaaaucucugcagcacuguaacauguucaugauggcccucacacccaagcuggaagguuguggguuuacaggaaugacggcaaggaacaccuggcccgcccaggguggaaaaccgcuuaaaggcauucuuaagccacaaacaauagcaugagcgaucugugucuuaagggcauguuccugcugcaguuaacuagcccaaccuauuccuuuaauuuggcccuucccuucuuuucccauaagggauacuuuuaguuaauucaauaucuauagaaguaaugcuaaugacugguuugcuacuaauaaauauguggguaaaucucuguuuggggcucucagcucugaaggcugugagaccccugauuucccacuucacaccucuauauuucugugugugugugucuuuaauuccucuagcgccacuggguuagggucuccccaaccgagcuggucucagcagcacugacaucaaaaaagaagaaaaacuucaaauuaauaaccuaauggugcaucuugacuagaaaagggcaaacaaaaccccaaauuaguagaagaaaagaaauaauaaagaucagagcagaaauaaaugaauguggaaugaagaaaauacaaaagaucaaugaaacaagagguuguuuaucuuuuggaaagauaaacaaaauugacaaaccuuuagccagacuaaugaagaaaaaaagggagaagacccaaauaaauaaaaucagaaaugaaaagggaaacauuacaacugauaccacagaaauucaaaguagcauuagugguuacuaugagcaacuacaugccaauaaauuggaaaaucuagagaaagugaauaaauuccuagacacauucaaccuaccaaaacugaaccaugaagaaauccaaaaccugaacagaccaauuaacaaguaacaagaucaaagcuguaauaaaaagccauuuaguaaagaaaaacucaggaccugauggcuucacugcugaguuuuaaccaacauuuaaagaagaaccaaugucaauccuauuuaaauuauucugaaaaauaaaggaggagagaaacuuccaaacucauucuaugaggccaguauuacucugauacuaaaaccagacauggaaauaucaaaaaaagaaaacaacaggcuaauaucucugaugaauauugaugcaaaaauacauuuccaaaaaaaccccaacaaaauacuagcaaaccaaguucaacaacacauuaaaaagaucauucaucauuaccaaguuggauuuaucucugggaugcaugaaagguucaacauaugcaaaucaaucagugugauacaucauaucaacagaauaaacaacaaaaaccauaugaucauuucaauugacguugaaaaagcauuuuauaaaauucaacacccuucgugguuaaaaacccucaaaaaacuagguauugaaggaccauacuucaauauaauaaaagccauauaugacagacucucagcuaauauuauacuggauagggaaaaacugaaagcuuuucucuaagaucuggaacacaacaaggauacucacuuucaccacuguuacucaacauaguacuggagguccuacuuagagcaauuggacaagaaaaagaaauaaagggcacacaaaucggaaaggaagaagucaaauuauccuuguuuacaggugauaugauuuuauacugagaaaaauccaaagacuccaccagaaaacucuuagaacugauaaauucaguaaaguugcaggacauaaaaucaacauacaaaaaccagaagcauuucuauaugccaaagguggacaaucugaaaaagaaauaaaaaaaguaaucccauuuauaagagccacaaauaaaauuaaauaccuaguaauuaauaaaagaaauaaaacaucucuacaagaaaacuauaaaacacugacgaaagaaauugaagaggaugcaaaaaacuggaaagauauuccauguucguggauuguucaauauuguuaaaauguucauauuagucaaagcaagcuacagauucaauguaaucccuaucaaaauaccaaugguguucuucacagaaacagaaaaaaaauccuaaaauuuauauaaaaucacaaaagacccagaacagccaaagcaauccugagcaacaagaacaaaacuggaggaaucacauuacuugauuuuaaauuauacaacggagcuauaguaaccagaacagcaugguacuggcauaaaaacagacacacagaccaauggaacagaauagagaacccagaaauaaauccacacaccuacagugaacucauugucagcaaaagcgccaagaauaaacacuggggaaaagacagucucaucaauaaaugguucugggaaaacuggauauccauaugcagaagaaugaaacuaguccccugucuuucaccauguacaaaaaugaaaucaaaauggauuaaagagguaagucuaagaccucaaaccaugaaacuacuauaagacaacauugaggaaacucuccaggacacuggucuggguaaaaauuucuugaauaauacccuacaagcacagccaaccaaagcaaaaauggacagaugggaucacaucaaguuaaaaagcuucugcacagcaaggaaacaaucaacaaagugaacagacaacccaaagaauaggagaaaauaucugaaaacuauccaucugacaagagauuaguaaccagaauauauaaggagcuccaagaacucuauaggaaaaaacagaauaauccaauuuaaaaacuggcaaaagauuugaauagacauuucuccaaagaagacauauaaauggcaaacaaguauaugaaaaggugccuaacauuacgaucaucagagaaaugcaaaucaaaacuacaaugagauauaaucucaugccaguuaaaauggcuuuuaaccaaaagauaggcaauaauaaaugcuggagaggauguggagaaaagggaauucuuguacacucuuggugggaauguaaauuaguacaaccacuauggagaacaguuuggaaguuccucaaaaaacuaaaaauagagcuaccuuacgauccggaaucccacuacuggguauaugcccaaaagaaaagaaaucaauauauccagucgggcgugguggcucaugccuguaaucccagcacuuugggaggcugaggcagguggaucacaugaggucagggguuugaaaccagccuggccaauaugguaaaaccccgucucuacuaaaaauacaaaaauuagccgggcgugguggcacaugccuguaauuccagcuccuugggaggccaaggcaggagaaucgcuugaacauaggacccagguggcagagguuaacagugcagugagccgagauugugccauugcacuccagccugggcgacagagugagauugucucaaaaaaaaaaagaagaagaaaaagaaaaaagaaaucaguauaucaaagagauaacugcacuaucugcacuaugugcacucccaaguuuguugcagcacuguucauaacagccaagauuuggaagcaaccuaaguguccaucaauagaugaauggagaaagaaaaugugguacuuagacacaacagaguacuauucagacauaaaaaaagacugagauccugucauuuacaacaacauggauagaacugaaagucauuauauuaagugaaauaagccaggcacaggaagacaaacaucacauguucucacuuaucugugggaucgaaaaaucaaugcaauugaacuccugaggauagaaaguagaaggaugguuaccaaaggcugggaaggguaguggggaaggguagcggggagauggagguaguuaauggguacaaaaaaaauuguuagaaaguaagaauaagagcuaguauuugauaguacaacagggugacuguagugaaaauaauuuaauucuacauuugaaaauaacuaaaagaauauaacuggauuguuuguaauacaaagaagaaaugcuugaggggauggauaucccauuuuucaugaugugaucauuaagcauugcaugccuguaucaaaguaucucauguaccucauaaauauauauacuuacuauguacccacaaaaaucugaaauuaaauaaaauuuucuaaggacaugcaaaggcucuagaauaggaaaauaaucucuagagaugcuauuuaauaaucuuaaaaauauuauuuuuuguucuuagggcuuauacuaccacauuucaagaauuaaaguuacaauacucaagacaaauguauauuggcauaagcauagacaaacagaucaagggaacagaacagaguccagaaauagacccacacauauacaucaauugauuuuuguccaaggugccaagucacuucaauggagaaaggaaagucucuugaacaaauggugcuaacagacuggauaucuauccagguugacuuguaucucauuucacacacaaaaauuaauuugagauaaauuggagaccugaauguaaaacucagaaccauaaaacuuauagaaguaaaauaucuucauguucuuggggguaggcauccuugaacaggaugcaaaaagccauaucauaaaagaaaaaaauugauauacugaacuucauuaacauuaaacauuuuuauauuugacuuguaucuggaacauaaaaaacaaaucaauaauaaaaagucaaaaaaggggcaaaagauaugaauaaacaauucauuaaagaagauguaugagaaaccaaaaaacauaggaaaagauaauuagucaucaggaaaugcaaauuaauggcacaauaaaacaacauuuuauaugcauuaaaaugcuaaaaucaaagacuaacaacagcaaguuuggcuaggauguggagcaaguguaacccuaauacauuguuggugggauaaaaaaaugguguaacuauucugaggaacuguuuggcaacuucuuauaaauuagacauacauuuaccauaugacccaggaauuucacuuugauguaucuacccaauauaaaugaaaacguuuauguucuaaaagaguuuuauaagaaugcucauagcaagcuuauucacacuaguugcaaacuggaagcaaccggaacaucuaucgacaggagaaugaauaaacaaauugggauauguuuauacaaugaaauaccacucagcaauaacaaggaaugaacuacugguauauaaaacaugaauaugucucaaaaauaucuuguugauugaaagcagucaaauacaaauacauauuguaugagucuacacauacaaaagaaaacaaaucuaucuauagugauacgagucagaagugguugccugaaguggaaggaacugauuagaaacggguaggagaguacuuuuuaggagagucuuaugguaaugauggguuuagggaaugauccucaauugcucagauaacuccuucuccaccuccuuuuuacccacaacuuugguuaacucuugggugcggcuuacccaauguccuaccagaauuugauuaugcagaauuccuuugagaagaaauauggaaugcaaaaauauggaguauaaaauauguauaaaauauuaucuguauuguggaaauaaagaucaaccaaaugagaaaagcaaacgcuauuuagaccuugcuauacugaggaaguccgccaccauaacugccauuuguguuuuggcagaaacucaaaggcaggcagaggaguggcaaagauuuacaggugagaaaagggaaggcuugaaauguggcuugaauggaggcuguuggcauggggaagcuguagucaagguaauaaaaagugggacaucucgugugauggguuggggggugcauguuuggcugucucugguugaaucuaaguugaaaaugggaacaaaaauuaaggaaagcugucaguuaugaaucaaguccuggccauuugggaauuuuuuuuuuuuuuuuuuuuuugggaaacagggucuuccucuguugcccaggcuggaguacagugaucacugcucacugcagccuugaccucccaggcucaagugauccucccaucuuagccucccaaguagcugggacuaaaggugcgugacaccacacccagcuaauuuuuuaauuuuuuugaagagaugaggucucacuauguugcccaggcuagucucaaacuccuggguucaagcaauuuuccugccucagccucccaaagcguugggauuacagguaagggccaccaugccuggcucucauuaggggacuauuguuacagaaauuauuacuuagcuuccuggauugucaucagagacagcaaccuggcuuccugcaaguuugacuuauaacaggcuggcuucuuggacuguuuauuguagauaagggggaugguuucuugggcaggucaugggucaacguucuauuuuuuuacauggucuagucauuguccauuuguagaugucucauaguauucaucaaaauaggcugauucaugaagagagagagggcaaacauauauucaccaguguuaacuaacaugacacaaacuaaaauugucuaugaaggacaucacuaaaagugcugagagggggcuaagauggugucuagagaacaauauaucuguacuaccaggaaaaucuaaucuguuaaacuuaggguacaccaacacgggugagcaggcccucuucccuaagugagguuuugaaagcugggauuucaaggcuagguucuuggcuauucuuuuucuucuuuuuuuugagaaagagucucgcccugucacccacacuggaguacaguggugcaaucuucacucacuacaaccucugccuccuagguucaagugauucuccugccucagccucucgaguagcugagauuaaccaugccugguuaauuuuuguauuuuaguagagacaggguuuuaccauguuggucagguuggucucaaacuccugaccucaaacgaucugcccgccucagccucccaaagugcugggauuacaggcaugagcuacuauuuauguuaaaucagacaacugaagggaagaaaaucuggaggagccucucucccagguaaagcagcuucacugucagcuucucauagucagcuuccaccuagaauucugcuugggcuuccgugagauguaccuuuguuacaggcucagcugcacaauucucaucaccuggcagugggaagagggcuucuuccaacuauguugagauccaagggccagaggaaagaucacauacccuuucccuccccuucucuaucuuuucaguguuuuuugguuuuuuuuugcaaauggagguguauaguuuuuuuguuuuguguuguguuguuggugaguggggaggagaauuaacauuuuaaaguuaggagccuuguauuuuuuuuuuaauucaaccuguaagaagccuuggaggaaaaacccucaguaacugaggaagcaacugaaaaccuuaaguaaguucuuuggaaguuaaaccccguacaaguuuguuccauuucucuuaacccaaaugcuguuuauuugggcauuuagccacugacuuccaaccuccuaaauuacagcaguccuuuucaaagagauauccuacaauagcugcagauggcagauucugcccacauuucuagagaucugcccaaggaaguuugacuucuuauugacucuaaauuguuuucacauggaaauacauaacuggacguuuauuagccagucaccuuucuuggaauuaaaacuuauggcauuuuauaaguauccuuagagccuagccauaauccccuucccaagccuuucucaaauuugcauaguguuuugcuuuaaaauaauuguacaauaauuucucuuucucaaacaaaggauuuuuagaaggagccccaccuucuccaagucaagcaauucgguacuguuuacuucucagagcuaucagggccaaaaauguguaagaaaaggaaugaaaauuggcuuucugaacagcaagaaugggccacauaauaugcuucacacuuuauauaugaagcauauuauauaugaauaacauauauauguuauaguuuaucuucacaauagcccuauaacagagguccuuuuaucucuuuuuacagagaagaaaauggcuuagagaauuucccaggaucauaugcacaaauacagaacuugggcuucagaguuaguauauuguaaugguuaaugguaaaagcuuaggaguuagauugcuuggauucaguccuaacucuacugcuuacugugccaucuuggacaaguuacuuuauuccucuaagccuuggcuuccucuucagucagaugcagccaauagcaguaucuguuucauaagguccaggcuguaagcauuaaaugagauaaugcuuauacauuugcaagcugccucaacaugauuucucaauugcaugugauuucuggauugcuaguggcaaugagugaagagaaaugauucucaccuacuuucccagcucagagauggagacgcaggaaaaagucccuuuaucuucugcuucagcaaaaagcaaaggugaaauuccaaaaugaucaaaaaaucucaacacucaaucacaacugaauaacuaaugaagauauaaaauaauuuuugaugagacuaaugaagugaugucugaaugucuuuuuuucuuacagccuauuucuuaauuuaagccugaaggaaaaaauauagauuuggcauagccuaagcaggaauauugugugagaccagugcgugcacuaucaguggcuccuaugccacucugugaagcgugaguauacacaacuggaugcauucuaauugcucagguuaauccuuggcuguggaugcauccaaaauguuugcuaguaacaaucacuaaauccuagccccaagagguauuaauuuucaucugucuugggcuucuaguuaauuuaagagauauuaagcaauuagaaucucuuaauauucauaauuaaauuuauaauccugaauaauauaaaagucuuaauauacuguguccuucuaagauaagugacuguuuuucccacuuucuaaaggagcuaauauuuaagcugucaggaaguuccuuuugguaucagaaagaccaugguuuaagguccaauucccaagucacuacagcgcucugagucucaucugcuaauaggauaaaaccaccuacugaauagagugauuauaagaauaaaaugagauaauguauauaaaaugcucagcauaguauaauaagaacucaauauaugauggcuauaaucauuaugcucacuacagaaaaccagaaagaacagaaaaguauaaggaagaaaaaaguccauaauuucuucucucaaaggcaacuauuguuaacuauuggcuggucaucuucuuucucuauguaguuugucuuuauauaauuugguaucauaccacacaaacuauaugcaucuuguuuugcuguuuucuuccuuugggccuauuaauguaacuuagacauuuucccacaccguuaacaacuagccauaacaguuucuuuauggcuucuaauaacauaaauaaauacauaaauaaaaauaguuuuuccuaguuaugaggcccuugggaaugauauggucuugccuaccucaucuuccugccacugugaccuccugacuuugggaauucucaagucugucaccauccucacuugaggucacuacagagaaccuccuaaguguuuauagggugcuggguauguagaucccccaaaacccaaaugcagaccuuuauagaccacaguguaaagcaguacagaaagccuuacauuccacagccaucugcuuaacugacucucaauuuuuuucucccacacaguguaacagaaggugcuaaaaaaacaaaaacaaaaccccuaaaccugaucaucucucuucagcugaaguuuaagcuccuucuuucugaauaccuucucuaauaccuuuuuauucagagaaaaggcaagcugcauuauuuggcuuaaauauuuuuaaaaacugccaguauaucaaaauucaauuugguucuaaacauuugaauugccccaacucuacugcccauguugauccauccuucauuugccauugauauuaucucuuguuuuuucggagaacauaauuaucuaacuguggagcccaaaauuuaucccuauucgcagaauuagugaaagucaaauaaaaauuaaauguaaagauaaguaucuauaacauuuauuuuggccaacuaucuggagccacuguuuuuguuuuguuuuguuuuguuuuuucuuuuuugagacaagaguguugcucuucuugccuaggcuggagugcaauggcgcaaucuuggcucauuacagccuccgccucccagguucaagugauucucgugccuuggcuucccaaguagccgagauuauaggcgcauaccaccaugccuggcuaauuuuuguauuuuuaguagagauggagguuuugccauguuggccagccuggucucaaacuccagaccucaggugaucugcccaccucagccuccuaaagugcugggauuauaggcaugagccaccgugcccggcccacuguuuauuauuguuguaaaaagugaaagauuuauacaaucuaaagagaaaccagaggauuauuauuguucuuacuguugcugaucuuaaauaaguaggucuugagaagagcaacggccaagugucuaggcagagaacaaauuaaaauuaacuggcacacggaagauuagggucucugaggggucugagauucuggcucuaucagugaugagcuguaagacccaaaggaacacaaauucucugaaccuucuccccaucucaaaaacagaaauauuaaucuucacuuagucacccuuacagauuuuuuuuuuuuuaagauggagucucgcucuguugcccaggcuggagugcaguggcgcaaucuuggcucacugcaaccucccugucccagguucaagcgauucuccugccucagccucccacauccggcuaaucuuuuguauuuguaguagagauggguuucaaaccauguuggccaggcuugucucgaacuccuggccucaagcaauccaccugccuuggccucccaaggugcugggauuacaggcgugagccaccacucccagcccagaauuuuuauuuaggacaaauuaaauaaugcauguaagaguaauuuguagcuuauaaaaagcuauacaaacauaagggggagaguauuuuugcuuuauuuuauuuuugauagagucucacucugucacucaggcugaaauguagugaucauagcucauuguagccuuaaacucuugggcucaugugaucccccugccucagcaucccaaguagcugggacuauagaggcacaugccaccaugccuggcuaauguuucuuauuuuuauuuuuuguacaaacagggucucacuguguugccaagcuggucuccaacuccugguuucaugugauccucuuuccuuggccucccaaagugcugggauuacaggugcgagccacugugcccggcuguauuuugcuuuuaaauaaaagggaagggcgagacuagacaaucccaaacacauacaaauugccuuuugauauuuuaucuauacauucaauaaacuuuauccaugauuguccaguuuuccuccauacaugcaucaugcuaauuaaaggauuggcuaucuucaugcuguguuagaagaaacugaaguguuagaaagaaauagacuaacaugcuaucucaaggaguuuauaccagcugaagagggacugaggaaaguuagaaauuagagguaugaaggauuaggaucacuaagguuauaagaauuuuaaaauaaaaaagauacaaacagcuuagaauuuaaagaaauguuaggagauggcucuucccaaagaggggcaccauuauccaaaccucuagauaacugauuuugugaagcuauuauaugcaacuccuccagagccugacauuugauuacauuuaaaauucaucuuuugcuuccccuuuccuuccucccccauauaaaauguguucuugccccaaccucccacuuuuuccuccuuugauuuauuucaauuucaaucccuuuuaaaagucuggguccaguuuccuauuggccucuuuaacuucuccuugccuggcucugcuggcacacaccucccacccugacaucacaugagcauuccucuuuagaaaaagcacaucucauucuugcagaggagacuuagaacauuauucaaaacucaauuacuuuuuugaaauuuaaaggauaagaucucuaaauuccaagcuguuucccuaggaggguagaagacgugggggaagagaagcaaugguaguuccaaaccgguucagacuuggucauuggugguggcuccauggcauucucauuccauccgggcaggcuccggggccagaggcauucagucaaagcaggugggaggagggaaacacaagcacacagacuagcaaagauaaagauggagagaaagaaaacgguaaaauaaaggaaggaguugauaggggagaaggaaugucagaaacaaggagggaagauggggaaaauggagcaaagaauaaaggaaaggagaagacagggugaguaauagggggaaaacugaagagagaaauagaaauaggccaggaagaacacagaaauggcugggguguuaacaggagugggguccagacagaccaagugggaugggcagagcagggaaagaggaggggaaggagcgggggagacugccaugccuagccucgaucuauuuguguucuuccuuacacugucaucgguagcugccuuaucaauuuucaccucuggcaggagacgcccgccgaugugggagccggggccgccgaugagggacaccacgccguugcaguccaccgugcuguugcgcuucacgcugcgccgcaggcuggggaagaugcgcgaggagcggcugcccuggcuguagccgcuguagccgcuguagcugcuccggcgcucgcgggcccggauggggaugaagagggagucccggcggcccucgcucuccuccaccgugcugugcucgucauccgcgaacucauucucggagcccgggucucggaaccgcccagguccccugaaacugaagaugcugcucuugcuguuguggcgggagaggaagggcgagccugggaugcugagcagugacugcaggggcagacagggaaagagagagggacggggaaaugagacgggaguguggaccuuuauacugagcaaagugguuagguucccagccggccccacccucgcacuccugugaucagaacacaaguguuuccagaaagcacuucugcauguugacugcuacaguucaucacccauuguuacucaccugugcuugaccaguuacggauucaaaacgucuacccacuguucuugcacgcaucccuaagaugcuuuuaucucacauuauacacaacuuauccaggguaaagcacauggcuguguauuucuuuuuaccaugggcucagaggaggugucuuuaacuucaguuagacuacgccacacugggcaaaaagaauuuauuuauuaucauauauauaacaauaaauaaauauuauauauauaacaauaaauaaauauuauauauauauauauauauauauauaauuuuuuuuuuuuugagauggaguuucgcucuuguggcccaggcuggagugugguggcgcuaucuuggcucacugcaaccuccagcuccuggguucaagagcuucuccugccucagccuccugaguagcugggauuacaggcauccaccaccacgcccuggcuaauuuuuguauuuuuaguacagacaggguuucgccauguuggccaggcuggucucaaacuccugaccucaggugauccacccgccucggccucccaaagugcugggauuacaggcauaagccaccgcuccuggccaaaaagacagaauuuaaaacgugccuguaucauuugccauucucuccaaguacauguccuggucaacuacuacuccaacaguggccuucaagccuuuuaguucaguugaaaauuauauaugcccccucccaccccauuuuauuuauguauuuauuuacuuuuccuuuucuuuuauuauuauuauacuuuaaguucuaggguacaugugcauaaugugcagguuuguuacauauguauacaugugccauguuggugugcugcacccauuaacucaucauuuacauuaguuauuucuccuaaugcucucccuccccccucccccaacccuaugucaggccccaguauguguuguuccccaaccuguguccaaguguucucauuguucaauuuccaccuaucagugagaauaugcaguauuugguuuucuguccuugugauaguuugcucagaaugaugguuuccagccucauccaugucccuacaaaggacgugaacucauccuuuuuauggcugcauaguauuccauccaccccauuuuaaacauauuuuuuucaucaaaaguuuacauaguuguaaaguauauaauucucaaacagcuguaaguuauauaauauccggcauugauguuuuuaaauaaaacucuuguuuaccguaaaguuugugguaaagaaauuuacuuaaagaauucuuuuuuuuuuuuuuuuuuuugagacggagucucgcucugucgcccaggcuggagugcaguggcgcgaucucggcucacugcaagcuccgccugccagguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaagaauucuuuagcauaaauuuuuucuuauuuauucuucuccuucaauuucaugcuuccuuuccauauucccuagggaauuuuauuugaauguacacuuuuauguuuuaauguauuuuacugcucaccccugaauuuacuucucuauguugcccaggcugaucucgaacuccuggguucaagugauccuccugccuuggccucccaaagugcugggauuacaggagggaggcaccacgcccagccuguuaacacuuuugauguuaacacuggaagggccauggggcuccucuuuaacauuucugcccuuaucuuuuuguuggcuaugauuccaacaaauuauacaaaaaauuauaaauaaacuguacuuacuauuaaaaauuuucuaugagcaugagucuuuaagacauuuaaauaauucuccuggauugaguuuuuauuaauauucuuaugaauacaauugaucaagcuauagaaauauauuacacauuuuauagguaauagacuuaagaaagaaaauuguauuaaaaugcauuucuuaauaagauggaugagauuuucuuuucaauugguguuuaaauauuuguugguaguauuacuuauuauuagaaugagacauggcucaacaucaauccuccccaccuuucuaauaaucaauuuuaugugcuaaaaccuuauucacauaaauauuaucuuggaauggaagaacuuuguuauaguaaugucacucaauucuuuggacuccuuccaaguuauauaccaaaaauauauagcaaacuaucagcaaaauuuauuguaauaaucuaucggcuggcaauuaagucuuuuuccaauuuuauugaaagcaaagaacugaaaacucaauuugccaaaagauuuguuaccuacacacauucccuuucuugauuucugaggacaucaaaaagcuguauuauuuacuaauaauuauguggguuauucucacaugaguuacucuuguacuuaaaggaagcucguuuaacccaauagaugguugaaaugaucaaaauauuauuaaugucuuuccaucauugccaacauuuauuuuuaauaugauuuuaucuuaucacaugauuuaaauauauuuucaucaaaaucuaccuuaaagucacagauuuagcucauuucugaaaauguucaaucacaugaucuaaugagcagucaguccucaaugucagagcaauuggcuaaauuagauuuauuuucauuugaaaaagcaugaucccauuuuucacuguuaauaaauguauuaguauguauugcaagggcaacaaucuccugaaauuaaaacaucucaacauccccaguuauaauucuguuucacucauaacagaaauauguaaaacagaaauaugccucaaaccccugggcucaaggcauccuccugccucagccuuccaaguagcuaggacuacaggcaugugccaccaugccuggcuaauuaaaaaaaaauuuuuuuuaauagagauggggucuguauguugcccaggcugaucuugaacuccuggguucaagugauccuccugccuuggucucccaaaguccugggauuacaggagugaggcacugcgcucagccuguuaauacuuuugauguuaacacuggaagggcuauggggcuccucuuuaacauuucugcccuuaucuuuuuguuggcuacaauuccguuucugguucuauacuuuagauccugucucuucuuguaauguacaaagccccuguccccagauugguauauuuucuuuggauaauucuaguugcauauuauuccaugcucucaccuguaucuuucacguguuauguaggcuuuuccugcuuuggcuuuaagcaacccacgaacuucuaagacaauaaaugaauuugaucacuggggaccacaucaagaaaagcacuaaucauagauaauuauauauaaaugucauuguuagauacaugccauaugcuauauauaggucucuagaaaacaggaugacccugacuuauuuuguucuucugccucauccuuguaccagagagaaggagcuacauugguuagauuccagaauguugacugagccucauuuaugaguagauguugucacuguguguuaaaaggacacauacgcugugugguaaaggagcacauaacagaggaagcccuugcacguccuucuuccauguugcuggauugguaagcuuacuauucuucuuacauguauguuugggcacccccuuugaaucacugauuaauuccccugaaccagcucugcucggugugauucacaggcagcuaguacaugacuuguuauuggucugcaaugagacaaguaaggaaacugagaggggcauuuagaaacuuuuguaacaauuagacacagucauaacaucuaagaaugugaugauuuuucuagaaauugauuguuacuguauuuuacaauaguaucaguucaugaagaauugggaaaaauagaaaugaguccuuuaccacagguaacuugagaaacacugcucuaaacaauguggcuggccagaagauggugucuuaagauguacuugggauuuuguuuuaaucagaucacgguaaggugacagacacagaggcaacugccuuugaaagaagaguucguuacuuccguucccaagaggagugggcuugccaugccauggagggccauacggggaaauauaaguguuggucaggaagcagaaggagugagggggaaaguuuagccugagccugugguuuccucaggaaggaagggaugaggcaggauagguaagucugagcaaguuuaggauuggggaguuugaauaauuuuggaaggcucuggccuacagaggugguaacuacuugucugguaucuggcuauggggugauuuagggaagggaaauauuggcuuagugagugaguuagauaaaggagguaguugggaaugugggcuuuggacugguugaucuguacaugaaaaacaaguuugaaggcaagcguaacauagaacacugagguucagcguacaagcccagguguuaauaaccggugccuugggcacauauaucucucuugagggcgucacugcggagaaauauggccaggaaaacacaggacucagguacucauggccccuuugcuaaaugccacaaucaccuuuaacacuaucacaccgucauaaaaauggcauucaagacccucccagcuuugacucuaauuuacuuauucuacuucaucuuucacuguuuucucauacacccuaccaugcagccacccuaccgcaggucuuuauuuccucuguuuccagugcacgcuccauuuucagcuggggaaauccucucaguucuccaugauccagcccuucugcuucuuccucuacuaacuuccuuaaucuuuccauagcaccaaacccccuuucagaauauuuaugcucuacuuuauuuuuuauuguuuucuucaagacagggucucacucuguugccugggcuggagugcaauagugcaaucacucacugcagccucaaccuccugggcucaagugauccucucaccucagccucccaaguagcuggaacuacaggugugugccacaccacacaguaugugccauaccacgccuggcuaauuuuuauauuuuuuguagauacaggguuucgccauguugcccaggcuggucucaaauuccugggcuaaagcaauccucccgccuuggccucccaaagugcugagauuauaggcgugagucacuguauccagccuacgcucuacuuuuuacaacaguucuuuauauacauguucuaccucucauuuuuaaccaacuacaaacuccuuaagggcacauugacugauucauccuuauaucucccagagugcuuugcacauaguaacuacaauguuuaacuuaauuaacaugcacuuagauuagguacugcagcuuagccacccauuuuaggguuguuccacaccugcacggggucacugcuucacuucucacagcaagcuaaacuacacugaauucauaauuuugccuuaggucaaugcugggugcugauacuaccugguacauuaggccuucacauuaggaaagagguuuuaugcauuuuacaauaaaauuuaauuuuauauaauuuuuuuuuuuuuuuuuuuuuuuuugagacagagacuugcucugucacccaggcugaagugcaguggugcaaucuuggcuugcugaaacuuccgccucccagguucaagcuauucuccugccucagccucaagugaucugcccaccucagccucccaaagugccaggauuacaggcgugagccacugugccuggccaaaauuuaauuuuauuuaaccaaauaccuauugugugcuaagugguguggauacaguggugaacgagacauaugacauggucccugcccucuugaaacuuggaggccaggaggaaauaucauauacuacaugagaucuaauacaucagacuauucuuaaccuuaaggauagugauaaggaugauaagacagugaugaagguuaugaccaauucagugaaccuaugaacacuuaaaaaucaggauccuaagauaauacauaauaugaggaaaaacuguucuauuauuuucuaauuccuuguuucacucuuugcaaaagaguagucugcaauggacaaaugugaaagggguaaaggugacuugcuccauuucuccuuguacccaggauccaauccugauuuagggcauucccuaaggagcuacauccugagggcugaaaccccaacccuuccucaaucucaauuuuccuagacuagagguuuucagugaugacucaggauccauggcucuauuaaauccugggauccuguguaguuuaugagaugaguaggccuuacucccucuuuucaaaaucuuccugucaaccaaccaggagcuuuuaguccuuuucaggcagucacaguuaaacuaugaauuccaacuuagguuuagauguuugcucgggagaauggcucugggauguucuggauuugagaguguaacuuuugcauuccacagaaaaauuaucucuagggaucucaggggauacacguaaauugucugucaagaugaggcuuacaugacugggauguuuggaaugugaugaaggagugauuuuacauguucuauuuccaugccauauuucacuuuuucuuucuaguauaacacugguucuuaaaguguggucuggagacccccggaggucccugagaccuuuuaaggaaggcucaugaggucaaaauucuuuccuaauaauacugagaugauaugugcuuuuaucacucaucuucucauaagcacacagugacacugugagccugacaguuucauaauauuuaaauaguuuuaugaugagauuggugguaauaauaaauauaguuuuaaaaucuuguguguauuuggaagauuugcauaaacucaggaaauuucucaaaugaucaaugcaugaugcuagaaaucauucacagguuaaagaucuauggcacaaaauggagcaagggauuuuacuauaacagaguacaaaguuacuguuauaguuuccacgucacaacuaacuguuuaaauaauugucacuguuaaguuuuggaacagcaucaaggaggaacauucacaguuaucugaaaagguuauuaaaauauuccucccuuuuccacuacauaucuguaugaaacuugauuuucuucaaauaccuuaaccaaagaaaaucauacugcaacaaacugaaugcaugcauaagccaguaugauauuucaacuguuuucuauuacauuacagauuaaagagauuugcagaaauguaauacaaaaaaaaaaacccuuuuuuuugguuuuggaaaacaguucauuuuucuuaaaaauauauaauuuguguuaaucauguaauggguuuaucauuacuauauuuuuaaaauuaguaaauauuuuuuaauuuucuuaauuauaauuucuaauaugagaaauuaaaagcacauuuuagaaagguuuuuagguccucaaaauuuuuuaagaagauaaagggguccuaagaccagaaaguuugaaaacugcugcaauagagcaauuaaaauacuuugaaaaaauaggcucaacuuaauauuuauaaacugcccugagccuuaaaaauauagagaaauaggucggagaugagugagcaggagaugucucaagaagaacucaggcucaaaauggagguaaaaccaccgccuggucgcccccaguccgacuccagccgucgacauugccaccggcaggaagagggccaugacccaaaggaaccagagcaguugagaaaacuguuuauugguagucugaacuuugaaacuacagaugauaguuuaagaggacauuuugagaaauggggcacacucacagauugugugguaaugagagacccccaaacaaaaugguccaggggcuuugguuuugugacuuauucuuguguugaagagguggaugcagcaaugugugcuugaccacacaagguugaugggcauguaguggaaccaaagagagcuguuucuagagaggauucugugaagccuggugcccaucuaacagugaagaaaauuuuuguuggugguauuacagaagauacaaaggaauauaauuugagagacuacuuugaaaaguauggcaagauugaaaccauagaaguuaugcaagagaggcagaguggaaaaaagagaggaucugcuuuuguaacuuuugaugaucaugauacaguugauaaaauuguuguucagaaauaccacacuauuaaugggcauaauugugaagugaaaaaggcccuuucuaaacaagagaugcaguccgcuggaucacggacaggucguggagguggaucuggcaauuuuauggguugcggaggaagcuuuggaggugguggagguaauuuuggccgugguggaaacuuugguggaagaggaggcuauggugguggaggugguggcagcagagguaguuauggaggaggugaugguggauauaauggauuuggaagugacgguggcaacuaugcuggugguccugguuauaguaguagagggggcuaugguggugguggaccaggauauggaaaccaagguggugugguggauaugguagcggugguggaggauaugaugguuacaaugaaggaggaaauuuuggcggugguaacuauggugguggugggaacuauaaugauuuuagaaauuauaguggacaacagcaaucaaauuauggacccaugaaagggggaaguuuugguggaagaagcucgggcagucccuaugguggugguuaugcaucuagugguggaagugguggauauaguagcagaagguucuaaaaacagcagaaaagggcuacaguucucagcaggagagagcgcgaggagcugucaggaaagcugcagguuacuuugagacagucgucccaaaugcauuagaggaacuguaaaaaucugccacagaaggaaggaugauccauagucagaaaaguuacugcagcuuaaacaggaaacccuucuuguucaggacuaccauagccacaguuugcaggaagugcagcuauugauuaaugcaauguagugucaauuagauguacauuccugagguuuuuuaucuguuguagccuugucuuuuucuuuuucuuuucauuacaucagguauauugcccuguaaauugugguagugguaccaggaauuaaaaauuaaggaauuuuuaacuuuucaauauuuauguaguucaguuuuucuacauuuuaguacagaaacuuuaacaaaaugcaguuuugaagguguuuccuugugaguuaacaaguaaagaucauuguuaauuacuauuuuguaugaauuuugcuaaaguuaacuguaaagaaacaccugcugacuugcaguuuaaggggaaucuauucuccccauuuccaaaccacuauaugaauggguacugacguggagagaauagauaauuuguguguuugcaauguguguuuuagauaaauaggauugaauauuuaaauuagcauuugugaauuuaauagcauuacgauuaccuucaaaugaaaaaaaucucaaaauuucuaaaaaaaaaaaaaagaacucagaagcuauggaaauaaaagaaacugacacauaacugaacuauguugugagaaaacugaagccacauucauuguuaaacuaacagaagagaugaucauguacgugugcaggaauaaagaaggggugguuaggagcacaggcucuggaguuggaugaaccuggguucaaaucuuggcuugaacacuuacuaguuauauaaccuucuauaacuaguuauaguuauaagugauucuuucuaggccucgauuuccucagucacucuuccagagaaacugcaggaaaguccugggacaaagaauacuacuaucccuuguagcaucuuaagcuacucuuggcagucagccuuggccucuaggaauuuacuauuuuuuuugaauggagagauuagacuaagugaauauuuucaugcacagcagggcaucucaaaaaccugguuuuauuuuuugaguuaaggagcaaucaguguaccuuuguacuaaagccuauagaauaaucagagaccauucaauagcaaagcguuaacagcgcuaagguauucauagcucagugagucucucaagacaaggguaaaauuacaacaaagcuacuaucauacuuuccccaaaagaggcugaacuagaagaaaggagaggugaaggugagauagagauggcuucaggcuauaaagaagucucucagaaaggguuaaaucaaauuucuaaaagucuugcauucauuugucuaacaauaucuagccaugugcuaagaagcagaccuugacuuuaacacuuuauuuagagagaagaggauaugagcauaaauaaauaugcacacagaguauauguagaguacuuucuauauguagaguaaaaagcaacaaauaaagagguacauauaaaacauaacagaaagauaaaaugaagauuuccaacuagaaaacaggagagucagggaagguuucuugaaaggaagauauugagaauaacuaugaugcagaaauucaaagacagaaaaauagggcauuuuauuuaauuuuaauuuuuugguuuguuuuuguucuuguuuuuuuggagacagggucuuguucuguugcccaagcaggaguguagugguaagaucacagcucacugcagcuucaaccucccaugcucaagccaucuucccgccucagacuccggaguagcugggacuacaggcaugggccaccacgccuggccaauuuuuugguagagacaggggucucucuauguugcccaggguggucuugaacuccuggccucaaaugauucuuucaccuuggccucccaaagugcugggauuacaggugugagccacugugcuggccaacaggacauuuuagagaggguguuucuugagcaaaccacagaggguagaaaacaaacaucauauaugagaaauaucuaguagcucauucugguucagguauagggugcuugauggggcacagagacuggagaaugaacacauagguuguaaccguacuaaggggauggggaaugcuaugaauuccaggguaaggaguugggacuuaauuaguaaauagaaugaaucugauuaggggaauucccucucccauucuucuuaaaaacuauucuaaacugucaauauuuucuuuaaaccuccaaacacaaccucucauucccuucaauaagauguuuaauucccuacauuaucaaaaaauuaauucauuuuuuguagagacagaggucucacuauguugcccaggcugaucucaaacuccuugauuuuuaauucccaacauuaucaaaacacuaaacugucagggguuaucuuccucaacuuccuacuccuuuucuacaaauuuauccaccucauccuucccuguuuucuuaagguuucagggaacaagggucccuuuucuguuaaaaaccacaucuauuucgguaucuuccaagauugugcucuacuucuaucuauucuauuucauuuucuaacacgucucccuuuucuguuuuuuuuucuuccacaaaguauaaacaugcuuauuuccacccacacucuuuaaagaagcugggaugagaagucuauacucauugucuccacuccccacucaacauggcauccuuccuuacucuggacuaaaacaugucuuuaaaguccucaaugacuuuauauugccaaauccgauggacacuuucaauucugagcucacuaagcaucucuguuaaauuucaauccauugaucauggcccugccuucuccaacaucgcuacucuccugacuucacugaacucuuggcccucucagcuucucuaacacuguuuauccguuuucuuuccugaacuccaucucuaugccagugaacagcaauggucaugccuuuggcucacuauucuuccaacugacacauucucuuugaguaaucuccacaagucucaugguuucaaucaccaccucucagcucaggaccucuucccugagcuaucauuugccuauccuugucuaaaaaaaucuguacuugguuauccaacaaauaauucaaacuuuggaugucuaaacuggaauaugcuucccuucuaaaccuagaccaucccuuuuuucuuauuguucccucaccaacacacacauacacuaccuaauuccugucuauccuuuaagcuucaguucagaaauuuaccuuucccagaaaaucuuuacugaaucuccauguugggauagaucugugcuuuucuaacacccccagcauaucucaauuauggaauaacacaugcuacuacauaauuuuuuaguguauucagcugucucacuguacuguaagcucucuaggguagggaugauguuuuaaucaccuuuuaagcccuaggaccuaguacaauccuugauauguaguagguacuccauaaaugccuacuacaugaaugaugagaacuacauuuuaggacguaaucuguugacaguauauaaaauacaaaggagaaggagaaagacuacagaaaacaaaacugcaguggacaaacgcaguagaacaaaauaauacaauuguaaagccaaaacuaagauaagguuaaggaauggaaagaaagggauggacaugagggauuuugcucauccccugaaaugaauaagacuggcaaaagacugaaccggaaagugagagaugcaagugggaaaaugaaucaucucugggaaaaaagaaaagacacuggauauacugccauaaacaguaacuauaaucuauucuauaccuaccaacuuuccagcauuucuuuaaaaugggaaauuaaauggccuaagaauuagauuuuggugguguucucugaaauucaaaaauaccuauuuaugugaugacaucuauaguaacagaaugcucaacaauuacccuaagucuucucuucucuuuuuugcuuaguuuccuuauuuaucaaaguugggaaaaacuggaggcuuucaaucuaccauaggcuaacuuaucagugugauacuacauauccagaauaauuaaucaguagaacuugccaugcucaaauaagauguccuguuucaugacuccuauuauuauuauccccuauaauuaaaugcaauucuuaaacagagauguuugagcuaaauucugaugcuuagaggagaaaagcucucccugauguuuuagaacaugaagauugcuggugugacauauacuuuacugccaagcaagucugccaaaggugaucacauagucuaggguuggcuuuuacaucagagaagggagggcaggauuagaauggagaauguuccaaaugugcugguaacacuuccucccagaggagaacaauauggagcauagugagguagaaaugaggaugcagggaugggccuggaaaacauagggccaaaggggaaaacaaaaaucaagugggauuagaaaaaccagauguuuuuaggcuuauugagccaaugcaaagaguuuaccuguugugggaaugcacguuaguacaaugaguuuggagaagaguauggaggcuccucaaaaaacuaaaaauagaauuaccauauaauccaaugugauaguuaauacugcaugucaacuugguuggacugaaggaugcaaaauauugauccuggguguguuugugagguguguugccaaaggagauuaacagucaagucagugggaugggaaaggcagacccacccuuaauguggugggcaccauuuaaucggcugucagugaaaauaaagcgggcagaaaaacguaaaaaggcgagacuggccuagccucccagccuacaucuuucccccaugcuggaugcuuccugcccucgaacauccaacuccaaguucuucaguuuugggacucagacucacucuccuugcuccugaaguuugcaaacagccuacugugggaccuugugauuguguaaguuaauacuuaauaaacuccccuuuauauauuuauauacuaauagauauauaaauauauccuauuaguucuauaccuuuagagaacccugaauaauacaccagcaauuucauuaugggguauauaacuaaaagaaagucagucaauauauuaaauagauauuugcacucccauguuuauuguaguacuauuuacaauagacaaaauaugaaaucaaccuaagugcccaucaacaaauaaauggauaaagaaaaugcaguauauuuacauuauggaauacuauucagccauaaaaagaaugaaauccuaucauuugcagcaacauagauggaaccagagguuauuauguucacugaaauaagccaagcacagaaagacaaauguagcauguucucacucauacgugggagcuaaaaaaguggaucucuugaagguagagaguagacuggugguuacuagaggccaggaagaagaggggauagaggggaugaaagaggaaaaagaagaauauaauugugcuuaacacugaacgguacacuuaaaaugguaaagaugguauaauauacauauacacauuuuaccuuaauaaaaaauacauuuuugaaaaagguauagaaaaaagaagaguuuaccugauucaugauggaaaauuuccucccuauucuguugucuggcagccgaaaggccuuccuucucaugccaucuucugacucugacuuaaacaccuucucgggauccccuuucuccucuccuucagagaguuccuuuugcuuccucuucuuucuccuguuacgucuuuccuuugcacucuuugagcugaguuuagagauuucagaagagcuccgaggggagcccccuccuucuucaccuucuuccucuauggcaucuucugagacaguuccugcugaaguggccaucgcagcagccuaggaaagaagccacagcagggaagccagaccagggcaauuaacuggagccacccaaagccaaccaguuaguacagaacauuucccuacugaagggaaaggaggaaaaaaggaggcaggaaaccuagacuguuagaggguuucuguguauucuggcacacagcccuaagugaacagagcagaacccaguggugagaacuuugggaguuauucucuugagcauuucagacaagaacuugacugcugccuugguaccagaggaucccuucugagcaagucuggaaaugaaugcuaaguaacauuauauauuauggguccuaaaaauguauaaauacauguacauuuagauaaggaugagaaaguuaaguguuaaggugaugagaucacaaaugucuuucaaguuuuacuuuaauauuuugccuguaucuucuuuuuaauuagaaauaauacuuuuuaugaccacaggaaucuuaacauuucucccaagaaaaagaauaugcuuaugugaaacacuauauaaacugcccuggucacuuuuuucuucccagucaucauggcgguugcacacugaacaguugagcaauucaacaaaagaugauaugaacaaacaauuuggcuguuaagacaaauggaauaauuggagcaaccaucugcaguuguuacuuggguuauuuucaucagaccaauggccucuauuugaaaauaugccuagaaaagaucaacugcagugaaaaucagauggggucuuagucaccaugaucuggcaggaaggucuauugcaaagaauucaucaccaaccugugccucuuccuguugcuucuuaaguugcuccaacauugcuuuaaauucagccucuuuuuguucugccuccuccaguguugccugauucuguucuucauaagccauggccaccacagccaagaucaaguucaccagauagaaagaacccacaaagaugaccaagacgaagaagaucauguauguuuucccggcugcucguaaagucugcaaagacaaaggccauuuucugagucacuuguaccaaaugaaccgggcugaaaacagcuaaugggccaaguuccucuguaagggcacuauuugcauuuuguacaggacuguuuccuugugcaguacuccuuccuauugugggcacuugguacucccaaugguugaaugguuucacuuauccucaacucauauuaaauggcaguaguuaucucccaaccauugugacaaaaaaauccccucucauuucuaaauauuccccauacacuucuuucauaaaaaaaguuugauuuugggcuaagacaaguauaaagaaaagaauacaagacugcaguuuauuuaucuacagauccucaaacagcauuaacagacaaauuaugucucugaaaucagguccaaguugaaggaaaucccaucuuuuuauuuuauuuauuuuuuuuuugagaugaagugucacacuaucaccuaggcuggagugugauggcacgaucuuggcucacugcaaccucugccucccagguucaagcgauucuccugccucagccucccgaguagcugggauuacaggugcccaccaccaugcccagcuaauuuuuuuguauuuuuaguagagacgggguuucacuauguuggccaggcuggucuugagcuccugaccucaugauccacccgccucggccucccaaagugcugggauuacaggcgugagccaccacgcccggacccauuuuuuuuuuuuuuuuuuuguagguggagucuugcucugucacccaggcuggagugcagugccaucaucucagcucacugcaaccuccaccucccagguuaaagcaauucucccaccucagccucccgaguagcugggauuacaggcaugugccaccaugcccagcuaauuuuuguauuuuuaguagagaugugguuucaccagguuugccagguuggucuugaacuccuggccucaagugauccaccugccucggccucccaaagcgcugggauuacaggcaugagccacuguguccggccaggaaauccccaucuugagugacacccuuccuuauucuuuugcaauaggaugaguuuuaaaaggauaugacaauaugacauaaaggauagugggggagguuaaaaaaaggcagaaggaaacuagguuuuagguuaugugcaugcaacccacuauuacacaguuuucaucuuuauucuguuaaccacaaaaugggccaggcacgguggcucaugccuguaaucccagcacuuugggaggccaagacagguggaucaccugaggucaagaguucaagacgagccuggccaaccaacauggugaaaccccgucucuauuaaaaauacaaaaauuagccaggugcgugcgucaugccuguaaucccagcuacucgggaggcugaggcaggagaauuguuuggaggcugcagugaacagagauugcgccucugcacuccagccugggcgacagagcgagacucugucucaaaaaagaaaaaaaaaaagaaacagcaucaaucacaaauauuucaugagaaacauucaaccugagggaacucuaggcugugcaacagaaagguaagaauuaacucagauauuugaacuagaaacuucccuuaaagaggguccuucaugccugaggggacguguuuuucauuuucaaaguaacugguaucaccaaaugacacaaagagaaaacaauggacugucauaaaauuucuaagcuguaagacacuuagcaaucacuuacacuaacuucauuacaaccagcaaaguuaaaugacuuguccagagucaccaguguagcccaacagaauguuacugaccuuauuuuuaucuguacaaccugcuugaacaaauccaaauguguuacaaaucucaaaaauguugauauacuccaagguccuuauggaaauuccaucuauauagugccuugcacaaagagguguuuaauuuuucuuaaacagaagcccuaaugguggcucacgccuguaauuccagcacuuugggaggccacagugggaggaucacuugaggccagaaguugcaagaccagccugggcaacagagugaaaucccaacuuuccaaaaaguagaaauauuauagccagguguggugguacaugccuguaguaccuaccucaaaaacaaaacaaaacaaaacaaaacaaaaaaaacaaacccuaaccccaaauauccaaaaggagauaugcugcagaggaugaacaauaggaaguagauagagauagcagauucucaggccagacaagaggccgucaaggcuguaagagucuacagcuauacaugacugagcauucgagaaacagggaugagaacugagagaauucacuuaauaucaaaaaccagcugacugugggaaacacaacaguuagaucuuguauaaugucuucacuaaaugucucucacacagaagguccccaaccccauauaagcucaugcaaacucuauggccaaaggaaaagagguauuacucaccaauugauacaaguuuucccaauaguccugggucauaaggcgaaauaaugccaagaaggcccagcuaaaagugucaaaacuuguguaaccauaguugggguuccuuccugcuuucauacacugguaucccucugggcauugccuaaagaaagaaagggaaguucaggacuuuucaacauaauuccacccagccaugaccuuggagauaauaaauaacauaauucuauuuacuccaugaccuuggagauaauaaauaaccauugauagagccaggccaacaaauuagaagaaaaagaagaaggaaauaagcagcuaaccaacuucuggggacagccuagggucagaaucaccuggcauggucuuuaaaaaugcagauuccugcauccuuacccaaacuaggaauuaaaaguucuggauaugggaucuaugaaucugcauuuuuaagagguaugccaggugauucuuaugcaugccaaagugugagaaguacuguucuagauucauaucaaugugcaauucaaucaaauuuaacucagcuauuaucccaaaugacaaacggcuagaaguuccucuuuuuuuuuuuuuuuuuuuuugauacagagucuagcucuguugcccaggcuagagugccauggcaugaucucgggucacugcaaccucugccuucuggguucaagcgauucuccugccucagccucccgaguagcugggauuacaggcaccugccaccacgucuggcuaauuuuuguauuuuuaguagagacgggguuucacuguguuggccuggcuggucucgaacuccugaccucgggaucugccugccccagccucccaaagugcugggauuacaagcgugagccaccgcgccuggccagaaguuccucuuaaucauuuguuuucuuuacacucacugugacaaccuaagucaaggggggauuucaguuaccucaguuacaccauuucuccugcuuuuagauucaucucauauuucuuucaauguaaucucuaguagucuaauacagaaauuaaauggauuucuagacauuguggucauguuaaaacaccaguucuuagaggaccaauauacucugcaaaaugacacuaccacccuacauuuauaaagcccucuguuuacaaagcauuuucauguaauguaaguggauccuuacaguaacccugugagcaagagagagcauggcuuauuaaauaaauccauuuuauggaugaaaaaaaccaaggcucagguaaguuaaauggcuugccaaaggucuuagagcaggaaguaucaggaucaggacucaaauacuacguugcuacucuuuuuccuccucuaugcugucaggucaagcauauuuugggucauccuuggauccauaaccaucacuaagaugguaucuuugcucucuauuguacuauaggaugagaggaguccccaagaggcagguaagcuaucugguguuauugauuucauccuuggauucuuucauuuuggcuugagacuacaagcacaggcacuuacuagugaaaugucaacuuuagauagacaaaugugaaacaaagaaaaucuaugccaaccgauaggucagaugcaauuguaaggucuacuacuugagcacaaagaaaaguaaacauauugccuauuuugacccuacuaauaacagguacauuauuuuaaggaaagagaauaaaacuaggugagcuacuuacccagcaucagaacuguucccacagaguaaagguuccagcaugccaggaacuguguagaaauuugcuagaaaaguuugaagaggcaggaaaugaacaggcagauuuaagugaaugagagaauaagguuacacuguuccuaacuagccccagcagaaaguuauugacuuuagcucauaaaucuuuuccaacagcugugacagcugauaagaauucuuuccuauuaaugauuuucuuauauauauuuacaaauuaaaagugcuaucccaaaguucuugaugcaauauaguuuucacagacacccaacuuccauucauacuucaaaucuauaugccagauucugguacuugaaucaaagggaccuaaaaguaaguuuucugaguuguacaccccuuuauaccacucuauucuucuauccuuacaacgugucuuuaucaaagauauuuuagagcucauuggucacuagauacuagguccuauuuuaaauuacaaggcauguuuuccuuuccagcauauguccccgaaaucuccuuugcaacacuuucuuaugguuacuaaacugacuuuauuuucucaggaaugacuaauagugacaucucuaacuuuuuucaugagucuaaagaaguaucacuacaucaaauuuuccuuugguuccucaaauaaaaugauuaaaacuacucaacuguaauaggauugaauagugccuuaaagaucaccugauucccuagacuagaucgacugcaauagucuuaguaguauuaagaaaauuugaguuccauagauacauucuggacuaaauguguaaauaucccaaguaacucagcuagggaaaaaaauaauuuuuaucaagcuucuaagccugaauuucaaagcaaaaguuuagggguacaugcgaaaaagggagagagagggcugauguuugagagcuucugaacacaauccuacgucgaggaaaggaauaauuuuacaaggcuaguucuaguagcacugccauuccuuuccagcuccaacuaccucuuuuuuuuuuuguuuuuuuuuuugagauggaguuuuguucuuguugcccacccaggcuggaguacaauggcgugaucuuggcucaccgcaaccuccgccucccggguucaagcaauucuccugccucagccucccgaguagcugggauuacaggcaugugccaccacgccuggcuaauuuuguauuuuuaguagagagaggguuucuccauguuggucaggcuggucucaaacucccaaucucaggugauccaccugccucagccucccaaagugcuaggauuauaggagugagccaccgcgcccggccuccaacuacuuuuuuaagcccugugguagcuucugaccaugugaacuaggaauagacuuuuccuauuccucuugcagagaagaggccaccuacuuuuauuguugauauacucuucccaaucaaagccuuuggugccauuuucaagauagcucucguugaaguuuaugggccacacaacacacuuguuucgaagguuccccaugaacagcugcaguccgaucaaggcaaaaacacucaggcagaacacugucaggaucaucacaucugacaguuucuucacagacugaaucagggcacccacaauugucuucaggccugaggagacagaauccccggaaucagaggcaccucaaagcccuccccaccuccccaagccucccucuuagccacuggcugcuacuccuccccacagcaccacucuugaaauauggccacuuuauauuuaugccaugagaauaauaauaggucagcaaaauuaucaauauuccagaaguauccauuuuuaagugaauacaucuuaaaaagcaaaagaaagauucuucugccaacauguggcuccuuucuuccugggaacacuuucccaucucugacuacuuuuugguuccccauaugagcccagcucuuacuugccauagggccuucauaccugcuguucccucugccuggaaugcucccugcuauauuaucuuguccucugugccuaaauccuacucauccuucaaggcccaguuuaaacgucaauucuuccagaaagccuucucugacuuugcaacucuucuuccucuccauuguuacuaguguuucaguagcaucuuauacuuucuucuguagcauuugucaugguuauaauugauuuuuuauaucuaccuuguucacagcuguaucuauagugccuagcccacaguagguauuuaguaaauauuugucaaagaaacaaauggaaaaaucaggaauugaggaggccuccagguuagaaagaaaaccacugggaaguuuaaaagccaauaauaaaugagaagguacaauaauauuuucccaaggauucuggaaaugccaagguauugaaaagguuauuauuaauccaguauuuauacuuugucuuuuuccauuuaaaaauauacuucuucuguaucacauacauucccugcuuucuacaaugaucuuuuuucuguccuaaauuaaaaacaaaaacauuaaaaacauuuuaauuuaaaguuuaaauguaagacacuggcucaaauguagacugaagguguauuucuuaauugcacauggagagaucagugacagaagagacagaaaaauaugguuguagguucaugcuuuuuggguccaaaugagucuuuacgugcccagauaucaggcuauccauaggauacggccaacaaagcacugagcacucuugguagccaaugcaccaggaugagcaagaggcaggcgcuaagccuugacacacaggccucaggaagaaucucaucccugcucacuucugaaggcaagaccacugaacugaaauucaagggaauccuaauccuggcuuugaagggugugccuggguagauaaucacuaaucuuaacuaaguuaugccacuuacuugucugacuuacgcaauacgccuucuaaccucuuagaaucuguuuuuucaucuuuaaaguagggaaaauuauaguugaguagcauagggcugcugugaggauuaagugugguucauauaaaacaccugacaaagcagcugggagcaguaggucaccccuguaaucccagcacuuugggaggccaagaaagguggaucaccugaggucgggaguucaagaccagccuggccaacacggugaaaccccaucucuacuaaaaauacaaaaauuagccaggugugguggcauacgccuguaaucccagcuacugugggaggcuaaggugggagaaccacuugaacccggugcggggguggagguuccagugagccaagauugcgccacugcacuccagccuggucaacagagcgagacuccgucucaaaaacaaaacaacaacaacaaaaaaacaaaaacaaaaaaaacuucacaaagcauuuaguacauagcaaaugagucaaauguugaccauuauugucugaaccucagucuacucaucuauaaaaauggauuuacaauaccaaccucauuggguuguuguuagguuuaaauagauaauuuauauaaaauaccuaguaaaguuccuggcacauagcuggcacucaacacuuguuaucacuauuuuacauaugguacccuccucaaagggacaugauugggaaaauggcacugcucagggcuaaccucauauaauggugaucuaaugggugguauggacaugauucuucuuuugcuguauuuugcaaguaaucaccuagacuuuucaaagucgagcccaauagaauuuucugaguccaauaauagaaauggaugcucugccuagcacaagaccuggcacaaaggcagccacuuaauacauuuuuauugggagaguaaaugaaugagaaaguucucuccucuuacacaaauaucuuaaaagggaucuaagaggaauuaaagaaaaaagaaccaagagguagacuguagagauaaaggaugcagaguccugugcuuucuuagagugagccuuccauggagacuguggccacaaagggauuaugaagcgcuugcuugggcuccaggaaacaaagcauuuauaaucugauuauuuuucuccucacagggcugugcagaaagagcaucagacagggaaucagaaagcugguauucuggcccuggcucaaucacuacuuaugaccuauuguguuucuuuuucauuuuuuuuuuuuuuugagucggauucucgcucugucguccaggcuggagugcaauggcacgaucuuggcucacugcaaccuccgucuucuggguucaagcgauucuccugccucagccucuagaguaacugggauuacaggugcccgccaccaugcccuggcuaaauuuuguauuuuuuuuuuuuagcagagaugggguuucacuauauuggccaggcuggucucgaaccccugaccucaggucguccgcccaccuuggccucccaaagugcugggauuacaggugugagccacugcacccggccugaccuauuguguuucaaaucaaauuuaagguuacuucucauagucucauuuucucaucuacagaacauggauaaacacaccacuacacagcagugggcaguaguggagaagcugaagaaucuucuccaaaagucuuucaaaauaaggcagagauguuucuuugauugagauuaaguaauugaaauuucaagcuaucuuuuaaaccuaaggcccugggaaaucguaucauaaucacacagcuagguaagaagguacugguggaauaaaguagaaggcagccaucaagaaauaaaaauuguuccaguguaauggaauuuauuuucauuuaguugcuaaggaacagagaaguccucauuauauuuugacuggguuggagugggccuauauugaaucaauaauucaauccuaggcuucuaaaauuacgcaaguuuacuguuuucaaagucauagacugauuuaaaaaauaauacuugaaugggucacuaaaaaugguuguacaguuucuuuuuccuggacuuuuuuaugaagccuauacagccaucucuccagacgauucagacaaucaccuuuccaaacaccagaugacuguuaaaggacuuuaccauugcuauuuuacugaauugagaaaugagcuguaagcugucuuuuguauuaguaacaagaguauaauacuacaaaauagccaaaccacugaguuuguaaguaaauaauuugaaaagcauacaauuuuagcaugaguagaaucugauuuuccugggcugggagcucuuugacaguuccagguccacauaaguggaaauucuaggccaugagcuccaacuauccccuguuccuuaagaaugagcucucagcagccaugucuguacaaggucaccuucucucaguaguugcagaugucuggguggacaucugaccuaaauccagauccuuuccuacaggaauuuggaacaggauaagagacaguugaguaauauuuucauguggugagaaugguaauaaauaaauuuggaagcuaagugguagccauauucugucauuauauuaagaugugacugagcaguaaaggcaguuaguaugcugagagagagaaauggacacguggagagaagagagauggagacaaaguacuuccuuguaccuguggcuuucuggcucugcauucugguuucuacuggcuucccagaagcacaagugcauuccagcccuuggguucccugaauuauuccuguguccugcuacuugcaaccagagaugacccccacuaaucugauaugucaagccugcauggaauucacuuuccuggagauggacccaaaugcucacaaucagcugguuuaacaucucuucuccauaaaccagauguuauugcuaaagaaauguguaaacaugagucaaggaagcuaaaaagacacuuuuucaagccucagcuuugaagucuggggcuuagaucaucucauuggugaguuagcuuuuaagauguuuaaaguagaaacuuaauuggaaaugguauucagcugcuuauacuucacagagggucagauaaaucuuaauuaagcaaggauaaucacuaaauaacacuaacuacagcaaucuaaaagguuuacucuccaagauucccauccagaucaccaagagaaaaugagaaggcaaaggaaaaagaagaagaaaggugaugcggcuucauguuuucagguaaaggaaggcacaugaucacacagcaauauuaaauaauaaacagucacugaacuauacauuggucucagccaagacucuucuuccuugcauuaggauaaauugcaaauggccauauuugcagacaucaaugccaauuuauggagaugaugccaucaauucauuuccuaagcucaagcucuacagucuugccagcugugacugccugaaagcgcucccucguaccaucaacaccugucaauaaaggcaaaaaguuguuaguagaauuccugaccugacacaagccagaauguagaaugccaucauucuggcuauacagagacacugucuuuuuauucuauuggcucacaacaucacauuccagaacaagcaagauacugacugaaaaccaauuauccaaaacagcagaaugcuucuucaaaagacuccuacacaacagagugugcaacagaagccacgugggggcaaauuggacagugagaacucuuggaaaaggcuaacauuagcucgcuuugguacgugucugaguagaaacaguuaauacauuuaccacaggccaagaaaagacagcuggauucaauguagagaacggucagugacaagagggaaagcuggauauuuaaggaauuuuaagaagcaggugaagaauucuacucuauguccaaagguacuucugaaucuccugucacguuucacaaugcccaggaauccugugaacaaaugaacaaugccugccuaugugcuauguccagaaaaaucagucaagcauauuggggucaaagucuuccaccacuggauggccagauuauaaauaaaguuaauuugccaggcacgguggcucacacuuguaaucucagcacuuugggaggccaagguggguggaucaccugaggucaggaguucaagaccagccuggccaacauggugaaaccccaucucuacuaaaaauacaaaaauuagcugggcguuguggcgcaugcuuguaauccuagcuacucaggaggcugaggcaggagaaucgcuugaacccaggagguggcgguugcagugagcugagaucaggccguugcacuccagccugcgugacaacagcgaaacuccgucucaaaaaauauauauguauaaauaaaauaaacaaauaaagcuaauucauauucccuaguuuguagcucagguugagaaaucuaagugguuugaagcaaugugagcuaauuccccuacaaaguuaauauugaaacaggccucaguagcaauaacaagcaguucucaacccagggaaagaacaacugcccuguucccagaguuaggcuuggguucagacaaagcauagggguaaaguagugugcuguguugacuuuuccugcugcaacugcaauccucaugauaauauuuauuuauuuauucauuaagagacaagaucgcacuaugcugcccagguuggaaugcaguggcuacucacagguguggucacagcucaacgcagccucgaacuccugggcucaagugauccucugccucagccuccugauuagcugggacuauagguguguaccacugcacccagccuacagugauagcucuugaagauucuuuagagcaacaguaauuugaaagagauugggggacucuagauuuauuuacucgagaccugauucacaucacaaagugugaccaaaacuaaacuagcucucaaagaugggucagugggauccugugagcauuuaguguuuuuucacuuaggaccacuguuaaacuuuaucuuuccuaagaagcaaugugggaaaaggagaaauacaaaggcaagagaauaaccagaauaguuuaaaagagacaaugagucaggauauagucuuaaaaccguuuauaucucccaucauuaugcagcagaaauugccacauucacaaaguauacguuuaaagaaaaugcuuucuuugugaauacugggaugggaaaaagaaaggccuaucauuuucccugcuuccugucugaucccacugguuaggagugaaaguaacagaaaugaaagcugagaaauaaaauugccaagagaaaaauaaucaagaaaguacaauucuaaagaagguggaaugaaauuaaauaagugcuaaugagcagcagauaagcagugcuuugggggagccauuuaaaugacagaaaugaaaagaaacugacaagugaguuucucucaaccaguucuauuaguacuuauacuauuaaaugcugcuaagaagaaccugagaaacucuuucgagauucccacccuuucuuugggcaugucagcccuguggcacaugaucaaagcaugcagaggacaaaacuucugacagagucacuuagaaguucacuuuaugcgggacucagacaaauacaaagugaaaacaaaguuuuaagacauauaaacuuuuaggcagaauauuucaaugucaaggugaaccugacaaauuccagacuaaagaaaauuuagaaagggucuccucuauaaccgacccuuuuagcacagaccuuguguacacuguucuccaaguugcugccucuggagcaaaacggaaagcauaaauaguauguauccaagucaaguaaaguaaaaagggucagaagguggguuuggucuuuucugagcuacaagaaagcuguaaagcaaagcauuucuuacagaaaagggcagagcuaacugaugcaccuuacuguccaaucuucaggaguccuggcggcccugacauacucagaauaucuaccaaagacacaaagaggaaggacaguaucagcccagguugggggugggugagugcucuaggaaaggaaaagcucucauaaaggaaguugauacacagggagcuuugugagaccuugcaggcuccaggucagugguugcucucacuuacauucuauuuuuggcacccuuggcaguagucuauaaccaaacugggaagaggagaagacaaagagaacaacaauuccacugaagugauccacgagaaaacuugguauacagaacaaugguuuuuacuaagggggaaucaugggccagcucuaccacacaagaaucaaaaugacauacuuccaagcaagagauggcccagauccacugacucauacacuggugcucccgccuuggaaggagacugcauagcaggcagguaggaauagcacaacagcccucuaugggagaaagcauaaucagcaauuucagaauuucccaugggaugagagaaaacuucccaugagggaaacuucauuacuggauuucucuugcuaacucuaaaacauagaaucgggagcaaaaagauugagacugagagccacacuuuuaauucaagaaccaaauauaccauuuacugacagugaucuauuauucgcuuuacuaucccuuaauguuauuuuccaccccaguuagccucccaaagccagcucaauugggggugcuucuagaaauaggaaucugggacucuauuucaaacugugaagcugaugucuaaaucuugauacaaacccuuucuauuggcuuagguuucuuuauaaucauaagugcugcuacuacaaucauuuauggagcacuacuaugggccaggcaccacuguguuagauacugcauauauuccagauauauauauauauauaaaggauaaauaacaugacauauuaaggauauauacaaagaauaaauaacgugacaccaaucaagaguuaucuugcagaaaugccauggucaaaaguuaaccauauagcagagacagagacagaagcuaugagcuagacuagagacagcaucugcugcccuaguuagugaauagaauacagcuuuccaauuuaauucugggagagaaguuuugagaucacaggaacauaaagagacagaugccuugcagaguacgcugagggaagugagcagaaaacacaagaucauauuuaaaaggggccagaggaggagagacaccauaggaaaaaggaaaguaaagauguggcauuccagaugccucaaaaaauaagacagggcuugccuaaagauuaggccaccaucaaugagcuaucugaggcugucuggagaaugagcugagcuuucuguuaagcagauuuaaaauggcuaggaacuaaaucuugguaaguuaagguuguaguuuuuugccaagaaguauauacuccaacugacacccagccuuugguugauagggagucagcuaccaucgcuaaaaauauaggaauucaucuuugguagggcacugauuuacuggccaacuccauggcccaaauuuguaaguggugaagaugaauuuaccuucuuugagguucucaguaaaccacauuccagucugcccucuccaggauucuaucuuugugcuucccucucuaucugcuauugagauaauguuaaaaaggggaaaaagaaauauuucugggccagaugcagugguucacgccuguaaucccagcacuuugggaggcugaugcaggaagauugcuugagcccaggaguuggcagccagccugggcaacacauagggagacccugucucuacaaaaaaauuuuuuuuuaaaaaugagcugggugugauggcaugcaccuguggucucagcuacuuggaaggcugagaaggaaggaucacuugggcccuggaagucaaggcugcagugagccaucaucguaccacuccagccugggcaacagagugagacccugucucuagaaaauaaaaauaaauuuuaaaaagagagauauuucugagucagccacaaggggaagagccacguaauaggaauaggauaagaauaggaugccucuguucuuucuccacauuccuauuucuacgaaacugcuguggaaagccuggucucuacggagucuuccuugaaaacccaugaccacaacuaaaguccaaagagcaacaacacagucuucaccucugccaaguuacugccaguauaucuuaggcucacaauacuaacuaaaauaucuuuccuuuaagauuucaagacuggucuuuagaaagauaaguauuacccaguagcaaugauuuaaauuaaauuaaggaaucuuaaccugggguccauggaugggcuucggggggggucugugaacuuucaucugauucucaaagggauccaaaaccuucaaaagguuaagaaccacugggcuagcucaaccagaaccaaaaagaaaaaggcacaaauuuuaaagagguugucaaucaacuaacucucaacucaccuacugauucuguuuuucccccucaaacuucuauacuuuuuguugcccauaccuuuaguuguaucuuaucuuaccuuugauuuuuuuuuaacagugccugcauaagcuuucauugggauuuaugucugagaaugaacccugaauauguacaguagaugucuacugguucuuauucuagugagacagacagcaguagaacaugauagacagugauuauuuaagugcaguucacuaacuccaagucucuuaaauuugucucugauacuggauuaguuaacuggguagaucucuucugugauuaaaaaauuucauuaauauaguaauaguaaauguauaauucuuugaauaacgucccaucagcaaaccaugcgauaggaagccuagaaaucacaagcaaugaaaugauggcaaaugucaaaauuacuguaauuccauggagccaggaagcaaaugauuuauauacaaagagacagcuagcucugugacaauuuuuucaaauauggugagauccaagugauucuuaagcacgugcuuuuucaauagcauggauggaaugggggcugcaugccuggcaagcacucagagaaaacugccugaggacccaacggccauuccagagaaugucucccaggaaaaacaugcagaaugcaaggccauuaucaacuguacugaugcugcuuuagaaugguggacaaaacgaauggaggagaaagaggagauguggcaaagucagucuuauguacaaauuuucucaccuggaauuacagagauaguuuucaaagcucggagaacccugaauguucucagcgcugagacauugcccagguccacaaacucugucacauaucuguaguaagggaggucacacacagacacaagugacaaacacagacacaaacacaaacaccaaaggaaaaaacaaaaccacaacaaaacaaaaaguacaauacgucacgucagggcccuaucccaacaccuaacaccaaccccggaccaucuuaccugggauuaccgaaauaguuuucaaagcccucaguacccugaaagugcguagagcugaaacauugccuagguuuacaaacucuguuauauaccugcagaaucaaaccaaaguuaacuuguaaugguaccacugggcgaggguuugagaauggggggaagaaagggucuuauauacaagcuaugguuucauuuuuuuuccuugaaaaagaaaagcuucaaaauacaaacauuuaaggaacauuuguuuuuaauuggacaagaagaauucaaaaguauauuagaaaggagguuuuugggauuuacuccuuuaaucagcauaguaaugugcugaucccaaucagaauggcuuuacugucagcccauucacauuuuuuaguaaaaaggaaggccaggagguaucaaagacuuauguucccagguuuugcgaacaauuucuuaagagagggagacaaauuucugcagcaggagccccacaaaaacaaaucuacauuaaaguaacucccuaguugacaauggcaaaauugacuaaaugucuguauauaugacuuaaucaggaguuguaaucauaugauuguagucaugucuauaaacgaaguuuuggccugugacauacaaaagcagggcucaggaaaauccaaaucaugggaucagagcaaauauuguguuaagugcucauuuuaauuacaagcucugugccuagcaaggacacuuaaaaauuuuaaaugaacacuaauguguauucauaaugcuagaaaguaagacauugccuuuauauaacagaaagucaguuucaguuucaaguauucgaugcauaucauuuauucacauuuuacaguugaaauacaucuuuccaccagaugcucagaucaauacauauuuaaaugcacucuuucuuacacaucaugcauacaugcaaaaccuauacaccacccccacuacacucucaaaccacaaaacgcuuucccaaccuggaaauaaaaauauuaaagccugcuauaacucuucuaucaucagcuaaguuucccaaagauacauuuuuauugcuaaaacaacacaaaugagcaagagcaguaacauaccaauguggaguuacacugaucuugagcaauaguucgaaauucugguuaguaacucuucaggaagugccaguguggguaccuuggcucauguuuugacucuaaaaugugcucugaagucugcaacuccuggccagccuuauuaaauuacauacgguaagacauacccaggaaacuaauuuucagcugaaaguuuacaacuaaaaaauuucaagucuucacagaggccuuguaaugauaggugugcaaaccgugaucguuacaaggaggaauaaaauacgagagagugccaaugggaaaucaccuccuccuuucucucccagcuguaaagccucugcuugccuucucccacauaaucacauuaucaucgccugaaccacaagaggcccucacaagcaagaaucauagacauaagcccacagggccuuacaugguuauccauuaauuccucauacagcuguguccacaaaugcacaccuacaaacagacccaggaguacaacuccacacacagaaucacacccagaacaccaauaaaguaaggggagaacuuacgccaucaugaugacacugaaaucuaaccaguuccaugggucccguaaaaagguaaagccaucuaugcagaaaccucuugcaaugauuuucacuagugauucaaauguauaaaucccugugaacguguaccugucaaagaaaugaauagcuugagguaauuucuggacagaaacuuuaaaugaaccuuuuaaguuagcacuugccugaaguguugcuucaacuaagagagacaaaacagaaagggcacagccaaugcagcaggaaggaagugaggaggagaaagaaaugcuuugaaugaaacuuacugaaaugcacaaacuaagaccuuuggaauguuguacuggguccugaacuguauuccaaggaaguuaacuuugcagcuaucuaguacaugaucauuuugaagaagguaaggaggccccccagagcuguuuuuaaccuuagagaagucaaaaaacagggaaaccuaaaauuggagaaaacaguaucaccaggaacugaggauacaagauggugauggggcugcagggcaacggcacugccuggcacaggaaaggguggagugaagggcaguaauuucuagaguugacuuuuagggagggcuauuuccuaaauuccacauguacuuucagccuucucugugaaauaaagagaggcaauaacuaauuuuuuuucuccuugauggguaaacuguggcaaagcaagauuuagugacuaaaaauauuuaaaacaaacaagcacacacauaaaugaguuacuuacuccacauucuucgaccagucaggaggguuacuaaaagucaugaauacacaguuggucaaaauagugcacauaaugaucaugcuaaauacuguagagaagagucaaggggcaauauuaaaaucuggccugccuuuuguuuucucaaaaaacaaacacauuuccauuggguaucagaucuaaaucaauaaccugaaaggagaugaagcacagaagagaaaaaugcaaggugacaaugaaaacuguggucaccaccauaaacacagcaugccacugugaacuguggauggauggggaaggacagcuauucuccuucuuucaaaagggccgucacuguucuacucccuuuggaugaaacauguuccccuaaccacuuuucagcucaacuacagacuaagccucuaaauguuuuuugcacuuaguauaauaccuuugcacuuucucaaccaaaguugucagauaagaaaaucaauuaaaucuauaugacuagguauucauuuauugguaaguuaauuaucuuauauagcuaguuauuugaaaaucuacaugcaaugguucacuuuuuuuccauaguuguuguucuuuuuuaagagacaaggucucucuaugucauccaggcuggucuugaagcccugggcucaagugauccuacauccucagccuucuaaagugcuaggauuacaggccugagccaucauacccagccuucccuaguccuucuaaagggcugaauugucuuugggggcaaggcaucagccaauacagcccauauguguugaauauguccaaugugggaaaccagcugcggcguguuagguaaagauuucaaggacaucugcaccaccacacuucugaagacuagguaauagagcaaaauccauucugaaaguguccaggaauguuuauggauagcaaaccauacugccauuucauuuccauccagaauuuuucucaggccuuucuguucuuaucucugagaaaaauuaaacuauuuuaggucagcacaaguuacucaaacucuaauugucauauuagacaauuagagccaauuagagccugggagccauaucccacuugccacuaauucacucucucuuguuaauggcauucacuaucuuuauucuaccaguggaguuuuaaaaagagaaaauauuucuuacagcuggauuuuuuuuucuucauuacagcuggauuugucuucaugcuuuuuggaaccagaagagaaaaaacacuccaucuucugauccaacagaaaggaagaaguccacugugaauuauuuauuuccuuauaaacuuucagguuucagaaguguguugcuucuaaacuacagauuucacaaccauguugcuaaauucucaagaguuaauaaaauguggcaaaagcuucuaaaccaauucaccaaguugccacugcuggcuuccucauccuacuuggaggauacaguaaucuucgaagcaugggacuacaugcuguuaaauaucgaccagccauggaaguuucaagccaccaugcaacaucacuaaauccaucaaauaauuuuucauuugccacaugcacucucauauguuaauaagguguaacucaggccacuugaauaaauuggcauuuuucuauuuaaggugaguaaaaauaccagaaaaaauuccuauuuauccuacaaucugcaucuaaaccucuguaacaaggagguuauuucaucugagaacuaucucacuuucuaagcucacugcucaaaaaauuuuuuaaaaauucaaagcugauuucuaaagcauucauccaacuauuuguaacucaagaaggacuuucaaaaaccucuaauaauggcuuuuaauauauuaagcugaauaguuggccacagaaagaaaucacugaagucugaguacuaaauaaaguuaagacuucaacaaagguuauuuuaauuuguccauacaaugauaccaaacaaaauuucagauucccacaauaucauccuaagaaaaaaaauaauaauuugcugaagcuuagcuugggauguggcaggaguucacucuuaaaccucugacugaugggcuaguuaacuacacuaucaguaaaaaacuuaacauauaauccaguugucaaauauuggaaagguaaacaagcaaccaugcaauugccgcacucacuccacauuugccgaaaaggauaugaauguaucaaaauuuuaauagcuauucuucuuaucagguuaaaaggacuuaaaauguacaaggcaggcguggcacuaaaucugaagagaguuuucccucuguuuaauacuacaaaggucuguggagaaagaaagagagagaaauuauuaaagcauggguaugagucaccacaugaaacaaugauuucuagguaaggaauacauaaacucaaaagucuuuaauacuuuuuacuucccaacuugguuuuuaaacaagcaaacuuaacacaauguuugccccaccucccucccucugcccugcccagauuauaauacaaauagcugaugcaaucuuggcaguuuuacagaauaaacuuguuucuuucagaaacaggccauuugaaucauaccuaagcuucuaugccagcucuguacacgauacugaaguucauuaauuuaggauucauucacucaacaaauauugacuggacaccuacuaugugucagacaguguucuaggugcuugggaauggucagugaacaagauagucuuggcccgaagaguuuaaauucuagugggaaagacagacaauaaauaaaaacuguaaugaaugaguaaaucauauaggcugugcuacacagaagaugacaagugcuaugggaaaaggaggaagaacagggagaggaagaucaagaaugcuggagucaggggaugggugaauaaagaggcaacaguuuuaaagagguggucaggauaagccuauugagaagagagauuucagcaaagacuggaaggaagugagaaauguucuucauucaaucaauauuuacuuaccaauauucaaucugcuuuauauggcuuucaagagcccccaauaucagccuugccaaaauaauuaaaucauauuucccaguaugaauguucccaucuagccaaacuagcucauguccucggaacagguucucauaauucauaacguuggccuuuguuuauguggcucauucuacccagaaugcccuguguucugaauucaauugaauuaaaauauuuuugagcaucuauucugugccaagcauugugcuaauuaccaggacacaacacugaauaaaacuguacuuuuagggaagacacauaugugagcuaguaauuaugaugcaggguaaguacaaaguucaauaacaaaaauaugcauaauguaugagaggcagcaggagggagagauuuuuuuccccuuggcugggaaauaaaaaagagagugagcugggaaguucacaaaggaagguaacuaauauuuggaaggggcuuuaaaggacaaacaagaauuaagaaaaauuaauugggcagauuuagugagaagggauggaaagguaagggaacaaaaaucacauguaugaaagcauaguagcauguagcugcagguuuuuuuuagggaauugaccaguaauucaguguugauggagaauaaaauagggaagagggagagcagacugugaagcugagagaugcaagggccuacuagacugcaaguuccuaaggagacaggccaguggcagauacacaguccuaacaucucacugugugagugaaagagcaaauggccaaauaaaugcuagucauuuuaaguaguuuuuuauuuuuaaauuuuggagcaaugcaugaucauaauuuuuuuaaaagaaaaaaggaacauaagaccaaguuccaucucauuaccuaaugauaaccuucgaugccaguuuuuuuguauauccuucuagaaauuuucuauguaaauaaaagcauacaucuauguccuuaaaaagucucucucucacaugggauuguuccauaaauacucuucuguaccuugcauuaaaaaaugaaccuccacaaagaagagcccaggaccagacgguuuugcugaugaauucuaccaaauguuuaaagaauuaaacaaacucucccacaaaauagaagagaacauuucuaaacucauucuaaaggccaguauuaccuugauacaaaaccaaagacaucauaagaaaacucuauacuaacaucccuuaugaauauagacacagacagccucaacaaaaaugccagcaaaccaaauccaguagcauauaaaaaggguugcacaccaugaccaagugggauuuaucccaggaaugcaaagauaguuuagcauuugaaaaucaaccaauguaaugcaacauauuaauaaaggagaaaaaccacaugaucaucuuaauagaugcagaaaaaagcauuugacaaaauucaacaccuuucauaauaaaaguacucaacaaacuaguaauagagguccuucuuaaccugauacaggucauuuaugaaaagcccccaccuuuuuuuuuuuaaccuccauccccuacaauuaggcuuuugguucuuugagggcaggaaccaaucuuaugcuucccuccacaguuccaaaauaaugaucagccuauguacucccaaugcacaguauuagugauguuuuuuaaaguucuuuucuuaucuucuauucuuuccuuuccuaaucuaccagagucacgucauucucuucccaauggaaaaguauugagcuagauucauucuacaaacgcccacuacaccaucccuaguguuugacauuguacugcagugaaauucuuccuguaauggagcauacugguucuggugggauaugcugcagaaaaagccuaauccuaaaagcaaagagaaguaggagaccuaggguucaucugaaacauaucgagggcugagcuauagcucuuccauaucuuggcuucucaaagaaacaaacagcccagggcuucccccaaaccccuucucugaaguacuuguaccucucuguguuucuacagcaacucccucuaugaaaauagccuuuuaaauaaccuccucauucaaccucaugagguucccaugaaguaugggugaaggaggaauuauuauccucuauacacuuaacaaaagcucaggagaggaacaccaccuaucaaaggucacgcagcaaagagcagcauguuaugccgagcuucgagccucucaacagcuuccacugugccagauugggaggcaguucaguggcaacguggcaaagaaugaaguuggugugggagacaaauucucuggugaaugagaaauuugaguccccgggguagauagggcagcuaagcaacaaugaaagaagcacuggcccaugccccaagaccuaaaaaccaccgggccaggccuuuacaauaucaccuacaaaaccucuccuuaggagacagacaacaggauuuuuauuuuuuauuuauuauuauuauuauuauuuugagacagaguuuugcuuuuguugcccagguuggagugcaauggcgcaaucucggcucacugcaaccuccgccucccggguucaagcaauuuuccugcuucagccuccccaguacuugagauuacaggcaccugccaccacgcccggcuaauuuuuuuguauuuuuaguagagacaggguuucaccauguuggccaggcuggucuugaacuccugacuucggaugauccgccugccucagccucccaaagggcugggauuaaaggcgugagucaccgcgccuggcaggauuuuuuaaaguaauguacucuauacuuuccauuuuucuugucucuugguuuggucgugauggaaauauaggucuagagguagcauggaggguauuuccuaucacugaaucagugccugcagugcuuggcauacagcaggugcuucauaaaugucuguugauugguucaugaacaaaugcuuauguuguuuuaggugagggaaaaggagaagaagaaaaacaaaaggaagccauuaggaaauggaaacuguuacaccuugguugaagaaaaacuaggagguaggauucugaauuaggaucagucaugagcugucaagugggagacugaugauucugggggaaacuaagcaucuuuagugaauucaaaaacuaugauuuuguaagcagaaggcuuuacuaaggacauuugaugugugaaauagaaauuuccuaauuaauuuggguacugaguguugcacuuaaaauaaaacucauuuaccaucaccccuuucuaaauauuuacaucuuauaucuucaucaaguauaaaaacaguuuuucuguuaacaaaaauaaacaucuagcacacuaaacuccugaaaugaagguaaaucucccauacuuuaguaggaaauuguauuacaauaaaacauguuuuauuauugaaauaauuagauuuacagauaauuugcaugcaguuuuucacaauggaucuuuuuugaaaagcaagauaguccaccuauaaguccagcacuuugggaggucgaggugaguggaucacgaggucagcgguucaagaccagccugaccaauaugguaaaaccccaucucuacuaaaaauacaaaaauuagcccgacaugguggcaugugccuguagucccagcuacucuggaggcugaggcaggagaaucgcuugaacccaggaggcaaagcuugcagugagccaagauugcaccacugcacuccagccugggcaacagagcgagacuccgucucaaaaaaaaaaaaaaaaaaaaaaggcaagauagucuuuggacaaacacaaguacucaaagcuuaggaauuucccuuuuaauacuggggcuugcaguaguuacacgagaaagagauaaguaauauacccggcaccagcaagcuuuuucugaaagggcgcaggcagucaauacugcaggcuuuguaggccauacagugucuguuaaaacaacuuaccccuguaacugugguguaaaaguagccauagacaacaugcaacccaagaagaguggcuguguuucaguaaaacuuuauggacacagaaauuuaaauuucguaucauuuucacacauccaaccauuuaagaauguaaacuacucuuagcuugugggccauacaaaaacagauggcaaaacugaucugccccaggggauacacuaauauuaguuccugacuaaguccagacugacugcauaagaaucaucugacuagcuuucuauuuugucuuaucuuuuauuuuuauuuuuuguagagacagggucuugcuauguuguccaggcuggucucgaacuccuggccucaugcaauccuccugccuugaccucccaaagugcugggauuaugauuauagcugugagccacugcaccuggggugaguagcuuuauuuuuuuuuauuuuuuuauuuuuuuuggagacggagccucgcucugcugccuaggcuggagugcagcggugugaucucggcucacugcaaccuccaccuccuggguucaugccauucuccugccucagccucccgaguagcugggacuacaggcgcccgccaccaugcccagcuaauuuuuguauuuuuaguagagacgggguuucaccguguuagccaggauggucucgaucuccugaccucgugauccaccugccucagccucccaaagugcugggauuacaggcgugagccaccaugcccagccuaggcugaguagcuuuuuaaaaaacacagucauaaaucccuucuccagguguucuauuaaauaagugugcagaauccaggaaucugugcucaccagauuuggggaaccacuagaucaucucucaggucaugugcuaaaacauuuguguucuccuucuucccugccucugccuaacuguauggccuggcugggccacugcaugucucuagaucucauuuucuucgucuauaaaauaagagagagggcugccugaugggcauacucagguccuuuccagcacugauaucuguaauucuacgauuuagaaaauucacagagcauccaggauuaagugcaacaaagcagcaaaccauaaauuugaggagaaagccuauuauuauuuauucucucacauuuuauccuuguagaacucucuugaguuaguuauucugcuuccuuauguugaagucugucaaguccagggucaacagugcuugauaguaccauacuuaugucagcaggggggagcauagagcagccccaaggcagaacugcgucacacaaugcuuuucccugcacuaucuccccuacuuuuauccccuguucucaggagaacagugaauaugggagaauggaaaggaaugacuggugauggguugacuuugagagagauauauguauauauguuucauauggcugauuaaacguuuguaaucaucguuaaacuucuggugggaauccagaaaaggacauuuguccucucucguucaacacuacgcucuaacgccagauccuucaaagccuagauauaguggaaaggacagcaagcuuuggguuuuuacaauacuucuuaaacaacaaucacuuggugcccaugaaguccaauaauauuuuaccuaaucugucucaaauuagaucuuugugaaguaaaugaguuaaaagggaaauugaaauuggauugcgguuacugcccaaggggaaauaucaguuuacaacaacagccacugaauguguuucagcacaagguccauuaagagcggcagaacaguucuuaacgaguuauggcauggaguauuaauaaaugugucauguggcauaaaaugagccuucugaaaagcacaggcuuuucauuucuaauuagcaauguggggcuuggagcacacaauguagaagcauugccauuguuaacucaggguaagauaucuucucuuuggggcccacuauuaggggaaggaacaccgugcaaggccagguagagcacguccauaugcauaccaaacaaauccuagcauacugcaaaugcaaaacaaugaacacacacagucaucacaggacugcaguacagcuaguuuauuagcaugucuccaccccaucccaagacugaaauaauuuuuuuagccacacaaaaaguguaaauuaaaaaaaaacaggaugggcucacaucuguaauccuguaaucccagcacucuuggaggccaagaagggaagaucgcuugagcccaggaguucgagaucagccugggcaacauggcaaaacuccaucucuacaaaaaaaauaaaaaaaauuugcugggaaugguggcaugugccuguagacccagcuuacuuaggaagcugaggugggaagaucguuugagccuaggagguugaaacugcagugagcucugcucuccagccugggaaacagagcaggacccugucuugguaaaauaaaauaaaauaaaauaaaauaaaauaaaauaaaauaaaauaaaauaaaacaaaacaauaaaggaugcauauauaugaaaagacuuuauauagaagaguacucaaugcagggguggagaauaucauagaagagaaagcuucuucgagaaauauuuauuauccauucccugguuugcugugaaacacauggcccaggagagcagcucuucacucaaccaauucuccccauccugagaggucaacaucucaacuagggcaaagguaaucugcaggcaucugaugagcuucuggcuauaaugaacaccuaggggcucagagguuuagcuaaucaacaagagggcagcugggaaccuuugagucuaucugacuauaacuauuacuggcaaugacuuaugacugucccuagaucuuaacuguuuugauuucuagaacuaacugguccucucauuuuuagccaacuucucuggccuuaaauucuugccugccuaaacaaaauauauguacuuuauucccccaggccuaugcaccucuuucugaacuaggcaacuggccaguuguucauuaaucaacagcaauuuggcauucauuucugaguaugcauacagccaauauagcaagcaacaaauaagugucuuuucaaaauuucccugguuuaauaacggaaaauauaaugcagaaucuaaacagauucuauaucaggcuaggaagcuguucagaaacaaaugaccuguuauguaaaaaugacuaugccauguugaaaagaauccugauuuaugcuaaucugccuagugaauuccucaaguaaaauuacaauauagguuauauuauauagccccagugugucccaggaaagucuccagcaaaggcauaacuggaaugcauuuccagaguacccguguccugguacuauccagcuccccuuagaaauacuaaaccaaagcaggacauaaagacaccagcaaaauucuucccuaggcguguacuucuauuugagcugugugauuauuuagaaccaucauuuuccacgccucuauuacacgauacugagaauggagcaaaagagaccacuaaaucccguauuuuaaaaauuccuucuuaguaaccgauaauuuuaccuaugagucuauuugaagaaauaauaaaauucaauauuuauuaagcauuuacuauguggcaggcaggcacccuacuaagauacuuaauauaauaauugucucacaacuacucuaugagguagguacuauuuuacagaugauaaaauugaggcaggagguuaaguaacuugcccaagacaacacagcuauuauguggugaaauuuagcauugaacugaggcaaucuaacuacaaagccuauacucuuaauuaucaaggcauacuacaauuuuaaaaagcuucaaaacuauuacucaaaucuaacuauucguuucacaaacaagaaaccaagcacagaaugcucugcccaaacuaaggucacagcacuagugagcaggagcggggcgggggaguugccagggacuagaucucccggcuucuaguucuaaacucuuuuuacugcaccaggucaucugguccaacccucagaucaaugaacgaaucuccucuacuuaauaacuuuaacuguugcaaaacggaacccccuacaugugcuguuuauggucuuuucuccaaguucaguuugaugaagauaaugcuagcaccacaucugccuguggcuuuacaguuuuccaggugcuucugcauacacuucuucauuugcuuugaccuuguaaccccaugcucuccaaccuacauuuggaguagcugccacccuuccugcucacguucuggucacaggaagccauaccgggcagagcagcagcacugugcaccugcuucaaugcugagccagcacaaugcugcuucccagggcagggcaggucugacccuccuccauggccauucuuccuuguuguccuucgauauaaauuugacuuugaucaccuucuacuuuaaccucuuaaagugcacagacuacaguugcucuaagcaagagcaaaaugcaggcuuauuauguaaagcauauuaaccccucuauuuacugaauucauauucuagaaucuauucucacucuccucucucuuagaaagcagcaaagcagagugguuuacaggcuuugaggccagaaagaccuggauucaauacccagcucugucacucauuagcugucaugaucuuaggcaacuuauguuaagguugcuaaggcucaguuuucuuauugauaaagugggugccaucaaucacuauuccaauuuuaucagguuguuauaaagauuaaaugaagggucacaaggaguccuuaacacaguggcugguacagaacaggcacucguuaaaugugguuaugaugcugccacugcuaucacacaguacugccauuccuucagcucuuuggcuccaaacacggaguggccauuagaagacaagaaggggcuggccaggugcaguggcucacgccuguauucccaucauuuugggaggccgaggcggguggauuaccugaggucaggagcucaagaccagccuggucaacauggcaaaaccccgucucuacuaaaaauacaaaaaaauuagccaggcgugguggcgugcaccuguaaucccagcuacuagggaggcugaggcaggagaaucauuugaacccgggaggcggagguugcagugagccgagacugugccacugcacuccagccugggugacagaacaagacucucucucucaaaaaaaaaagaagaugacaagaaggggcuaauauuucuguuaauuuggauccacauacuuggcacaagccugcaggaaggacacuugugcacaaguuagagcaagaauccagagcaaggcugcacuagcucaaaaugggucccaaagguuauuuccaaccugggaacucuggaagugagagaaaacaaaaccccuuaggaugcacucauuggcuccaaccugccucuaggcuuuaucuccugucuuaccaaaccacacucuaugcuucaguuacagcuacacucacuauuuuaaacaauuaaaccugugucaugucucucggccuuuauaugcacuguuccucacaccugaacuacucucucaucucuucucugacaggugaauuuuuuuuuaaccauacuuuaauauuuaaagguccaggucaaagaucacauccucuaugaagacagccccauucaacucucuucaauagaauuguccuucccuccugugugucccuauaacacuuguacuuacuucuauuagagcaguuaacacagaauauuguuauugagguuuacauaccaguaucucucacuggacccugagauccgugaaggggagggguuuaucuuccaucuacuaugauuuucucagcuuagcaagcacaguacauaaugugaugccuaucuggcacaagguagacaguucauacauguuuguugaauguaugaaucucuucuuucauaaagaaauacuauagcuaaaaucaccuaaccuuuaacuauauccaacuuucuucugggugcccaguugaagcuauacggucacuuuucuaccccuuagcucaucuacccauaaaaauucacuaauuuuaguuugaaaagucuucucuccuuuucuaugucucagauaccaugcugaagguaugguauaaaacaaaugaacuaaacacaacaacauacaguuguuccucaguauccacggggaauuggcuccaggacucccagggauaccaaaauccacagaugcucaaucccugacauaagaugauauuguauuugcacauaaccuaugcacaucaguaaauuuuaaaucaucucuagauuacuuauaauacuuaauacaauguaaaugcuuuauaaauaguuauacuauauuguuugggaauaauuacaagaaaaaaaugucuguacauguucaguacagaugugcuuuuuuccccaaauaauuuccccaaauucuuaaauguggaacccauggguauggagggcugacuauacuaacuucauauugaggcaaugcaaaaugauagaaaauucucuaaaaaugauaggaaacaaaaccaaaaaaaucauccugcaauaugcucuauauagacagcagggcauggaagaaagaccaugaaggugaaauucacagaucccuggaacagaaaccugacucuaccacauauuaguugagggaacuugaggaagcaaguuaauguuucuggagccacaacuguuucauacuugugaaagcgugcaucauuauacugagauaucccuaguacuggcaauccucagggacugaagaaaauuggggagucaaaaaugauaucuagaauuuugcuggugccaucaacuaggaaaguagauaaaagaagauaagcagguuugaggggaagaaaaugaguucaauucugaauauacugaguaaccugugggaaaauccagaaacagaugacuggcaagguguugaauauuuaaggaacauucuaggcuaggcuagagucaggaguccucgaacugaggcuggaugagaucauccagggagaaugugccaacugagaggaacaugggccaagaacugaaucugggggaauauaaacauuuuagggaaagguugagaacaugaaagagaaggaaacauuugagauaaaaagaaaauuaggccaaggaaguaaagagauauaagagucagggaauaauaaauggugucaaacacugcagagagguuuagugaguuaagaacuuaaaaaaaaucuuagacuuggccauuugagauguuauugggaagaucuuauaauaucaugaaaggggugaggaugcagucaggcuucaaggauggaggaguggguagauauguguauguggugaguaaacccuccucuuuacaauuuucaguggcaugggaagcaauuagacuaccuggggacaggaggucaagugaggauucauuaggaugggagaggcuuugaguguguuuacagacuaugggaaaggaaccuauaugagaggaaagacggaaaauacagaaaagagaaaggguaaccaaaggagugaaauuccagaggagguagaaaggcacagggucaaagacaggggugagggauuggucuugaacaguagauggggcacccuauucucugaaaucagcagaaucuuuuauuccaacuugguuccauaggccaaacuuugcaggcucaacagugucuggaauagaaaugcaucuucagagcuuguaucaaaaauucuucugguaaaaucagaguuagcagaaauugucauaugaugggacaauccugaucuuaaguugugucaaauaguguuauauguaaagaaacauuuacaacucauuugucaauuuggaaacaauucaaaagagaagcaucccucuguaaaauaauaacacaguuuucucuccuuaacuaagaaagcacuuaaaauauguuuaauuauugucagagaugaucgauauuaucauaaucuugaaacauucuuuaacauuuaaauggccauuauuaaauagucccauuccacagguaaauuuuuguuaugauaagauugcacaaaucacacccuggagaaaccaacagaaacuaauuccuaaaauuaccaaucaguggaauuuuauggcugaggugacuggcuaauaacacacauccuagaauucagguaaaagcugucuaugucuauacccuauguggcucagaacuauggaaucacagcuuaguaccugcaugagaacuuaggacuggagaaaauugcaaacauuauugggaacacagguacccuccauaucuaacccgaguuaaaccuggagaaaaugcuggguuucuuuguaagcaccccaauagcucacacugaugcucaaguauauuuuauuucugucuguguaaaaauccaagaggggcaaaugcucucaaaauuggcucuuuuaaagauuauaauuuaguacuugcugaaguccuauuuaagauacugaauauuugagagaccauauaaucuuugauucuucuggauucuccaaguuuagucucuguaccaaauuagagcaccauaagccucuaaaguagcuggaacauguuaucuucauuaaugcacguaucauuaucaguaauaauuuuauuuccguauuuguuuguuauguguuucccuaacaaaaaaacuaaguuccaacaauguauauggcuugucuguuuuguucccaagggcacggaacagagccccggcauauagaaaacacucaguaacaauuuaucaaauugucaaaugaauaauugcaugcucgauuccuuccuuaacccuccauaaucuaucauaaaucauauugaauucauccaauccccuuaauuuccacucccaccacuguaacucagaccuucauuauuucauagcugaucugccuguuucaguucucuuuccuucuggcccagcuuacauauugucgucccauucaccucucuaagcacagcuaucaucacguauccuuacucccauuccagaaccuucaguaguucucuacugcuucucaaacaaacaccacaccucugagucuaacauucuaagcccuccaggauuugcuccagcucacccuccccagccucaucuuccacuguuccucagucacuuccccacauuccaaucaaauuagaugaccuggauuuuucuuacagaaauggucuauacugcaaccuguaauaagugacauguuagcuguuagcauaaucuuaauuuucuagauuggaggaauugagaccuuaaaugguuaaauagcaugcccaagaucaccuggaauuacacagggaugggaucagaaauaagauuucccaacuuuuggucuauugccaaggcuacaaaagagaaaucugauuuaggaaugcuuaauuaaauuccuucuccucuagguagccauacuuagagaggggacaagaccauacgugcccaucaaugacccauccccuugagaagggcccaccucccagugucucaaagcauuuaucucaauuugauuugguaaauaaaauaacugaaacaucauuuuguuuccuuauauuguugggaaaaaauuuuuaacaacaaaauaaaccaaaguuuuaaaauauguaguuuuuauuuaaaacagaaagcagcauuuaggcuuauugugcaaaagcaggaaauacaacuuauuagcaauacuucaaaucacaccuaaugaacauaaauccuuccguaauggucucugugcugcacaccuguugaaagugugucagcacaguuuuggcaaggauuuucugccaggagcucauauagggcugcguguguauguaucacuuaagcugauggcacuaauauuagugaaauaaggagaaaauugcaaacauuauugggaacacagguacccuccacaucuaaccugaguuaaaccugaaaccaacuucuuauccaauguaggacugaagauccuaauguguuuuaaaaauuuaaaaggaguaaucaguucuccaaguguaagauaauuaaguuaggcuacaaggaaaaagaggccucugggcugggccuguguggguagaauaucaaaagguaaaacuaaaagacagaguacauuccaacaggaagagagggagaccagaagaagguggguggguggagggaucuuccacacuaaggaaacaggaaguaguucgccacagcuaaaauacaauaugugacaggcaaaagugugaaauacaauuagaaagauacagauaugggucuaacucuauuuugcaaauauuguagguaaggaaauuaaagugauuuggccaaguacaaacaugaagcaaagccggaacuaaaacaagguuuuauauucccaguuaggcacucuuuccacuauagucagacaccacauaacaauguuuuggucaacaauauuugggaugguaguuccauaagaugauuaugaggcugaaaaauucuuauugcccagugaccuuguaucugucauaaaguuguagcuauagcacaaugcauuaccuuuucuauguuuagcuauguuuagauacagaaauaccaugguguuacaaaugucuacagcauucaauaugguaacaugcuguacagguguguagccugggagcaauaggcuauaccauauagccuaggggugcaguaggcuacaucgucuagauuuguguaaguacacucugugacauucaaacaaggaugaaauggccuaauaacucauuucucagaacguacccccaucguuaagugacacaugauuguauacuauccuaccauagguuagggauggacuauggcagauaggaaauacucuuccuuuaaaaaguaacaagugguagaaagguuaaacaaauugccucaagaucacauguccaguugaauaacuggcgguauugauaauaagcccaagucccuggaauagcacaccucagagcuccuugacuugagaagauacaauacagggggcuaacaugaauccuuucccccagaagcacugcucuuaccacugcacuuuuuaggaccuguccuaaaaaccacagggauuuuuaaggaauaaaugaaaauggagcuuauuuuucuucuauuucccugcccagcuucagcagaacugagccaauugaggcugagaaucaauuaauaaaaaauuagaaaaguggggaacuagaaauauguuguaauaaauggagggucaggaggcaugagcucuaguccugguuauaccaccaacaguggugugggcuuuugacaaaguacuucaccucauaaaauuuauaaaaugaggaggaugaacuagaugaugucuaaggcuaucaaauuauaauuuucuauuauucuaauaagcagauaucucuuugcagaaaaagguacaccugaaaaguugaagguaaacugaacuuuaggaagcuauauauaauuuuuuuuuuuuuuuuugagauggaguuucacucuuguugcccaggcuggagugcgauggcgugaucucggcucaccacaaccuccaccucccggguucaagcgauucuccugccucagccuccugaguagcugggacuauaggcaugcaccaccacaccuggcuaauuuuguauuuuuaguagagacaggguuucuccauguuggucaggcuggucucaaacucccgaccucaagugaucugccugacucagccucccaaagugcugggauuacaggcgugaaccaccacgcccggccauauauaauuuuuuuaaugcaauaggagugugcccuauuuaaaaacacauugaucaaucuuguaauuuaaauuuuuguuuauaugauuguaacacgguauacccauuaaacaaaaaagacacauauaucaacugucaguucuaagaaauuaaaaagggauaggagucaauucugaaggccuuguuucagcuuaaccuacagauuuccuggcugccuacuuaagauagucauuaggaguauauauggccauuuuguauucaacaaauuauuaagcauuggagagcauuuuuuuagugaagacaggcacuuugugcaacagagaaaaaguccuuaauuuuucacuaaacaagaaaaacuuuuaaaagugggagaaauacaaaaauuagccagaugugguggcgcaugcguaugauccuagcuacuugggagacagagauggagguugcccaggagguugaggcugcagugaccuaugauugcaucacugcacuccaacuuggaguuagacucugucuccaaaaaaaaaaauaauaguaaguaaaaacaaaaaacaaaauuaagacuucaauagguuuaagaaaacaacaggaaaaaaacaagaacaaaggcuuuuaauggaguucaaguuccauaaaacacauauuuguuuuugcuugcauacacauaaagaaacucuggaagauacuacuaucagugguugccugugcagggagauaggaaauagacagaugagagacagguguaaaaaggaaacuuauuuaccaaguaccuuugaauuuuuaaccacuuaaauauauuaccuauuuuaaaaacugaauuuaaaaauuuaaauguuccuuaaacaauuauuuguagcaaacagcugaaaaacaagaaagccaaagaaaggagguauuagaacgaaguaccaagagacaaagaaaauguaaaguagcccugagaagucugaggcaauucaaagagaggaugauucagauuguuugcagggaccagcugaaaaagucagugugaaacccaacaaggaccucagauacuuaugauagccaaaccaguaccagcuggaauaaauaacaguaucucgaaaacguggugcacaacuuuuagggcccugugucccuugggagugugaaauccgagcuaaaaccagaacuucacuaauagaaaacgaguucucucuuacccacuaggagaaagagggaaggaaauaagaaacaaguuuuugugagagucacaaagacaauucaucaguuagaaaaugagaccuaugaggaaaagauaaaggauuccacugguaucauuuagcaaagaaaagagauucuauuuugcgaagaauuauuuaaggcagcccuugaagaacaaacagaaaggaauguccucuuaaagucauuucuacccuuaugacuuuuugauuuguggguuaauucccagugugcuuccuuguagaagagaucuugcuaauuuaguacaaggccuaguuagcaagaagugaagggguuaagauacgcuauucuggcauauugacuaaguuaaagacauuuguauaacagcgggugcaaaaaaaucacucugaucuucuuguuguuucuuaagaguggaagaugaaauuccuguguggaagacacucccugaaccugaaggaaaggcaacaugcuuaucuucaagggcgagaaggugagaccaagagaauacuguacugaccuuguuaaauaagucuuaucuuuuaagccugcccacauaauuuaguugcuucuucacaauuuacuacuuuuuuguccaauccaguauauaaauaacugacucugcuucuuuaggucuucauuucuuucuuuuuuucuuuuuugagacagacucucacucugucacccaggcuggagugcaguagcacaaucuuggcugacugcaaccuccaccucccggguucaagugauucuccugacucagccuccugaguagcugggauuacaggcccgugccaccauacccagcuaauuuuuguauuuuuaauagagaugggguuucaccauguuggucaggcuggucucaaacuccugaccuugugauccacccaccucagccucccaaagugcugggauuacaggcgugaaccauugcgcccagccuacggucuucauuucuucaugaggguuccugugcuacauaaagcauguauuaugcuuuucuccuguuaaucuauguuaugucaauuuaauucuaagacccagcuggcacccuaggagaauggagguggacuuuuuccaccccuauagaaguaucagcacugcugguaaagauuugcaaguuaacuugagcaagaauauuauuuuuaaucaaguaaaauauccuucauuuaaaaguacaaugaacauaucuaaagugcuagcaauguucuuucuugacaugcuguuaguuuguaaucauuaugcuauguauuuauacuuuaugagcuuuucuguauggugguauauauuuuuucaagauuaccaaaaaaaauuauuaaaguuauccuuuccaggaacaauuuacccuugugaugaagccgaaggcugaagucagaauuucuaccaugaagaaucagucuucuaauggagcaccaucaagaacaauuuggccuauccaaugaaugacacccaucagguccagagacccacucucuuugguaaguccccacucucaagccaggccacugaaaucugaggcauugggaauggaaagaggcugucuauagagcaggaaccagggaaaaagaguaugcaaaggaaaauugggcucuaacaacuauuagcucuauauauuuuuucauaucuccugucagguuuaagaaaaugagaaauuagaaaugagaucauguccuuugcagggacauggauggugcuggaagccauuauccucagcaaacuaacacaggaacagaaaaccaaacaccacacauucuuacuuauaagugggagcugaaucaugagaacacauggacacaugggagggaucaacacacaucggggccugucagagguagggaauggggggagggagagcaucaggaagaauaguuaauagaugccgggcuuaauaccuaggugaugggaugaucugugcagcaaaucaccauggcccacauuuaccuauguaacaaaccugcacauccugcacauguaccccugaacuuaaaauacaaguuaaaggaaaaauaaaaaauaaaaacuauaaaacaaaaagaaaaugagaaauuaauuugcauuugaguuggaaaaaauaguuuagguccagagagaugaagugucuugccgaaaauuacaaacuaguuuugagaagguuuuuuucuucauuuauuuccccauaaauuaucugugguagcuuggacaauacauuuacuaaaaaauaaaaauguaaauaauaaggccaggugcgauggcucacaccuguaaucccagcauuuuggaaggcugaggcgggugaaucacuugaggucaggaguuugagaccagcuuggccaacauggugaaaucccaucucuacuaaaaauacaaaaauuagcugagugugguggugggcgccuguagucccagcuacucaggaggcugaggcagcagaaucgcuugaacccaggaagcagaggucgcagugagcugagaccgcaccacugcacuccugucugggcaacagugcgagacucugucucaaaaaaaaaaaaaguaaauaauaaacaugguaaauuaugguagaaucaggauuucuuacuuccaaucuaccguucuuuacaucauaucauuuuguucauuaaacuuucuagauuucccagugaaagaacagacuaaugguuccacuuuuuucuauuacguagcugcucugagccuguagucccagcuacgcaggagagugaggcaggagaauugcuugaaaccaggaggcggagguugcagugagcugagaucacgccacugcacuccagccugggcgacagagcaagacuccaucucaaaaaaaaaaaaaaaaaaaaaaaaucugucaaaugagggguucccuaaaacggugucugaugccaguccucaagauucaauuauuuagcugguggaucacccaggaggcuuuguuucucuacuuggugccuuguuucagaagauaaucaugagaaaguagcugaagauuuagucaaauauuuguucaggaaguuugaaacucuuggccaaaugaagauuaguaguucuuucacuugagcucccuacuugcaugaauaacagaauugacucuacugcaagaaucagugcuggaagaaucaauccagacaacuguguaacagggccaaugaccugggucuguccucauuggcuguuugcuuuacucaguuuuauuccuguccccagcagcuaugcucuaaugucacaaagggagcuagacaagagagcaaauacaccaucuccaccacacuacucuacugaugucacaauaguaacaacaucuuuauauuaaagauagaauuuugaauguguguuugagagagggaggcuguacuaucuuuuacuaucccaucuuuuaaagacucuuuuaaauagucccauuucauuuacauccccuuuuucugaucuggccuggagccaaaaucagaagucuuauuaauagaguugaugagugccaagaccacaaaugacccuuaguagcaauuaaaaugaaaaauaauccccacaagccagaacugaaacaaaagguuaacuacuuauccaaacuuuggcaaagagacacaguucuuucucccccaucucccuaagccuguuaggaaacagguaucugcagcugcuccuccuccuccaacucacuuucugcgucaaauaguaugggucaaaguccuccaggggaacugcaaccaggccuugggggauguccccguagaugaaaggcaaacucuucccugcuuccaggucgcuguuuggcuugggcuugcuguccucaucguccucccgaugacugccaucggccuuuggugguuucuugagcuugcucucagcaaugcgccucucaauguuugccagugacucaggggugaaaggcuugaaacuaucagggccugguggugcaagcagccgcgcugccaucuucucauccugcagcagcuucguuaguuaugcugcguccaggacaggucagcu

SEQ ID NO: 192587 - RNA, 15944 nt, Homo sapiens
aggaaacgguuuauuaggagggagugguggagcugggccaggcaggaagacgcuggaauaagaaacauuuuugcuccagcccccaucccagucccgggaggcugccgcgccagcugcgccgagcgagccccuccccggcuccagcccgguccggggccgcgcccggaccccagcccgccguccagcgcuggcggugcaacugcggccgcgcgguggaggggagguggccccgguccgccgaaggcuagcgccccgccacccgcagagcgggcccagaggugagucgagguccgcggacgggaccggguggcgggcggccugacccccgcuucagugggcccuuccuucgggcggaccccagagucaccgcagaguggucgcgggaggcucagucccagcucauuagaaaggcaagcugcuccuggcugaccacgcacagcucccaugacccuaccugagacuuggaggggaauggacgagacuggacuggaaaucagaaacuugguucuagucgggugaccuggggucagugacuucacuucucuguucuccuacccucuucauaaaaugggcagugggauuccugucuugcucuacucacauagaagggaucacacguccuccaggccgcuggguggaccuggagugaaugccuacuuccacagcuguugagccucccagcagagcucaccuuucccagaucaguccuuccagcuguugcuugaggaaucugacacuaucacuccaaccuaggagucucacccuaggcgcgcauggucagucaccuccuugccacgaccuuccuucaggauccaggccaaaggggaucccagucuccccccaggcugggaccccagauuuuuccauggaggccagugcugugaaacccauggcugggcuggcugccccagcuccucuuuccuucuccaaggacaggggcauaauggacaguugcucucacucucucuauguauggccagcuucuggcugagucagggucuguccuaauaccuguccucucaccuguccccccauuucauugguuuguuagaaauagcuaccauugauugaguacuaacuauguagacacuuagauauauauauuuuuucucauguaauccuggccgcaaccuaguggaagagggguuacuauccccuuccuacagaaaaggaaacagacaugaauaugggacuuguccaaaacuccuuggaugguggggugaauggcaugguuggggucuugauaacauuucagugcuuacuguguacuacuuauacucugcuaaauaauuguacuacauuuuaccuaugagauaacacuauuauuauucccacuuuacauaugaugggaagccuaagccucagaaaguuuaaguaacgucucaaauuucauaccucuaaguggcaaaggcaggauuugaacccaggucuccaugcuccagagcccacacccuaaccucugugcuacacugugcugccuccauggucugccugagaccugaaaauccaggcaucaccuggauguuccacugcaucaccccgcugugaagggcuaauaaaucacauggaugaaucguaagggcaacccaauaugaacagcugggucugcuccucugcuguugggguaaggccuacugaagugcagagugaguccagaagguugugcuugauauggcgcuucuccagcccugugaagaucacugcugugcugagccacugccguugaugggaguagguuuuaucaauccuucaggugugcuagggagaaaaacauugauaagcaccuuucgggcauaccacuacucuggcucuccccaccugaggcucagacuuugacuaagccuauggcaaacagaugauuucugggcagcaacaccaccuuuguugccugggucaacauagugagacccuaucucuacuaaaaauaaaacugggcauggugcugcaccccuguagucccuugggacuugggaggcugaggugggaggaucacuugagcccaggaguucaaggcuacagugagcuaugauugcaccacugcacuccagccugggcgacugagcaagacccugucucaaaaaaaauuaaaaacaaacaaaaacgcugucuucauuuaaacaaaucugaguagggcacccguuaauaacaacaguagugggcaauuuguacacguccaccgagacccaugucuuuuucuuccuuugagggacucaucuaaccccaaacaacuggaggaauaacaaugaccaaggaaugauuuauuaucagcaauuuaaguuuauuaagacacgcucagugacuauggacaagaaacugaacaucucugagccucacuuucccccguuggacuguugugaugauuaaaucagauaaaccauucaaguucaguacuuagcacauaauuaguacucagagaagguuaacuguuauuauuaaguauuucauaguguuuagcuaacguuugaaauuaguuuaacgucuguaauuucuggccaacaauagugaugcuucugucagcaggagaucuuucacaaaguuuugcuuagaagugaaaggauccugccaggccccaggagucugucugugcuacagucagauuucaggguaaaucguacagagucagcucugaguuuggacuggucgggacucagcauccuccuguacuugaucucacacuggguccaguuaaaaauuggacagucccaauuuuacuccaucacauucccaggauuagaccauagauggguucugcagaugcagacagccucgcuccacagugucaccacgucccagcuuugguguuuacccuuggcugucccuucuguaguagauggggaguauccugggugggagugaguguccccucccucugcaucccacucccacucacccagcagggcccuguacagcaaaaugaaagcagaggaaccagacuuagcguugugcccacacaaacugaucagaacucccuggggaacuuuuaaaaaaugcauguuucuugcugauuccaggacugaaucagagucuggagugagggugaaaccagugaauaugcuuuucucagugagcacuucaggugauucugaugcgugauaaaguagaaggaggguggacuggggcacggccagagaaguagagguacggacagaggauccuagaggaaugccggauuuuagccuuauuguuagccacuuuuuccuuuccaccucaaacccucuccuuugcagcuuucugggcuagcaaaggcugccaaggauggcuuccugcuaguaccccagugggcagauucagcuccucuagggugcucucuccaucccaucccaccgucaguccugccgcacagugcuagccagaguccucacuggcugcgggaggggcaagaggcaggaggucaggcagaggcuggggacacagcugcagcagcccagggcucuguuuccucccccagccugggccucuggggcagaggaagcccaggcaggaaggccaggccugccaccagccagagaggccuaugaagccccccuaccccaccccuagccauacugcccucagagccucagcaucuugggucuucauuuggcaccauucuuagacuaugggcuuucugaagccucuguggccaugugcccagcccugucaggcucaccaugucaugccaaaggacagucucccugccuugugcccugccugaggauccaguccccagacacacaccugcacaugcuccaccauucagaaaguccuguugcugucugaccaggguccuucuugcugcagcuuuagccaauaucuucugguucuaaaccugugagaaaugaagacuggguggcuucagaagcacuaguuggugugggaccuggauuggggacuaucauagaccagaauuacucccccuaacacucuccaacaaacuucuggaaaaguucaacccuagucagccauggaaggucaaacauucagugucuaaguguguuucacuuccccugccacaucacuggcccuccacccacccuuuccuagauggcaaggggaaagaagggggccagggaacagcuccgagagggcagcuuauacucuggugagcuugcagagagguuucucuacaccuggcaugacccugccccguccgagcuuugcaugguuguuauagcccugagggcucagacaugggcugccaccacuggauagggacagagcgaagagagcacuugauuaggagucuggaaaccugggauguacgccugcuggugccagugaguccugucugacccgggacaagucuucuucccuguaugagccuuacuccucucuucuguaaaacaaggagcuggauuuugugauucacaggauguccaccuagaauucugucaugugggugucccaggcacaaggaacuaaggguagcaaggaacuaagggcauauuuaaaaagccccuccagaccuuguggcugcugcagcccacccugaaaauaugcccucaguucccugcugugcgugacuccugccuguucuauccagaccccaaucuaaacaaucuugauuccuguuccuggcuuggcaggacccugaauggcaggaagcgaagacaggagccuguuuauguuugaggcagccagggcugggggggcauugagaaaggguaggcagggguggaagcugugagggagugggaaagagacacagaacagaaggggagcugcuggagagaugcuccuucuaccccaauugggugcucccugcggcucucccaaccugccugcagucugagcucagcagcaggagugcagagcuaggguuuccccaagcucucagucacuuaaacauugcucuccacccuucaccucuaacaggaugguuuccauggggaagugaaccaggacuuccccugcaggccccgccccaaagccaggcggcagggaguagggaggcggccucccugccuccccuccaaaaaaaacucugugauuuccucugggcaggagggagccacggccagcggcugucacacuucauggcucuuacuccaccucucuugcuccucucugcagggaccaugaccuugggcucccccaggaaaggccuucugaugcugcugauggccuuggugacccagggugaguacugggggagcaguuaggaaacaggaaccuggauacagaaagggcuaucugggcccagaucagcucugccuggggcugaacuugagaagcuggggagaauguaggagcuugacuggagaguggaggacagugaggcuccauuagacucaguccccagcuaccccagcccuccuuugcucuccucuugauccagaccugcaggcuggagcucugucagacuaggguggaagccuauaugugggguggagggagagcagguguuggcaggccaagccugggagagcacucagggcuggggcugggggcccagcccagccuagaacugggaggggaggaccuaggagccaggaggggacaaaagccugcuuuucagagugucagcugcucugaggggaggguucugagggaaggaugacugaggaugaaaguaagagaccaaagcuucaagguguuugucugaggggucagacgagagggacaguaggacagaaaugggugucgggcucagccugggggagcugggaccacaguggcugagcuuccggugugucuuccaggagacccugugaagccgucucggggcccgcuggugaccugcacgugugagagcccacauugcaaggggccuaccugccggggggccuggugcacaguagugcuggugcgggaggaggggaggcacccccaggaacaucggggcugcgggaacuugcacagggagcucugcagggggcgccccaccgaguucgucaaccacuacugcugcgacagccaccucugcaaccacaacgugucccuggugcuggaggguacguccagcugcccuagcacucccuccccaucuucuuggccccugcccucccuucccuccuuuccucucaugcucuggccaauaaaggggcugggggcgggggagcgggugggcaggacucugggaucuaacuggcagaguggucuggcccgagguggggggagcugaccuaguggaagcugagccucagugucccccucccucagccacccaaccuccuucggagcagccgggaacagauggccagcuggcccugauccugggccccgugcuggccuugcuggcccugguggcccuggguguccugggccuguggcauguccgacggaggcaggagaagcagcguggccugcacagcgagcugggagaguccagucucauccugaaagcaucugagcagggcgacagcauguuggggguaugggccuggggaccugggacacaggguguaggaggggcagauaggaacugcagaaucagaggggucacccagagauuagagccgguggggagcugggcgagugaggagcuugcagugacccagcaggucccaggucgaggauagagaagggggcuguggcugguuguggcagccucucaguggccucuccguacccccaggaccuccuggacagugacugcaccacagggaguggcucagggcuccccuuccuggugcagaggacaguggcacggcagguugccuugguggagugugugggugagcagugggugagcccgguggaugaggaccaagggcucucaugagccuggaggggugagggaguuuuuggcuacuggaaucacaggcggugccaggccugggucagaauuggaauucugcugggcagggagugggcuggagacgggccagggcuagguucuucuuucugcaggaccgggguggaacgagaggcagcuggggguggccugccacuggguuugggucuggauuaaguuaaaccuaagggucugggguucuguggguggggugggcgagggaggcagcgcagcaucaagauggggggcucuuccagggcucugugugcccaguguguaacccucaccuuccccucuggccaucaggaaaaggccgcuauggcgaaguguggcggggcuuguggcacggugagaguguggccgucaagaucuucuccucgagggaugaacaguccugguuccgggagacugagaucuauaacacaguguugcucagacacgacaacauccuaggcaaggggagaggccagcugugccaggccuggggcuuugccccccugcacucagggcucaaguuugcagaccuccagacauuaacagaacccugaaggacucucagcccaccugcagcaucaaccucuuuuuuuaauuuaauuuaauuuaauuuaauuuaauuuaauuuaauuuaauuuuugagacagggccucgcucugucacccaggcugggaugcaguggugcaaucucacuggagccucaaucucuugagcucaagugauccucccacuucagccucuugaguagcugggaccacaggcaugugccaccaugcccagcuaacuuuuuuauuuuuuguagagacgaggucucccuauguuucccagacuggucucaaauuccuaggcucaagcagugcucuugccuuggccucccaaaguguugggauuacaggugcaagccacuaagccaggcccagacccaaccucugacuccagcucugucucugaccuaagccacaucaacccccacccccagaccuagcuuagcagugacccaguccauucccucucccccaaccccacccugacccugacgacuccagccucccuuagccccagccccuuggcugagucacccaaccuuucugcacacaggcuucaucgccucagacaugaccucccgcaacucgagcacgcagcuguggcucaucacgcacuaccacgagcacggcucccucuacgacuuucugcagagacagacgcuggagccccaucuggcucugaggcuagcuguguccgcggcaugcggccuggcgcaccugcacguggagaucuucgguacacagggcaaaccagccauugcccaccgcgacuucaagagccgcaaugugcuggucaagagcaaccugcaguguugcaucgccgaccugggugagccgggcggggcaggggcgcgcccuucacaggugggcggagcuugugcgcucuccucuccuuugccugugggcggugaccaugauuagcacuugaaaauuuagaggugcauguuguuucaguucuccuccgcaagaccccacgaguugucugaacacccuuuucaaacccagauuccuuccaccauaccauccuggcuccaggaguugggagaaaggaggcaggagccaggaaccuggguucucauccugguuucgccagccuccaggucugcucugugaagugggcucauaaugccugccuugcccacucacaucucgcuggguucuugggaaccuagagagcacuacacaagcaaagaguaccuggggccaugguucucucuguggccacugccuuccagcccaucuccgugcacgucuccaucugccuuccccucucugucccacuguuucucucaguccccaccuugccugcccccuggaucccagguuugggagaggggcaggagugacaggccucacccccacaggccuggcugugaugcacucacagggcagcgauuaccuggacaucggcaacaacccgagagugggcaccaagcgguacauggcacccgaggugcuggacgagcagauccgcacggacugcuuugaguccuacaaguggacugacaucugggccuuuggccuggugcugugggagauugcccgccggaccaucgugaauggugagggcccacccuacacaggguagggaaaggggaaucagccuguggagccaggggcuuccagccauggccagugcccauggccugggagguuugcagucagaccuccuggcaccccuuccaugcugcccaccagcugguucagcugagugaccuuuuaagguauaaaccuuaaaaacagauaacagggucugugagucuggcugugaaaucuuggguacaugauaauaacagaaauauuaauagcagcuaauauugauugagcuuaaauaugugccagaugccaugcuaugcacuuuacauguauuauuuaauucuuugguauggacaaggcagugguauugcuuaguggcuaagagcauaggcuuggaaucagacuuccuggguucuauuccugaucuugccaugaccgugcguagguuauuugaccucucugugccucagcuuccucauuuguaaaaugggugcgauggcucaugccuguaaucccagcacuuugggaggccgaggcaggcagaucaccugaggucaggaauucaagaccagccuggccaacauggcgaaacccugucuguacuaaaaauacaaaaauuagcuggcugugguggcacacaccuguaaucccagcuacucgggaggcugaggcaggagaaucacuugaaucuaggaggcagagguugcggugagccaagaucaugccacugcacuccagucugggcgacagagugagacccugucucaaaaaaagaaaauuuauuaaaauaaauaaauaaaaugagaauaaaaauagcuuccaguuguugagauaaucuaaguauuuagaacaguaucuagagcuaaauauuaguggcuguuauuguuguagauagaaugagugccugacaucauauuguccccauuuuacaguugaggagacgggggcacagaaugacagugggcuugaggcagcaucaggguccgaaaccgggcagucugccccggggccagugcucaucaucacugugugcacuuaaaccucucuggcccuugauuuccucaugcacgcaaugcaugugagugccugcacugccugcuuauugcugccugguuguuacuguggguugccacaggggacucugauuuagagggacugcgacagguagagagaccugcccugggcaggcagcccugaggucgauguucucucagcccuggaguggacggaggauaggugggucgucuagacuggugggagcauugucaaccuuugaggaggcuguccauggugagggacuuccaggagucgugacagguuggggacaauccucaggauauggcuggagcccugcuucuuggggacaaggauguccucauuuccugagcaucuaccaggagccagccccaugccagacuucauuuguccucgguggucaucaacugaaaacagaggcuguggugucaccggucccuuggggagacucacgaggugcuuagauuccucaagacuccgggcaugaauugccagagugggcucuaaggagaccgggaucgggggaaagaggaaccuggaagaagccaaggcuccuuggaccaggcugcagggcagaaaggaaaggcugggaggaggcugccugggguggagggggaagcuccaucagccccacacggacucgcggcgcauuauaaacacuguaaucuggugucagccccggcacugauuaaaggcccauuagacacauucaggccucugugcagcacugauuagggcgugagcggcacaggggccggccuggaagcuggccauggggagaacagcuggcgaaggcucuaucgagguugcggccuguguggccauggcccccagccucaggcugggaaacaggauggggcacggggcugucugcggcuccaccggcauuguuuucagaaagcuccuacuaaaaacugugaacuugggauaccaagaggagggggucagugcuggcugcaggagucagcagaggccugugccaucccugacacugggugauguuauguggaccuggguaaaaagauaagugcagcucagaggucaagagcacaugcuuugguguuagacugugggcuuaaauccuagcccugucacuuacuaucuguugaucuuagacaaguuucuuaaacucucuggccuucauuucuuggcuuauaaaguggagcucauaguauuaccuaccucauagggcugcugugaggauuucaugcagagcucuuaggacagcaccuggcauacagugcucaguaaacauuugguguuauuauuaucaggcaugugugauaguuggggccugggagcagucccgggcacuggguggaaggcagcugagggaagacuggaacaaggcuggccuaggaauccgagauggguuugagucuugccucugccauuacuagcuguggaaccuugggccccccuucucugagcaucaguuucuucaucuguaaaauggagguaauacuaguacccaccccacagggcuguugugaggacaaacaggauaaagcauguaaaguguuuacagcagaauaucuggcacaugccaugugcaaaacaaauggcagucauuaacauuaguuagaaacacauuuauugcauuauacugucccucucagggguagcguguccaggccacugguuucuggcccuuggauagaggguagaaaaggcucuccucugggugguauugggccuccuuagagucccaagugauuguccuguccauucuccauuuccaggcaucguggaggacuauagaccacccuucuaugauguggugcccaaugaccccagcuuugaggacaugaagaaggugguguguguggaucagcagacccccaccaucccuaaccggcuggcugcagacccggugaggccucugcugggacuaggauggcguggggugguggcucauggcugggauuucugggcccaggaacuugugucugaggccucugcuucaucucauagauacugaguguccugguuagggcaccucucuagguacucccucuuucaacccuggcccaugcucccugcccccagggccaucuggucauucugggauuuuaagaaccuucaccuucccugugaaaagucagaggcuaucuguggcucuguguguguguguguguguguguguguguguguguguguguuugagagucaggguuuuguuugcucuugucacccaggcuggggugcaguggcacagucauagcucacuguaaccucaaacuccucggcucaacugauccuacugccucagccuccccaguagcuagguguagugcacaccaccacaccuggcuaauuuuuaaaauuuuuuguagagacaaggucuuuuauguugcucaggcuuaucucaaacucuugggcucaagugauccuccugccucagccucccaaaguguugggauuauaggugugagccuccacaccugaccacugugguauuuuuguugcuauuugucuuuguuuguugcuguuuuguuguuguuuguccuuguuuuuucucaaaacacuucacuuguacaaagacacacacacguauaucaacacauacaagcgugaauauccuucugaacauacacucacagaaauauacacaugcgcauauaugccagacuguuggccccgugaggacaaagaacgugucuuuugcucacccuuaugucccuauuaccuaucauaguaucuggcucacaauaggugcuaauaaauauuuacugaaagaaugaauauauucuauacauguauacaucuauguguacauagacauacauuucuguacaacauauccgcaaaaagccacauguaugcauuccuguacacacacacauacacucacuuucaggagccagaaguggggccagcucauuucaggcccugggauggguugaugagcuuccugggauggguugaugagcuuuuugggauggguugcucccuggacacuugcauuuuuagggcaguucccacuuccacaguccccugggcccagccauggcugauggaggggcuggaagacacugcccucugcacuggggucuuaggcuguggauggggaugugggagcccccaggcuugaagaaucggccccuuccuauggaucuuggcaaagguggggauggggguaagguguuucacagacacugcuugcccaagggggcuugagugcuccugaagaucugaguucucucuuucuguccgcccugucuuucuccaucccuuucucacucuacucucuuccucuuccauuuuuuauuuuuuugucauccucuguucucucucucaccacuugucuuuccucucgcucuccuuuccaaugcucucaucucccuccucucauccuuucucuccugcuuaugucuccccauuaccggccauccuccucaucuucuucccaucuucucugacccaccucccucugcaucucucucccgacccccuccucuucucugcaucucucucucugccuccucuccucugcaccucucucccaacccccagguccucucaggccuagcucagaugaugcgggagugcugguacccaaaccccucugcccgacucaccgcgcugcggaucaagaagacacuacaaaaaauuagcaacaguccagagaagccuaaagugauucaauagcccaggagcaccugauuccuuucugccugcagggggcuggggggguggggggcaguggauggugcccuaucuggguagagguagugugaguguggugugugcuggggaugggcagcugcgccugccugcucggcccccagcccacccagccaaaaauacagcugggcugaaaccugauccccugcugucuggccugcucaaagcggcaggcucccugacgccuggcucucuccccaccccuauggccagcauggugcacccccuaccacucccgggacaggaugcaaaagaggcuccagagucagagugccaagccagggaaucccagucccagacucagagcccgggccugcacuuugcccccugcccuugaucaaccccacugccccaccagagcugccaggguggcacagggcccuguccagccccuggcacacacuucccugccaggccucagccucuagcauaagcuccagagagccagggcccaucaguuucucucuguggauuuguaucucagcuccaugaugccuugggcuuucugucuccucaacaagagugcagcuugcugaaugucagcugccugagagagcuggggccugacuuacuagggcauuaaauccuaagagguccuacugagguguggcaggaucacaggccaguggaaaaagggcaggucagaugggcaaggcccaggacuuucagauuaacugagaggauaucgaggccaagcauggcagggggaaggucagugggugucaagagacccaggucugaccccggauguuugcuccaugugacaaaagcaggccugucucaggaccuuuucuuuucuuuuuuccuucuuuuuuuuuuugacacggaguuucgcucuuguuguccaggcuagagugcaauggcaugaucccagcucaccgcaacgucuaccucccagguucaaaucauucucuugccucagacucccgaguagcugggauuacaggcacaugccaccaugccuggcuaauuuuguauauuuaguagaaacaggguuucaccaugcuggccaugcuggucucgaacuccugaccucagguguuccaccuaccucagccucccaaagugcugggguuacaggugugagccaucgcgccuggccaggaccuuuguuucuuaucuacauauuggaagauuugguccugauguccuuugaggcuucuuuagcucuaguucucugacacuucagccuauaucacagcuaacuucuucagucucaucuauuccuuaugcuccagccccuggcaauuugccucaagauggggguuugaaaauaacuuuaccugacucaaggagugucuggagcaccuccuagucuaagucugcaagcuccaguucuugccuaaaaccaugccaguggccacccuugggcucagacagcucugggccuuuugaccacaagccagccccucgcccucucuguggcauagucuucucugccccaggacugcagggcggcuuccuccaaggcuuccaaggcucaaaagaaauuuggcuccauccaagaaggcuccagcuccccuacuggccccuggcucaggcccacaccccuggccaggcccagagagugugucucaggagaauucaauggcucuagagagacacacagaaaguuuggcauuuggaaauuucaaggauguauguaugcucacguauggagcagguuguccuggucccugggugcagggaagugggcugcagggaaguggauuggaggggagcuugaggaauauaaggagcggggguggagacucaggcuauggacaaggacagccccaagguugggaagaccuggccuuagucguccucagccuaggggcagggcagugaagaaagcucuccccgcuccugcuguaaugacccagaguagccuccccaggccggcaucuuaugugugucuuccaccauccucaugguggcacuuuucuaggccugucucccagcauugugcaaggcucggaagagaaccaggaagugaaacugggugaaaacagaaagcucaauggaugggcuagguucccagaucauuagggcagaguuugcacguccucuggucacuggaauccacccagcccacgaaucaucucccucuugaaggauuuuauuucuacuggguuuuggaacaaacuccugcugagaccccacagccagaaacugaaagcagcagcuccccaaagccuggaaaaucccuaagagaaggccuggggcaggaaguggagugacaggggacagguagagagaagggggcccaauggccagggagugaaggagguggcguugcugagagcagucugcacaugcuucugucugagugcaggaagguguuccagggucgaaauuacacuucucguaccuggagacgcuguuugugggagcacugggcucaugccuggcacacaauaggucugcaauaaaccaugguuaaauccuga

SEQ ID NO: 192588 - RNA, 7522 nt, Homo sapiens
gcuuccggucccggcucagccuccgacccagguggucuggagccugccgggagagugguggcaucugagaggcuggucguggacugugguugggggaggugggagcuguuuuaaccgugugcccccucuccugugccggcgugggcaucccccggggcaguggaacgcgggcgcuccuccagcuuccgaguccagccagccugggcgcggggcgccgcccccgagacacccgaggaguccguuccucccugguuacguggacuguggagguucgcgcguaguggcggcgggggauacgggacccgggcgggaauuccuuccugcguccgucccgagucucuugauauggagccaaguaaguuuucugguuuugcuuuuagcuggucucuuguggcucagcgccgugcggagguugaagcguaccugcggaggucgcaccagggcgugaggaggaggaggaagggcaugagccgagcuugaggaauccgugcuccaaacucuacacucaaggugggaaugggcgcacccugugcuccagccaggcuugagaaggcggcuguuagccucugccacucggggggacaagagggacgagacuuuccagacccuacucuggugggcccugcuugcucacugcucacuguguggggcaggggacaacaagguuuucacagaccaaauguggcagcugugggaaggagaaugggguuggucaggacugacuucuuggaggaguggauccuaaaauagcacguagaaugagggaggagcccaggcuuggggcacaagugagauguguggcuugugugaacgauugcgggggacacaagagggagaagucguggaagaaagggagccggaccagagccgggagucucuagaugggaagaaaacugcuggauggaguaaaacuggagggcaaaacgagcaagagagcccuucuccuucuugauccaagcauguaggagaaacuaauccagcaaccccuggaagaaccuggaauuccuggguugggcucaauugagcaguuguuuuguagaagguacuaggaauuaccauuauagugaugaauggaauauagucucugcccuauaagcagaauauaggaauuguuugccuagugguagagacaaaaacaaaacgugauggugcuugauaguacagguagacgcgagcugaucgccagcugagaggcagagcuggccugaucucugugcgguccacagaccguugcccuguauccugugcugagcaacaguuuaaaaggggcagacacaaacugaaauauacuuuuuauauucaccaucugucaaccagaugagugaaauauacuuagaggagagcugcuaggauuccaugcagauaagaugugauguggaacagacauguuuuugaggacuggggaccuucagccuguagaaggggugagggggugguggaauagcugccccuaaauaaaaacucacuuguggaaaagaggugagacuuauuuuguguggcuuuggguaccaaaacuaaaacuaaaagugguuugaagcacuaagagacagauucuucagcagaaagaauaacuggacugggugcgguaaucccagcacuuugggaggccgaggcggguggaucucuugagcucaggaguucgagaccagccuggguaacauggcaaaacccuuucuuuaccaaaaauacaaaaaauuagccagguguggugguguucgccuguguucccagcugcuugggaggcugggaugggagccugggaggcagaaguugcagugaguagagauugugucacuguauugcagccugggugauggagugagaccccauuucauaaauaaaauaaauaaauaaaucagaauaacugaauagaacuuccugaacauugacugguuguugugagagcuagugaauucccagucaggggagguuugcaagcugaauacucugaguuauaaggaacuugaagcucccucucccucugggcauguauuuaguuauuauguucuaguucucaagucucuuguucucuccuuccuacucucucuaccacugcuguguuauagccuugcaucaucucuuggcaguaacaauguaauaaugaauuauagcagcuaauacuuaguggauauuuaccauuugucagguacuuauuuaaguguuuuauacaugcuagcucauucagcccucaacccuuucaagguagccauuauuaucucuuuuguauauguggcagauagguguuaagcagcuugcccaagaucaugagcauggagcaaguggcagagcugggguuccauuccagguugucuggcuuucaagucaucguuuucaaccacuauucuacuguauuuuacauguguuaccuuaauucucacuacuauccccauuuacagauaagaaguucagagagguugagugauucgcuuaaggucauagagcaagauguagaugaggugggauucaaacccaggacuguaggacaugaaaaaccgcccacaccugauuaugcugcuucuguaacuacaucuacuguaguggucuuuaacugacuuccgugcccagccuuugugccuuaaauccacaaguuuuuacccuggagucuguggaugugggugucucuagaaauaggugagauuugguauaugugugugugugagagucauguuuuuaaagcccagucuucauggcuucauucacuucucagagcaguuugugaccccaauacgguuuagagccauucuuugcccuuuagccaaagguacuugucuuuuuuuuuuuaaauuuauuuuauuacuuuguauuuuuguuuuuuuugagacagggucucgcuuugucacucaggcuggagcacaguggcaugaucucagcucacugcagccucagccucccacauuuaaguuauccuccugccucagccccucaaguaacugggacuacaggcgccugccaccaggcccagcuaauuuuuuauauuuuugguagagaugggguuuuaucauguuucccaggcuggucuugaacuuuugagcucaagugauuugccucggccucccaaguugcugggauuaaugugagccaccacacccggccuagagguacuuuuuugaugcacagauuugaucuuggcuuagugaugcauugacucuucgcugcuuuuaggacagaguccaaaugccuuaaccuguucauucaaggucccaggaaaucagacuccaaucuuucuguacuucuuacucccacccuguacucucuccguggugauaauguuuaguugcgugcuuuuucuucauccugucagccugagggcaggggccgugcuugccuuugaugucuaguaccugacaaauguugcacagugagcaucugcuguaaacuacauugaaggcuguaaaauggaaucccagccugucauuuggacugauaacuuugaagcucuugcacuuucugauccugagacuugaugauucguugauagugugugcugccaaaaugcagagaagggccaguggaggcagaggcugagcugagccuagaaggaagugaacagauaacacguggacuauucuugucagcauucugaccugggcuccuuuugcaggguggcccuuggguagggugaagauccccugucuuuauccuaguuccacaccuugguguggguuacugggugcaggaugaacugucgcucggaggugcuggaggugucgguggaggggcggcagguggaggaggccaugcuggcugugcugcacacggugcuucugcaccgcagcacaggcaaguuccacuacaagaaggagggcaccuacuccauuggcaccgugggcacccaggauguugacugugacuucaucgacuucacuuaugugcgugucucuucugaggaacuggaucgugcccugcgcaagguuguuggggaguucaagguaagggugucggggaguucaagguaaggguguggcauagcagauggcaggggggccucgagugcuccuccacuccagcuugguguugaaccagccuucucuuccugagugcgugaaucggguucuuucagguucugagaaacagauguguugagagcuccucuucaggggagggcgcgcgggcgcguguguguguggugggggagggagagacucauaaaugugccugggggaaaagggagagcaggaagcugagcaguguuggcggccagguccccuggggccauccuugcuucuguggucuugaccucucugguuacagcucucucugcuucugcuuccacuuuuccuuucccacaugaaacucccccagaggacggcuugcuugguucagguggcugccauccaagaugggagugucccuuuuggugguguggcauugugugccuggguaggagaaagauguagaagggacacggccggcugcugcuguuggucaccucaggaggugggagugguagugugccuucuccucuggucuuuguucagagucacaguguuugaccauuucauugagugcguacuuuuacauuuuaaaguagcaaagauaauuuuucuuucuuccuuuuuuuuuuuugagacacagucucacuaugucaccccagucuugaacuccugggcucgagcaguccuuccacugcagccuuccaagcagcugggaccacagguguacaccaccaccaccaugcccggcuaauuuuugaagauuuauuuugccaggccugguggcucaugccuguugucucagcacuuugggaggcugagauggccggauugcuugagcccaggaguucaagaccagcccuggaaacauggcgaaacuccgucucuacagaaaauacaaaaauuaguggggugugguggcacaugccucuaguuccagacgcuugagcagcugaggugggaggauugcuugagccuaggaauucgagacugcagugagccaugaucacgcuacuguacuccagcaugggugacagagcaaaacccugucuccaaaaaaaaauaauuuuuuuuguagagauggggugucacuguguugcccaggcuggucuugaacuaaaggcuggucuugaauuacuggcaugagccugaaggcaucugcucugggguuagaacacgggggagcugugugucugacuuucauuccauaaauauuugcagagcccuucacugugcuggguacugugugcucauugcaggggguugcccagugucaggugaaagcugucucucauugucccgccaaacccagaaagggcaaguucauaagugguuuccuagucacccuuaagagcagcagcagcacucagcccuguguccuccagguguccaugagaggcagguggagcagaguggugaagagcaugggcuuuggagcuggggucugccacccagcaagugugugaccuugggcuagcggcuccacucaaaauugcaauaauaaucuugcuuaccucaaagggugugugcacugcaaggacugaauaagucaaauaugcccaguguuuggaacagagccuggcacacaguaaacauuacagaugcauuagccauucaagguuacuugaccuugguuugucagugaaggaaagccucuucccugaugagugugguucaggauuucaggcauccuuacccucuggguugguauuaacucagauggaaaggaacuucaggguccuggcugcccuaggaagaggaguauggggccacucacacccaugggguggcaagggcagaaucauuggacuggaugguccuguuugcuucucaggggagaagagggagaagugccaggucuggucuguccuucaacuucccuuccccauucuguugcuugguuucccucuuuuugagcaaggaccacugggcucuacaguucccucuuccuuagcucauaaaagagacugugaacugggugcaguggcuugugaccguaaucccagcacuuugggaggcugaagcaggaguauugcuugagcccaggaauucgagaccagccuggauaacguaacaauaccccgucucuuaacaaaauaaaaaaaauuaaaacuuagccaagugugccuguaguaucagcuacucaggaggcuaaugugggaggaucgcuugagcccaggaguccgaggcugcagugagccaugauugcuccacugcccuccagccugggugacagaguaagacccaguuucuuuaaaaaauaucaaaagaauuauguuuaauuggcaguggagaagacaaauagaguuuacaggggaagagggaaauguugacgaggugauuagaacauuuugaaggauaugggcuaaaggggugguguggaaggaggaggcccuugaugcaaugcaaaggugaaaagcaaggauuuagaaaucagacaauccagauucaaacccugguccagccauccauaggcaugugacucucgcaaguuaccuuacuucucuaagccucaucgugccuuggugaaagcugaugggguuguugggaggagccagugggauuguguguguuaaguuccuagcacagaauacgugccugcagaccaguaguuauuccuguaauaucaguucuucaccaagcuggaggaguugggcuuggagacagauuuuguugguuugcuugaacuacacaauuucaggcuggcaguuugcugugucacuaagcccaaaucguuuacccucucccagucuuguuuccuugccaugcuuggaugaugacuagagcuaagagagcauaauucccuggggugugggaagcaggcccucacaggugggaacucagaggccuuggcuugcucauucguucccuucuucccaggaugcacugcgcaacucugguggcgaugggcuggggcagauguccuuggaguucuaccagaagaagaagucucgcuggccauucucagacgagugcaucccaugggaaguguggacggucaaggugcaugugguagcccuggccacggagcaggagcggcagaucugccgggagaaggugggugagaaacucugcgagaagaucaucaacaucguggaggugaugaaucggcaugaguacuugcccaagaugcccacacagucggagguggauaacguguuugacacaggcuugcgggacgugcagcccuaccuguacaagaucuccuuccagaucacugaugcccugggcaccucagucaccaccaccaugcgcaggcucaucaaagacacccuugcccucugagcgucgcuggaucucugggagcuccuugauggcucccagaccuuggcuuuugggaauugcacuuuugggccuuugggcucuggaaccugcucugggucauuggugagacuuggaaggggcagcccccgcuggcuucuugguuuugugguugccagccucaggucauccuuuuaaucuuugcugacgguucaguccugccucuacugucucuccauagcccugguggggucccccuucuuucuccacuguacagaagagccaccacugggauggggaauaaaguugagaacaugaguuugggcuga

SEQ ID NO: 192589 - RNA, 12847 nt, Homo sapiens
ugcaguugcaccauuuauugagacacagacagggaagggggauguggguagauucagggagagggugggucuggugggggacuggggagguugaagggucuuuggggaccacucccaauuucucucucuccuaauggcuugagaaauucagccuccucucgguggucaaaaggucacccccaagucacccaagcacaucacucaagcuggcaacuuuaaccuucccucccauccuacugcaggaccaaggagaaaaccugaguagauuugagcgcuucccaagaugcaaauagucugguaugaaaauacccugggucugagguccccuggcuguuccugcuccugagaagugacuggaaaggacagcagagguggggugaggagggcagggacaggauugcaggggcccuugcagggcucagcagcuaauaccucuggcuggacgucuugaccguaguggucuuccgcaggauggaggugcccgcagagacuggcccucccuugacggugcuauagcccacauuugugcugaauccacccuugguggcccccccacucccacccagggagaugccaccuccaaagcuggcugcgccaccuccgcacacagugguggaguugccagucacagcugcaaagcaaagggucuggauuagucagggcggccaugccagagagggcugggggagacccagaaaucaguggggaaucagaacaaaaucaagcagcagagcuaugggaaauggauagagaagcccagaacuaggacccucugaaccugucuccaggggcucgaauggaggagagcaugcuuuaggacagguacagguugcauaaacugagcagaguucuggggccuggccagggguggagcaggaaguggggaguaaauacucacaaaugcugacugcacugggacauucuccagacauccuaggggacacagaaaggccaggagagcagucaguuaucccuggugcccacaugaaaacccucuccuucccucugccuuuacauuggauccacucagugaauccugaugacaagaccaggaaacaugagaaguauguguauagggcugugcccagguccaaaagccagugcugcagaaagggcagagccaccaguaggcugugccaacucccauccuccccuuuucuuuccucucugcccaugugggcuacggacagcaucccugccccaauggaaacaagcccacgaccagacagagcugccuaguuucugcccacuuucuauuucaugcuuuuccuaaggacagagaugguggauuuuuuuuuccaaagcuuccacugcuggugaaaucugcugguggaagaggaaguuccauuccuaccgggcugucagccacaguaaagauuaacaagaguugugccaaccaaggagaggagugauggaggcagugggcacaagcagauuuuccccccgcgugagucaggaucuugcucccugguuccucucucccucucuugaccccggagcagacucccugggcucucccccagggcaggcccgacccagcuuucugggucgggcaggaggggccaccaccugcucuccucgcucuccagaagcuugcgguagguggcaaucuccacguccagggccagcuugacauucaucagcuccugguagucacgcagcagccgugucagguccuccuuggccuggugcagggccacauccagauccccaagcuucuucugagcauccuugagugccagcuccccacgcugcuccgcuuccgcaauggccgucugcagcugcugacacugcccaggggagaaagguguuggaagcacccuccggggucaucccauucaucucucugcccucaagccauggagacaucaucauucccacaucccugcccccaaccagcugggaaagagagaagagaaauauucaucugaagagaugcuauuacacaagcaggaucaaguaaggccacugggaaaguccuuacugaagucuaaccucaaccccuccugcugcagaucagcccaaugccucagaagagaugaaauaaauaacacagccuuauuaguaaccaggugcuucauucuaaucugugaaagaacccacacuuuuuagccguucuaaagguggagucggcaucagcaucugugaccuggccccuugaacccucuaccuccuguucugacuuccuggagaugggauggaucaguuuccuuggagaagguugucccaccugcucuaccacucauauaccaugugacguuggacaagcuccuuccugcucugugccucaguuuccccccauguaaaaggagccugugaucaauggccuagcauucuauuguguccgucaggagaagagcaggccuagccccucggggugacaaugagaaggcccugccaacaccuaggccagacccccaagcccccaguagagucccaccugcuucuuggcugcaucagccucccccugcagccucuggauagugcgggugagcucagcaaucucguucuuggugucccgcagguuguccccaugcuucccagcagucaccugcagcuccucauacuggggaccaaagaaguggcagugcgcuuucaaauggccccagcccacccucacagcuggaggccccaugcaaguugaguauaucuggccccccggacuccaagggucccagaggcccaagccucucacgaugggagaucugauccgaccccaggccucacaccugagccagcuaugccucucaccuuggucugguaccaggccucggccucagcccggcuccucugggcaaucagcucauacugggccuugaccucggcgaugaugcuguccagguccagguugcgguuguuguccauggacagcaccacauugguguuagacacgugggucugcacuuggcucagcuccugaagaaucagagacagcugccaccagcaccccugcuccaggccccaggaagcaucagagggugaaggacaugggcccccagguagcaucaggaggccugugcucuuguccaggcuccagccuagagcaaaguaaggaaaacugcaaggaaaggccucagucuccccagcuauaaaaugaagcucccauuuuuacagacuucauuuauuuuuauggguuugcaggcuuccaaaagauuagagaggguaaagagaauguguacucucugcacuaacacuggugcccggcacugugcuagcacauucacuaaccccucuaggccucagaacacccugugcagcuggcaggcccauggcaggcucacagggugccuuugugcaaauuggggaaagacaccccuucagguggaaacagcauguccagcaccagccaagucaccaacugcaccaccauccacaguaguccugaccauggacaagugaggaaagagguuuggagaggagaagugaugcauccaagggcaccagguccagggugggacccagccugggaccagucaauugcaccacaaagcccaagugguuuccucuagagcacacugaaaaguauagacugucuugauguucuugggcccuccuguuucuagaaccaucguccuucacacauaaguaggcuucaggaugcugugaauggcggguuaggugauggggaaucaaaggucucuguucuggccuugggaccagugggaucgcugggccaggacugugauggcucccacguggggcucugccuccaucucucccaugguccuuccugcucugggcugcccauagaaugcccuaaacuccagcucugacaaaucacucauucacucaguaguccucagaggcucccugauagguggagaaccuucccccuaaaacccaacaccucccauauccuggucuugucuccauccuuucucaaacacuggcccuucauggcagcccagggaauuauaauagaauaauaauaacaacccucgcaugcugagcaucacugugauucaggcucuguguuaggcauguggcagguacuaacucauuacaugcccuuuuccaguagcacaaagagauuaaguaacuuggcccagaucacaagccaguaagugaggagcucaguuucaaaccccaggagucugacaucagaagcugagaggacguagacuaaaauagagauaggcaggaacaaagagagacagggggaaaagagaaauaccaaaggcaaaacugauauccauacugauguagauguagauuguuaaauuagauugucuuucaaaaagugggaugaggaguuuagagaugcaaucaaucuagucacuacaaaaacuugugguuuuugggaagauaugaguuuuggagauagacaagccugagaucaaguccccagccuaacacgcacuggcuguguagcugauguagcagcugagccuugcgaugccucaguucccucuucuguaacacggccugaucauacuuucuuccuguggugguuguggggcuuaagauccauguaugacccauggcaugugcugaguaaagugcauucuuacuuucccagacuucucugaaggccacuggaggugcccauaaggucuauuugucacagauaagauuguguugucacagcugcuuugucuccuuccccaccgagaugaacugucagcaucaucuugacgcauccugccccugcccuccuuagcucagggucucuagccccaugucagagcauaguccucaggaaaaucaacccgaaacuuuuaagacaaggaggcaaaaucucuccacuggauggcaucaagaguggaugaggugaugcaauggucuugcuggaacaaggggauagaaaggucaggcuuggccaggugcaguggcucacaccuguaaucccagcauuuugggaguucaaggcuagccuggggaaaauggugaaugcugucgcuacaaaaaauacaaaaauuagccaggcauggugacgugcgccuguaaucccagcuacuugggaggcugaggugggaggaucgcuugagcccaggaggucgagacuguagugagcugugauugcgccacugcccuccagcaugagugacagaaugagacccugucucaaaaaaaaaaaaaaaaaaagucaggcuuuccgaugaaagggagcucgugaaaucagagcagaaagagcucugugaaucgcuaaggugugugucuccuuagacaccagggacucuaagggggaaagacaguggagacuucuaggcaaggguaaagggagccagcgggcagaaguggcacaagcggaagagggacuggguuccacagaugccccaggccagagggaggccaccauggaggcugccuuccugcccuaugagacacccagugauaggugguucaucccccagauugccgugggaucuggcuuggccaaaaccagaucauggcauugguuacugagagccaugcugguuccgugacugaucgagcccaugaggcagcaacagaacaauugugcugauccuuguucucaccccacggaggcacugcugggccgugaggaccucugacaggaaagggcccaggcuuggucccuaccacucuuucccuugccuccugcucaccuaacugugcccacacacucgaugugggcacucaccacccacugguccccaagcaccauguuccuucaugccuccaugacacugcacaggcugggccccaggcugccaaguccuuccugcuccuccucuagaagucuagcccuuccaucaagauccaacucagaagucaccucccucgaaggcuuccgcagcccucccaggaagggucagccauggcgucccaugugccuuugcaccugugccugucccccacagcucucaucacuugauaaccuggccccacaagagcugagacuuugucuuuguugcuauguggaaggugcucaguaaauguuuguuaaauaaacaaggcauagcaauggaaaggaaugcugaguaugccagccauguccuuagaccaaagaaaagccaauuccuaaacauucagaaaagagggggagagagaauggaaccuaauggaccacaaggaggccccagaccaugaaugacuaucaaugacccuggcaaaguagaaacuggggaagcaccuaaaaacucagcauggcagcccagaaaacuucccaguaaguuccauccagacaggccgugcagagaugcuggaaggcaagcaauccagccaaggauaagcccgggaaacaccaaagccaggggucagaggcugcuagaugaacucuaggcagaaauaacacggaggucccuuugggcugaucccuacagaagauccaggaaaggccaaucgcucagcugcuuugucauuugccucuuuuccaucaagaacaaacuggucaucaaaguggaaagcacaagaaauaugcuugagaggaaaugggaacccaagacaggguagaugagagaccuuggccuuguuggagaucacagggauccaggcuagaaaagcauacacucagaggcuccagggacugccaagggaaggaacgcccuggucauccuugagagauauggagaggaggagaccccaaaaccccaaacgcagcaaauggccugauuuucaaaugggagagauuuggaauuuuucaaauaaggcugacaucaaccuccuccagacccauagaaugaauuccuaaaugugugugagaggcaugaagccaucauggguucccuaaggaaaaguggaaccaaguggauuucauuuuccuucaugauuauaauauuaaacugcuaaaggccugccauagacaaugucugaccaagccuuccauagcauucuugaaagaagacagaaaaaugugauccugguaacaguacuguuaaggggauuuuaaaguagcugaggcucuuuaaccacaaauuauugguuaacagacuaacagucccuuggaaaaucaccacugaagacccacaggacuuuguuuuaggcccugauugccuuaacauguguaucaaugauuuacacugagaugcuaucaaauaccuagacugaaaguuuaucccaccugcagauaacacaaagcuaugcaucacuaauacacuggauaaaagaaucaaguuacuaagagcccacauagcuuaaaauguugggaugacaccacaguggcauuucauaggaaagaaagggaaugguuaacuguuccacucaauugcaaaauucagcuacccacauacaggaaguuggaggagaguagauacaugucucauuugaaagcauuuaugugaaaaaguccagaagggguucuaagaaagccaacguugugaaacaacuucuaaaacaacacauaaacuagugcacuauuaggcugcaucaauagaaguuuguaucuggaaccucccuccccaccccuccaucuucugaauacuucacuaaaagcccuguuuccugaacguccucacaugccacagauuuuuauccugucaucaucaugacuucuaaagggcuaucaugugaaaggcauaagucacaagaagacaauugggcaaagucaagggcagaagucaugagaaggagauucaagucagugcucuaaugaaguuguucaacaaugguaaugccugcccuaaaaaguagugagcucacugccacaggaaguauuugaguagagguuacauaugauaggguuaugucagggauaucauagaaauuguucuugcacuggauggaagguuggucuugaggucccugcggacccuaagagucugugauucugcggucaauucauguuaaguucaacccucucacucuagucuccaaagcccucuugucuccuggaaccccuccuggauucuuuaaucuacccacgccucaccuucuacuccaaucuggaaucccagucccuccucucugcccauuccugcucccucaucccuugcuccauuacaaaccgggcaggaagagggcaauauaacagugguaagagucagacuucggaguucaagagccagauuugaauucuagcaugcuucuuccuagcuaugugaccacgagcaacucugagccccaggguccuugacuauaaaauugagacaauaauaguucuugcauucugggguuauugagaagauuauguuaaaaguuugcccccgugccuggcccaucaaaagcacuuaauaaguugaagcuaguauuaauuaaagugucaagguuuuaggcugggugcgguggcucacgccuguaaucccagcacuuugggaggccaaggcggguggaucaccugaggucaggaguucaagaccagccuggccaacauggcaaaacuccaucucuacuaaaaauacaaaaauuagcugggcaugguggcaggcaccuguagucccagcuacuccaguggcuaaagcaggagaaucgcuuugcagagguugcagugagccaagacugugccacuacacuccagccuggguaacacagcgaaacuccgucucaaaaaaaaaaguguuaagguuucaucuuccaccaaugagguugcacuggugaauucaggucagaccuccauggaaaacgcccagugcuguuuauaguguaugcaaacucucccugcccauuggccaccucaccauuucauagaguugcugcaggaagucaaucuccugggucaaggugcccacuuugccaugcagauccauccggcccauguaugcugcauccacauccuggggacgagagagcaagacagauccucaggccccagggauguccccucuccccgaaucagcccaguacccuggcagccaaaggaccaccucccccacuccacucggcucaccuucuugagcaccacaaacucguucucugcagcagugugcuuguugauuucauccucguaccuguuacacaugggagacucaggccaggcucagccuggcucugccuuucaggcaugggacccacucagccuuacagaagcccugaugggucccucacugaucaagaacaccucuggggagcaguucuuuaauguagccaaccagugaagaaacauggggucugccuugauuuaaacauucucucuccccaccccauuuuagggaaagaggcacagaauuugugcaauaauauggcaaucaagagcugccaucucuuuggauccaagcccuuaggaggcuuuagagggacaagugaagaugugucaacaguggcugaccuuuaccaucacuuucaacaacacagugucauucaaaccagcuaacuccuccccaaccacuuuugaugagauuuuaagguuuagaaauugccauggucaauuuaugggaaaagucauuuuuaaaugugcguguuuaaaaguuauaaauacgcauaucaaccaauuauaauauauaaaccuuuggagcuugagucaaauaagcuguauuuuuuaaauuuaugacauguauggggucacuggaaauucaaaacuggcuggauauuuaaugauauugaggaauuauuguuuuaaaauuuuuuaggugugauuaugccacuguauguuuuacugagucauagaugaacuacauucacaugcagauauaugaauauaacuuguaaaauauuagugaaugaaaugacaagaugucugggauuugcuucaagacuacaagggaaucagaacacguagaaaaaggcaaagguaaaaaaaaaagacuacacgggaagaagggaaguggggagguguaaaaaaugcaacaagauugguuaugaguugauaaugauuaaagcugggugacaggaacaugggguucauuauacuauucccccuacuuuaaaaacuuuuuuaaauuacaaacaaaccugccaauucuccagguggcagcaggugcuggaccugagcaccugagggagccagcucugucugugcaucccccaggugggccugggacccugggaaugggguggcccucuuggcagguuucccacugccccuccucacucccacauggccccgccuggccugcucuccucacuuguucuugaaguccuccacaagguccugcacguuccugagcucugaguccagccucccccgcucgcucugaagucuguccagcgugcuccgcaugcuacccagguaggccucaaagaggggcuccagguuguuccuggugacacccaaguucuggcccugcuccugcagcagugcccacuuggucuccagcaccuuauucuguugcuccaggaaccgcaccugagccagagcagaaagggugggcugaugucacccuccggucaccagaggagccaaggaugggguccauugccaccuccccuccaaggccagggcaacauagggacgcugcagccgcaccuacacuuugcuguggggaggcacuccuuaggggaauagacugcuggaaacgaccguccaaucugauggaaagaacucuaccaaguuaauaagcacaaaagcccagcucaguagcaguaccaauuuacuaguugguaaccuuggucgaaucauuucucucugagucucccucucucacuuguccugcauaaacuggacuagaucuauguuucugaccccuaauucugcauuaaaaucaucuguuuaaaauguaaaucaacuguuuaaaaucacacacuuugggagccugaagcuggaggagugcuugagcucaggaguucaagaccagccuaggcaacauagcaagacugucuccacuaaaaaucaagacaauuagccagguguaguggcaugcaccaguagucccagcuacucaggaggcugaagugggaggaucacuugagcccaagagauggaggcugcagugagcuaugacuguaccacugcacuccagucugggaaacagagcaagacccugucucaaaaaauaauaauaauaaauuaagaaaauuggugaacugggugaaagaguauacaggaguauguuguacuauucuugcaacuuuucuguaaauucaacauuuuuucccaaaaaaaacuuuuuuuaaaguaccaaugucugagcccuuccucuauagacucagaaggaggcuuacgguguggguuuaacaggacccccgagaguucuuggcccagcugggguuccaagacaaucucucagaccuccagcucccaagcugugauucugcaauccugagaaagguuuuggcuuguuuggccucugggacagucccacaggaaaaccaaaagucacuaggggagagggugaggaggcaggcaagacggcuugcuucauauucugucauccaauaucuccaggucccaucuccacacuaccugggccucagucacaugcccugggagcaucaugcagcaggugugccuauugugagcaguaacaacucuuagugccaagaaccacagaguccaggggccugggucccagucccgccucugccuccaacuccuuguaucauccugggcaaaucacuugagcucucuagaccucaauuuucucaucucaaaaaugggcacaauaucaccauuucugagucuucauagaagcacuguggguaccucaggagaaaagggaugugcauguucuucggaaacacacaaaucacugaaccaagguacauuugucugccagaccuuccccaucaugacccgcugccuuggcucaggaucgagguggacaaugccagcgaaacagaccaggaaaucccagcacaaguguugcucccauccaucuggaggcaagggcaagguucagggcaugccuaugggcaacaggucaaauuccacauucccagagcuuggugaccuggugaccacccuccucauuguccaccccaaauugagcuucuucacucagaguguaaaaaaaggagaagcggaagggagccuaccccuaggaccccacccacacacaacuguguuuugaucacaucuugcccuuaagccuccuccaagccugaaagaauggaacaaacagggcuccaugcucuuagccuugaacaacucuuucaacuccugagcauuguuuccccagcuguaaaaugacaaaaggcaaugcaggccaccccacuaagaggagcuaugaggacaauccauuuuuugaugaugagguaaggcuacugugcaaucaaucguauuaaucauggugguaggacaggcuucaacacgggcaagguggacuuggcaaaccggacucaugaguagacuggagacuccccccgcacaggcacggugaagaccugaaggccgccuccagccacccacgucucggcaucccaggcucagaccgggagagcuccagagcucuaucaaccaccacccuaguacaagugggcuacagcagcccuggcccagcccacccucuauuagaggucccgcuucuuccccaagagcucccuuccuccuuccugcuuggcccaccuugucgaugaaggaggcgaacuuguuguugagggucuugaucugcucccgcuccugagugcgcacucgcuggaucucggggucaaucuccacauggaggggggucagcaggcucugguugacagugaccuccuggauccccccaggaggacaagcaggcccaaacgucugccugccagcccccugucccauaaaugcccugcugccaaagccaaagccccccagagcccgccccaacaaggccccuccggccacacugacagagauacucuuguggccccccaaguuauagaggcuucggcugccaaagccaccugugccggggccacagugggccccgccaccacugccacugcuccgagacaccgucacugagcugaagcuggugcgggccugggacccacucccuccgcuggcagaguuggagcugaagcccccuuuuguggaguauguuugccgagagacggaggaccucauagcugcagaggggccggagggcaggaugagagg

SEQ ID NO: 192590 - RNA, 35932 nt, Homo sapiens
ugaacuuuaaagaucagauuuauuuggagaaaacaaaaaacccacaacccaaaggaugggauuuuacaucaagacaucucccagguaauaagucuacagauuacaaaucauuuucauagaagauauuuuuguacaaauuuuacauguauucaggagcgggacauuaaucaaucccuguuucuauuuuaauaggggggacaagguaggggagagggaaaaacaguuuuggauauaacuauuuggaaggagaguagacaugaagagggcaaacccuagcuuuucauuaucuacaaucaauaguuuguuuuucuuuuuuaaaaaagaaagaaaaacccuuucaaucuucaauacucuuuaaaagcccacuucuuagcuacuggccaauccacaccaauuauuuaaauucacuugguacacaccuuuguccacuggguaaauuauauucauuaugcccacugcugcagcacgcauaaaccaacaccccugcauggcugaacagggccuaaucuaggacugaugggagaagggcuugcaaaccaagaucaagguguuucuccgcuaauacugucuaccaagcugaucccuacaaaaaugcauauaaaagcaggcaaguuuagcuacuguguugcaagagaaaccaggaccuuguuaaauaguucucuccauuaccauuuauucucucaagggaagcuuaaaaaaacaacaacaaaacaacacauuggucuggccaccucaugaauccaacaagcauuaguguggcauuucaguggagaaggaaacuuggggggaaaaaucccaucaagguuguaagaaaggcucccaauuuaacugucccugucccuauuuauccaucauccaagaccauccauuauucuagagcacucugaucaauaaaagggguccaagcaucaggagcaggcaaggagaaccaaaagacaucaagaaaccgauuugcuugagaaaagcagcgauucuuccuuucagaguucuccauggcugagaaaaugcccaagacaucauguaugugacuuagauacugcuuuuugggagguuaagaguagcaugaagaacuuaagaugaugauaagagucuaaauuuuuaguuucaagguuucaauagaauguggauauauucaaaacuuucaaaaaggacaguguuuagaaaggguaaaacuaggacacagaaaacacugggaauuaccacgacccccaagugcuuccggcuccaggaaauaaccauucauguguuugcuggaggucacacaauuuuccccuauuaccuggugcaaaaugacucaucacuucccaaaagcuucuuuucaaaccacgauuuucccauuuauuuugguccaaugcagucccauucuuuauggccuauagucucacucccaacuaccccccugggggguuaaaaaaaaaaaaggaauucccucuaggcuggcccccaaaacucagaauuaaauaagaggaggggcuggcagccuccuggagacuagaacaacuugaggcuaaaucuaccuuuccaagaguggaaaauuuauucagauaauguuugagaauucauauaugccacaauaggauaaaaacuaaaagguagaaaucucacacuuuuccuucuaccucccuccccuacugcccaaccagguuccaggcauuauaucacugucauuaccauuucugcuaaauggagaccccuaggcacuaaucacacuggcaacugcauggugacauaacgcaccacaacuuuuccucuaaaaagcuguagucccuuucucucuggcuguauuggcaauucuccaguuacuucaauacuuuaaaggcugcagcagcaugcaaaauaauuucauuuuuuguuuuuaaaaaaagguaagaaaggucuucaggagauggugaguuuuauuuugucuugucuggauagagguuuugauuugcucucgaauguuccaggguggagagaaacuaggagaaaagcacaggauguagaggucuauucggcauaaucuucucccucauuuucaucuucaccaucaacagagagagcagcauacuugcuugcagaacugaacuucuguaacacaacgagagugacaggauaaugaaggcccugaauuaucacaucaaaacccaagacacaggauacugauccuuuggcaaugggggaugacagucagaugacacccacuugcuugcucaucagcauuguccauuggagaggagcuagggaagagggucagaggcacaugcgaucuuacuauagucucauaccaccucuacaccuugcagaagggaugagaacaaaggaagacagaaaccaggaaaaagcuaaacuucuuucgcuauuucaguaaagaccaaugucuuauuuccaaacacuuuguauuccaaauggaaagaaguccaacggcaaaaaguuuagaauacuaagaauuuuuaauucuuaguaagaauacuuagaauucuaagaauuuuucuuagaaugaaaaauugggagcagccuucaacacuuacggaagcuggauuuuccucagguuucuuuggcucaggugcagaucuggagucuugauccuuuuugccaucuuuccugcagagacguaagcauaaaaccaugucuuuaggaaaggacucgccuaauacaaacauguguaugcaugcaguuucaaggcacugaacaggcaccucuagucaacaguccuuguugucuggaugauguauuacuucuagauuuucagaaucuuaacugucuacguuggcugacuuuaguuugcucacaaugagcgaucuggcagugcucugagaaccaagaacuuaauuucuuaauuacacaaacauguggaucagaggaaagaugagaaagagaacaagcauaccuaucugacuccuuccaguggucucuguucccuccgucgccuggaccacggcuagaguucccaguuuggccuuuuggggcauucaucccaucuacuuuauuuucaucugcuugggcaguaauguaaacaaauuaaaggcaaguaaaaguaucaaugucccucuccuaagauuucccuuaagcugaagaaaauugugcccacauguacugagggaaacuaaccucaccccaacccagacuuccuuccugaagcccuucuuuccacauccucuacagcacacaaaaauacaaaaaacaaacaaaauccacuaaaaaguuccauguagggauaugccaucaugaaaagcaagcuggaaauaaagauuaugacgcucuguagugaccuugguuaauuuccuuccgauuuuuuucuccccgucaaagaaauguucuaccaggaaagggcaggguuucauacuuucuccaaagaggccacuccucccucuacuggcaagaaaagguagauaacccaauaauucuuuuuuuuuugagacagagucuugcucugucgcccaggcuggagugcaguggggccaucuuggcuuacugcaaccuccgucucccggguucaagcaauucuccugccucagcgucucccgaguagcugggauuacaggcaugugccaccacacccggcuaauuuuuuuuguauuuuuaauagagacgggguuucaccauguugguaaggcuggucucaaacuccugcccugugaucugcccgccuuggccucccaaagugcugggauuacaggugugagccccugcgccuggccaacccaagaacucuuaacacgguaucaggugcgagacacacugcucuucaaaaucuaauuuuggaggccuuuuuauuuaggcuucuaggugaaaaaccuauuucccauacuaugagcucaccuuuccuuccugguccuuccucagaugguugagcuggagcuacuuuucccccaccacuagaaggaaaacagguaaucacauucaucaguuguuucagggagaaaacaaccaagaaacauaaucauccuccaaaugcaguggguaagcuuuauagaaaacaaaaucauacucaauguuauggaacauuaaaauaugggaaagauuacaaugaaagcaguaauuugaacacuaaagugccauaugcuuucuaaucaucacaucaugcaggauuaguauugcuauuuucuuuucuuuuggagucuuaacucugucgcccaggcuggagugcaauggcacaucucggcucacugcaaccuccgcucucagguucaagcaauucuccugccucagccucccgaguagcugggauuacagguaccugccaccacgccaggcuaauaguguugcuauuuugcuuacaaaugagaagacuuaagagaaaugaaaggaaguuacccccuaccauacugccaauauguggcaaaagggaagccucugacuuacaguauuugcagauuugugcggcauuaguacucccaucauagcugauuucaagcuaucaaagugguggaacuccagaaaauggaacaacuaggucuuaugagccaguuccagcacacuaagagacuaaagccagcauaacuuauaaggugcuauacaacgcuggcaucccguaggagaucuuccaucauuacaucacaguauuuuagaaucugcaguuaaccaacuacuguuuccaaacugacucaccuuguaggggacugcugcucugugucugagcucugagaucgagcaggaggguuagaacuucgcuucacccaagcauucuccuuugguggaggggcuggcauuaccuuuaggggcugaucagguuugggagguuuagaaguuggagaguggcaaucuuccuccuuauugaguguuucauuuucuagagacuucucacucucucuccuucgugcaucugugaagccagagugaaaauaucaaauuaucaggcugcagaugcucacgcaucuaccaggaucucaacaguguggaaaaugguccacauccaaguuuuggcucccaaagauggauuuaucccuaaaccagugguuuacaaguauuuccagaacaaugucuuacugaugcacagagaaauagaaaaaauaaugaccauguauacaacuuaagggacacccagccaugugaccuuuuuaggaaugaguauccuuuacagccuuucugcauucucaauguuaaaagugucuugaccuggagaauauacauaugugaagaggaccuacaaugaaaccccaaacucuaguaaccacugcucaacuucagcuuaaaacucaacacacauggacuaugaugcaaucauauuuaugaaaaaccaccuacuggcugggugcaguggcucucgccuguaaucuuaggauauugggaggcuguugggggcggaucguuugagccuaagaguuucagaccagccuggacaacauggugaaaccccagcucuacaaaaaauagacaaauuagcuggauguggcaugugccugcagucccagcuacuagaaaugaugaggugagcugugaucauguugcugcacuccagccuggcugacagagugagacuccaucucaaaaaacaacaaccuacacgugcguuuuuuaaaaaaugcaguuaagugucuucuaaaaacaaggagcccccauugggaggcugaggcaggauugcuugaggccaggaguuugagaccagccuggggaguguagugagaccccaucucuaaaaaaacaaauuuuuuaaauuuagccaggcaugguugcgugcacccgucguauaacagcuacuugggauauuggggcaagaggauugcuugaggccaggaguuugaggcugcagugagcuaugaucgcaccacugcacuccagccugggugagaaugaaacccugucuuaaaaauaaaaaacuaggccgggcacggcggcucacgcccguaaucccagcacuuugggaggccagggcgggcagaucacaagaucaagagauggagacaauccuggccaacauggugaaaccccgucuuuacuaaaaauacaaaaaauuagccaggccugguggcagacuccuguaaucccagcuacucgggaggcuugggcaggagaaucacuugaacccgggaggcagagguugcagugugcugagaucaugccauugcacuccagccugggcaaaaagagcgaaacuccgucucaaaauaaauaaauaaaauacaaaaauaaaaaauaaaaaaaauagaaggccaggcaugguggcucacgucuguaaucccagcacuuugggaggccgagacggguggaucaugagguuaggaguuugagaccagcccguucaaaaaauuagucgggcaugguggcgcucaccuguaaucccaucuacucaggaggcugaggcaggagaauugcuugaaccagggagucagagguugcagugagccaaaaucgugccacugcacuccagccugguaacagagcgagacuccaucucaauaaauaaauaaaugaaugaaaugcaaguacaaaucaauuuagaggugggaggaaagaccuuaaaaaauaucacaguggcuggcccuuggaaucccagcacuuuaugaggcugagaccagccugggcaacauggggaaaccaucucuacaaaauuuuagcuggguguaggcugggugcgguggcugacgccuguaaucccaguacuuugggaggccgagucggguggaucaugaggucaggagauugagaccauccuggcuaacacagugaaaccccaucucuacuaaaaauacaaaaaauuagcugggugugguggugggcaccuguagucccagcuacucgggaggcugaggcaggagaauggcaugaacccgggaggcagaacuugcaguaagccgagaucgcgccacugcacuccagccugggcgacagagcgagacucggucucaaaaaaaaaagaaaauaaauaaauaaaaaauuuagcuggguguaguggugcaugccuacaguuccagcuacuagggaggcugagggcugagggaggugaggcuacagugagccaucaucaugccacugcacuccagccugugugacagaguaagacccugucucaaaacaaaauacaaaaaaaacacaucaugguaagggaagggagguauuacaauugaaccauuuagguuuccaaaacacuaaaagugcuugaucaaccaguaauaacacugcuugagaacacugcucuggugaugauaacaucaaaaaaggcuggucuugggacagcucacaugaaacuccaagccguugacuguucugaauaaacaacauucaaagaugucaagacauaaaaugaaaauauaccaaaaaaaaaaaaaaaaaaaaaagagagagacaaaccuaacaaccaaguauacacuucagugguagauuauuaagcagaucaucuaggucuacucugguacccauuccucagauucuuuggagcagaagauaugaaacuccaaucggcccaugcaacccaaauaaagaguucaugacugaauuuaaauauugcagggucucugcauaauuugguuauggauaguuuauggaaaacggcaauaacacgauacccacccuggucugacuuacuucugcuagaugugguggaggucccaguuugugaugacucacuuccuguccucgaccguucccguuccugaguuucuucacuucgccagcuugggugucuguacgagagauucacaaaauacacauuaugccuggcucagugaaggccaccuuagacccaugcugaccccucaagaaccaucacuuacuucaucuauauguguauaugcauauaaauuuaucuuucccucaaacuauuugaaagcuacagacauuaagacacacuuuggcccuaaauacuucagcaagaaucaacuaauaugguuaagaacaguauccuacauaaucuacaauacugcccuucuuuacuaaucaacacaguucuacaagccacucauuaccaggccuaguuuuucagggcaauuacuuauuauaguaggucucuagccuuuuagauacaauaccagcuuuuaauaguaaacacuuuuguaauggacagggaacaacucuucauuguguaaaacugucccuaacacugcauacugccuaacaccccuggccacagcccacuaaaugcccaucagugacaaccacuaaugugauaacgacacaaauuucccaaaugccccuggggauguaaugcccccauuacgaaccaccggauuccuagaugggauauccaucaagacaacacaccucucccgaggccgucguucuaguuuuggcucauccagcugacgcugcaacuucucuuguuccuucuguagccguucuucuacuucucuuucucuagcagcugugucaacaggcuuugccccuccaaagauagaagcagcucgaguggacugggagguacuagcagaggaaucaucuuccuuaggaguacuccgaggcuuuagauucaguuugggucuuugggggggaccuaaguuaaaugaaacuuuaaguaauaguuuuccaaucaccagaagcugauggcugaaagccagauuucucagauauaacuccuaugaaaugcuacaugagauucaaguuaguggccuaaccaauccacagaaggcaaauagaucauuagaaaacagguaguuuaggcugggcaugguggcucacgccuguaaucccagcacuuugggaggccgaggcggguggaucacaaggccaagagaucgagacuauccuggacaacauggugaaaccccgucucuacuaaaaauacaaaaauuagcugggcguuggggcgcgcaccuguagucccagcuacucaggaggcugaggcaagagaauugcuugaaccugggaggcagagguugcagugagccaagaucgagcuacugcacuucagccuggugacagagcaaggcuccgucucaaaaauaaaaaaaagaaaaaaaaaaaagaaaauagguagcucaggcugggcgugguggcucacgucuguaaucccgauacuuugggaggccgaggcggguggaucaccuggggucgggaguucgagaccaacacaaccaacauggagaaaccccgucucuaguaaaaauaaaaaauuagccaggcaugguggugcaugccuauaaucccagcuacucgggaggcugaggcaggagaaucgcuugaaccugggaggcagagguuguggugagccaggaucgcaccacugcacuccagcccuccaggcuggaaaacaaaagcaaaacuacgccuaaaauaaauaaauaaaaauaaauaaaaauaaaaauagguggcauaaauaaccaaguucuggccgggcgcaauggcucacgccuguaaucccagcacuuuggggggcugaggcgggcggaucaccugagaucaggaguucgagaccagccugaccaauauggagaaaccccaucucuacuaaaaauacaaaauuagccaggagugguggcacaugccuguagucccagcuacucaggagacugaggcaggagaaucgcuugaacccaccggggaggcggagguugcagugagcugagaacacaccacugcacuccaaacugggcaacaagugccaaacuccaucucaaaaaaaaaaaaaaacaaaaaaacccaaguucaauuacucuucuaccacauccaugauguaguacaagaccacaggaaagacuaaaaaugguaaacauuuaaguaauaaauuaauaaucuaucaagacuucuuuuauaugggaagaaauuuuugaccaucauuaaacuacuggaugaaaguaucuugcuccgaaaucugcauguuaagaacuaauacaauaugauagggaagauucuaguucuuuauuuuuuuugagacagucucgcucugucacccaggcuggagggcaguggugugaucucaacucacugcaaccucugccucccugauuuuccugccucagcuuccucaguagcugggaguauaggcacguggcaccaugcccaacuaauuuuuguauuuuuaguagagauggggcuucaccauguuggccaggcuggucuugaacucccgaccucaagugauccgcuugccuuggcuucccaaagugcuguuacagaugugagccaccacgcccagccaggaagacucuagaucuuauacccuugucucuguguauaauauaaauuuggcaggugguucauggggcaaagcauguaacacugaacaaauaaacucuuaaggcaggcagucugauuucuuccucaauucaaguugucagaacacuuucaagagaaaccuaaguguuucaaggaaguuaaauuucuaaaaaugauuguuuguccuaaauauuuuggauauacaaaagauacagagaauauaaagaaagccuauguauacaaucaccuggcuuaaguaauguaaccuuaacaaagagguaaaaccuccugaugacaugaccagcuguacucuguccucuaaauaaccacuagauggugacuucaucaugcccacacuugauuuuauacuuuuacuacauaugcacauaguaccuguagauagaggguacuguuuaacaagaucuaaauuuucuacgagggcuuuaagccgacaguuuauauauguuccuaaacauauuuuaaaucuguguuauagccccgucacuuuuguaagauaaaauaggggcucagaaaaaguagcucauuuaagauauuaauaaaagaacgcagccgggcacaguggcucacgccuguaaucccagcacuuugguaggccgagggcaaguggaucacuugaacuuggaaguuuaaaaccagccugggcaauguggagaaaccccaucuuuagaaaaaauaucaaaauuagccaggcauauggcacgcaccucuagucccagcuacuggggaggaugaggaaggaggaucacuugagcucagaaggcugaggcuacaguuaaccaugauuaugucacagcaauucuagccugggcgacagagugagauccugucucaagaagaaaaaaguaaaggcugggcaaacagugaaggcccguguaugucagagguauagagaaagggcuauguuccaggccauggggaaacuagacaggucuaaacaggagaauaagguaauuagaucuuaugccagaaagacaacugacaacuggggccaaugugaagaacggagcaagaaagggaacucuguuaggaggcaauggccaguaacgugggugcagcaaugaggccucaacgaagguagcagcagcaacuagagacaagagggcaaaucuuagagggaauggggggguaagagcaagaagagaaauaaaaaauuagguaugcagcucuugguggggagguaagggacagugugagagaggaaaaggucagaagucaaggagaacaugaggcccacaucugagccuccacuuuucuaacuuguaauuuuaccuauaccacacagaagucuuagaauuaaacaauacuuguacaagcccucagcucacugauggaacagaguaaaugguuaauaaauguuagcuauuauuuuuaggcuucuugcuugaggaaaucgcuuuuaagaacguaguuuuuucacugggcgcaguggcccacgccuguaaucccagcacuuugggaggccgaggcgggcgaaucacaaggucaagagauccagaccauccuggccaacauggugcaaccccgucucuacuaaaaauacaaaaauuagccgggcgugguggcaagcccagcuacuugggaagcugaggcaggagaaucacuugaaccugggaggcagagguugcagugagccgagaucgcgccauugcacucuagccugggcaacuagagagagacuccgucucaaaaaaaaaaaaaaaaaaaaaaaaagaauauaauuuuuuaaaaccuauuuccuauuuuauuauuuuuuagauggggucucacuauguugcccaagcugaaaugagaccuuggcuaacugcagccuugaccucccaggcucaagcgacccuccuaccucagucuccuaagacacggggacuacaggcacaugcuaccacgcucagcuaacuuuuauauuuuuugcagagauggggucucacuauguugcccaagcugaaaugagaccuuggcuaacugcagccuugaccucccaggcucaagcgacccuccuaccucagucuccuaagacacggggacuacaggcacaugcuaccacgcucagcuaacuuuuguauuuuuugcagagauggggucucacuauguugccagggcuugucuugaacuccuggacucaagugauccuccugccuuggccucucaaagugcuggaaucacaaaugugagccaccauggcuggccuaaguuuuuuuuaaaaaaaacaaacauugaauuauuauuauuauuuugaggaaggaguaaagacuucaccauuuucugagggagaaggaaagaccucacugcaauagaauugccauauggcucugaugaauucugucaucucacuguguuuuauuaguuguccagaucgauuuuccuuucuuggggaaucacaggagaugauggauauaaagccauugccacaaaguuuaggacuaacacaaagauguuaaagauaggaaaaauuuggccgggcacgguggcucaugccuguaaucccaacacuuugggaggccaaggcaggcggaucacgaggucaagagauugagaccagccuggccaacauggugaaacccugucucuacuaaaacuacaaaaauuagcugggcaugguggcgugcaccuguagucccagcuacucgggaggcugaggcaagagaauugcuugaaccuaggacgcaaagguugcagugagcugagaucaugccacugcacuccagccuggcaacaaacagagcaagacuccgucucaaaaaaaaaaaaauaaaauaaaaaaaggauagaaaaaauucugggccagauaccauaaccuuuuauaugacaucacugaaguuagaacacaaaugguggccauuuauuaguauuuuauaacagguuagauuuguaacacaguuuacauuuuauaucuuauaguauuaggggcauaauuuuagaauaggugcaccaaaaucucaccuuuauaauuaaugaacaucaauuauugugguauaaugguacagaaagcaauccuuuuuuuuuuuugagacagucucacugucgcccaggcuggagugcaguggugcgaucucagcucgcugcaaccucugccucugggcucaagcaauucuccugccucagccacccgaguagcugggaugauagguaugugccacuacggccaccuaauuuuuguauuuuuaguacagacgggguuucaccauguuggcuaggcuggucucgaacucuugaccucaaaugaucugcccaccuuggccuuccaaagugcugagauuacaggugugagccacugcaccuggccuuaaugcuucguuuuuaaccccauaguaccaauuaugggcuacaggacuauguuuaaucugaauuucauuucccuuacuuggaaaauggagcuaaaaccaucuguuuuaaguguaauuuacugagaucacaacauaacaguaucuggcaacuuuuuuuuccauuucuacuguuuauucaauaaauuuuaacugaaaaaucuaucugugaaggcauaugagaugaaaacaauucgacugcuguguuuccacugaugucauccuuagccaaugcuuuuuuuuuuuuuuugagauggggagucucacucugucacccaggcuggagugcagcggcgccaucuccacucacugcaagcucugccucccggguucccaccauucuucucucucagccucccuaguagcugggacuacaggugucugccaccacaccugguagagacgggguuucaccauuagccaggauggucucgaucuccugaccuugugaucugcccacaccuggccagccaaugcucuuucuacuaugcuuugcugcuuccuguacaaugugcaaauuauauuugugcccaacucaguaguucguaacacaaucacaaauuuuccguaguuuucccaguuucugcuccaugaaguacguaaaaagaaaacuauuaccucuaucaucacgccuauaaucaucccgagaguaaucaucucuggagcuccacgaccgaucaucccgucugucauaucggucuucauagcgguccccgccuccucuguagucaucaucccugcgauacccacugccaaaugcucuucugccacugccuauccgggaaucauagccuguaaauauaucccaaauuauaaucaucacagcggagggggaaaaaaaaaaggcaaaguuacugaaagagcaauucgacauguuuuacaauuaccucuaucauagucucugcugccucggucaucauagcgaucccggccaccauaucgauccauaucccggcgugggccaucccgauacccaucccgauacccaucccgauaccggucugaaucauaacgaucucgauacucuagaggaaacagacaaguaacaccauccccuuuucucugacaccauuaauagaaacacgguaagcuaucaguccaauuuggaagaaucuguuuauuuaaauuuucuaucugauuucuucaaaaaguuucccuggugaaauaauuguugcucagcuaauaauuugggaaggguggguuggaaauuaaaaaaucccuaaauauuccauaaugaauuuccagaaggagaagagguuuacaugcaaaaacaaaaaacaaaacaaagcacaagacacuaaaacaauacaguugggaaucucccauguuugaucccaaagaccacuuauuuuuuaauuaaaaaaauuuuuuuagcuggucacgguggcucaugccuguaaucccagcagcacuuugggagcccgaggugggcagaucacgaguucaagagaucgagaccauccuggccaacauggugaaaccccgucucuacuaaggauacaaaaauuagcugggcguggugacgcacaccugcagucccagcuacuugggaggaugagacaagagaauggugugaacccgggaggcggagguugcgcugagaucaugcccccgcacuccagccuggcgagagagugagacuaugucucaaaaaaaaaaaaaaaaaaaauuuuuuuuuuuuuugagagacagucucucucugcugcccaggcuggucuuggacucccgggcuuaagcaauccuccagccuuggucucccaaagugcugggauuauaggccugagccguaacacccagccucaaagaucacuuuaagaggcaaacaaaaugagaaacaauauaugcaacauaugacuaacaggacauaauuuucuauugaauuuuaggagcuuaaaucaauuucugcacugcugaucauaauuuuaaaugguacaaauacacuuugggagguugagguugguggauugccugagcucagggguuugagaccagccugggcaacauggugaaaccacaacucuaucaaauauacaaaaaauuagccgggcaugguggugcaggccuguggucccagcuacuugggaggaugagguggaaggaucacuugagccagggaggcagagguugcaaugauccaagauugugccaaggcacuccagccugggugacagagugagacuuccucucaaaauaaauaaauaaaucaauaaauuaguauaaauacugaaaguuguauuagaacuaugcaugaaaagauuugaagucauguauacccuucuugaccaacaauuuaauuucuugaaauucacugaggaaauaauuggaugugugauaaagauacauguacaaagacauucauugcaauguuguuuauguuauaaacuauauuuuacacacacaugugcauuucaguaucagaggacccuaaauacuagaaaucuguauaaagaaacguaguagcucagauagcaaacuguggguagcguuauguuguuuguaaaagggauagcugcuauuuagcuccagcugacuguugcuaggaucuuccaauuuucugagagaagcuggcaacccagauuuuaaaguuaaaaaaaaaaucugaauuucuaaauauaaauuaacuaacuaaaacaaccuacacguuuuaagagcugauaauuuauguaugggggacaaacagggaucuuuuucuuucucuuuuuuuuuugagacggagucucacucugucgcccaagcuggagugcaguggcacaaucgcgggcucacugcaaccuccaccucccggguccaagcgauucucuugccucagccuccccaguagcugagguuacacguguccggcuaauuuuuuuuuuguauuuuuaguagggacaggguuucaccguguuagccaggauggucucaaucuccugaccucaugauccgcccgccuccgccucccaaagugcugggauuacaggcgugagccaccaugcccggccagggaucuuuuucuuguggcugcugucuuuuaaauaaugauuucauuuuggaaaccacauaauuuuuacugaccagacauaacauuuccugguauuauaaacuuuauauauuaaagaacaugcuaauguuaguaaaaugauuauagaaaugaucuaaaacaggacacauauaagaaaaucagcccuguguuuauuuugaaaugugguuuuaauuucuggagaugcgauuuacacuuaauuuuauuuggguaauacugaaauuaugauaagcuuguguuuccugagaaagcauagauccaugcuggagaaaagcagcacaugcuauuacugacauuucauaggaauacugaguguaauaccccccaacaccccucgggguucucuuuuuggccuaaugcuugggacaggagucucuggaucuuuaauucagguuaacuaaguugacuuuggggcagcuuuggauaacaacagcacacucacucguuauccauucugcuugcucuaaauucaagguuucaggugagaaaagucaugccccuggacucaaaacaggacccuuggucugauugucugcuuuuucuuucaagagccauuucuuccuguuaacaauagaaucucuugcauaaaugcugaaguuaaucaccucacauaguucuccccaaggcuuugcugugucacaaagucauguaaaaagucagauauaaacuugcugauuuauccuucuuucagaccuaugacccauucuucuuccuucuacaucuuaaaagguuaaggacucuccucuaaaaggaauuauacauaucccuuacugcuuccccaauuauauuuaguacaaagcucaaaagguaccucacaaaauuaaaaugcuugugcugggagcgcuggcucacaccuguaaucccagcauuuugggaggucaaggcaggcagaucaucugagguaaggaguuagagaccagcuggccaacguggugaaaccccaucucuacuaaaaaauacaaaaauuagccaggugugguggugcgcaucuguaaucccagcuacucaggaggcugaggcaugaggaacacccugaaccuggcaggcagagguugcagugagccaagauugccacugcacuccagucugggcaacacagagagacugugucaaaacaaaacaaaacaaaacaaaacaaagagcuuguaaauuuaaguuggucuguuuuuacuuaaacuauuucaaacauacagaaaaguaaagacaccauuauaacaaacuuaugaaccuauuacuuagguuuagugaaugucauauuuugccauguuuguuuuuuguuuaaaagaaauauguuacagacuaaaaacagaauuuucccuauccccaccaacaauuaaaagggugguuaaauuaccaugcguagcuuuauaauuuuacaacuuaugcauuaauacuacaugguauuguuuucaaauuuauacacaauuuuuuuccccuuaauguaacagguuuugaauuuuaucccuguuguuaugcuauuaaguauuugauuacagacaaaccacuauuuauuuauuuuuacuagguaguagcuucuuuccauuuuaaaaauaguguggucuacuuuuguguauuuuaauaaaguugcauaauuuuccccauaaaggucuuuguuaaagugauguauguaauuaaucucuacuccuaccccaugauauuucccacucaccuaucuuuccgcaccccaacuguuuaauuauucacacacugucucuucccuccacuauaauaauguaugcccaauaaagacaggauuuucuuguuuuuguucacugcuguaucuugagcauuuaagugaaucaauuuuuauuagaaaaaaauuacacugcuguaucuuuguucacugcuauaucuugaguauuuuuaaagugaaucaauauuuuuauuuuagaaaguuacauuuuaggccaggugcaguggcucaugccuguaaucccagcacuuugggaggcugaagcaggaggaucaccugaggucaggaguucgagaccagccugaccaacauggagaaaccccaucucuacuaagaauacaaaauuagccaggcaugguggcacaugccuguaaucccagcuacucgggaggcugaggcaggagaaucgcuugaaccuaggaggcggagguugaggugaccugagaucaugccauugcacuccggccugggcaacaagagcgaaacucugucucaaaaaaaaaaaaaaaaaaaaaauuuuacauuuuaauuguuugcuacaagcauauaguaaugcaacugaugggccaggcgcaguggcucacgccuguaaucccagcacuuugggaggccaaggcgggcggaucaugaggucaagagaucaagacuauccuggccaacauggugaaaccccaucucuacuaaaaauacaaaaauuagcugggugugguggcgcgcgccuguagucccagcuacuugggaggcugaggcaggagaaucacuugaauccaggagguggagguugcagugagccaaggucacgccacugcacuccagccugggcgacacagcgagacuccgucucaaaaauauauauauauaucaaaaaguaaugcaacugaucuuuguaugcugcucuucacucagcaaucaugcugaacucuuauuucaaauagcucacuuuguagaaucuguuggauuuuuuuuuuugagacagggucucgcucugucacccagucuagaccuccugggcucaaggaguccucuugccucagcuugcugaacagcuaggacugcaggugcguaccaccacgucagcuuuuucuuuuucuuuuugguagacagggucuuguuuugucgcccaggcugcucucaaacuccuggccuuaagcaauccaccugccuugaccucccaaagcguugggauuauagccaccaugcccaguuuggguuucuuuauaaacaauugucuccaaaaaaagagaaaugucugucccuuuguuugguuaaguuuucaaaaaaaauuauuaauuuaucaaauucguuuccugcaucuaucaguucuuucagauacuauccaaaauuuuucuuaaucugcuuuccuccuucuaucuguuaaugugaucugaucaucuguaacacauuuguccuauuacuaaauagccucccaaagcacagaggaagcuaacuucauaaaaacaaacuuacugucuccaaagcuaucaucaccucuucuagguggguagucaucaaagcugucuguagcaggacgagcccuccagucuguaucuguuuugucagaaucccgauuucuaucacggccaaaagaacgaucaucccugucuacagauacauuaaaacaaaaaccguaaguuaucucauaaaaacuuugcccaauauuucucacacauagaaaacccccauuuuacccuauuuuucacuuucacgucacacugucaucccaguuaccucaggccccauaaguacaugcuccaauucaaccccagguggcucuuuuccucccguuuuuuccuauugguuuaaugcuuagcuaucucaaauucuguaugggccaggagucccugaaacauauacaaauuagguccccuuugugaccaacgugcuguuaggcagcuaaucuauuuaucaucuauuuaauguucaucuagaucaaucagucuucucaaucuugacaugcauuuugggcugcauaauucuuuguugauggggacuguccuauucccuauagaauuaaccccuggauucuacuuaugucagcagcacucccuccaauugugacaacuacaaugucuucaaacauugccagaaguccccuguggggcaaaacugauugaaaacuguuacuguagauucaggcaggcccaccacuaccccuauucaaauuuucugggaaaggauggcuuggugucauccugggaccauuaccaaacagaaaucucuaccaguuuccuuaccuuuauccugugcuugaucagcaacguccacucgaauucuccuguuaccuagagacugagagcauaggaccauauuaaccaaccuuuugccccauuaugcacaaaucccuugagugaccuugaacgucugggcauagcagaagcacuaggggaaggaagauaaaggaaaacacuguaaucuagcuaacacuccaauuugugggcuaaagaguccuuuaaaagacuuaaaaguuaaacaaauuuaagcuggccuugaauauuaggucaauuauacuauuuuuacaaagcuuaauuucacagaauagaauuaacuuuuuaacuauccaagguaauuugucaaguguaguaaauuaaaaauaauucucacauaacuagcugaauaaaaggcauauuuggugccacaacaauuauuuaucaaaauuuauagaagccaggugcaguggcauguaccuacagucucagcuauuugggaggcugaggcuggaggaucacuuaagcccaggaguucaaauccagccugggcaauauagcgagacacugucucuuaaaaacaaaaacacccaacacauuuauagagccucuacuacuacuauguaccagcaaaauugcauaaagcaugcuuugucuacaaucuuagguucuuucacucaguauuaccuucagauaaaucaguucuuccagagauacccucugacuucccuuucccacaucauuauuuauauacuuugaacccaauuaauucuauugcugauuuuuccucauuucauaguagaaucuacaguugaaggauaacaaugauuuuuaguuaaaaauacccaaaacuauauuaaacaccacuauaaugaaaucucuaguaacaaaguaacucuuaacuauggaccacaacaauauauuaauaguuaaucuaguaaacaucaaauaguuaacaauugcaugguauucuuuuucuuauccagacugaguaaaguuagagaccaguaauguuaauaaaaaucuaaaaauaauccaguaagaguaacucuggaacaagauuagaccuucauaugcauuuaacuaaguacauuaauuuuuaucucuauuucacacugacuacagguuaucaugaugguaaucaauuaugaggcagcaaaacuauuucuaagagguguugauuucaaucaugucauauggcaaaauaggacuacagaaauauggcacaaauggcacuagaaauugccuuaucaauaaacaauaagguguuuuuggaguuaaaggaggaaaaaagucuuuuuucuucugagauauaagccccucaaguccugggacaggaaaaccuuugugggcaguguugacaagcagaaggacuagauauuuauugucacucuccuguaaaauauuccuuuguaggaaauguuuccaaauccucuuaaaugaacaaauauaccauuacaacacuucccugaaaaugagauaugccuuuaauacuaaacaaacuugauuuuucuauuugccuuuaucaggccagauuacuuugaaaaagcaaugccauaagaguugaggcaacacuguggguaaaucaguguaagacuuaauuagagaccuggugugugguggguuucuuccacaacuuuccaccuaaguaccuaucuaaauuauuggggccuacugaauuugcugaagugugacuugcuagauguucgauguuaagugauacacuguuaaauaaugcaggccuuuauuuguagauaugggaaucuuugaagugagccucucaaccuaaaaaauaccaguuugaucaauaaacaugagauuugugaacuuacaccccucauauccccacucuuauuuucuuuaccucuucauugagacucagggcacugagcagggaauccagguccucaaauucagcauaaccaaaaccuuucaaccucucuggauugcuggguucacgugguaaacgcacugcacugaucugaaggaauaagaaucaacaacaaaguuucccagcauucuucuucauuugucauuuuuugagaggacuacaaaagcauuacuguaugugcaugaauuuuucugaauacacaagaacaugguugucucaggaggaaaacugaugcagagggauaguagaaacuuuacuaaaugcccuauuauaccuucugaauuuugaacuguaugaauuuaacucuaaaaaaaaaaaaaaaaagauuaauucaggccaggugcaguggcucaugccuguagucccagcacuuugggaggccgaagcagguggauccucugaggucaggaguucaagaccagccugaccaacauagugcaacccuaucucuacuaaauacaaaaaauuagcugggcauguaauccacuguacuccagccuggaugacagaaugagacucugucucaaaaaaaaaaaaaaaaaaaaaaaagaaaaaaaaaaaauauauauauauauaauuuugauuuuauuuuuuuucuuugagaugguguuucacucuuguugcccaggcuggagugcaauggcgcaaucucggcucaccacaaccuccgucuuccagguucaagcaauucuccuaccucagccucccaaguagcugggauuacagacguguaccaccacgcccagcuaauuuuuguauucuuaguagagacagggucucaccacguuagccaggcuggacucgaauuccugaccucaaaugauccacccgccucagacucccagagugcugggauuacaggcgugagccaccauucccggccuuaaauuauauuucuaguuguuuuuucaacagcaacugcccauuccacaauuagucuuuuuuagacauuauccucaauaucuaguuaauuauuacaacuuuuacacuuacauuuaauccucgaaagaauuccuuaauugacucuucuguaacaucauaggguagguuuccuagaaaagcaguguaggguggcgauuugggaagacggcuccggucgauauuggguucccgagcagcccguggagcagugggaaggauggaacggucaauuggaggcgcccuauacacaucgucaucguuacugugccaaguggucgaaacuaggauagaggaaugaauguaagaaauuagaagaaacuucucucacuacugucauagaacaagaggacccauguuaauugccaaauauuaaacaugcuauacaagaaaaccagaccaaaaaaaguggggguucaguaauaagggcacuuuacgaagagaagcuucugagauuaauuaugacaccuuaaucuuuauguaagcaaagaaauauuauuccauaaauacaacucuuuauggaauauuacugugugccagcuacuuuauauucauuauaucccaucuuaucuuuuuaacaguccugugagguugucccccauucuacagaaaagcaaacucagauuucagacaguaauuugcccaaggucacagacgguaaagcuaggauucaaaccugggucccucuuacuccagguauauuuaaccacuacugacaacucuuguauuccuaguggugaguuugaaguugaguauuuuucugcauggucuauccucccuuaaaaacaacaacaggccuggcucgguggcucacaccuauaaucccaacacuucgggaggccaaggugggugaucaccugaggucagguuugagaccagccugaccauuauggugaaacccugucucuacuaaaaauacaaaaauuagccaggugugguggcaugugccaguaaucccaucuacuugggaggcugagacaggacaaucuauugaaccgggaggcggcaguugcagugggccaagauauugugccacugcacuacaaccugggcgacagagugagacuccaucugaaaacaaacaaacaaaaauaucacaacaaaaaucuuuuccuacagcacuguccaugaauuuguacuucagauaccaacaccuaugggaaguacgaccuauauaaaauuuccuguuuuggccgggugcaguggcucaugccuguaaucccagcacuuugggaggcugaggcaggugggucaugaggucaggaguucaagaccagccuggccaaaaugguaaaacccugauucuacuaaaaauacaaaauuugcugggcgcgguggcgggcaccuguaaucccaacuacucaggcggcugaggcaggagaaucgcuugaaccccgggagcagauguugcagugagcagagagugcgccacuugcaccccagccugggcaauagagacucugucucaaaaaaaauuuccuguuuuuaggaauuaugaaaacaggucauaggaaaaaauauucuuucagcaugcaauaaacgauuuucaggaaaaaaacaaugguaaugagauuuaugucauacccggucauuauaaaacauagcuccuuauuauuccuggcgacucccugaaggcacagaacuuguccaauugacucuucuuuauuuucccaccauaauuacuguucucacuccuuuuccucagaccauuuucguuuacccaaggacacucugauuuuauacuaaugacaccuggaacuaauuauuccuuggcucugaguaaacauagcuuacagauuacacugaaacaucacuuuuuuuuuuuuuuugagauggagucucgcucugucucccacgcuggagugcaguggcaugaucucagcucacugcacccuccgccucccagguucaagcaauucuccugccccagccucccgaguagcugaaauuacaggcacaugccaccacgcccagcuaauuuuuguauuuuuaguagagauggguuuucaccauguuggccaggcuggucuugaacuucucaucucaugugaucugcccaccucggccucccaaagugcugggauuacagguguaagccaucgcgagcagccugaaacaucacuuuaugaggaccccauagaauuuuagaccuaaaaggaauuuuaaaagaugaucuaguucuuacuuuuaaaaugaagaaaaugaggcccaaaagaauaguaacuuaagaagucuguuaaugcaagaacaagaacuagcaaagcucucuuaaaugaccacuucagucuucacugcaaagucugacagcccaaaccucagauuaaaccuuagauucuauaaaauauguaagauuucaggugcuaaaaaaugaguaaguucuuuucagauuacaaacgaugugaauuauuauguaauagguuuugucuagaaaauaauaaacauuccaaacacgaugacaaaagaaaaguuaccaucuccuuccaggucauccguuucaucagcccagcugacugguuuggaaacauaggugcuuccuccaccaguacccccauccucagccagaaagucuguuagggagauagucuuccccuucuuauucuucuuuuuugcuguuuuaaaaggcaagagaaagauuauucaccaauacucagguauuuacagaguuguacaaugcaauauuguaaaacauuauuuagaaagaaauaacauggacgcuccucaaaugguuaaauuauggcauuuccaugaagggguacuaugcagacauaaauaagaaauuuaaaaguugcagaauaccuauuauguguaaacacauguuuacguacggaaaagggucugaguguuugagauacacccuggagaguauguuuggagugugggggcaaccuuuuauuuucuacuauauucacuuaucauuugagaucuuuaauuuuguaacuacuucuauucaguuacuacuuucacugcucuuuggauaaaaaagaucaauaaaaauucguaucucacauaacauauucaguauggcaguuuugaagacuguuuugacacuuguaaacaaaccauauagggaaggaaucacaacugucuuuuuuuuuuuuuuuuugagacagagucuugcucuuguuguccaggcuggagugcaauggugccaucucggcucacugcaaccccugccuccuggguucaagcaauucuccugccucagccucccgaauacuugggauuacaggcacccgccaccaugcccagcuaauuuuuuguguuuuuaguagagacgggguuucaccauguuggccaggcuggucuugaacuccuaaccucaggugauccuccugccucggccuccgaaagugcugggauuacggugugaaccgccacacccggccccauuuuuuuuuuuugagacagggucuugcucuguuguccaggcuguagugcagugguguggccacggcuaucugaagccucaacccucccaugcucaugugauccucccacagccuccucaauagcugggaccacagaggcacacuaccacgcccagcugauuuuuaaaaaguuuuuuaauucccuauguugcccaggcuggucucaaguauccuggaggaucccaggcucaagugauccuccugccucagccucccaaaaugcugggauuacagguaugagccauggugccuggccacaacuaucaauuuacagaaaaggaaacuaagucucagagagguuaagugaaacaccagaugucuguaaaguuacagagacauuagauggcuaggcugaagauaaaaccuaaguuuuuuucauacgaagucuaaggcucuuucuauauaccaagguauccuugcaucucagcagcuuauucuaugucagguuaucaaaaccacaguaaaacguacugcuauuugaaaguguucaaauguuaacagucauauucccuagaucucucugcccucuagaaaaaauguccuccucuacuauaacaacacugcauaugaggauguaaugcuaaaaggaaaacacacgaaaacccuaauaaccaacacauuuaaguguuucccacaguuauggaauauuuaguaaucuccaaauggcucaacuuagugaacugacacugcucuuucuuugugguccucagaacuuccgagaagucaccaccaaucaagagcugauucagaagagcagagggacucagugaaguuccagaacuggccugauagcagccacuacaugauuaagaaaaaaacaagcagcuuuguuguaaaaaagauuggcuucaugguuuuuauaaucaugaauuucuccuccauguuccaauugucaccugauuuuuaauccaagaauaucaaacuugauguaccccuuuguuuaacugaagguugcuuucucacuugguaucccuuucuuucaaaauuuaacuuucaggaaauaaagguaaccaguuugcuaugaauguuaacacauagccuucuggacacaauuagaaccugaaguauuacggucucaaugugcaaaccagaugaacccggcuaaaauaaucaaaguugaccacgaacaugguauuuucuguaucucucaagugacuuaauauuaauccagcuccaaaaguauuguuuaugaucaaccagaucacauuuugaauccauccuacgcuuuuuuuuuuuuuuuugagacggagucucgcuuugucauacaggcuggagugcaguggcgcgaucucaguucacugcaaccuccgccucccagguucaagcaauuucuccugccucagccucccaaguggcugggacuacaggcgcgugccaccacgccaggcuaauuuuuuuuuuuuuuuuaguuucacaguguuagccaggauggucuugaucuccugaccucgugauuagccucccaaagugcugggauuacagacgugagccaacgcgcccggccugcuuuuucuuuuuucuuuuuuugcaguggugcaaucguggcucacugcagcuuugaccuuuugggcucaagcaauucucccacuguagccucuugaguagcugggacuauaggcaugcaccaccaugcccagcuaauuuuaaaauuuuuuguagaggcaggggucuugcuacacugcccagauuggucuucaacuccuggccucaagugguccacccgucucagccuuccaaagugcugggauuagaugugagccacugcacuuggccuuauuccacagcuuucaaagaauacgguuacagagagguugggucucauagcacuuuuauugcugcagcucauaugcaaagguuuuuuuuuuuuuuuagagggagucucacucuuguccaggcuggagugcaguggcgccaucuuggcucacuauaaccucugccucccagguucaagugauucuccugccucagccuccugaguaacugggauuacaggcaugugccaccaagccuggcuaauuuuuguauuuuuaguagagaugggguuucaccauguuggccaggcuggucucaaacuccugaccccaaaugauccacccaccucggccucccaaaaugcugcgauuacaggcaugagccacugugcccagccucauaugcaaagaucuaugggagauuuuaauaagcgaacacgaguaagacaugagguaaaccacuuacagugcgugggcuuauuuuagacuuuuucauaucauuuaauucaaaaauagugucugggauuaauaugaugcuagcuacagauccuuacccucauggggcuuaaucuaguaccaucagcuaauauccaauuauuaaccuguccuuccacugggaggauaaaaacagaacugguggucaguacaauaaggucaaguucaacaaaagaacauuaacaaucugaauaagguaucccuuuccucuuuguucuauauacguaucuucuaccaaaacagcagaauguggaauuaaucugcccuuuaguccgauuuggcuuaaaucaacuuuguagaucacaguuucucaacucucaccccuugacuccuuugacaaacaaguuucuucuuuaacguuauuugaaauuuccaaacaaauuaaauaucaugacuaaaaaauauuaaaagcacuuuuaaaucuuagaaugucuuuucaaaucacaagucucccccuccucugauugccacccacucccaggcccucugguuaagaaauuacuguugggugugguggcucacgccuguaaucccagcacuuugggaggccgaggcggguggaucacgaggucaggagaucgagaccauccuggcuaacauggugaaaccccgucucuacuaaaaauacaaaaaaauuagccgggcaugguggcgggcaccugugguccuagcuacucgggaggcugaggcaggagaauggcgugaacccgggaggcggagcuugcagugagcugagaucgugccacugcacuccagccugggcuacaaagcgagacuccgucccccacaaaaaaaagaaaaaaaaaaaaaggaaaaaaaaaagaaauuacuguuggauaagucuuuuuuuuugagacagaaauuuugcucuuguugccuaggcuggagugcaaugguggaaucucggcucaccgaaaccuccgccucccggguucaagcgauucuccugccucagccucccaaguagcgaggauuaccggcaugcaccaccacaccuggcuaauuuuguauuuuuaauagagaugggguuucuccauguuggucaggcuggucuccaacucccaaccccaggugaucugcccgccucuguaucccaaagugcugggauuacaggccugagcuacugcgccccaccuguuagaugagucuuaaaaaaacaggcuaaaauuccuuacaagaucuucaacuuauuuaacuguagcagcagcacugacucagucaaaauauaagcagcagguuuaaaggaauuagcccuuggaaagcaaaaucaauaaaccuaaaguaggugcccguguuuguuccacuccguuucauuccaguuaacugagaaaagauguuaucuaaauccuccaugcccuuugcucccucaauaccuaggcccauuacauguuuagauuucaacaguguucccucugcuuuauaaguaaagcacuguuuaaugcuccagguuuaucaauccuuugcaauucaacaaugaacugguccaauucuuuaauuuucucuaaaucuuaugugaacugguuaaaaaguuaacaaaucaaucaccucacaaaacaaaaccugucccaauuauuuauacauggucuacaguggggaaaacacaccuccagcucuuuauauacccauacagguuuaauaaaagaucuuaaaaacggaaauauugcuaaguccagaagccguuaaacaagagacaacacauucaugguuuucuuaauaaacaggauuuguuauaauagauacuaaaauaaauacagccuacuucuuaacucagaguuucucuaucucagcacugcugauauuuuagcuuagguaauuugucauggggggauuuuagcaguuaucucugauucugcucauuagaugccaauaguaauccccgauccccauuccacucugacaaccaaaagcgucucuggacacugccaaaugcucuggggugggaugaggguuugggaugaaaagacugucccuuagcugagaaccauguucuaagugauguuucacuucaauaaauaaaaagauaaaugaaaaggaauuguuaguccuauauaaaggacuuuucuuugggggugauaaaaagguucugaaauuagauaauaaugaugguugaacaucucugaauauacuaaaccccaccaaaucauacagggucuugcucugucacccaggcuggaguacaguagugagauaauggcucacugcagccuugaccuccagggcuuaagcaauccucccacugcagccucccaaguagcugggaccacagguacaugccaccaccccuggcuaauuuuuaaaauuuuuuuuguagagacguggucucacuauguuacuuaggcuggucuugaauuccugggcuuaagugauccucuugccuuggcaucccaaagugcugggauuacaggagugagccacugcacacgguccaaacuguauacuuuaaaaguguaaauuuuaugguauacaaauuacauugaauaaagcuguuacuaaaagugaguucugccacauucuccauaauuaaaagcuacuuuaggccaggugugguggcucaugccuguaaucccaguacuccgggaggccaaggugggaagaucaccugaggucgggagcucgagaccagccuggccaacauggugaaacuccaucucuagaaccgcuugaacccaggagguggagauugcagugagcugagaccacgccacugcacuccagccugagccauagugagacucugucucaaaacaaaaacaaaaacaaacaaaacaaaagcuacuuuaaauaaugaauaacaaauguuucccuaaaccaacaacauugcauaaacacaaucgauccacccagagugccuagaauuagacuaauuauauugguguuuacagcccagccaugaaaagacauuucaugcaauguaauacaauauuucaccuucaccuuuacugcacuauauagaugcucccugacuuaugaugagacugucaggauaaacccuucucaaguaaaaaaaugcauuuacuauccggauaaacccauuguaaagucaaaaagaucccagugcaagccaccuuuugauuuaguuggggauuggguaaguuuagcauaguaaagacugagucaaaacucauaagcuccaccaucuugacccccguacggguucaguuacaugaccucucugugcccaauuacuucauuuugacagaagaugccauacuaccuuuuccuuaucccuccagggauacucaauuugaucauauacauaaucaaacaaaauaagugcccaaugcaugccaugcuaaccauuacacaaaaugggagacaggagguacacaaauucaaguuaaacuucuugauuugguacuuucccacuaucaggaccauagcaguaucuacuacaaauuuaagaaacuggcucauaaauguacauaaggcaaaccuaauuacaaauaauuacuuaaaauacuguacucaaguucaguuauuuccucuaccaucacgaaaagagaauuccagaauguuuugagaugaaauauaccucuuuuuucaaugacauuacuuagaaacacugcuuuaucuuaauugacacuauucuguauuuguauuuaaacuuucauaaagaguuuuaauuuuggccuucuggguaucuuacucacagaauaacauauacaugauagaggauggaacuugacacuagggaaucuguaagcaauauauaauggcaccccuuaaaaccauuucacugugagagucagcaguguaugaaaacaaccacugcagagcaucuucucccuauaaaaauaaucaaauaagaugucacacaggacugcauuuugaagcauuauggaaaugaaaggccugugcaugagcuuacauauguuauuuccaauuuuaaaguuuguuuuuguuuuuuuuuuuugagacggagucucgcucugucgcccaggccggagggcaguggugcaaucucaauucacugcaaccucugccuccuggauuacaggcgugagccaccacgcccagcccaaaaccccgcuaauuuuuguauuuuuaguggagacuggguuucaccauguuggccaggcuggucucgaacuccuguucucagguguuucacccaccucagcuucccaaagugcugggauuacaggcaugagccacugcacccugcccaauuugaaagcauuuuaaauguuaaccuguaucaaacgcauuugauucccucuagguaaggggacagcagauaaauaaugaccacuuuccagauaaagaaacugagauucaagcgguaacuggcuuauuacuggcaagucuacuaaaguagucacaaugaaaauuuaagaaaaaugaaaaacuucguauuuuuaagauuuuuuuuugaaauggagucuugcucuuuugcccaggcuggagugcaauggcacaaucucgguucacugcaaucucccccucccagauugaagcgauucuccugccucagccuccggaguagcugggauuacaagcacgcgacaccacgcccagcuaauuuuuguauuuuuaguagagacagaguuucaccauguuggucagguuggucuccaacuccugaccuagugauccgcccgccucgaccucccgaagugcugggauuacaggcgugagccaccgcgcccggccuuuaagaauucuuuuuaagaagcaaagcaaggaauuaaguguacuggcucaauguaucaaguuucuaggaauucaaacuauccucauucuauaguuaguucugagaccuaccuuaguucuugaaggucaauaauggaucacacuggaaacugguauugcugcaaagaauuuuuuggucucauuuaacaguaaaagaggcguaugaaguuguuuuauguauuuucacacagaacacauaacauccauuucccacaucagggaauacugguuacuucacaaagccagugugacuggaaagaggagcggggaaacaauccgauaaaccccagauuccucaagaacagacugaaagaugugacuugugcucagauaccaguaccagcuaaaaagauuuacugaagugaauuaaaggagaugaggguuuucaaggggguagaguaaauauggaagaacaagagaaugggacgucagaguaaaucccuuuuaucagucuggauuucccucaacucgguaaaacgaaggacaugaauugcuguccuauguuccgccucuaaaaauuacacaaaaguuaagaaaacacagauuuucuucacuaaauuacgauacuaaacuguuaagguggcaaauccagaccaaguaaguacuuuaagcaaugguuaguuuaaaauauauuuaggacuuuuacuagcccacuggagaaaaaaauaugaacauuuuuguaaacuucagaugcuuucgggcagcguccuaaacugaugaugacaccuugauacuuuuaaguugcuaaggagucucaaagauuaugaccuugcucugccagcugagagcaguguggccuuaaauaauauuccuuagcugagaaauaccacuagcucucugcaguaccucaggauggaaggagacaacaugcacaaaagugcuuggucaacugucaagcguuacaccaaugaaagauguucaaaugcaccucaaauuucucaacauuuuccaaagccaaccaaaacccuuagcuucuuuguaauagagacgaugaauuacuagguaagaaaugagcacccagagauagaaguucaaauaauguuuugaagaaugcaaggucaugccagagaaaacaaacuauauuccucaaacuaaaaucaaugcuacaagauguugggucaucacugcuuuuauaagcccauuagaaauguaauuagacuugcaaggcacugauacuccccuccaagguugucuaaagaaguaagcaacuccagccauuaguaagcacuauuuuaaaaguaccugcugguaguugcacaguuaccuuaaaaaaaaaaaaaaaaaaaaaaaaaaaaggcugaaaucuaccauuggagcuauccaaauucaaccaacauggaagcgccggaagcgaaaccugauccuggcauauagcugcgcugaguaaaaaaugccuccaauugaguaugagaaaaaagccuagaaggaaaucuaggugcacaccggugcuucuccaacacgugggcgcaccuaacuggauuccccacccccaucuaacgccaauagcaccaaccuccaaggcuaacacacacacccuuagaagaauacaggcacagggcccacacucuagaaagggaagagacaaccuaaaaggacauaagugcgcaacacaggcgcguuaaaaagcuucccaucuggguucuagcgcacgcauugaaggcgcgcccgucucuacuacccucgugucuccuaccgcgcacgcgcaccgcugccuucccccgccccuccaccaacucgcgcucgcguuccaacugcucccccccaccacacuuacuccccuaccccccacuccgguccgcuacagccucgcgccuuggagacguagucuaaugugcacucguccgcgcagcaaccgccuccuuccuuccuccacgccuucacgcgggcacggugauucacgucuacgaaaaggccucgcaccacccgcacaccuuucugcgccuccuuccccaauucaagccagagucuaccauuacugccuauuccaaucucgcgcagaaagggugaaaagagugugagggggaggggaagguguccuuccccucccccccaaacauccagaggcaguaaccuaacagggccacgccgccagccugccgcagcccucaauucagaaaggaaccagugccagcaauuccccgacuucaggaaaucaguggaucacgcucggagggggguuucagagcccaguccuuggccgcgcucggcugcucgcucaccugaggccgccauguugggagagggaaagagaacgcaaaagacccggaugaggcaaucacgugauuauagcgggcgcgucgagcuaggagacgcgaagcugggagggggcggggaggugaggacggagacaggaggcggggcggcgcugcucuagguucguaaagcugcgcggcgagguggcacgccguccgacgggaagacaugcgcgacauguggcc

SEQ ID NO: 192591 - RNA, 14173 nt, Homo sapiens
ugaguggaaaacaaaaggaaaacuuauuuauucuuagaggugggaauguggggaguggggcagaacaggugguggcccugggagagggucccaaggggcagagguuggggaugucucaguaaagaggggcaggucaugaauagagccuccacccccagcaggggguuccugggcccgcccaagcacugggcuaaaacguggaaacugggcauugacaaaguacagcgggaugugggcaauucggccuguggaccagcccugcagagaagggaaagaaaaggaucagagucugggcccaaagaagggccaccuggcagagccauacagcagccaaggcccucagcuucuccauccaacuccuggaagccccagcagccuggcgcacucaccacacugagcagggccccuuuguugaaggaaggauggaaagugaugagcuggggcugggcuccuggcucccccuggauaaugccacuagaagaaaaggugagcaggcaaccggaggcaagaagggagcugaauguagugggauguggguuuguuugugcaggaaggcuggugagaaguccagaccuaagggcccacauggcacuuaccagggaaggagcucaaacacagggcuguuucgagugcgaaaaaggaggaugacugguuuaccauccuguacccuuggcuuuccuguaagaaauggauccagggauaggggaggaacucugaaggcagagucccaggacaugggcagaggagaacuccaggccagggcacggccucauuagauuaacugggaagauggcugugggcugagcccuucauccuugccucucaccuuucauaagcacagccagacguuccccacuggggucccagaccauggagugagccucucccccaagccuguggguaaggacagguuaggagaguuucaguguggucccucccaccugcuuuucacugccacucccucaaccacucagcucaccucuccucaccaucuggugucuguauuguugucucagacagaucugccacaaucguugcugacuuugcaccuccaacgcaccccuuucccucaccuguggacaaauaagagcagagagguucuugcaagaaacaggccucucacugguccccugccagcucaccaaaggcaucaacaccucgaaaucuccuaagcuucuauauuucccuuuaucccucagagcugcaucuuaccaaagguugcugccucccucugaccaccccaaauacugaaguguugcccuaacucaccacaacguucuggaaaagacagggaguaaaucaguggcucucccaauacagugaacagcagucggcugccaucugggcuccagcagccagucuggggucagggagcaaaaggcaggagaagguaugucuauaguagaaugcaggagggaaaguagagguggccagguuugggagcaucaggggcccauuggaaucaucuccuccccagugucugugaaucagaguccccucuuaccugacagcgcccugauagaguaggccaccucucacaaguccacaucugggccucccagacucugagccagagaaaagcaaauuacagcucaggaccucuaaguucuaaaaguuggaccuaccucccuugacagagcuuccaggagcuaagugccuuucucuagguccuugcccucccuccauccuugucccacucaccgaaagacagcugaaggagugguagccaggauuuugcugccgucuggggaccagagcagguuggucaccccaccuccucggaaccagggaagggggacacaggucucuguugagacaucccauaccuaggagaguggggcaggagauaagggaaaacucaagcaccccaucaucucacagugggcuggccucucuaauguacaaagagccagaaacgagaggaagcgggagagggacugugaaacaugaggcacggguucaugcugacaauuacagacagcggaauuuuaaaccucacgagucugauggcaaagcuccucucuggguaaguuuaagacugaauggaccaaggucccuccuccuucccccaagauguuuccacaaccgagugaggaacacuuuugccaggacugaaaugugcaugaggggcagggacccacucacccggauagcagcauccacgggugaagcugagagcagccgccccccacugggggcccaggccaagcugguaacagguguaugcccagggugagacagcacuugggcacagccagaagagggucuggaggggaacacagaggauguggagucagaagaugacaagaagccauccccaaaauucuauuucuuugccuccugcuaaaaccuccuauccugauggcccacucugggcucaaauccagguugugaaaaaggaauaaggauugugaaaguuaaaagaaaaaaacagcgaaggggaaaaacgaccaagucaccacgagcaggucaacagagaagagguaaucugcaaggucucaggccagggugaaagagugcuuucacgagauaggccaugaggcaaaaccuaaccaguaaccuagaagguacugccccuggggcgauaucaggcccuaccccagaacacagcucucugcccacaggccauccagccuggccauccaucuauccaggauuaauaaucuaugacauuacuucaagguuccaaccuuuucucuccaguuaucuaacacuccucagaacacauccugugcucccaaacagcccuccugccuugccuuaucaaaguaccucccaacucugcagcucccgcguuugcuccuuaucauaaagaugcugcaggcugggcgcaguggcucacgccuguaaucccagcacuuugggaggccgaggugggcggaucacgaggucaagagaucgagaccauucuggccaacauggugaaaccccgucucuacuaaaaguacaaaaaaauuagcugggcguggugguguucgccuguagucccagcuacuugggaggcugaggcaggagaauugcuugaacccgggaggcggagguugcagugagccgagauugcaccacugcacuccagccuggcgacagagcgagacuccgucucaaaaaaaaaaaaaaaaaagaugcagcauguggcucggccuccaucaccagcagggaacuaccugagggcaccugccaugugucugcagcuguguauuuccagagccaugugccuggccugacagacgaaggcuacuaccugaauuaaugccaccucucuuuccaccuaacuauaaccaccuucagcuccagugaagucuuagucauggauguacaauuuaauucucuugaacuuuaugauaaaucacagcugccuuugcagguggguucagauucaucucauucuuuucaguggcuccauuguauaccacucaauagaugaacuauaauuuauugagucaugccucuacaaauggacauuugacuuguuuguaauuuuuuauuauacauaaugcuguaaaaaauauuuccugggccaggcauggugguucacacuccaggauggagugcagugacacagucauagcacacugcagccucaaaguccugaggcuccugccucagccucuaaaguagcuaggacuacaggcguacaccccacgcccagcuaguuuuuuuauuuuuauuuuuuguauagacagcaucuauguugaccaagcuagucucaaacuccuaggcucaagcgauccaucugccucagccuccgaaagugcuggaauuacacgcaugagccaucacgccuggccuuguuuuuuguucauuuauuuaaaaaaauuuuuuuaaaucgaguuccgcucuugucacccaggcuagaguacaauggcauuaucucagcucacugaaacguccaccuccuggguucaagugaauucuccugccucagccuccugaguagcugggauuauaggcgcacgccaccacacccagcuaauuuuuguauuuuuaguagaaacaaaaaaaaccaacaaccuuccaggcgugguguacgcaccuauagucccagcuacuuggcaaggggcucacuugagcccagguguucaaggcuguagugugcaaugauugagucugugaauagccacuguauuccagccugggcaacauaaugaaaccccaucucuaaaaaaaccaaaaaacaggccaguugcagcggcucaugccuguaaucucagcacuucgggaggccgaggcaggcggaucaccugaggucaagaguuugagaccagccuggccaauauggugaaaccccugucucuacuaaaaauaaaaaauuagccggugugguggcacgcaccuguagucccagcuacuugggaggcugaggcaggagaaucgcuugaacccaggaggcagagguuguugcagugagcugagauggcgccacugcacuccagccugggcgacagagugagauuccauccccccccaaaaaaaaucugugaucacguguuuuuuucuuauaguaccuauugucaagguuuagguaucaggguuacauuagcuuuauaaaaauaaaucaggaagauccugcaacaaaaaaaagggaggacaggccgggcaugguggcucacgccuguaaucccagcacucugggaugcugaggcgggcggaucacgaagucaagaggagaaucacuugaacccgggaggcagagguugcagugagccgagauugcaccacugcacuccauccagccugggcaacaaaaguggaacuccaucucaaaaaaaaaaaaucucauuauuuucuucuacaauccacuuugguaacuuauauuuugcuagaaaaucaaacauuuccacagggcacgguggcucacuucuauaaucccagcacuuugggaagccaaggcgggcggaucacaaggucaggaguucaagaccagccuggccaauauggugaaacccuaucucuacuaaaaauacaaaaauuagcuagugcgugccuguagucccagcuacuugggaggcugaggcagaagaaucacuugaacccgggaggcugagguugcagugagucgagaucgugccacugcacuccagccugggcaacaggagugaaacuccuucucaaaaaaaaaaaagaaaucaaacauuuccuucagauuuucaaaucuguuggccuaaacaaguccacaauauucuuuuauaauucuucuauuuucucccguaucuauaucuuuccacuucugaaaauaguauacuuugguuuucuuuuucuccuuaauuaggcuaaccaagagguuuucuucuuuauucauauauauacguauauacacguauacauacacguauauauauauauacguguauauauauguguauauauauaaaacauauauguguguguguguguauauauauauauauuuuuuuuuuuugagacagagucuugcuuuguugcccaggcuggaguacaguggcgugaucucaguucacugcaaccuccgccucccagguucaagugacucuccugccucagccugccaaguagcugagacuacaggcgagcaccaccacgcccagcugauuuuuuguauuuuuaguaaagaugggguuucaccguguuagccaggauggucucuaucuccugaccucaugauccacccgccucagccucccaaagugcugggauuacaggcgugagccaccgcgccuggccuuuuuuuuuuuuuuuuuuuugagacagggucucacucuguugcccagaccagaguacagcuguaguggcaugaugucaacucacugcaaccuccgcuucccggguucaagugauucuugugucucagccucccaaguagcugggaucacaggcacgcaccaccacguccagcuaauuuuuuuguauuuuuaguagagaugggguuucgccauguuggccaggcugguuucgaacuccuggccucaagaaauccacccaccuuggucucccaaagugcugagauuacaggcaugagccacugcgccuggccuaauuuuuguauuuuuagcagagacggguuuuaccauguuggccaggcuggucucaaacuccugaccucaggugauccucacgccuuggccucccaaaaugcugggauuacaggugugagccacuguucccagccuuuauucauaauuuuuuuuuuuuuuugagacagagucucgcucuguugcccaggcuggaguacaguggcaugaucuuggcucacugcaaccuccgccucccagauucaagcgauucuccugccucagcuucccgaguagcugggacuacagguguguaccaccaugcccagcuaauuuucauauuuuuaguagagacaagguuuugcuauguuggccaggcuggucucgaacuccugaccucaggugauccaaccgccuccacaucccaaaguguuggaauuacaggcaugagccaccgcacccagcuuagucauaauuuaaagaaccaguuucugguuuuauuuuuaguuaguuuucacagguauucuuuuucuaauuuuauuaguuucugaucuuauuaguacuaauuuucuuuacacuuccuuuaaguguaaaggaaguguauaguccucugaaagagucuuuccaccccguaacccacagacacauuguccccacaauccaaaaagccccuaguucucuuucuccagauuagaguauucucagcaacccaccuugaucuuacuucugcuuuucccauagcccugggaagugcugugaggacaaagaacuucuccuuucagacguccucaccacccaccaugccuagcauugcacaacucucaggccaagguaaggcaggcuacuaggacuuaccggguagacaaggagguaggguccaggguccagauaagaaugcagcucuggcaggccacagccaagacagaggcacuaaggggcuuccaggccagagacgccacauuucgcugcagccggugcuucagggaggggacuauggugcuagggugaaggggcaggaaacugagucaaggcaggaacacuaaggcuccagggaccagagugcaguuaaggagggaaagccacagagaagaaggaugauccauccaggggccaggggcaccauaggacaggaggggauaaagguuaggucuagaagaagcacgcauccaguuauggagcuucccugaccccaguucuggaaggagccccaugaaucagguucaagaacuacaggacuccccggaaccaaggcuggcaagggaaggugauauugacaagucagagcccaccugguguccccacacacaccugcuggcauuauacacacggacugagucaucuagcagggccacugcaaacuuguuggugugggggugccaugcaaagacacgcaagcagcagcuggaccuaaggaagggguuaacaugaagaguuccugcaccuaucccuacccuagcccagaagcucacauucauuuccaguaaggacaugguuuuuuccuacuuuuucuuguauucuuuuuugggggaacaggaggaaugagaauauggugagcaaucagaaaaggaguaggagucuuugccuucuccccaaagggaguuuugagguucaggacuuccuuuccacaaagcuccagggcuugugcacucaccaauuugugacuugggcaaauucagcgaucagaucuucgcuccugagcuguaagaacaagauagacacaggacacacuggggcaaaaggaguccaucuccucaauauuccaacaggggagcuggaccacuccuacccucugaagucaucacacccaacccugaccugcaaggauaggaaugagggcagaguaggauggggacacagcaaaugcagagggcuggggaggaagccaaacuuacagacagaugggggaacagggacccauggagggaagaggcccaucgacagagugccagggcccagccggaugccgucuucacccacucaaacacuguaggguugaggaagcagcucugauuaaaccauucacaggccucuuaccagguaccuucuaggugaaagacaaggaaggacaggcacuccccagguccuucugcccaguaagugcucucaacaccacacucuggacacccacucuggacacccacucuggguuauuuggguagguagaggagaggacaggaaaaauagggcuaaaagaggcugagccaacaggugucgggggugaguucaagaauauggagaggagauaaccacaaaacuagggaaggcuggagggaaaaauacuuacccucuucuucugaguuugcaauuucauuuagcaccccaaaaaggcccacaucacgccugauaagggaggaaaaugugggucagcuuacucugauccccucugucccucucuaccaguuucauucauucaauauacauguauuaaaaauaugggcacucacauuuaaugagugccaacuauguaccaggcacucuacgggcuguccuuucauuuacauaucucacaaaucugaacgagauucuacccauuuacggaugagacaaccaaggcucagaggacuuuuggggcuuugugagcagguuaaggaguugggacuugcucuaagacaaugaauggaaagccauggaaggguucuaaggagaagaauaaacagaucacacagcagcauuuuagaaagagcagucuggcugcagauuagagagugauaagaauagaaaaggccaggcuggcugugguggcucacgccuauaaucccagcacuuugggaggcugagguggguggaucacgaggucaggaaacugagaccauccuggccaacaugguaaaaccccgucucuacuaaaaaugcagaaauuagccaggugugguggugcguaccuguagucccagcuacucaggaggcugaggcagggcaggagaaucacuugaacccaggaagcggaggcugcaguaagccgagauugugccacugcacuccagccugggcgacagagugagacucugccucaaaaaagaagaaaaaaaaaaaagaauagaaaaggccaggcgcgguggcucacaccuguaaucacagcacuuugggaggccaaggugggcggaucacgaggucaggagaucaagaccauccuggccaacauggugaaacauguugaaaaauaugaaaauuagccagguguggugguccaugccuauaaucccagcuacuccauaggcugaggcaggagaaucgccugaacccgggagguggcgauugcagugagccaacaucgugccaccacacuccagccugggcaacagagcaagacuccaucucagacaaaaaaaaaaaaaaaaaaaaagaagagaaaaaauagaaaaaguccaggugcaguggcucaacccuagcacuuugggaggccaaggcagguggaucgccugagcucaagagcuugagaccagccuaggcaacauagggaaaugcugucucuacaaaaaaaaauacaaaacuuaggcaggugugguggcacaugccuguagucccagcuacuugggaggcugaggaaggagcaucacuugagcccugggggcugacaaugcagugagccguguuccauguuugcgccacugcacuccacacugggcaacagagcaagaugcugucucaaaaaauaauaauaauaauagagaaaaauaaaucaguuaagaaucuacuucagggccgggugcgguggcucacaccuguaaucccagcacgcugggaggccaaggcagguggaucacgaggucaggaguucgagaccagccuggucaagauggugaaaccucaucucuauuaaaaauacaaaaauuggccaggugcgguggcucacaccuguaaucccagcacuuugggaggcugaggcgggcggaucacaaggucaagagaucaagaccauccuggcuaacacggugaaaccccaucucuacuaaaaauacaaaaaauuagccaggugugguggugggcgccuguagucccagcuacucgggaggcugaggcacgagaauggagugaacucgggaggcgaagcuugcagugagccgagaucgugccacugcacuccagccugggcaacagagcgagacuccgucucaaaaaaaaaaaaccaaaaaaauaaaacaaaacaaaaauuaaccaggcgugguggugugcaccuguagucccagcuacucagaggcugaggcagaagaauugcuugaacccaggaggcggagguugcagcgagcugagaucacgccacugcacuccagccugggugacaaagugagacucugucucaaaaaaaaaaaaagaaucuacuucaggaaccuaggaaaaaggugaaaguggccugaacugguggggaugaagaaaaagagacagauuugagagauuuaggaauuagcauaaacaagaugugaagacuaaucagacauuaguaaaggaaagagcaauacaacagaaacaccuagguaauaauuacaucagcuaauaugcuuacaaugugccagcucuggacuaggugccucacauuaacuaaucaagccauuaugacaauccuacaagauagguauuguuaucacugcauuuauuuuuauuuuauugagacagggucuugcucugugacccaggcuggagugcaauaucaccaucacggcucgcugcagccucaaucuccugagcucagguauucuugccucggccucccgaggagcugagacuacgggugcacaccaucaugcccagcuaauuuuuaaauuuuuuguagagaugggguuucagugugugugugugugugugugcguguguguguguguguguguguguguguuaagacggagucucacucugucacccaggcuggagugcaguggugugaacucggcucacugcaaccucuaccuccugggugcaagcaauucuugcaccucagccuccugaguaauuaggauuacacacggaguuucaccacauuggccaggcuggucucgaacuccugaccucaagugauacacccgccuuggccucccaaagugcugggauuacaggcaugagcuuccgcgcccagacuaucacugcauuuuuagaugagagaacaaaggugugaagaggcuaauuaauaugaacaagguaaucuaaguagaaaguagcagucaggauucaaccaucuaucuaccccagaaccuauacucaaaccacuuuuuccugaaugaguaauaugaucauuccuuaaagugaaccauccagagaagcagauuuggagagagaaauaaagagacuggauuugagcaugcugaauauaugaagucugcgaaauauucaagcaggauaauuuggcaaacacgugaacaccaggucugaugcaucaacuggaaaucuagccccaagaacaccaacauuuaagggacaucaggaagaggagccaccaaaaacccugagaagcagcagccacagaaguaggagacaaggagccugggaaugaauggcuuuucaacaaacugauauucaacuucacacacacaggcaugcccauuaaacuguacugaaguaccaaagaucaaagcuugacagcacauguguuggaaaacaggcacucccauacacugcuggugggaccauauacauguaccauuuugacagagggcuauuuggaacagcucacaaaauuacagaugaacauacccucugagccagcaacuuaauuucuaggaauuuauccuacaaaugguaaugguauuaauaaaaauauuaaguaacccuuuuuuuuuuuuugagacaaggucucacucagugccacugcacuggcacaaucuuggcucacuacaaccuccaccucccaggcucaagugauccuccuauacauaagccucccaaguagcugggaauaaaggugcaugccaccauacccagcuaauuuuuguacuuuucuuguagagaaaagaacaugguuucgccauguuccccaggcuagucucaaacuacuaagcucaagcaaucugcuggccucagccuaccaaagcgcugggauuauaggcgugagucacugugccuggcauaaauaacccuuaaaggaauuaauaugugccauuaauagguccaggugcaguagcuguaaucucagcacuuugggaggccaaggcaggccugaggucaggaggccagaccacccuggccaacauggugaaaucucaucucuacuaaaauacaaaaaguuagcugggcgugguggcacaugccuauaguaccagcuacucgggaggcugaggcaggggaacugcuugaaccagagaggcggaggcugcagugagccgagaucgcaccucugcacuccagccuggcaacacagcaagacuccgucucaaaaaaaaaaaaaaaaaaaaaaagaaaaagaaaaugagccgggcgcgguggcucacgccuguaaucccagcacuuugggaggccaaggcgggcacaucaucugaggucggaaguucaagaccagccugaccaacauggagaaacccugucucuacuaaaaauacaaaauuagcugggcgugguggcacaugccuguaauccuagcuacucgggagacugaggcagaagaaucgcuugaaccugggagguggaaguugcagugagcugagcacgccacugcacuccagccugggcaacaagagugaaacuccaucucaaaaaaaaaaaagaaaaugaaaccagguaguguagcuccacuccuacaagugcaaaguggaugaccuauguaggagauuauucagugcaaccuuauaucugaucuugcugagcuucagguaaaagcucagaagugguaaugccaugaggugggggcagggagcagguucaccuaaucaagccagaaagcaaggcaaguuacuagagaugaaauggaaguacuuuuuccauaguguuccugggaagggcaaggaagggaaccugacauuuauugagcauuugaguucuauaauaaggacuaaaaauuucauaugauuuaggauauacagcucucguggagacagccugaauaaaagucuuuugaagaacaccccaagguaaagggguguugacucauuuuccaggaucugcagacugugacccaggaaacccuuugccaugccucaccaaauguugaugcaucucuuccacacuugcucccggugauggaugaaggcaguucuugugccaugguccagccuuccaggggucuuuaggggauccuuugucaguuguaggacaggaagauugauccacuauagcacaaaagugaggagugugacggugauucagucucuucccaaaucuuuaauuccgugccaucuccaacccaccgcugggcuaaguauaagagauuccagaggucuguuucccauuuccacaaagcuaacacuugugagaaugggaaacaagucuuagcucccguaucugugcaacuagaauaauauuucauaggguugcugugauuaugaaaccauaugacauuuuuagaaaacaccugacucagccucuuucuuacauagcaaacgcucaauaaaugucaguuucccuuccuuguccuucccaggaacaccauggaaaaaaguuccauguuguauccuucugauccuccccagauacuguccccaacuuuuagauaguucucccgcauccucacacucccuagauucucccucauucucuccauucccucuaggccuccuccacagcuccuuaaccguucccccguuauacuccaaucccaguccuaaaacagauuccagcccuucuagccuccugccggggccaagcuguuuccacuccgccagacucugugacccugccccugucacacugccuccuuuccccaguaguccccgacuccgcccccaugccuguagguccccucccuccucgcccuggccaccuggccccggaagucggggggcgggcucucauagcuacugcccgucaccagcucguuauugugcucauauagggugacuugaccccgaggcgguggaggagggaacaaccccagagagcacaucuugccgguucgcaggacgucugcagucggcaaacuccuggccggaacggcacagaccgcacucccgcaacucgguucccgggcuagauucguaugcggacggguaccgcaagggacaaacggcgaggcggaacucaacggaagugaagaaaagacuaacggg

SEQ ID NO: 192592 - RNA, 35799 nt, Homo sapiens
uuauuaaaaaacuuuuuaauugguuuacaaaggaggcuacagacuacauugaaacuaaucuuuguacaaaaggccaaaaaaaaaaaaaaaaaagucccaaaacaccaagagacaaaagguaggaggaaagacaagaaaggaagauacaaaaggagcaggaagaaacuuacuuagggacaagauuagcaucauacauaccuaagaguggggggugagggggaagaacaagaugagagagcauuuaaaagcauuuacccacacagcccuggugauaauuggauuggaaucaaaacaaacacagcaugagauuauuaagagguuuuaaaaggcaacagugguguggacugguuauugccaguguuaagagagaaauaaacuuggguuuuuaggcaccagagauuggagcaccacccaucccuuccagaggaugacagacuuaggaaggggaagcaggcccuggggcagcugccacugguguguguagaugucuccucaggucaaucucaguguaucuuccccgaagucuuugugcccuagacucuagguaagggcuaugggauuucacugggagaaagggaugaucaaaaauaugaagaccugcccuuguccacaauguucaagagcaguuaccgggaaacuggagcacuggguagacagagcccauaucccuggggaaaaggcacaguguaauuccugaaggcaagauaugggaaagcacacaucccagcagagguaucaacaaaauccucacuacuugcagcccuagucuaaucccauuuguuaggcuuuuuuuuuuuuuuuuuccccugauacuuagcuaggacuuagggcaguugagaggcagaucaucaugccucuacuuucuuagcagagacaaggaagacuggggcuguuugauaaugaggaaggggaaaaugggacaaaauacuccucuuucaaaugaacacuguggagaaaaucuuucuggguuuggggaagucagaguaaagacuuaggggaguaauaaagccagagaccccccuucuuuuccuuucccugccuuggaucuaaggcaagugagccaaauuuggaagagggaguaggaauuuaagcuuaaggcugcuuaaugucuuccugggggcugguguuuugggaaggcagacaaagagaaacaggucaaccucaaagcuggucugcucauccucuuagaagaggucugguaucuguggaguagagccaagagaggcaccacagagagcacagucucccaaacagaaguaauaaccggcucauauuuuaucagcaguuuucaaaagcaauguuuuccgggguuggagaagugccauaucuuccucccuuuccccaaagcuacugcugcgaccuuucuuucauccuuguacauaaguuacuggcucucuucuaagggagauaaauucugagauuucacauuuucccucucaaccccaauaggcuacccagcuucagugagggggaaggagagcuaugcaaagggccccucacuugaggcagcuagacuguccuuauuuccuugguaccugaucuccaaaacucuugaucugaucccaagguccaaaaggcaucaggguacuuacacugaaaacuucaagcaaguagcaccagggcucccccuaagcauaacaggggccugauuagcaccccagaagaaccccucaaaaaguauauaaauuuauugcguccuagcaaagaucugcagcuuccaguauucacacaaugugaagauauuaacaauacaaaauauauuuugaaagucaaacaccuguaguucauagugcuuuuuuagauuuguuaaaaaaaauacaaugcuuaguuuccuauauaggauauacaaaagcaaaaaauauauauguauauaguagaaauaaaucagccauaguaauuuacagcuuuugucuccaacccuccccuaaucauaaucuuuaucccacacuucaguauauacuuucugggaucaaaggaucaauuuauucugaaccaggcugagaaauauccauuaaauugcauucuguguagcacccacagagugccaguuggaaaucccugaaggaagacgguguggguuguuacuguucuggguaaaaagugagacagucaaaugacauguaaaugaauauaaaugggcaaccugaaaaccugaaaggaugagggaauaaguguuuuacuaucucaccacucuucugggcauccccugcccugcaaguuuuggucaucuaaaaaauuuaaaaaacucauucaaaaaaaugaaaaaaacuuaggaaaaaaauuucagaaucaauaugcaugucaguuaaauuaauuucuguuagccaaaaguucagggaaacgggguuuuucuguaauaagcuccugacucaaggaauguaggcuccaaacuuccuguggaagagacugaguggcucacuacugcugggagacaaaagaagcugcuucuguuuugaggccaaacaagauacuggaucuggagcuuccuuggugugaagagaacagggcaaguggaaauaauuagauauaaauucacucaugguaaugcuaaugaauaggguugaggguaaaccagcagcuuuucauucgagaaagaaauaccaucaaauuaccuucuaaaagcuuauauccucagcaucauuacauuauuuuauaucugguaauuucauacuggagaagauuccauuccuugaaaugcacuagcaaaauacuguacauuccagugaguuauccugccccuuuccuccaaaagaugccaaaguacaugauuacagacauaaaauaacagguucugaguucugccuuucagugagaauaaaggguaugauaguggcugugcauggaugacuuguaucucagcguuaauagaauuugaucuggggaaaguuccuugccauaguuccugaguugaaaacauaauuacaucuguggagaaaggaccaaauggagugaacuauuguuuagaguauuaaguuacuauaguucagauuaaacaacacacuuacccaaaacuuaauuuggauggauuuuauauaaaauauauaauagaaucauaccaucaucuauuuguagccaaaguaaaaagauuuaugagaagaauaaggacucugcuauagaucuggauguugguuucacuuucaaacacaaaaauaguuucuuuuuaaaaaaguacaguagaauauccuccauucauaauuguaauuaauuuagcauaagcaaagaaaugaccuuaggaacauacccagguuuuaagauagauuucuagguaaugggccugaaaggcauuuugaucugaauuuauuuuccaacgauuucaaauauaauuugucaucuguguguagacauauacgggcaugaacacacauucacccacacauacaaaaacacuugcuuucuaucagaucaggguaauuuuuuuauugcaggucucuuuuaauauuggcuagcagaaaaccuauccccaaccuaacagauuacacacacacacacacacacacacacacacacacacagagcuauuuuuccacacuuccucacagugaaaagcucucuaacaagauaccagaaggucgagagagacaaugcuuuuauggcugggccuugaggacaauucugguugcauuuaaaucucagugccaaaugcacuagguucccugccguuauaauuuuuggaucagucucuucugaaaucaggucacagagaaaacaggaugauuucucccaaucucuccuauaaaacacugugguaagacaagauuucuuuuuguucugggcuaucauucccaugaucaugugcuucccuuucccuuaggaaccacccaagaacauacaaggaaaaguuaagggaaaacaucauaagaaccacugucuugccacuagcacaugcuuuggaggaguucugcagaauggaaaccugaaacagauucacuggcugaugcuccuuauugacaauggaaaagaaccuaguggggauguucaaaagaaguguauuuccuuucagaauauaaacucagaagcccacacaucaaaacuuagagcuaccuuggaagacagcaguaccaaaguccaaauacuccacuaacuccugaaccugacuacgagucauuuccucuucugagcacaugauuuuccuagugaaagcccccuaccuauuauuugaaaauuugacaguuuauacaaacugagccaagauuauuaucuucaaagggacucuuguacaauuccacugaaagacuucuaauucuugaugcucagagcagcuaaugaagggagaugccuuugacucuccagcgccaagaaggugccugcgucaguaguauuuugaacacucccuccacaguuacuucaagcaucagccugggcuucaaggauuuuuccauucugcugcuggaacuaagguccugaaaaaauugacagaagugccucauccaggcaguaacaaaaacaaaacaugaagugaucagaugagagaagaugagacggcaacaguugaguuagggaaggagugcaagaagcugaucccaaacaaaaagacaaaauuaagaaaggaaaaacauuauguauguauauaugaacuaaaagcagagcauaugaacgcuuaagcuggugggaagccaagacaacaucuacagaaaagcuugaugugucacaacaaggcucagccauagggaaauaaggcaauauaaaaaaaaugaccaagguauuuuggucacagaauggucuuccuccucccagccaaccccugugaaugcaucucuauauaucuuuauauauauauauauauauauaauaauauagaaucuguuuuuuguuaaaaaguauuucaaugaucauauauauuuaucaaggcaugauggcuuuaggaaaggggggggaauccaucauggaagagcugagaagagaaaugcaggaaggguaggcugggguaagaaguguaagaagaaacuggggucaaacaaaugcucaucaaagcguggcaccaacagaauuuucacuaauguuucccaccuucaaagaggcacugaugauacagaugggugccgggaccccaucuccucucuuguaucccucuccugauucuucucaacaccaugcauuuuaaugcuucauggcucucucuuccaugucucuuggacccaugcuaccuugcaucccgggguuaagggguauggcccauaugucucuggccccgggugccugaucucagaagccauugccacugauauuaauggacugcagaucugccaccugcaugacguugaugccacuguuggcaagacgggcaaugcccucuggacagauggccuccauggcuaccauauuggugguaauaagggcugaaggaguggcagugccacugccuucugaaccugccccacuguccaggggcaaagugcccacacucagagcuacaccugggccucccuucuuauucuggugggucuugauauguuuugacagguggucacuccucaugaagcgcuuaggacacucagggcaggcaaauuucuucucaccuagguaaaggaagaaaagauaagaagcugacauguuaggaagugagguuaccuuacccaauucagugcuuacucuacuaagcugaguaaggccaguaugagaaggugaucaaaaacaagaaaaaucuucaaguggcugggcgugguggcucacgcuuguaaucccagcacuuugggaggccaaggcgggcagaucacgaggucaggagaucaagaccacggugaaacccugucucuacuaaaaauacaaaaaauuagccgggcgugguggcgggcgccuguagucccagcuacucggagaggcugaggcaggagaauggcguggacccgggaggcggagcuugcagugagccgagaucgcgccacugcacuccagccugggcgacagagacucugucucaaaaaaaaaacaaaaaacaaaaaacuucaaguauauuuuccuuuuggcgggggcgugaggaagaaaacuagauaaagguuggggaguacucgguaaggaagguagaacuuagcaguuuuaaaaguaaggcagggcagagacuaagaguaaugguuucaaugcuucaccuucaaaaaucccacucaaaaucuagcuccuuauuuuauuuuauuuuauuuuuuugagacagagucuugcucugucgccuaggcuggagugcaguggcacaaucucagcucacuguaaccuccgccuccaagguucaagcaauucuccugccucagccuccugaguagcugggauuacaggugugcaccagcacgcuugacuauuuuguaauuuuaguagagacaggguuuccccauguuggccaggcuggucuugaacuccugaccucaagaaauccacccaccucggccucccaaagggcugggauuacaggcaugagccacgacaccuggcuccuuccuuuuuuuuugagacagugucucgcucugucgcccaggcuggagugcaguggcacgaucuuggcucauugcaagcuccgccucccagguucaugccacucuccugccuccaccuccugaguagcugcaacuacaggcgccugccaccaugcccggcuaauuuuuuuguauauuuaguagagacgggguuucaccauguuagccagaauggucucgaucuccugaccucgugaucugcccgccucggccuccaaaagugcugggauuacaggcgugagccacugcacccagccccuccuuccuucuuaaaaauuuuccagauuaacuccaauuccauuugugacccauauauucaguuucaaauuaaguugcucagaaauuuuaguuauuuuguagguauauuuuguguuuuucauucuagucuauuacuauuuuucucucccauaggcucuugcucaccuguguguguacguuugugccucuguagcucauccgaacgugugaagcguuucccacaguaugaccagguacacauaaauggccucucgccuguaugccagcgcaagugugcccgcaggugagaggucuugccauacacuuucccacagccuuggauguggcaaauaugcuguuucuuuuugccaggaucccccgagccccugaaagugaggacacaacuguuaaucauucauucuagagaaaacuaaagaaccacaaaguaucaacagcaaucacccaaucgacaccaaacuaacccaaacuuuuauuuuuugaaaaagucuucuuuuuuguuuuuuugagagagucucacucugucguccaggcuggaguacaguagcaugaucacggcucacugcaaccuccgccuccuagguucaagcgauucuccugccucagccucccgaguagcugggauuacaggugcacaccaccaugcccagcuaauuuuuauauuuuuagugcagaugagguuucgcaauguuggcgaggcuggucucgaaccccugagcucaggugauggaucugcccaccuccgccucccaaaguacugggauuacaggcgugagccacugcacuggaccaaggcuucuuuuuuuuguucguuuguuuguuuugagacggagucucgcucugucgcccaggcuggaguguaauagcgcaaucuuggcucacugcaaccuccaccucccggguucacgccauucuccugccucagccucccgaguagcugggacuaugggugcccgccaccacacccggcuaauuuuuuguauuuuuaguagagacgggguuucaccauguuagccaggauggucucgaucuccugaccuugugauccacccaccucggccucccaaagugcugggauuacaggcgugagccaccgcacccggccaagccuucuuuuuuaaaaagguuucuaggggcugggagugauggcucacgccuguaaucccaacacuuuuggaggccgaggcagguggauugaucaccugaggucagggauccgagaccagccuggccaacauggcgaaaccucaucuguacuaaaaaauacaaaaauuguucaagaccagucuuaucaacaugguccccaucucuacuaaaaauacaaaauuagccaggcgugguggcacaugccuguaaucccagcuacuugggaggcugaagcagaggaauugcuugaaccugggagguggagguugcagugagccgagaucgugccguugcacuccagccugggcaacaagagcgaagcucuuuuuuuuuuuuuugagacagagucucacucugucgcccaggcuagaguguaacggcacgaucucgguucacugcaaccuccaccucccaaguucgagcaauucuccuaccucaaccucccaaguagcugggauuacaggcaccugacaccacgccgguuaauuuuuguacuuuuaguagagaugggguuucaccauguuggccaggcuggucuuguacuccugaccucaggugauccgcccgccuuggccucccaaagugcugggauuacaggcgugagccaccguacccggaugaagaucugucuuaaaaaaaaaaaaaggccgggcgcccccauggcucaugccuguaaucccagcacuuugggaggccaaggcaggcggaucacaaggucaggagaucgagaccacccuggcuaacacggugaaaccccgucucuacuaaaaauacaaaaaauuagcugggcgagguggcgggcaccuguagucccagcuacuagggaggcugaggcaggagaauggcgugaacccagggggcggagccugcagugagccaagauugugccacugcacuccagccugggcaacagagcaagacuccaucucaaaacaaaaaaauaaauaaauaaauuuuuuuggccaggugcaguggcucacgucuguaaucccagcacuuugggaggccgaggugggcagaucacacagucaggagaugaagaccauccuggcuaacaaggugaaacccugucucuauuaaaaauagaaaaacuuagccgggcgugguggcacacgccuguagucccagcuacucgggagacugaggcagaauugcuugaacccaggagguggagguugcagugagccaagaaugugccacugcacuccagccugggaaacacagacugacuuugucucagaaaaaaaaaaaauuuuuuuuuuuuucauuuucucuuuuuauggccaguaaaauauucccacauaauuuuuaaauuuuuguagagaucggcucucgcuuucuugcugaggcuggucucaaacuccugggcugaagugauccuccuaucuuggccucccaaagugcugggauuauaugcauccagcucugagucuuaaauccuaaaaaaaaaaauuaaccuuugccgggcaugguggcucacgcugguaaucccagcacuuuaggaggccgaggcgggcagaucacgaggucaggagaucgagaccauccuggguaacacagugaaacccugucucuacuaaaaauaaaaaaagauagcuggguguggugacaggugccuguagucccagcuacucgggaggcugaggcaggagaauggcgugaacccaggagguggaguuugcagugagccaagauugcgccacugcacuccagccugggcaacagagucagacucggucucaaaaaaaaaaaaaauuaaucuucuuccucuuaucuccaaaucuauuaauuuuucuuuauauuuguaagaaacuggcugggucaacucaccuuccuucacugucuuuacaguaggggcaggugcaugcuucccgccggguccuccgaccggcuugggguugggcaucugggcuguuuucuccuuccucuccaccugcugugucaucauguauuccaucaccaccagccccauggagaccaagcugagcuccaugaucaccugaaauuaagagagaaaagggucaacaugugacaugggcagguuaucacuggcaucucagugauacccuacagucacaacaucauuucuuuugaacugacauccuacauucacaguaucacaaguuuugaagccuuuuuauguuuagccauuccauucacugacaccugaagacucacugaaaucucaagaaucaucauugaaaauaccaagaguggcugggcgcagugguucacgccuguaauuccaucacuuugggaggccgaggugggcggaucaccugaggucaggaguucaagaccagucugaccaauacggagaaaucccgucucuacuaaaaauacaaaauuagcugggaaugguacgcaugccuguaaucccagcuccuuggaaggcugagccaggagaauugcuugaacccgggaggcggagguugcaguuagcgagacugcaccauuguacuccagccugggugacagagcaagacucugucucaaaaaaaaaaaaaaaaaaaaaaaagaaagaaaauaccaagagccaauaaauacguaaaaaucugaucaaaucucauaguuguuuuuuuuuauuauuauacuuuaaguuuuacgguacaugugcacaacguguagguuacauauguauacaugugccauacugaugugcugcacccauuaacucgucauuuagcauuagguauaucuccuaaugcuaucccucccccgaucauaguuuuuaaaaugcaacuccacuuauaacgcauuuguaauuuuucaccuaucagauuaccaaaaguugaaacccuaauaacauacggcauugguaaggguacaggaaaacagacccucccucucucucuuccuucccucccucccuccuucccuccuuccuucucucucucucucuuuucuuuccuuucuuuuuuugagacagagucucgcuggcucuggaguacaguggcauuaucugggcucacugcaaccuccaucuccuggguucaagugauucuccugccuuagccucccaaguagcugcaacuacagguauaugccaccaugacuggcuaacuuuuuuguauuuuuaggagagaugggguuucaccauguuggucaggcugucucgaacuccugaccuuaggugauccacccgccucggccuucgaaagugcugggauuacgggugggcaugagccaccauguccagccggaaagagacauuuucauacacaaauagugauaaauuaauacaacuuuuugaaggccaguuugaaaauauuuaaauguacaucuaauuugaaccagcaaugcccauauauuuacaugugguucugccuguaaccucagcacuuuggaaggcugaggcaggagaacugcuugagauuaggaguucaagaccagccugggcaacauagggacacucugucuauaaaauaaauaauaggcugggcaugguagcucacgccuguaaucccagcacuuugggaggccgaggugguuggaucacuugaggucaggaguucaauaccagccuggccaacaugguaaaacccccaucucuacuaaaaauacaaaaacaaaacaaaaaaaaucagcuggguaugguggaguacgcuuguaauccuagcuauucgggaggcugagacaggaauugcuugaacccaggaggcagagguugcagugagccgagacugugccacugcacuccagccuggccgacagagcgagacuucgucgccaaauaauaauaauaauuagcugggcaugguggcaugcgccuauggucccagcuacucaggaggcuaaggugggaggaagauugcuugagccaagguguuuaaggcuacagugagcuaugaucacaucacugcacaccagccuggccaacagaacaagauuccaacucaaaaaaauauauauaaauaaacaguguaugcuaaaaugcuuuagacucucaucaugacucaguuggucacauuugacauuuucaaacacagcucuaggccacugguaaaaagugacagauaauauucuuuuuuuuuuuuuuuugagacugaguuacacucuuguugcccaggcuggagugcaauggcacaaucuugacucauugcaaccuccgccuccuggguucaagcgauuuuccugccucagccuccugaguagcugggauuacaggcacccaccaccaccccuggcuacuuuuuguauuuuguuguauuuuuuuaguagagaugggguuucaccaucuucgacaggcuggucucgaacuccugaccuugugauccgcccgccuuggccucccaaagugcugauuacaggcgugagucaccgcacccggcugauaauauucuucgcaaaaguaauaucuuauaaaguggcagauaauauucuucucaagacuucuuuccuuuuuuuuuuuuugagacggagucucgcucugucgcccaggcugaagugcaguagcgcgaucucggcucacugcaagcuccgccucccagguucacgccauucuccugccucagccucccuaguaggugggacuacaggcgcccgucaccacgcccggcuaacuuuuuguauuuuuaguagagacgggguuucacuguguuagccaggauggucuuggucuccugaccucaugauccgcccgccucggccucccaaagugcugggauuacaggcgugagccaccgugcccggccuuuccuuuuuuuaaggagaccgggucucaccauguuguccaggcugaucucgagcuccugggcucaagugauccucccgccucagccccccaaaauguucuguugugauuauagacauuagcuacugcugccuagccuuucucaaauuuucaaagcauuuacuauaaauaaguauuagucuaucacagcaucuuguaaacaaguuagcaacucuauccauauauuuaauaugucugggaaggcacgguggcucaugccuauaaucccagcaccuugggaggccaaggcaggaggauucuuugagcccaggaguuugagaucggucugggcaacacaguuaagaccucaucucuacaaaaaaaaaaaaaaauuagcugggcaugguggcgugugccuggagucccaacuaccugggaggaugaagcaggguaaucacuugagccugggagauggaggcagcagugaguccugauuguacaacugcauuccagccugggugacagagcccaucucaaaaaaacaaaaaaccaaaaaagauuucuauaaugcaagguguuaacuuggacugcuuuguuuuaucuauuuuaaaaggaaagaaaguaacuaaacgagguaggacagacuuaacaucuagaaauccagguucuugauuuuacuucuguaccuaaucucuauccuuuucagcucuuccacauaauuuugaguuacuaugccuaauaaaacucuccuugugcuuuccuuccaauucuuuuuuuuucuuucuugagacggagugggagugcaguagaaucuugguccacugccaccuccgccucccugguucaagcaguucuucuaccucagccucccgaguagcugugauugcagguagaggcucccgccaccgugccuggcuaauuucugcauuuuuuuuuuuuuucugagauggaaucucugucgcccaggcuggagugcaguggcacgaccuugacucacugcaaccucugccucccagguuccagugauucuccugccucagccuucuaaguaacugggacuacaggcuacaggcaugcaccaccacgcucgguuaauuuuuuacuuuuuuaguagagacgggguuucaccauauuggccaggcuggucuccaacuccugaccucaugauccgcccgccucgaccucccaaagugaugggauuacaggugugagccacugcacccggcugcauuuuuaguagagacaggguuucaccaguuuggccaggcuggucucaaacuccugaccuuaggugauccgccccccuuggucucccaaagugcuggcauuaccagccugagccaccuugcccggccuccuucucauucagucacuuuuacggagcaguccaggccgggcgcaacggcucacgccuguaaucccaguacuuugggaggccgaggcggguggaucaugaggucaggaguucgagaccagccuggccaagauggugaaaccccuucucuacuaaaaauacaaaaauuagccgggcaugguggcgcaugccuguagucccagcuacuugggaggcugaggcaggacaaucgcuugaacuugggaggcggagguugcagugagccaagauccugccauugcacuccagccugggcgacaagagcaaaacuccgucuuaaaaaaaaaaaaaaaaaaaaggugcagccuauggcacuaaaauaaauuuaaucagaacgucugagauuuucaugauauugguagagcugaaacuaggaaaauguacuggaguacaggguuaagaacagguuuuggaguaggagaaacuuagauaugaguccuuucacaaccauuugauuaaguuucugauaaugagcaaaaacuuuucuggucgucagcuucuccaucaguaaaacugcgaccaauuaucaacuucauaaaauuacugugaaaaacaaaugaagaggcucacaccuauaaucccaacacuuuacaaggccgagcuggacagaucgcuugaggccaggaguuccaggccagccuggccaacaugaugaaacuccuucuuuacuaaaaauacaaauauuagcugggugugguggugggcgccuguaauccuagcuacuuggaaggcugaggcaggagaauugcuugaaccugggagauggagguugcagggagccaagaucacacauuguagcuaacaguauuaggaaaauaucuuaaggaguggcaaaaccauaguaaguaaucaugaaauaagauauacaccaauauuuucuuuaaucaacacuaagcauggccccaaaucauauuuucuuaaaauaaguaaugauuaugaugaacauaucaaaauuuucuugacucugcaguuuacaucucaauaugucuugccaguaucauugcucguugugugcaugaaauagauaagagcauucaaagcuuuuuuuuuuuuuuuuuuuucccagauagauggagucuugcucuugucgcccaggcuggagugcaauggcgcgaucuuggcucaaugcaaccuccaccuccuggguucaagugauucuccugccucagccuccugaauaccugggauuacaggcgcccaccaccaugcccggcuaauuuuuguacuuuuaguagagacaggguuucaccauguuggucaggcuggucucgaacucccgaccucaggugauccacccgccuuggccugccaaggugcugggauuacggcacgugccaccgugccaggccagaaaaacuuaauauuucuaggaauuaaguaaaacaguaagacugccaaggauaguaauaaaauggggcaaccaauauguuuaagaucaagauauagacucacccagaugagguggcucaugccugcaaucccagcacuuuggucuuuaggagccugagacagguggaucaccugaggucaggaguucgagaccagccuggccaacauggugaaaccuugucucuacuaaaaauacaaaaauuagccaggcaugguggugggcaccuguaguaccagcuacucaggaggcugaggcaggagaauggcgugaaccugggaggcggagcuugcagugagcugagauugugccacuucacugcagccugggcgacagaacgagacucugucucaaaaaaaaaaaaaaaaaaaaaaaauuagcccaguguggugguacacaccuguaaucccagcuacuccggaggcugagacaggagaaucgcuugaacccgggagguggagguugcagugagccuagagcguaccacuccagccugggcgacggagcaaggcucugucucaaaacaacccaaaaaacaaaacaaaacaaagauacagacucgaacucaucacaacugaaucuaacccaguaacuccacuccuauguauauaaccaagagaaauuaaaacauacguucacacaaaaacguauaaacaaauauucauagcagcauuaugcaugauagcuaaaacacagaaacaacccaaauguccaucaacuggugaaugaauaaacaaaaugugguauauauacacaaugaaauauuauuuggcaauaaaaaaaagaguacuaacacaugcuacaacauggaugaaccuuggaaauauuaugcuaauugaaagaagccagucauuaaagaccacauacuguaagauucuauuuaugugaaauaucuagaauagucaauucuacagaggugaaaaguacauacauugcuuggggcugagagugaacgugagaauggggcauggcugccaaugggcaagagguguuucuuuguuggaugaucaaaauguucuuggguuguagugaugguugcacaauccugugaauauacuaaaaaugauuaagccgggaccgguggcucacacugguaauccaagcacuuugggaggcccaggagguggaucacuaggucaggagauugagaccauccuggccaacaugaugaaauucccgucucuacuaaaaauacaaaaauugccaggcgcgguggcucacgccuguaaucccagcacuuugggaggccgaggcgggcggaugaccugagguugagaguucaagaccacccugaccaacacggaaaaaccccgucucuacuaaaaauacaaaauuagccgggugugguggccuguaaucccagcugcuugggaggcugaggcaggagaaucgcuugaacccaggaggcggagguugcggugagccggagaucgugccacugcacuccagccugggcaacaagagugaaacuccaucucaaaaaaaaaaauaaaacaaauaaggcagggcgcgguggcucacgccuguaaucccagcacuuugggaggccgaggcgggcggaucacaaggucaggagaucgagaccauucuggcuaacauggggaaacccggucucuacuaaaaauacaaaaaauuagccagaugugguggcgggcgccuguagccccagcuacucucaaggcugacagaagaauggcgugaacucgcgaggcggagcuugcagugagcugagaucgcgccacugcacuccagccugggcgacagagcgagauuccgucucaaaaaaaaacaaaaacaaaaaacaaaaaaacaaaaauuagcugggcaugguggagcacaccuguagucccagcuacucgggaggcuaaggcucaaaaaaacaaaaaacaaaaaaguuuaaucaaauauuugauaaggauguucaucacaguauugcuuauaacagugaaauuuuggaaacaaauguacaucaauaagguuaaguuaauucuaguaauucuaauacaaauacccuauggaauuaccauaaaaucauuuuaaaugaugcagacuuacauuuacuuacacagaaaagauguucaugacacaguggucagugaaaaugguuacgaagcacuguggauaguaugaucauacuuaagagcauauugacaaaacuauauauagauuucuuuauaaauuguacagaaauguacaaaaagauggcuggaaggauguucaccaaauugucaacagugaauccauuuggacaaauuucaguaaauuuuacuuucucuauuaauuuugcauuguuugacuguuuuuaaucgauauuauuuauagauaauuguuacuuauuuuucccauccucaaaagaaguuugcaaauuuaaguucuacagaucuuuaucaaguaaaugcuuuuaauuuucucauuacccacacugaaacuguaauuugcaucagcaguccuuugugcacaaccacaguucuccuucacaucguauuuauucuguacccaaauguuuaugguagcaagaacauuuuauauuauuaaaacauaaaaauaaaaagacuggguuugguggcucaugucuaaucccagcacuuugggaggccaaggagggugaaucacuugaggucacaaguuugagacaagccuggccaacauggugaaacccugucucuacuaaaaauacaaaaauuagcuaggcgugguggugcaugccuguaaucccagcuaccugggaggcugaggcaggagaauugcuugaacccgggaggcagagguugcagugaaccaagaucauggcacugcacuccagccugggagacagagcgagacucugucucaaaacaaaaaacaaaaacaaaaaaagaggugguuccugcccuauaggcaguuaagaucuaaaacacugacaaaucuaaagugguuaaagugguacaaagaauagcuaauacuuagauauuuguucauauguauuuguauaucuauaaaucuacaucacaagaaauuaaguaguuauaaucauccuacuucuauaagcagaagucaagaaauuccacuaaauuaacagucaguucagaccaaaauaguuuaauuuucuacugucauuuugcacuagaagauuaaaguaaggaaguucaucuacacacacaaccauaucauugucugauaagaccaaagguucaguagcaauguuaaaaaguguuaacaaagggggcuuuuaugggcuuuacuaguauuuguaaugcauuguguuucaugaacuaggauacaaguaaaagauuaucuacggucgggcgcaguggcucacgccuguaaucccagcacuuugggaggccaaggcgggaggaucaucugaggucagggguucaagaccagccaggccaacauggugaaacccuaucucuacuaaaaauacaaaaauuaucugggcacgguggcaggcgccuguaaucccagcuacucaggaggcacagguugcagugagccgagaucaugccacugcacuccagccugggcgaagagcaggacuccaucucaaaaaaaaaaaaaaagaaaaaaaaaggaaaaagagucgcuugaacccaggaggcagagguugcagugagccaagauugcaccacugcauuccagucugggugagagagagagacuccaucucaaaaaaaaaaaaaaaaaauuacuauauuauccuauauaguguuuagaugucuuaaauuaccucauaaacauuuuugaaguguugggguuuuugagcggaggaugagaugggugacaggaauuagcugagaguaagaaaaguaaaacaguacuuuagugaaaccagggucuaaggccaggcgcaguggcucauauuuguaaucucagcauuuugggaggcugaggcaagcggaucauuugaggucaggaguuugagaucugccuggccaaaaagcugaagucuccucucuacuaaaauacaaaaauuagccaggcgugguggcaggcgccuguagucccaguuacuugggaagcugaggcagaacugcuugaacucaggagguggagguugcagugagccaagauugcaccacugcacucuagcuugggcaacagagcaaaacucccgcucaaaacaaaaaacaaaacagggucuagaaagguaaaugaaaaaggaaaaaaaaugauuuuuuuuuaauuuacagaaaacagaacaacucucaagaaaacaggagaggccgggugugguggcucacaccuguaaucccagcacucugggagacaaagguuggaggaucacuugagcccgaguuugaggcugcaguuagccauguucacacucuaaaaaaaaaauuguauuuuaauaaauaaucuaauaacaucuaacacaguacccagaagacuauaacauaaaucaaaacauuuauggcccuauuauuucauacauuugucugcaacuuucagaaacaggugagugaaaacuggucuccucucaaguacacuaaguaaagcuauagcauaaaagcaaccggagcacagaagcacacuaugaaggcagcaaccuuaucuguuuuuuguuuuguuuuguuuuguuuuugagauggagucucgcucugucgcccaggcuggagugcaguggcaugaucucggcuaaccgccagcuccgccucccggguucaagcgauucucuugccucagccuccugaguagcugagauuacaggcgcacaucaccaugcccggguaauuuuuguauuuuuaguagagacgggguuuuaccacguuggccaggaugcucuccaucucuugaccugaugauccacccgucucggccucccaaagugcugggauuacagacgugagccaccgccccuggcuuuuuuuuuuuuuugagacggagucugucacccaggcuggagugcaguggcgcgauguuagcucacuguaagcucugccucccggguucacgccauucuccugccucagcguccugaguagcugggacuacaggugccugccaccacacccggcuaauuuuuuuuuuugagacaagagucucacucugucgcccaggcuggagugcaauggcgugaucucggcucacugcaaccuccacuuuccagguucaggugauucucccgccucagccucuggaguagcugggacuacaggcgugcgccagcacacccagcuaauuuuuguauuuuuaguagagauggaguuucacuauguuggccaggcuggucucaaacuccugaccuugugauccacucgcuucagccucccaaagugcugugauuacaggcgugagccaccaugcccagcuacgcccaguuaauuuuuuuuuuuuuuuuguauuuuugguagugacaggguuucaccauguuagccaggauggucucgaucuccugaccuccugaucugcccgccuuagccucccaaagugcugggauuacaggcaugagccacugugcccggccuagcagcaaccuuaucuguuucaaggacuccaagaagcuagggcauuggcacauaauaaauguucaauaaauuuugcuaaaucugucuaugaaggaaguaccaaaaacuggaacucauuuuuacuuuuauacuuuucucauucuugagccugcuaguaauuuauuacuaaguauacugguguucagcaaaugccuauguaaguuaacuaaaucauaaguauaacugaauuucuuaaacagcacuuaagaaagguaaauaagaagccuuaaaaugugauaacaccagacacucuuuuuuguuuuuuaaugugacaagacagaagauacaaauauucuuuuguuuuuugagacggaguuucacucugucgcccaggcuggaguacaguggugcugucucaacucacugcaaauuccaccucgcagauucaagcgauucuccugucucagccuugggaguagcugggauuaaaggcgcgcaccaccaaguccagcuacuuuuguauuuucaguugagacgagguuucaccauguuagccaggcuggucuugaacuccuggucucaagugauccgcccaccuuagccucccaaagugcugggauuacagacaugagccacugcacuuggccagaagauacagauauucuuucaaagggacaccaaaccaaagaaacuugugcccauaaucccagcuacuggggaggcugagucggaggauugcuugaacccaggaguucaagacuacccuaggcaacauagaaagaccuuaucuccagccuggcgcgguggcucacaucuguaauccuggcacuuugggaggccgaggcggguggaucacgaggucaggagauugagaucauccuggcuaacacggugaaaacccaucuccacuaaaaauacaaaaaauuagcugggcaugguggcaggcgccuguagucccagcuacucgggaggcugaggcaggagaauggcaugaacccgggaaguggagcuugcagugagccaagaucgugccacugcacuccagccuggacaacagagcgagacugcgucucaaaaaaaaaaaaaaaaaaaaaaaaagaccuuaucuccaaaaaaaaaaaagaagaaaagaaaagaccacgcagcacaguggccgauauccguaaacccaacauuugggaggcugaagcagacccacuugaucccaggaggucaagggcugcaguaggcccugauugugccacagcacucugggcaccagagcaauacccucacaaaaaaaaaaaaaaaaaaaaagauacuuuuaaaaauaacacaaaaagaggagagagagaaagaaacuugauuuuuuggaaaauuuccaaacagguuucacaguuaagggcuuuuuaucuucuuuaaggcaaaugaucuacacaaaauuuauuuuuuucaugagugcaagaaaccagucaaagaauucuaagcagaguacguucuuuuuuuuucucgagacggaguuucggucuuguugcccaggcuggagugcaaugguucaaucuuggcucacugcaaccuccaccucccggguucaaaugauucuccugccucagccuccugaguagcugagauuacaggcaugcaucaccacgccgggcuaauuuuguauuuuuaguacagacggggguuucuccauguuggucaggcuggucuugaacucccgaucucaggugauccacccaccucggccucccaaagugcuuggguuacaggcgugaggcaccacaccuggcccaccuucugguuuucaaaggcuaauuaaaggcugggcacaguggcucacaccugcaaguguaaucccagcacuuugggagaccaagguggguggaucaccugaggucaggaguucaagacuagccuggccaacaugaugaaaccccgucucuacuaaaaauacaaaaauuagcugggcaugguggcccacaccugcaaucccagcuacucgggaggcugaggcaagagaauugcuugaacccaggaggcggauguugcagugagccaagaucgcaccauugcacuccagccugggcaacaagaggagaauuccgucucaaaauugaaaaaaaaaaaaaaaggaaaaugcaguccagaugcgguggcucacaccuguaaucccaacacuuugggaggcugaggugagcagaucaccugaggucaggaguucgacaccagccugaaaaacauggagaaacuccaucucuacuaaaaauacaaaauuagcuggcaugguggugcuugccuguaaucccagcuacucaggaggcugaggcaggagaaucgguugaacccgggaagcagagguugcggugagcagagaucgcgccugggcaacaagagcaagacuccgucucaaaaaaaagaaaaaaaagaaagaaagaaaaaagagauggggguuucacuauguugcccagguugguuucgaacuucugggcuaaaccaguccucucgccucgaccuccgaaagugcugggauuacagacuugagccacuaccugccuaagucuuugucuugaucuagguauuuuauauuuuaaaacuccuucuaggccaggcgugguggcucaugccuguaaucccagcacuugggagguugaggcaggcagaucacgaggucaggaguucaagaccuggugaccaacauggugaaaccccaucuguacuaaaaauacaaaaauuagccgggcaugguggcgggccaccuguaaucccgguuacucaggaggcugaggcaggagaaucgcuugaacccgagagguggagguugcagugagcugagauacugccacugcacuccagccugggcgacagagagagaccuuaucucaaaaaaacagcaacaacaacaaaaaacaaaaaacaaaaccuccuucuaggccaggcaugguggcucacgccuguaaucccagcacuuugggaggcugagguggguggaucaccugaggucaggaguucgagaccagccuggccagcguggugaaaccccaucucuacuaaauauacaaaaaaauuaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaauuagccagguguggcugugggcuccuguaaucccagcuacuuaggaggcugaggcaggagaaucacuugaacuugggaggcagagguugcagugagccgagaucacgccacugcacuccagccucugucacaagagcgugacuccgucucaaaaaaacaaaaaacuccuucuucuaagugguuaaauuauuuauuuuguauauaggugagaaggaggauucauaauaaauuagauaugcacauccaaaguugucaaacaagucauauugcccaauuuccacaagccauucagaguccaaaaaacacuggaacaaaaggacaaauccaaauuacagcacagauuugcaaccaacucaaagauacacuuagaaacuuucuacagaaacguuuuucaggauagccauaaaaaagaaugaaaucauaucuuuugcauccaugucuggaugcagcuggaagccauuaucguaagugaauaaacgcuggaacagaaaacaaaauacugcauguucucacuuguaagugggagcuaaacauugaguauucauggacauacagauggcaacaauagacaccggggacuacuagauaggggagggucggggguaauguuggaaaaacuguuggguugcuaugcucaugaccggacccggguaacaagaucauuuguaucccaaaucucaagaucauauaacaaacaaaauaaaaguugaaauuacuuaaaaaaaggcugggcgcaguggcucacaccuguaaucccagcacuuugggaggccgaggcggguggaaaccaaggucaagagauggauaccauccuugccaacauggggaaaccccgucucuacuaaaaauacaaaaauuagcuaggccugguggcacacgccuguagucccagcuacucgggaggcugaaggaggagaaucgcuugaacccaggagguggagacugcacuccagccuggcaacagagcgagacuccgucucaaaaaaaaaaaaaaaaaaaaagacauuacuuaaaaaaaaaaaguucucagucuucuaagggaaauaauucuuaaagucuaacacaguauuaacaauauagucauaucacagugugggcaaauauauuuuaaaguaauccuuuagcauaccaggcccugcauacugcuaaauguuaaagaaaaggauaauaauacuauuguaacacuuucuguaagaaauaugaaaaauaaugugcuugcuuuucuauuaaauaguaaaaugaaaaaacucaacuaauuauuaucuacuaaaguugacagacacccaaaaaguaacuuaaaaagcaugauauaauaacuuuccuacagauguucaucuuacauuuuaaaacauuuucaaagaggguaaaaaaaagcaagucaugagcagaauuauuaguugcacguuuacaugcuacuuuacaaaaugaaacaaagggaaagggagauagaacagauacuaaacguuucugaaacagaaggcacucuuguuauuuaauuaagaacuaaaauggccccauuacacaaggcaacgugauuuaacaaugacgucauuuauaaagagaaagccacuggaaugaauaaauaggagcaauggaaaaggucugaagacugucuucucauaucccacugauuuucaaaucaaagcacuuagauuuuuuuuuuuugagacggaaucuagcucuguugcccaggcuggagugcaguggugcgaucccggcucacugcaaccucugccuccaggguucaagcaauucuccugccucauccuccugacuagcugggacuacaggugcgcgccgccaugcccggcugauuuuuuguauuuuaguagagacgggguuucaccauguuguccaggcuggucacgaacuccugagcucaggcaguccacccgccuuggccucccaaagugcugggauuacaggcaugagccacugcacccagcccccucaaagcacuuagauuuuaaaugagaucuuuccuacuuaaacugaaauaaccauuuaaaaagcaccaaacacccuaagaaacaaguauaucuuucugugcugauaucucuagaaaauaaauuuuuuaaauuaaaaagagaaacaaguauaauacuagggaaagacaaaagacgcagaaacauucaacauuauauuugauaaaauauaaucuuaaaauagaaaauucuuucauaugaccuuuugcacaaaaaugauaacugguaagacauuuaaaucaucuaaaccuacuuuucauuaauguccaaauguacugcucuaaaacacaacuuuuuaacaaauuagcucucagcaaucugacuccaaguuuagugacacccuuggcaaaccaacccugguaucacauucaacuuaacuucuaagagaagacauuuuccugaccccaauaaaacccagcagaugugaaauuguuauuuuuaguaccugaaauuugguuugugaaugaauuauacccaucaaggaaauauguucuauucuccugccaaagcccagcccugcacucuuuauuagacagaacucacaagaagucauccaaacuuaaaucuuuaaaagccaacuccccgucaaccugcggcaagaguuucaggauucagcagcggcuaagaaaaacaucugaggcuuuaaaugaaaaguaaaauaaaauaaaauaaagaucugggaaaauaugacuacaaaaugaaaggaaaagcuguugauaaaagagggaggggugucaauuuaaaaaaaaagaaacaucacgccuguaaucccagcauuuugggaggccaggagaucgagaccauccuggccaacauggugaaacccagucucuacuaaaaaugcaaaaauuagcggcugggcacaguggcucaugccuauaaucccagcacuuugggaggccgaggcaggcagaucaccugaggucaggaguucaagaccagccuggccaacauggugaaacucaaucucgauuaaaaauacaaaaauuagccaggcgugguggugggcauuacucgggaggcugaggcaggagaauugcuugaacccaggaggcaaagguugcagugagccgagaccacaccauuggacuccacccugggcaacaagaaugaaacuccgucucccaaaaaaaaaaaaaaaaaaaagaucauuuuaaaaaauaaugaauguaaacagacuaagugaacaccauggaagcugcaaucuuccacaaucauguaauauaucucauuuuguacagugauauauacauguaucauacaacauuucacauccaauguucuuucuacaucguaccaagaaguugaacauacugcaaaaagguuaaauuuuacaguaaaauaacuaucagagaaggggguaaaauuagauacuuuuuuuuuuugacagggacucacccuacugcccaggcuggagugcuguggcgugaucauggcucacugcguccucaaccucccgggcucaggcaauccucccaccucagccucccaaguagcugggacuauaggcgugugcuaccaugcucagguaauuuucauauuuuuuguagagaugggggaucccuauguugcccaggcuggucuugaacuccugagcucaagagaucugccugccuuggccucccaaagugcugggauuacaggcaugagccacuacgccuggccaaaacaagauacuuuugccagcaggaaggcaaaagcugaaaaaggaguaagccucuaggaagugauuuuauuaucuuucuuuaaggaugaagucauaucaauuaaaggggaaauacuacacaauuauuacuagccagaaaggagaaaacuuggaucuucaaaaaccccuauuaaugaagcaaacaaucucaacucuuacaaaacagccugucaaugccucauuaucuccuuagugaaugucaagcuccucuuaccuuacagaaacacacacgcauuuucuucagcucaaacaccaucaguaacaacuagguagcccuagucuaugacauauuaaauggcagacuuccccagagcaugauuuagcaaugagaaugccucauaacuguucucuaaacccuaaguuauaagccuuuuagaaauugcaaggauccaaauuauuaacaggaauaaucccacaguuugcucugaagaagagcaaaaccgggcacuucaaucuaagagcaaauagaaaauaaacaugaugguguagguugcccagaagugucuaauuuucuacguuguagaggucaguuuuuauaaaacuuuucccauuucuauucccauaaauguuuaguuuauaaaacauuuuuauaaauguuuuauaaacaucugucaguuuuagagcauuaaaucuuaaaucaaaaacaccuuuucgaauacauuuuuuuuuuuugagacggagucucgcucugucacccaggcuggagugcaguggcacaaucucagcucacugcacgcucugccucccagguucacaucauucuccugccucagccucccuaguagcugagauuacaggcacccaccaccacgcccagcuaauuuuuuuguauuuuuaguagagaugcgguuucaccauguuagccaggauggucuugaucuccugaccucaugauccgccugucucagucucccaaagugcugggauuacaggcgugagccaccaggcuggcucgaauacauuuuuaacaaucuaaagaauuguucaagucccuaguuaaaacagguugcacccuagacuaguaaaacuagccucagcucuggcuguugucucauuaagugauucucuguaccucaauuuccucaucuagaaaauaaggcaguuguacuaaauaacuucagucccuuccagcucuaacuuucaauucuaagauuucaauuaacuaagaaaauuacugucuuguuaaagcucaacauguaguauuucuaaacacaccacaggaauguaagaaaucagggaacuuaagcagacuuucccccuagauuuaccaaaacugcaggaggcaggaaauaugguugccuauuugcuacccucacuuauguaagaaucaguuaaauggaaugagaacuugguaacaaaaguaaacaauuuauaaacccacauauauaugccaaaagaacuagaaguggccaggcgcaguggcucacgccuguaaucccagcacuuugggaggccaaggcgggcggaucacgaggucaggaguucgagaccagccugaccagcacagugaaauccaaucgcuacuaaaaaaauacaaaaaauuaaugggcauggugggacgugccuguaaucccagcuacucgggaggcugaggcagaagaauugcuugaacccggaaggcagagguugcagugagccaagaucgcaccacugcacuccagccugggagacaagcuagagucagucccaaaaaagaaaacgaaaaaaaaaaaaaaaacaaaccuagaaguugggugauauuauuuggugauauuaaacuauuuuccguauuuguauaauugugccagcauauaaagauguauguguauccuuuuauugugcuuuauuaaagauuagcuccauacaauggaauuuaaaaugauaaagucaggccgggcauaguggcucacaccuguaaucccagcaguuugggaggccaaggcaggcagaucacuugaggucaggaguucgagaccagccuggucaacacagugaaaccccgucuccauuaaacaaacaauuaggcgggcaugguggcacacgccuguaaucccagcuaccugggaggcugaggcaggagaaucacuggaacucaggaaggggagguugcagugagcggagauugcaccacuccacucacuacagccugggcaacagagcaagacucagucucaaaaaugaaaaaaaaaaaaaaaaaaagauacagucuacauagacuuacaucuguuuacuguuuuaaauuucaaauuaauagugaaacauuuaguucaaaaugaaagacccugaacauuauggucaacagauucaauauucuucccagacuguuuuucccuucaaugcucuccucauuccuaacucuucucaauccuacaucccccacuccauuccagaccccaacuuaccccacucccuuuccuucucccuuccuaaccacacacaguacuuucaaagcagucuaggaaguuagacugcuaccuagaaguaucagaaucaccuaggaugcucauauguuagugugaagggaagcuaugggauuuuguuuuucagauaacuaggaguuaaaaaaaaauucaauccugauuaaccagcacacucagagugugggauauucugguuaauacuaaccagggaacuuacuucguugaaaagcaacccguuagaucauuuucccuucaauuaggaguuacaguucacaagaaauaucugaugauuuaaucuguguucuacaaacagguaaaauucauaaucaauuuuuuuuuuuuuuuugagacggagucucacucugucacccaggcuggagugcaguggcacgaucuuggcucgcuccaagcucugccucccagguucaagcgauucuccugccucagccucccaaguagcugggacuacaggcuuguaccaccacgcccggcuaauuuuuguauuuuuaguagagacgggguuucaccauauuggucaggcuggucuugaacuccugaccucaugaucuguucaccucggccucccaaagugcugggauuauaggcgugagccaccgcgcccagcccauaaucaaauuuauuuuuauuuauuuuuuuuuuuuuugagacggagucucgcucugucacccaggcuggagugcaguggcgcgaucucggcucauugcaaccuccgccucccugguucaagugauucuccugccucaggcuccugagucgcugggacuacaggugcgcgccaccaugcccagcuaauuuuuuguauuuuuaguagagacaggguuucacaguguuagccaggauggucucgaucucuugaccuugugauccacccgccucggccucccaaagugcuggaauuacaggcgugagccaccgcgcccggccgccuuuuauuuuuauuuuuugagacagggucuugcucugucaaccaggcuggagugcagugaugugaucucggcucacugcagccucugccucccagguucaagcaauucuuggccucagccuccugaguagcugggacuacaggcgcgcaucaccaugccuggcuaauuuuuuuauuuuuaguagagaagggguuucgccaugcuggccacgcuggucuugaacuccugaccucaggugacccacccaccucagccucccaaagugcugggauuacaggcgugagccaccgugcccagccacccgacuaauuuuuguauuuuuuuuuuuuuucagagucucacucuguugcccaggcuggagugcaguggugcaaucuuggcucacugcaaccucugccucccagauucaagcaauucucaugccuuagccucccgaguagcugggcccauaggcauguaccaccacacccggccaauuuuuguauuuuugucgaagacaggguuucgccauguugccccagccggucuugaacuccugaacucaacccauccaccugccucgucuucucagugccugcauuacaggcgugagccaccacacccggcccauaaucaauuuuuauccuauggaggaguuggccuacaggccaaagaaggccuuagagcuaagaaugguuuuacauuuuuaaagggguguggaaaaaaaacauacaaaacagaaaauguggcugggugcaguggcucacaccuauaaucccagcacuuugggaggccgaggcagguggauucacaugaggucaggaguucgagaccagccuggccaacauagcaaaaccuugucucuacuaaaaauacaaagauuagcugggcgugguggugcucgccugcaaucccagcuacucaagaagcccaggcaagagaaucgcuugaacccgggaggcagagguugcagugagccgagaucacgccacugcacuccagccuggguaacagaguaagacuccaucucaaaaaaaaaagaaaaaagaaaaaaaagaaaagaaagccgggcgcgguggcucacgccuguaaucccagcacuuugggaggccgaggcgggcggaucacgaggucaggagaucgagaccauccuagcucacauggugaaaccccgucucuacuaaaaauacaaaaaauuacccgggcgugguggcaggcaccuguagucccagccacucgggaggcugaggcaggagaauggcgugaaccugggaggcggagcuugcagugagccgagaucgcgccacugcacuccagccuggaugacagagcaagacucugucucaaaaaaaaaaaaaagaaaagaaaaugugaccacaugaggcccacaaugucuaaaauauuuacguuacuaucuggcccuuuacagaaagcuugucaaccauuauucugcagcaccaaaaacacugaguauuacagacuccagaauauugcccagaagugcuccuuccucaaacuaacuggagaaguuuccuuuacuucaguuccaaauuacuuaaacagaaucucuauuucucaaauuuauuugccuaaaugacuaacccucaagaaaguguuaucucaaaaggcucuauuccuuucuuuagacucaaguuucagcuacgaugcuagaguugguucccaauaaaugcacaagauuggaaaucuuaccuggggcauuugcuauagccaacggcaggccuugaauugggugcaccuggauuccugaaguacccaaugcacugagguuaauggucuggaggccuggcauggaggagaguugagcagcauucacagugacugugccagcaggaauggaagcagcugaggcaaugggugugagagugguguugcugcugcuggucugccccaaggaaacacccugcauuggggcuaaggugauuguuugggcuuguggguucugaacuuggagguucugcagcuguagagucugccaacugaccuguccauugggccccacuguugguguccggaugaugaugggaccagaguuuggaacagccugaagcuggagguucuggaggguuuccugggagauggcuugaguuguaaaggucugcccugacaauggugcugcuuggagggccuggagggccugucccccuugaacuagcugaggcuggauaagaauuuguugcugcugugucugcugguuuugcucuccuucuuuuugcuggccugcuugcaaugagccuccagaugucugguuuugcuggauguucagagcaucagaccccuguagcccacugacccucuggggugucuggccuugagaguuggucccugaugauccacugguaguaaaguucauaauucccauguugcuggugguaguaguaguugaguagcuauuggcauuggugaaaaaggagcuggaacuggcuugugaugauaccaagcuggcagaacugaugguagucccugaggugacaggcugugagccacucuccugggacccagagcugcugaucgugacugccugagagcugggagucaagguagcugcagaaacgcuguugacagguagcaaggugauguucccauucagggccacugguacauuggucacauacugagucuguccugagaguacauuauuagccaggccuuggagggggacagccugcuggaguagguuuggcauagcagcaaugauguugccuccacuuccucgauuugugauaaucuguugguuugcaccugguaugaucuguauuugaccagaaccauccugcugcacuugggccccaguggcagcaaacugcagcuguugcccaucaacggucuggaacugugggauuacuugauacugaauauuaggcaucacuccagguaguccugucagaacuugcugguucuguaaguugggagcggcagccacaacauacugcccaccagagacugugcgauucuuggaagacucacugccauugcugccauugguacugcugccacucuguuccuuugagguagggguagccccagaggaggaagagaugaucugccagccauuggcacccugugaaaguuguguggcugugaggucaagcucaccuguucccccugacugacucgggcccugggaguuguugcuguucucauugggugacucaauucugcugcaaguugcugccagcagagccaaaggggauggcugggacuccuggccgaaaauaagggagaggaaaggaguuagugacacccagcugccagccuagggggcaguauacaacaaauaaacagcaacguagugcagacaaggagcaaaaaacagaaacaaaaagcugaccuaucuguauugcugaaacuccuuugucuuuggggaucuccauucucuuacuuccuuaucuauaaaaugguuuagucucucccuaaaacgcuuucugugaagaguaaggcaauuaucuaagaauauuuacaucuucucaacaccuuccccacucuaugauuaucacuuaccugcccuccuccuccagugcugcugcuacugccugugcugcuacuucgagccugugaaaaggcaccaccaccauuaccauugcccccauuauugccaccaacuccuuuuucaauuuucaccacagcugucauuucauccauggagugaucuuggucuaaaauaauuaaaaaacaaacaacguaaacuugagggaagaaaagaaaugaaguaggaaggauaaaaggaggcuaugaugaaauagcaaugacuaacaggaaggcgaaagccaccaguauaaagaaaauggauuggagggcagaggggagcugcagggcaugcaggacaugaacuagguucaaugugccaaaagugggccuuaauucucccuuguacaaaauuaaacuaagaaaacauucaaaaagugcuuuggggauaggaaaugugaaggacgguaggcauggugagaguuucuaaauaagaaaaaguauccuaagggaaaaaaaggaaaaggacagguaaggcauaaaacaacaugugggugcauggaaagcuugcuaaaauuaaguuuaaaagagauggagaggccaggcgcgguggucacgccuguaaucccauuacuuugggaggcggaggcaggcagaucaccuggggucgggaguuuugagaccagccugaccaacauggagaaacccugucucuacuaaaaauacaaaauuagccgggugugguggcgcaugccuguaauuccagcuacucccggaggcugaggcaggagaaucgccugaauccgggaggcagagguugcagugagccgagaucgcaccauugcauuccagucuggguaacaagagcgaaaacuccgucucaaaaaaaaaaaaaaaaaaaaagacaaacaaaaauccaagugugaaaaguaacgagaggggaaaaagaaguaaaaagugugaguagaaaaacauuugugaauacugcuaaggaacuaaagggaucuacagguuaguagucagaagguuucggggcggagggcgggcccugagggaaagggcgguuucggggugaggggcguggaaagggcgggacgguggggggcgggggggaagggaaaucuacggaaaguggggggaggagggccuuggagcaggcggcgaccagagggcggaccaggcaggcgguuggcccgggcggggccu

SEQ ID NO: 192593 - RNA, 35623 nt, Homo sapiens
gccguccaaggguccauugguugccauagagaucgucgagcgcugggccugugaucgcugaggggcgagcaguugcgacccugggcuccuggggaccugagcguuaugucuuuccgcgaccuccgcaguaaggcagccccgcgccccugugaccugcgggucuuccagagauucagggcucccgcccgccggguccccuguguaggcgaucccugaggcuugcgcugccggaggcuccuuucgggccucugcgccucagggaccgccugacccgcggcugcaacccggccgagcgucccaggcccuucuucggccauuucuagcgaggauggaaaguucucuaucugccacuggccgcguguggcucagaacgcuugaaauguggcuagugcagaugaauaacugaauuuuuaaguguaauuuauuucuguuuguguagcugcaugccgcucuucgcuaccguauuggaaaaugcauggagaguuuagagacuauuuuuugaguuggguuagcuuagcgcuuagaaaaccgaacagcaggccgggcgcgguggcucacgcccguaagcccaacacuuugggaggccgaggcgggcgaaucaccugaggucgggaguucgagaccagccugaccaacauggagaaaccccgucucuacuaaaauuacaaaauuagccgggggugguggcgggcgccuguaaucccagcuacucgggagucugaagcaggagaaucgcuuuggagguugcggugagccgagaucgggccauugcacuccagccuaggcaacaagagcgaaacaacaucucaaaaaacaaaaaacaaaccaaaaaaaaaacaaccagcaacgaaaccgaggagaggaggcugggugauaaucauugcggcuaacauuuuuugaguuuuaacgaucugccagggcccgcucuguguuaugcgcauuucauuuuaaucaucugaacaacucugugcccccuguauuugguagugaggaaacgggcacagagaggucagguaacuugggcaggugauacaggcgguaggagguggcacuggggcuugaauucagguugccugaacuccagacauccugaacuccaucugcauccuuucugcagggcugguaaggagaagggagcucgaauuccuuugcuaagaggguggggaaguggaagaacgaggcuaagaguguugguuacggcugggcgcagugggucacgccuguaaucccagcccuuuggaagaccgaggcaggcggaucacuuaauuucaggaguucuagacuagccuagcuaacauggcgaaacccugccgcugcuaaaaauucaaaaaauuagccgggcaugguggcgcgcgucuguagucccagguacuugggaagcugaggcaggagaauugcuugauuccgggaggcagagguugcagugagccaagauggcaccacugcgcuccacccuggccgacagagugagacugucuuuaaaaaaaaaaaaaaaaaaggaaagguagaugaugauugccaauuuggugugauccgaggggucucuuaaagccaguuuucucguccaauuguuggugccugaaauuuuagcauuagagauuacuccuuuugguuaugaauugcucuuuucuacaauguaaaaauaucuaggaagacgcauuaccuuuuauccaugcagccacugagcaccagagugugaauccugcccucugggguuugaagguuuuugguggccacacaucaugcaggaugacugucuccucccacauaguuuuuagagaggccagcacccugccgggggacguagaaugggguuuuguuggggagcgcacacacggagauuucggaauauuuugaucuuaaauuaaugcucugcaguugugcaguguaugguaaggaucuuacucaaauuagugucuauuuugacaauaacaccgcagcauuaacagaacuugacuaguaccuaguggucaggaguauuuaggcagugccuuacugugugaaggaaaggcugcugcuuucuuuucuguucuuuuuuugagacagucuugcucugucucccaggcuggagugcaguggugugaucuuagcucacugcaaccucugccucccagcaauucuccugccccagccuccccaguaacuggaauuauaggcgcccgccaccacacucaccuaacuuuuguauuuuuauuuuuauuuuauucuuuucuuuuuuugagauggagucucgcucugucacccaggcuggagugcagugacgcgaucucggcucacugcaagcuccgccuccuggguucacgccauucuccugccucagccuccuaguagcugggacuacaggugcccgccaccacaccuggcuaauuuuuuuguauuuuuaguagagacgggguuucaccguguuagccaggauggucucaaucuccugaccuugugauccacucgccucggccucccagagugcugggauuacaggcgugagccacugugcccggcaacuuuuguauuuuuaguagaggugggguuucaccauuuuggucaggcuggucuugaacuccugaccucaggugaucuacccuccucggcucccaaagugcugagauuacaggcgugaaccacccgcgccuggccuuuuuuguuuuuguuuuugagacagggucucacucugucacccaggcuggagugcagucacaugaucugagcuuacugcaaccuccugggcccaggugaucgucccaccucagccugcugaauagcugagaccacaggcaugcaccaccacacccaguuaauuuuuuuuuuaaucucuguauucacauuucccagaaaacaguuacagagucccuuugugacuuugcuguuuccugugcucacacuuucuguuucauugucuugcgaagucugaccugacuugcaguaccuagguagguuauuugugaacauugauggaccauuuugaacauggaucuucaagaagagugcagacagaccuuaaauaaccaggaagcacacugaauguagaucuugguacauaugggaacucaacaaauguuugugguguucauuuccaaguccugcucucuugaaagcacuaaggcuuuuccugaggugaccccaaccuauggaucaacaaguauuaguauuacuguuucuuaaucuguuuuauaguaaaucuaaauaugguuguauaguucaaccacucuauuuaagauuucucuaaauacaaggcgacugaucuuuaaaacuuguguuauuuggguccuauguggucacuaaaauuaaaaaaaaagacaacucagaaacaugaaugucauccuacggauuccccucagaaauaaccacuguuaacauuuuaaaacacuuuuuaaucagcugaauuugagucaaaccacuguugacauuuaaaaauacuuuuucuucaugacauuuuauaaggacggguguuucuuccuuuuagcaguaaaaagaaaugagauacuaaagagagaaaugaaauucacagcuaaucccucaauuccauuuucauguauagccaucuacuucucccauugaacuuaaauauaugcuuuuuagguagcauuuuugguauuuuaaauuuuaucuccuuuuugcuuucccuuguagaaaguugacaaauagucccuaaagcugucaauagguuggaaauaagaaggaaaaguaaagacaauaucuaaguuaauaaguaguugcugugugauggggaacugaaugaauuguauuuuuccuuggacagauuucacagagaugaugagagcccugggauacccucgacauauuucuauggaaaauuuccguacacccaauuuuggacuuguaucugaagugcuucucuggcuugugaaaagguucgaacggcacuuuauugacaucuaagagugaauacuggguuuuauuuauuagucaucuagaaaacaggacacagcugugaugcugcaaaagggaaaguuuuuggaauuugacagacccagcuguauucuguuacaaaggaguuguggcugggcacaguggcucacugcucucaucccagcacuucauaaucucagucauucaagacuagccucaucaacauagcaagacccugucuccauacacaaaagaacaauuagcugagccugggugguacacacucauaguuccagcgacucaggaggcugaggcaggaggaucacuugaucccaggaguuugaggcugcagugccacugaucaugcuauugcacaccagcccgggcagauugagacugugucucaaaaaacaaaaucaggccgggcgcaguggcucacgccuguaaucccagcacuuugggaggccgaggcggguggaucacgaggucaggagaucaagaccauccuggcuaacacggugaaaccccaucucuauuaaaaacacaaaaaauuagccaggcgugguggcgggcgccuguggucccagcuacucaggaggcugaggcaggagaauggagugaacccgggaggcggagcaugcagugagccgaagugugcagugagccgagauagcgccacugcaguucagccugggugaaagagcgagacuccgucucaaaaaaaaaaaaaaaaaaaaaaaaucaguggaguuuaaagaaugcugugggagugggaaauauaccaggaagucgugaaaggagacgacuauuccucaguaggaugcugggccaggcugcucuucagccccucauggcagagugacaggggccuuuuugcacauucugaucaguacacuggauuagaaauaauggagauuucuuuuucugugaaaaaauugaauauguuauaugauucaggguuggcagcuuuuucuguuaaggaccagauaauauuuuaccuuuugcuaaauauaaaauucauaagaucucuauugcgucucuucuuuuuguuaaaauguaaaaacaguucuuagcuugcaggcuguacaggucggaggcugcagucugcugaccccugguuucaauaccuugaagaaaauaacuucaccaacucugcugcugcuuagagcugacuaaucggcccuagcacugaucucugagucaagggcugucagccaggguagcaguucugauuagcuucaugacauggugagaucugagagagauuuaauuuuauaagcugagauccacauuuaguuuuugaaaucuguuuuucuuagguggggauuugcucccuugguauuugguuuugcuuuugaaguuugccuugaucucacucucccacuuggggacuuggagagcguuguguuccagacccgcuguccucucaguugcccacauucucuuuaguagacuuucuccuugguuaacccgugcucucuccucuuaccucucuugauagauaugagccccagacugacaucccgccugacguggauacugaacaggaccgaguuuucuucauuaaggcaauugcccaguucaugguuaguggacacuuauuuuguggaguuguaaaauuaaauaaacuagaaaggaugacuccuuguuagggcgacuuucaaacuguguaauugaguuuuucuuucuuuuuuuuugagauggagucucauucucucgcccaggccggagugcaguggcacaaucuuggcucacugcaaccuccgucuccucggggguucuccugucucagccucccgaguagcuaggauuagaggcacacgccaccacaccuggcuaauuuuugcauuuuuaguagagacuggguuucaccauguuggcuaggcuggucucaaacucccgaccucaaguaauccacccuccuuggccucccaaagugcuggaauuacagaugugagccaccacgcgccuggccugaguuugcuuucuaaaaccauuccauugcuggguuucuguggcaccauuucaccagcgaaguucuuuuuguuugucuuuuaauucauuauuuguuaagaauuuuguuuaugccaggugugguggcucacgccuguaaucccagcacuuuggaaggccgaggugggcggaucacgaggucaggagauugagacuauccuggcuagcagggugaaaccccgucuccaguaaaaauacaaaaaauuaguuggaugugguggcgggcaccuguagucccagcuacucgggaggcugaggcaggagaauggugugaaccugggaggcagagcuugcagugagccgagaucacgccacugcacuccagccugggcaacagagcaagacucugucuuaaaaaaaaaaaaaaagaauuuuauuuauuuauuuuugaauagauaacauauuucauggcucacaaauugaaaguaggcugggcgugguuguucaugccuguaauccuagcacuuuggcaggccaaggugggaggauagcuugaguccaggaguuugagaacagccugggugauguagugagauccugucucuacaaaaaauaaauuuaaaaaaaauuagaugggccuggugacacgugccuguagucucaggugcuugggaggcugaggugggaggauugcuugagcccgggagguugaggcugcagugagccgggaucaugucauugcacuccagcccaggugacagagugagacccuaucucaaaaaaaaaaaaaaaauuaaaaacauuaugaaacaaaauggaguaaaaugacuuuuuacccuaucugcccugggccaaguuccauuccaaauaaccacuauuuuaaaucucuuccagaguuugugugugugugugugugugugugugugugugugugugcaaauaaaaauauauauuuuuccuuuguuuuacacaaaugguacuguauucuacuugauguacuuacuguacacuacaagauguuuagcaucuugcuuuacuuaaugguauauuuuagagaacuuuccaaauacauauagaauuuccucauucuguuuacgccugagugguauugcuugcauggauuugccauaauuuauguaauuuauauagguaggcuuuuagguugucugaagcuuugcucuuuggaacagugcuguaacaaauaaccuguacaucucauuuuguuuguguuugagugugucccuagaauaaguucuuagauuugggauugcugggucaaaagauaugugcauuuguaauuuugaugucuuuuaccaaauugcucuccaucaagauugucccaguuuauacaaccacucacaauguuugagucacuugaaugcuuugcuuuuauuagguuauaucccaguugucagcagaggcauuuucaacucaccuacaugggauuuaguuuagacauuacauggaaagggccuucaacuuuuuuuuuuuuuggucuaaaaauaggccaccaaggcacauauaaaacucaacacuaagaagcuuuaucaagcagauggguaugcgguaaaagagcugcugaagaucacaucuguccuuuauaaugcuaugaagaccaaggggauggagggcucugaaauaguagaggaagaugucaacaaguucaaguuugaucuuggcucaaagguaaggacaacaaaagccuuguagugggcgauggagcguugauuucuugagcucugaaguggaaggagucugcuacagcuccgcugcuuuucuuccuccucagcugagggcaguuugucaguuuugugcucaucagcauuuggauaaagucaaagucacaauccacuaauucaacuauuuauuaaaagcuuaguauuugucagguagcauucaagcgcugaggauacaguugugaacaaaaaggacaaaaaucguguguuuauucucuucaguuaggggagucagacugugaacaauaagagguguggaaggccagaugcagugcaggcuguggagaauaauaagcugggauggggauggaugcugcccagagugaucuuaaaucgggugaucaggaaggccucauggauuggaugguguuuccagcagagauccaagggagggaaagagugaguugugcggguggcggguggcgucagggugucucaggaugauaauuuguuuugggcugggugcagugacucacuccuguaagccaaacacuuugggaggccgaggugggaggauccuuugaugccaagaguuccagaccaaccugggcaacauagugagacgccauuuuuaccaaaaaaaagaaaaaaauuagcuaggcguggugguacacaccuguggucccagcugcccaggaggcugaggugggaagaucucuugagcccaggcagucaagccauguucauggcacugcgcucccgccuaggcaacagaacgagaccuugucuggggggaagaaaaaaaauguguuuuguguguuugaggaaaagcaaggaggccgugugaugaggguugggauugacagacccucuggcgccugggaagccccuggaaagccuuugucuuugccucuaaggugggaaucguugggauccaagcggaaccuucugugcuuauuucccguccaaaggguugcucuggcugcugagccgccaucagaccgaagcaggcggcagggcuggaagcagcgagccuguuuggagagugaggggugaccguggcuuugagcagagugcuggugggacaggugccgucaggugucagggagcgaccacagcagcaagccagaaauaaagguuaagccguuacucugaggcccaaggccucagagcaggagaccuaggaaugaaggccccggggcugggagugcaccuaagaguguggccacgcaggguacgugaaaccacagugcacuggcugagcuccaagucugcugcagggaagaaagcuuccccugugaggccugcuaggugaggccuugucauggucuauaguugggcuugaaaagccacacacagcuuuuuuguuuuguuuuuguuuuguuuugagacggaguuucagucuguggcccaggcuggagugcaauggcacgaucuuggcucgcugcgccucugccucccagguucaagagauucuucugccucagccuccuaaguagcugggauuacagguacacaccaccaugcccagcuaauuuuuuuuuuuuuuuuuugagauggaguuucacucuuguugcccaggcuggagugcaauggcacaaucucagcucacugcaaccucugccucccagguucaagugauucuucugccucagccuccugaguagcugagauuacaggcaugcgccaccacacccagcuaauuuuuuacuuguaguagagucaggguuucuccauguuggucaggcuagucucgaacuccugaccucaggugaucugcccgccucagccucccaaagugcuaggauuacaggcgugagccaccgcacccggcuuuguauuuuuuuuuuuuuuuuuagcagagaugggguuucaccauguuggccagcuagucucaaacuccugaccucaggugaucugccugccucggccucccguagugcugggauuauaggcgugagccaccgcgccuguccucacauguggguuuuuaaccaggagcgacacucgucagcaagagaagugucuagagauuggggcauauuuugaugguagaucucacgggaugaggcauggguugagaguaagucaggugcuacaggccgggucuuggggcagccgugcggcagagcuugcagagcucauggguguguuccgccucugugcuguacucuacgggaaccacuggccacauguggcaagcacaacugaggaacugaguugaguucugcauuuucuuuaauucuuaaguaauuuaagugaaaauggccacauguggcuauugguuacuauauuagacaucacugcucugaaguuuuuugugugagccccuggaaggaugaaguugccauguacugaagcagagaagguucugcacaugcuccauuugccacgccgauuggcuguccagguggagauggugcacagguagcugguaugugaaacuagagcccagggaaagcccaggcuggagcugggagcuggggagcaaucagcacacagaugguauuaaagccuugaggguaggagcagagccagcagaaaagacgggggguccaggaaugaaacucugacucgcuccacuuuugagaagcagagaaggugacagacuccugcaaagaaguuuggggaugugcugcucggaagggaagaaaagcagcuagagccagagcaggcuggauccuggaggacuaaggaagagggaagcaagcuaucaaagccaucagcugcaaaugaagagggagaguuguugcuaguggguugaaaaugagagccagaaggugaggauugguuguccaggagagagggagagugagcagagcagggagacguuuauguuugggcuccuuagaagaguuagcauauucuaggaagaaggggugacacacacauccuaagaaagaagccugugcacagggcucagugcuaaauccucauugugguugucaucaccuuccuggcaacagcugcccaucuguggagcccagaaccauuguaaguccuuagugggugccacccgauuugcgccucuccaagccuguggaggaaagucugaggcagagaaggagggcaggggaggacgaaacacaggacgucaggcugcugcaagaggaugugugucccucaggcugucccuuuguguggccgcucugcugccgucaggcacccuacugugacaaaguccaaguaggaagcacgucagcuuucucccagcuaugcccuccugguuguggcuucaguuugaggugacauuagguuuuuuggagagacccaggcguccuggaauuggucucuuuaguacuuagaugaucauuuccugagcgugugucccgcagccugugagcauguaacuggggaagcacauguuuguggucacgugucccaaccaaagguaggagcugacaugaacaggcuagugguugaaugcauguuaaaaaucuguggcuggccgggcacgguggcucacgccugugaucccagcacuuugggaggccgagguggguggaucaccugaggucaggaauucaagagcagccugaccaacauguagaaauccugucucuacuaaaaauacaaaauuagccgggcgugguggcacaugccuguaaucccagccacuugggaggcugaggcaggaaaauuacuugaaccugggagguggagauugcggugagccgagaucgcgcuaucacacuccagccuaggcaacaagaacgaaacuccgucucaaaaaaaaaaaaaaaaaaaucuguggcuggcugaacauggugguucugccuauaaucccaacacuuugggaggcugaggucggagggucacuugaggccaggaguuagagagcagccuggguaacauagccaagacccugucucuauuaaaaaacaucuguugcugagguuucuguuuuuguuauuuuccuuccagauugcagauuugaaggcagccaggcagcuugcgucugaaaucaccuccaaaggagcaucucuguaugacuugcucggcauggaaguagaguugaggguaagcauuccaguacuuccuuaaccaugcagauuuucucuucaagguuuucuuuuucaauucuguuucucccuuuucaguucugauuuaaugaaauacaccugguugaaugagcuaauguguggaaaggugauagaggauauuagcuguccuuccugcuucuggugggcacuggucuagcuuuauuuauuuauuuauuuauuuuuauuuauuuauuuuugagacggagucucgcuguguugcccaggcuggagugcaguggcgcaaucucgucucacugcaagcuccgccucccagguucacgccauucuccugccucagccucccaaguagcugggacuacaggugccugccaccacacccggcuaauuuuuuguauuuuuaguagagacaggguuucaccguguuagccaggauggucucaaucuccugaccucgugaucugccugccuuggccucccaaagugcugggauuaccggugugagccaccgcgcccggcacuggucuaccuuuaacuucuuguuuaggaguggcagcuccauggcaugugacugagcuguccuuguugugcccacuggcagacuuuauugaucaugauguuuuuuucugguguacucugcuucagcauuuucucaaaaaugaucuucugagcuugcaguuccccgaccuugcugcccagugcaaacaccuggggaccucuaaagacuucugaagccuggcuuucacucugggguccuuguuauggaaugugaccugggcauugggaguuuucagauucucccgggugauucuaacagcaguuugggaccagcaaucuuggcaucacuuccagucagcugaaguugauguugcaguggagacugauuugauuugcaauccuuauuccagccaaugccagccaagaaguaugugccaucaccuacauuuaaguagcuguuuaagacuggagugguguuuauuuuuuauuuuuuuaauuuuguuauuuuuuuugagacagucucacucuguugcccaggcuggagugcgguggcucaaucucggcucacuaaaaccuccgccucccagguucaggugauucuccuuccucagccuccugaguagcugcaauuacagauaugugucaccacacccggcuaauuuuuguauuuuuaguagagaugggguuucaucauguuggccagguuggucucaaacuccugaucucaagugauucgccuuccucggccucccaaagugcugggauuacaggcaugagccacugcgucuggccuagaguggaguaguguuuaauccuuaccuguaaagauuuauggcauuugaagcauaugugcucaaucuaaugcuuuaaaacuaaaugaauuucuuucauucacuuccuagcaagagugccagccauggcuucucucucucacugccuugccuguguucuggcauacccugggagcaaacuggaaguggaagucuggggaagagggacuuaggugcuagauugcuaugucugcucaucauauauugacccggcaguugccaccugaugaagugugguuggcagaaugaaacugccacugacaucugcuagcuaauucagaugaugaguaagguaccuccaggcuuuccccuguucuguuuguagugcagugguguacauaugucuguacaugucccuaagagacucagagacaggagcuggccacuugcugauugccacuagagcuguggcaucauugugagacuucauuuccaucccacggggucucuuucaacaccauccuguaaagaaugaugaaguaaccaguggcugaaacuguucccaaggaaaccaugagacccugaauguaguacuugucaaauucuguguguagucaugauccgaggaagagcgccuauccaguguuuguuuuucuuucauucaguaaacauuuacugaggugcagccucagccacaggcaaggcacugagcucugccuccuugacuaaguccucacccugcccucagccauucccaccaggugcaccguggaugaaaggaagcacaagacgaguuuugacacagugcuucaggaaccuugucuuacuuuguucaggcugccgucccaaaacacaauaagcugagugacuuauaaauaacagauuuguuucucacaguucuggagauugggaaguucuagaugaaagcacuagcagcuucagugucuggcgagggcuuguuccccacagauggugccuuguugcugaguccucacauggcagcaggggugagggaucuccccaggguuucucuuaggagcuaaucaccuccuaacaucaucacauugugguuucgaguuucaacauaggaauuuuggggucacacaaacauugucuauaguaaaccucauaacuauauccacauuacaaucccaugucucagaaguuuucagcacugauaugauagucacagaugucucccuugauagguuaaugguucaugcuaggggcagggccauggucacuguucuuaucgguugcguuuguuagugauaggcaacugagagggacuucaugcuaagaaagaugcuuaguuugggagucaccuggacagaaugcagguaaagaagcaaauuggggcugggcauagugacucaugccugugauccuagcacugugggagaccaaggaacguggaucacuugagccuaggaguuugagcaacauagugagacccuaucucuauuuaaaaaaaaaaaaaagaagcagcagcaaauuugggagaaaagauaauggaugcuaaguucaguuuugcucauagaguuggggucaccuaggccucuggcugaaaaggaggaccuugagcucuggagagagcuggguaggcacucagauaauggaagacauuauaggaggugaugguggcaguguuuuugcaucagagauccacauggcaauaaacuucggagaaucagucuauaaggcacaucuagaucuaggaauacugguuuugagaacuccuuuucugaaaauauacguaaaugauuuuacuguuuccuaggaaaugagaacagaagccauugccagaccucuggaaauaaacgagacugaaaaagugaugagaauugcaauaaaagagauuuugguaagaugacuuugcuuuuauauaauguuuuuuaugccugggauucaaaaauacugauuucuugcccauacaagacagaacaagcuaggcuuaguaacaagggauguguuaguggggaaaugaaaaacucaagaggacauucgagcuuaccuaggucacuuacuaucauuuuuuuccccucguuauaaauaaaaacagcuucucauguuauuaaaaauugaucaguuucaguaauuugauaauuaucaguuauucaauaauuuuaauaaauaaugcucuauuuuauuuuguuuaaccaauuccucacugcuuaguauuuaaaugauuucaggguuuucuaaauuccagacagcacuguaauaaguagaaggaucacuauuguuuacugcucgcucacaucaguuauccucucaucuaaagcagucaguuggaaggcagaucaugagggugacucuagacucagauugcuuggguuugaauuccacugugugauauuaggcaaguuacuuacccucucugugccucauuuuccucaucuguaaaauggcaagaacugcauucccaacugugugggguccuuauaaacaugaaucacgacagggcauaucaagccucgucucugaugcacaauugauaaucagucaucacuggugauuuauuuuacucaguagacacggaugagggccccuguguacauucagaguaggcauaaaacaagaauuugcuaugaguuguacaaaauucuaaaaaucauagguuuuuaaaaauauguaauucuuuugucauuaaacaguaauaccugcugggcagcccagccuagggagucagagccucacagcgggagaagggcaccacagcccuggugggagauuggugacagauaggcagaugggucagauaaguaaaaauauggcaaggauaauggagccacguuccucacuguuggagaaaaaagucacaaaaaugucacaaaaauggaaagagagaaaauuagggugaacuugaaauuggagguguugguuaaacgcauaguuuucaauauauagauagguauaggaauaaauuuugauauacauguaugcacauuuaaggaauuacguauauauguauauaaauguuuuauuuauauacauacacguagagacacccacacucauacauuucuuagcucugagcacacguagcaccuggcuuaaugccauucuccacuaaaaggaaccaggacucuuaggggaaaauggcuaauuccagaguugggcaggagaaguacgagaaaguaaggaagaguucaaaggaggaaagggaacuauuggaagcaugcagaagccaacuuaagugggcuucuccuggccaaaguaaggacaacuuaagcaucaaaauaaauaaguuagaauaauuaauuuuaugguauaauagaaugaaauaggaaaccaugaguuuucacuggcauaaaaaaauaaaugaauauuggaggcugaggaggagcaggucauucacacagauucgaaguaacuuuccacaaaguacuuuuuuuuucuuuuuuuuuuuuuugagacggagucuugcucuguugcccaggcuggaguacaguggcacaaccucggcucauugcaaccucugccucccagguucaagugauucuccugaguagcugggauuacuggcgcacaccacuacacccagcuaauuauuguauuuuuguuuuauuuuauuuauuuauuuguuuauuuuuuuagacgaagucuugcuaugucacccaggcugaagugcaguagcgccaucucagcucacugcaaucucugccuccuggguucgagcaauucucgugccucaaccucccaaauagcuggaaguacaggcaugcgccaccacgcccagcuaauuuuuguuuuuuuuuuuaguagagauggaguuuugccauguuuggccaggcuugucucaaacuccugacuucaggugauccgcccgccuugaccucucaaagugcugggauuacaggcaugaggcauugugccuggcccgcagaguacuuauuaauuacagaggggaaaagagucacuucucagggagaagccugccagucacccccuuaaucaagagaucaaagugaacaucaucguuacagaacaaaucaaaaucaugcacgccugguaggaugcagucacuucugaguauuccugccaacgaugcauaucugacucuaaugagacaaagccggauugaggggcauucuacagauuaaccagccuguaugcucccagagugaaaagguucugaaagucaaggaaagcugagggggcauuucagacugagggaggcuguggagaugugauaacuggacacauaggcagcuccuaucugcuguuggggacuucacugggacaaguggggacaguggaguggggcuggaguuagacggugguaguguguuagugcuggcuuccuguuuugaugauuguauuguggggauguaggagaaaguccuuauuuguaggaaauacacgcuaaaguauucaggguauuggaacgucuggucagcaacuuacugucaccuagguugggaaaaacgcuuuguguuguacaacagguuuuccguaaauuuuugauuguuucuaaauuuaaaaauuaaaaaaaaauuauuauaccucuuauccuugccaguguucuaacugaaucaggugaacacggcaugaaugugcccuuagcacuaauauguuaaaaguagaacacccaagagaggacaggguucauuucuugguagacaucucuuaagacuccuuucauuguuagaaaauaucugugauguuugaucauucuaaaaacaaccaaaacaacauggguacuuaaaaggguuuggggaguacaggccauuuauuucagaaaccagggaaaauugcuuguguuuacacagcuguuuugcauuguggaucuuucuuguuugaggaacagauauguuuaaggugggauaaauuuacuagguuuuaaucugacuuugguucgaggaaacaguugccauuaacugaaguuguuuagaaaggagacccaccuuucuuccugugagggugaacucgcauuucuccugggggcucuaaggcacuugcagcaaaucgaugauaagggucugauuauuuucaugaaaguaucuuagaaguggcuaguguacuuagaccaaaaaaauuagaccauaaacgcauugucaguaacaguggcugguuccaaaacacaccaugccugagaguuguggagagugucugggcuucguaggccauuucucuguggagcccauagcuuuucagagacuugcaggaaaacagaguaaccccuucgugggaugcuacacauaggcaaagagcuggaggggaagccccaccuuggccaccaggaacuuaaugcagggcuggaaagccagaacccuggggggcaguuccacgcucagcuggguggcaguccagauuccucauaaagagauuggagccugaaccccaggcaugugauccagccagccaccggacaagacgcaugugaagacggcgcacuaccagugacucuaccugcuucaaaugaaccuucucuuaggauagggagacuugugucaccgucagugggcccgugucccccuucccuucuuuacucagccucuguugcccaagggccucuguccaacuguugcccuggaccccuuccagagcuggugcacaccaguguggccauugccacugugggaacugcuuucguacugucuucagagugguuucuccucguuuuuagucuguagucaagcuucuguugccagggagagggaagaggaccuucucucaaucccagcaggcaguggguuagggcugggaccagcuguuucuuucucuccccuccuaguagagcaguacuugguguguguggguauucuguaagucggguguuuguaacuaggggcauggcccgaaugauaaaaaggcagacugaccguccagagugaugugcaccuuguucuaaccgagugagccagagaaaagacugcaggccucuccaccuugaccaggacacucuucuuugcaucuucacuucuuucccuggguagaaaugccugcuuuucauggggaaaaaaaaagagauaccuuuuucuggaccugugugacauucucccuggaacuaguggguuaagugagucauugcuuggggaagugucuauuuguuugcuuuuguguuuguugagcauaauguugcuaugccugaagaguugcaaaauucuucuaagaauuaggauggcuguuuuuauugccaccuugucucauuauuucccauuaaauauagacacagguucagaagacuaaagaccugcucaauaauguggccucugaugaagcuaauuuagaagccaaaaucgaaaagagaaaauuagaacuggaaagaaaucggaagcgacuagagacucugcagagugucagguagauaugaacacuuggagaaugaguagaaagauguccuggaaaguucaaacaaacugggcgugguggcucaugucugaaaucucagcuacucaugaagcuggggcgggggguucucuugagcccaggaguuugagaccagccugggcagcauaaugaaaccccaucucuaaaaauuuuuaaaaauuaccucaguauggugauacacaccuguagucccagcuacuugggaggcugaggcgggaggauugcuugagcccaggagguugaggcugcagugagcuaugguugcaucacugcacuccagccugagccacagaacaaggccgaguaacagaacaaggcccugacucuaaaagaaaaaaaaaguuagaacaaagacuuaagagaauagaaugugaucuuaacucuucucaagcaaugaaaaaaagccuuacauaaggguaucuucaccucaaauguacauguguugccugucauaacaagcagauggcuaaacucauucucuuuacugcuugcgguaugucuggaaaacugcuuaaagcuugaacugcccuuuaagcuuuuauagcuucuuggaacucaaggcagaguaagugaauccagacggggaaauccagacguggucuccuaagaucuugccauaaauuagguagaaacagaaacauacuccugccuguuuguuggcauagauuuuagacuuuauuuaaaccuugaucauuccucaccagucaguaauucaucuuucuuccuacguuaccucauuggaaauauauuucccaggaauaccgauggagaauaguggugccggcucucucucucuucucuuccucguucugugccucuuucccucccccaugcuucugcucuuucucccuuuucauucacccuuuauuuuucuuucuucuuggcucccuccucuucccagcugccuacucugcucggauguuuugccuuuuuggauguugguggcuggcuacacccugcccacugucccgaggucuguggggaggcagcaccuggaggcagcgacagcaaccacagggagcgcccuggcuccucccugcccagcgcaaggccaaggcccuuccccuccugaaacuggcucuuuaccucuggagccucagagagggaaaaaaaaaaaaacagaagucauugccgccauauagauugaucuccuugacacauuccacuuuuaaagcaucaauucauuuuuguuaagcuccaaaucauuuuaacagaaaagucucuuuguuuugcucuaguucaaaagauuauaauuauuucugaguuuaucugcuuauauuuuuaaaagaguagaauuuucccuuuaaggucaauaauaagaaaaaagaaaaaguucagcaaaccaguauagauuuuuaugguuuuuuuuguuuuuguuuuuuuuuuuugaguuggaguuucgcucuuguugccgaggcuggagugcaauggcgcgaucccggcucacugcaaacucugccucccggauucaagcgauucuccugccucagccucucaaguagcugggauuacaggcggccgccaccacgcccagcuaauuuuuguauuuuuaguagagacggaguuucaccauguuggccaggcuggucuugaacuccugaccuugugauccaccugccuuggccucccaaagugcugggauuacaggcaugagucaucaucacgccuggccuuuuuaaaaaauuuuuuaucguuuaaaaaccucuuuagacugggcacagugauucacgucuauaaucccagcacuuugagaggccaaggcgggcagaucgcuugaacucagggguucaagaccagccugggcaauauggcgaaaccccaucucuacaaaaaaaaaauauaaaaaauagcugggcauaguggcacaugucuguagucccagcuacuugggggccugagacaggaggaucaccugagcccaggcguucgaugcugcaguaagccaugaucacaccacugcacuguagccugggugacaaagugagacccugucucaacaaacaaaaaaaaaccaccagccuuaauucguaacaaccugugguccccuuuuuagaggauugcuuuaaauuuauaauauccugacaguagaacauuauuauuauuauuauuauuucuuuugagauggagucucucuguguugccuaggcuggagugcaguggcgcaaucucggcucacugcaaccuccaccucccagguucaagcaguucuccugccucagccacccgaguagcugggauuacaggcaugugccaccacgccuggcuaauguuuguauuuuuaguagagacgagguuucaccauguuggccaggcuggucugaaacuccugaccucaguugauccacccgccucagucucccaaagugcugggauuacaggcgugcgccaccgcacccggccaacaguagaacauuauacccaaauaagauaauaauauauauauuuauugauuuggagagaugugucugguaugugauuuuuuugccuuuagagauggggucucaaugugucacccaggcuggagggcuggagugccacggcaaggucagaggauccucacucacugcagccuugaacuccagggcucaauccuccuccuacuucagccucccaaagugcuaggguuacaggugugagccgaugcacccagccugaucauuuuuaacucuauugagauuacgguauauugaaaugaaauaaagauuauaaaauuucuugguauauuuaauuuuuuuuuuaaaugcauuccuaucuauauuuaugcauagaaaagucuggaaggauguaugucaacuaucaagcgcuuauaccuggugaugggauuaucaguaauuuuuacgucauucuucauacuuucaggauuauuucaaguuuuuacaaagagcacaucuuauuuaugaugaaaaagaaguauguucauuuuggggggagaaagcagaaaagggaaaauauuuuuaagcauuacaagaaugaaggaccuucucuaauuaaggguuuccagagaaagccaccauggaaucugaaacugugaauacccauuucaaacuacugcauauaauucaccuuuccuuuuuauuucauuugcuucuuuuaggccauguuuuauggaugaguaugagaagacugaggaagaauuacaaaagcaguaugacacuuaucuggagaaauuucaaaaucugacuuaucuggaacaacagcuugaagaccaucauaggauggagcaagaaagguuugaggugagcugagccuguccucuguucagccauuccuucugguguguuauuuuguacugggugacaggucauuuuguuaauaucauugugaaaaaaauaucaguacauguuuuuucucccuggucagucugaggauugcucauguaauguguuuguuuugcuggcaguguacacuggacuccaggguugucaaaucuuugaugucauauuucaucagguuuggucaguuaagagaacagacagggccgacaugaggccuguguggcugcguaagacccugugccgacauggggccugugcuugcuuucaggcccuguugucacugucuugaaauucauaauaauuuuuaagugcauuuuauuuuccacugaucccaaaaauuauguagcuggucucgagugcagauuuaaaagcuugcuuggcuuugggaggccaagacgagcggaucacuugaggucaggaguuugagaccagccuggccaacauggugaaaccccuccucucauaaaaauacaaaaaauuagccggguguggucguacacaccuguagucccagcuacucggcaggcugagacaggagaaucguuugaacaugggaggaagagguugcagugagccaagaucgugccacuguacuccagccuggacaacagagcaagaucccaucuccaaaaauaagaaaauaaagcuugcuuagucaguucacauaaagauuuucaaggcaaggugcgauggcuuauacuuguaaucccagcacuuugggaggcuuaggcaggaggaucacuggagcccaggagucugagaccaguuugggcagcauaaugagacccugucucuacaaagaaguaaaaauaaauuagcuggacaugguguuacacaccuguugucucagcuacuugggaggcugagauggaaggauugcuugagccugggaguuugaaguuggagugagccaugaucaugccacugcacuccagcucgguugacagagcaagacccugucucaaaaagaaaaaaaaaaagggccgggcgcgguggcucacgccuguaaucccagcacuuugggaggccacagcugguggaccacgaggucaggaguuugaaaucagcuuguccaacauggugaaaccccgucuacuaaaaauacaaaauuuaucugguaugguggcgggcaccuguaaucccagcuacuugggaggcuaaggcaggagaauugcuugaacccaggaggcagagguugcagugagccgagauugcgccacugcacucuagccugggcgacagagcaagacaccaucucaaaaaaaaaaaaaaaaaaaaaaaaagaaagagauuuucaaguccugguuaauugaaucaccagaauagcucauuggagauuguuuuguaaagaggaauggcaguuuauuuauugauugugggaaauaaauguguggccuugagccugaccaaccaucuuacagguuccucucaucccuguggguaaggccauuuaggaaaagaguguuuuagacccgagcaugaguugauaaauguggaauuuagagcaaaggaaauugaaccaaguugugaucaguuuuugaauugcccuauccuuaaccugagaauggucauuuagacuccauuuucaugaugaaauuggucugcagucucccuuucucaugcccuugacagcuuuugguauuaagguuaugcuaggcuucuuacaauacugagcauuugaguuuggcagagcuauuuuguuguccaggagggcuaacugggaguaccuaacgcauccguguggacacaugucaucuugacgaggaauucauugcuagcauuacucuguggcagaggcaggccauggagaaaugguacgggacaggcacauuucgagggcacuagaaagagcuuggaguuuagaacauuuuaaacauuggguaccugggaaagaacagucaagggcagugaaaagaaacguuggccauuuuuuuguauuaucuggggccaccucuggguucagagaacaaaccaaacaguaugccucagaguggcagguagguggcccaggaaacuucccagggagccccucuacccuacccuuccuucaacaaguacaucucuuuuucucuuacucacucucgcucucugucguuagaauaccuguucccucgaaauaccccaugccggaaacacagugcuuuauuuuuaauguuuagaacaacaauauauaaagccaacuuccucccucugucugucccucccccccacucucucucuuugucucuuucucuuucucaacggggucucacucuguugccugccacucugucuggagggcagggugugauuauaacucacuguagcuucagaccucuugggcucaagcgauccucccaccucagcuucuugaguagcugggacuauaggcacuugccaccauaccuggcuaaauuuuuuaaauuuguuguagagaugagguuucccuauguugcccaggcuggucucaaacuccugggcucaagugauccuccugccuuggccucccaaagcguggggguuacaggugugagccaccacgcccagcccccauucucuuucuugauaauaaucaaggccacauuuuaugaucugagauauuuccuccuguccccaccccuguucccauccuuaccugucccaccauuuagcaucuuuugagcuggaaucugaaggcagggcaggaaagauaaaugauaaaaucuauacuuucuuccuuugaaagcaggaggccugucucugcccuaaaauuagaugugucuguucuguguccccaggucauacaggcaugcgugaugggcauuuaguucuccucagaggcagggaaaugcaaucggagaagcaugggguggggcagcugcuucacucugggcgccccuguccaccaggccacgaggcaaccgcagagagaaagggcaguaaguuucaggacccuggaguugcucaggcaguguuaauucucuuccccuuccuugaguuuagcucuuuuuuuguucuguagcacaaacuuagcaguccuuacacaguggugaagaagaauagaacaguccagaaaagggccaucucuccugagucuguauuuccucuuccacaggaagcuaaaaacacucucugccugauacagaacaagcucaaggaggaagagaagcgccugcucaagaguggaaguaaggcugggcuucguagacgagcaguuuacucuggacuaguauuuucagccuugaaauauauauagagagauauauauauauuuuuuaauauguauuuucuucuuuuuuucagcaguuuuuuuuuuacuguaguaagaacacuucacuuuacaucuucaauuuugaaaaguauaauaaauuauuguugacuauagguacaaaaauauuuucaaaaggcgguuuucucacaacuucuauauuggguaccauuguauucacucaagagucugguuuaaauauagcauuuaaaacacauuucguucuugugccaguuaagauaguguuuuccccuguuuaaaugauaguuugaauuauauaugaugcguaacuauaagaaaacauggcccuagauguguguaggguucuguauuuucaggcugaaugauggaaagcaagcacugggaugcagugcagggagaggggccgcucgcuuugugaugguccccaugcugcugagaugccccccauaauccagaauggcucagcaagacacucagcuggagagacacaggguuacguccaugcaaagccuagauuccgggaaggagcucucugugaccaggcagcuucccuuauccuugugugggcggcaagccgcccaggugccgaggcaagagaccgagagcacgagcuguuccaguauaauaaaauauauaaaauaagaauaguuauacuagauauagaucauagauaugauuauauaugaauaucauuaaucauuaguuuauagcaauuacucuuuauuccaauaucauaauaauccucgcucuacaaucauaaccuaggaaaaaacaggccauacagauauaggagcugaggggacauggugagaagugaccagaagacaagagugcaaaccuucuguuaugcccagacagggccaccagagggcuccuuggucuagugggaacaccagcgucugggaagccgcccguugccaaguggaccguggucuagugguagcgucagugucaaggaaaaacaccugcuacuuagcagaccaggaaagggagucucccuuuccccgggggaguuuagagaagacuuuacuccuccaccucuuguggagggccugacaucagucaggcccgcccgcaguuauccggaggccuaaccaucucccggugauacugugcuucaguggucaugcuccuagucugccuucauguucuguccuguacaccuggcucugccuuuuagauaguaguagcaaauuaguggaaguacuaaaagucucugauaagcagaaauaauggcguaagcugucucucucuccucucugucucucugccucagcugccaggcagggaagggcccccuguccaguggauacgugacccaugugaccuuaccuaucacugaagauggcucacucuccuuacccugccccuuugucuuguauccaauaaauaucagcacagccuggcauucagggccacuaucagucuccacgucuucgugguaguggucccccaagcccggcugucuuuucuuuuaucucuuugucuugugucuuuauuucuacagucucucaucucugcacauggggagaaaacccaccgacccuguggggcuguacccuacaucccugaacuucagugucaagucacugucagggaccgguagcagcccaggaucuuccugcugaauugauggccuuguugcacggaguuccuccuccucuugcugguugcccuuucuuuucuucagggugaaauauucuauucacucucauguugagggcagcauacuugaggcaucaggcccacacacaugcucccacacacacucucucucucucucuuucucuuucuuugccauuucccuuguaucucucucauuuugcaccuguucugugacucucucgucugaaucucaggaaacuuuggaggaaggauagggacugcugggaaauccuccaggaacaagguuaggaaauuugaagggccugucuagccaaagcagcccuccccuuuuuaguuccaugucagccaggagcaugugaagcagcccucagugaucagccugcaugggguuugucccuugcgagaggcccagcucagcuaggagcccugguuuguugcuugcaucccaugcuguccccgggccaggaugcuaagaccugccauucugaucuugcuuuauucaccaagauuuaccuuuguguuuucuucuaggaguucuauaguuuuagcucuuacauuuaggucucugauccacuuugaguuaauuuuuguauauggugugagacaggggguccaacuucauucuuuugcauguggcuauucgguuguccuauuaucauuuguggaaaagacuauuauuuccccauugaguuauacucgcauguugucagccauuaauuuuaauugucacugucagcucagugguuucagugucagcaugcauuaaugucuuagucuguuuugugcugcuguaacagaauaccugagacuggguaauuauauauuuuacauaaaauauauacagcauuguauauauggauacaugcagucaucccucaauaucugcgaagaacuggugccagaacccaccuguggauaccaaaauccacagauguucaaguccuuuucauguaaccuaugcacauccucccauauacuuuaagucaucucuagauuacauaaaauaccuaacauaaugccuauacaucacuucauucacauggauucaacauaguacuugguauguggcaaauucaaguuuugcuuuuuggaacuuuguagaucuuuuuugaacuuuguagauuuuuuuuccaaauaauucagauccaugguuggcugaacccauggaugugaaauccauggauacagagggccaguuuuguauguguguguguguguguguaguuuauauauauaugucauauauauuauuauauauaauauauauuauauuauauauuauuauauauaauauauauuauauuauauauuauauaauuauauuauauuauauauauuauauaauuauauauuauuauauguuauauauuauuauauauuauauauuauuauauauuauauauuauauaauauuauauauuauuauauauuauauauuauauaauauuauauauuauauauuauuauauauuauauauuauuauauauuauauauuauuauauauuauauauuauuauauauuauauauuauauauuauauaauauuauauauuauauauauuauuauauauuauauauuauauaauauauauuauauuauuauauauuauauaauauauauuauauuauuauauauauauuauaauauaauauauuauauaauauauuauauaauauauauuuuauaauauaauuuauaauuuauaaauuuauauuuauaauuauauauguuauauaguuauauauuauuauauauaauaauauaugacaauuauauaacauauauaauauauuaguauuagguuauauuauuaucauuauaaucagaaacuuacuugucugaaauuuaaugagccacaguucuaggagcaagcccaagaucaaggagcugcaucuugccgcaccaucccauggcagaagggcaaagagagggcgagagagagcaagagaucaaacucacagccucaagcccuuuuauaaccagcauuaauccauucuucaaggcggagcccucaugaccuaaacaccucccaguaugccccaccucccaacacuguugcauugggauuuaaguuuccaacacaggcuuuucggagacacauugaaaucauauaauagcaauugacuuuaguuuaccugcucacuucucaggucuguauugguuugaguuguaagaagaaaucuuauugagccugagguacauguauuaauuuuauuuuaaaauugauuauauaauuugauuugcauugcaugggauaaggauuuaaugucuuaauuuccuggauagaauaagaaaugaacaaaugacuuuugcacacagaccuuacugggcagagcuguuucguugugaucaugaagccacuccuuuguuuugccugcuuguguuccugcuagguaacgaugacucggacauagacauccaggaggacgaugaauccgacagugaguuggaagaaaggcggcugcccaagccacagacagccauggagaugcucaugcaagguaccccggcgucuuucgcuggacuuccucccugcgcccuguuucacagaacaccuggccaggacuggggcaggcugcuuaguauugaggcccacaagcgugcugcgaauggccccuagaagcagcucuugcucagguuuauccuguccuguuguuuauggcucuugaacugcucaguggucauguuugcuccuugucugugaucccaagacuggaugguucauauuuauggcuugguauuucucacagccacaagaacacauugccucugccacucucagugcagugauauacuuaauagccugagaauuaaugcagaaagggacuuaaaugagcaucucugccuuaaaaaaaguucuucuaauuccuuuacucaucacaaaagauucaagcaacaaagcucagcgcaguggugcacaccuuauucccagcuacucaggaggcugaggcagaaggaucauuugagccuaggagcucggagcuguaguaugugaugauuguguccgugaauauccacugcauuccggcccgggcaacauagaggggcucuuaaaacuaaguuaagccaggcgcgguggcucacgccuguaaucccagcacuuugggaggccaaggcggguggaucacgaggucaagagaucgagaccauccuggcuaacacggugaaaccccgucucuacuaaaaauaaaaaaaaaauuaguugggcgcaauggcgggcgcccauagucccagcuacucgggaggcugagacaggagaauggugugaacccaggaggcggagcuugcagugagccgagaucacgccacugcacuccagccugggcgacagagugagacuccgucucaaaaaaaaaaaaagaguuaaaacaaaaaaagacucaggcaacaaaauuuguagagcaaaugugaauucucuccuggggucuuccucaugucccacucccaccugggagggcucauggcuaguggccagggugggugugucuuuacagauuaccuuucuguacauauacauacgcacacacauacacauacaaagaucaccugaaaaaaauuuaaccugagugcaaccagacgguauguaugguucugcaacuugcuuuuguuuuuaaaaauuaaguacaauuggaacucuuccucugucagcaauagaucugcccccuaauuuuuuuuuuuuuucuuuuugagacaaagucucgcucuugguccccagguuggagugcaauggcaugaucuuggcucacugcaaccucugcuucccggagggagcaauucuccugcaaucccaaguagcugggguuacaggcccgugccaccacacccagcuaauuuuuguauuuuuaguagagacgggguuucaccauguuggccaggcuggucucgaacucccaaccucaggugauccacccgccucggccucccaaagugcugggauuacaggccugagccaccacuccuggccugcccccuacuuuuuaauggcuaugucauauuccuagcaggacuguacccaugauuuacugggcguucucgcauugauauuuccccucuuuuccuuguauauacaucuuucugcaugucugcauaucuuuagguugcaucauuaaaagucaaauucuuaggucaaagguuccauaaauuuuuauuuuaauacuauaaaauucuccuauauuugccuuuaaaaacauuucuuaucuaccaccuguuaauguuuggagcacaguugcuuuuuuuuuuuuuuuuuuuuuuuuuuuuggagacagaaucucauucugucguucacgcuagagugcaguggcacgaucucagcucacugcaaccucugcuuccugguuucaagcgagucuccugccucagccucccgaguagcugagacuacaggugugaaccaccauaccuggcuaauguuuaaaaaaauuucuguagaaaugagguuucauuauguugcccaggcuggccucaaacuccuggccuccugucucagccucccaaauuccugggauuauacgcaaaagccaacaugccuggccagaaaacaaaucuugaaugcuauuuccugcuuuauuuuccaagauuuuuaugacuucuucaugcuuuuguuguucucaggaagaccuggcaaacgcauugugggcacgaugcaagguggagacuccgaugacaauguaagucccccgcuccccucagugguucugugcacucuggguuuggcuguccccauagaugggaguggcugaguugcugucagcagccagggagccgucuauggucagcccggccgugccucgaugcguggcaggguuuggccucaugaggcucuggacucuucguugcucguggauggcucaucucuuuucaagugaaugugcuugcucugcuuuuuuugccuucucacuguucuuuccauucucgcuuuccaaagauggaagcagcaccagcucucuuagguaaaugcaagacuuccagcuccaagaagcagguugguuuucuguucugccucauguguuugugggugucugucagcccucccggggccagccaggggccucucccuaggagugaugcuuccucucuccugggcaaaaaggccacucaaaagagauccuguggugacagcgggaucacugaaggccccugugcuaaaguggaggcgcaggcacggagccuggaggcggggaaagcucaggccgggccauccucaggcccugggccgccaccuagaaaugaaggaggacgccgagggccgggcucaggaccaaccccccucccuguucugugcuggggacggaauggugaagcagcacuguccccagaccaggcccucgaggugccaggcaugaggcugagacauaagcugccuugagcuuuacugaguggauaacucccuggagcacuuaagcaaaaggggauucuagggguccucagugagguccagucaucagggcucugccgcccauugcucaagccuacguucuuuguugcgucccuggcagugcugcucggcccacacagcaaagggcgacucaacagagacugaccccaggcugccuccaugugcccugaauuuacagggcacagucuguagagaagcagagagagcaacuggaaaauaauuuuccuaacaagcucggguguggaugguauacagcgucucuccgucuugcccacccaagacagaagcagagggaguguggcgugggugcuggcaaugcugaggcagcaccgccugccucuucuccaggguuugccuucucucuccucagagcgaaugcauuagucgcagcugagcuuuaugccugguggucacuuguuuauuucaaggaggcuguguccaugccgcccuccaggcacaggguuccaugcuuuacguguucaggcauccaacacgugucuguugagugccugccacaugccagugcugucguggauuauggggaacgcagcaggggcagaggcaagccccugcuucauggcucacaccccagcaauaaugauggauugucggaucagggcucaugguguuaacaggaggaauaacagcuucaggggacagggagugacagggaacaaggaggggguggcgucuucugcgaggucagugaaggccccugacguggugguguuugagcagggccugaguggagggagcgagcgcauggguuggcggcaccugggcauguggaaugcacuccucgcaucgaggagcagaggcagcuggugugauugugggugagugcgagaggcagcaggggccaugcagagcuuugcagggugagaugaagacucuguuuucucugagugugaggggaaggcccugaagaaucaugagcccagaagggucaagagcugaugaucccuguuugagagaagccaguuaggaggcgccugcacccguggaggucagaggugacggugcuuggccgaagguguggcagcagagguguugagaaauggucagguccugggucucucuaagaaccaucagguuuugugaauugauuggacauaggcuguuagagaaagagaaaaaugagggugccugggcuuggucuaaucagcagaaagcagaguuucauuuucugagauggggccgacuugacaaaggggcuuggaaggcagaucgaaaguuugauuuuggacauucugaaugugacagccacaugcuaggguugaguagccagguggaauuuaagucuggaguucaagggccacgucugggcuagagauugaauuuugggagccacccuuauuugguugguaucuaagccacaaggauagaugugacugccuagggagagcaaguagaaugagaagagaggcgacccaagguccugagcugcaucugcccugcagagguccgggaggaaggggcaggcagaggaggcugaggggcgucagcagugaggaagggggaccuggacuagagaaggggcccugggggauggagaagauggguuuuaaggaugaaggggugauuccacagcucaagcaggaugaggccugagaaucgaucccaguccguugaauguuuccuucuugacaggagcagugcuggggucaguaggugagagcccgggggaacugaagcagucgugaggggcacagguguggacagugaguucaacgacucgcucaggagcuuugugugaggggagagagacagggcagagcagcuggagaggaaggugggauuaccuuugggguuuuuuuucaagaaggaaauuacagcaugagugugcaccgacaggaaugaucuagauagaacgaccagccauccugguuuacaugggacgcaggaacugccguuuuaaagcugggcugaguuggucacccuggagcccuggauccgaugaggagagagagggugugucuuucacuuugcucccuuuuuuucuuuuuuuucuuuuuuuuuugagauggagucuugcuuuggagugcaguggugcaaucucggcucacugcaccucugccucccagguucaagcgauucuucugccucagucuccggaguagcugggauucacuuugcuccuuauaccaaugucuauguugcuuuccauccacaaucuacaaaaagccaaaacaggccucccuucccucucuccaagccccuguccuucuugccaucuguagggggagucucuagguccaguggcccucagcgcagaugcagagugcuucuuagacgcugcgggaaagccagccccugcagcaccacacccagaugcaccugcaguuuggaggauucugguuggaugauaaauuccagcuggcaguacauagccucagucccaucuguaugcccucccacagccugcuugccacucugccagccucuuccuucacacagggaugcugcuauagaaagggaggcagagagucuuaggacaagaugucaggaaugaggcaggaucccccguugcaucugccauuuuuuuccuauaggaggacucggaggagagugaaauugacauggaagaugaugaugacgaggaugacgauuuggaagacgagagcauuucucucucaccaaccaagcccaaucgaaggguccggaaaucugaaccccuggaugagagugacaaugacuucugacccuuuugccaagggacccuggcagauuaaaacccucagacuuguagguaaaugggaacuuagaagguuaggaagguaaccccuguuuuguuuacuaagcuggcuggacucaugaucacugaagcaauacuuauuucugcuuuagccuccuauguuugcauuccaugaagcuuaaauaagaauugaagcaaaucccuaagauuuauuuuuuuccaccuuauuuaucuucuaaaacuugaggaaugcauguguucuuagugauucacauccacgggacaaaaacucaagaagaaauaagagcugacgccacacaa

SEQ ID NO: 192594 - RNA, 59561 nt, Homo sapiens
gaggaagccccgccccgcgcagccccgucccgccccuucccaucguguacggucccgcguggcugcgcgcggcgcucugggaguacgacauggcgcgcgagcugcgggcgcugcugcuguggggccgccgccugcggccuuugcugcgggcgccggcgcuggcggccgugccgggaggugagggcguccuggcuggacgggcagcgggcgggccgggccacggagacggcagggacgucccugugcuccggggagcgaggcgccggcaccugcuucacaggcgugggagguccggcgaggccaagcgcggcagacgcguuuacuuucgcuccgcuccucgccagcuccagcuuggcugccuuuuccucggcuggacuccccucgccacccgcccaugggagcccugaaggaggcugggucuuggggggucgcggggucgggcggagcggcugcggggucgucccuccuggagcuucgguccagucagguagcgcacgugcagguggagccgcugcggagcgcggagucuuugcgggugcauguugcggggaauggacucacucggggugaucgugcuaguuccauggaucgugcuuuaccccuccccgccucccaguagcgcacugaggguucauuuguuaauucguucauuggacgcacaugugagcgcccgcucagugcccggcgccgugcagguucuggggacgccacagugaacaaaaccuauagcagucauccggguccccagagcagguggacucgaugucguugacgcagcuguguccucggggccuggaauugauggaugcgccaauaaauguuuguaaaacagagagaacgacccuaaccucugcuuucccaguccccacucggagguaacaacagugaaaguuucggcauugcuucggggcuguacacaguguuauacguguaaauauaaaugucugcguauaaguauuuuuuauucuaaaaagccuaaaccauguaugcauugugcuacguuguacuucagaaaauuuuaacgcucccagcauucuuuccacaucuuuucaugucaguguauacagguccaugugccuuccagugaccacacaguauucuguaugauggacgugucauuuguuuaaacauuguccuauuaguggacgcaauaaagguuauuucagguuuuacuuuuuauuacaaugcugcauagaaugggugaguacuuaaauauuuguucacgugcgguauuucuuuagccuuacauaauuagaauuuuagaauugauauuucagagccuaugcauuuuugaaauguuagcagauacugccaaauuguccaaaaaggccuuaucaauuuauauccccuuuagcaggcaucaagacugccuauuccaaagguauuuucuucaacgcugaaucuuaugucuuuucaaaaccaguggucuauaaaagauaccuuguggccgggcgcgguggcucacgccuguaauccuagcacuuugggagccugaggugggcagaucaggaguucaagaccagccuggccaacauggugaaacccugucucuacuaaaaauacaaaaauuagcugggugugguggcgcgcgccuguaaucccagcuucuugggaggcugaggcaggagaaucgcuugaacccaggaggcagagauugcagugagcugagauugcaccacugcacuccagccugggcgacagagugagacuucaucucaacaacaaaaauaauaauaauuuucccucagaaagugaugcuguugcucucuucuagcaccagugucugaucaauuauuuauuuauuuuuuugucuuuaugaggugggguuucacuauguuggccaggcuggucuccagugccugaccucaagugaucugccugccuugcccuccaaaaugcugggauugcaggcgugugucaccgugccuggccaacuguucuguuaauuugguucucguuucuuuuguagcugacucggguuuuuucccccuuggagguuaagauuuuuucucuuugucguuuguggucucgcguccacagguguuugugauucaugcuuuguaucaugcacugucccuuccauuuggaaaauaugucaguuuucagcccagggacauuuuaauucuguuucuuuaucucuuuuucuuuuucuuuuuuuuugagauggagucuugcucugucacccaggcuggagugcaguggcgcgaucuuggcucacugcaagcuccgccucccggguucaggccauucuccugccucagccucccgaguagcugggacuuuaggcgcccaccaccaugccuggcuaauuuuuuguauuuuuaguagagacgggguuucacccuguuagccaggauggucucgaucuccugaccucgugauccgcccacuucggccucccaaagugcugggauuacaagcgugagccgcugugcccagcccuuuaucucuuuuucuuaaaaauugucucucuccucucguccuccaucuucuggugcggugguucaagcauuccucugccugagucuaagaaauggaacauguucuuggcagccuucugcguggcaggugcccuugucauugucaccuguguggaugaaugggaagguaaauuguuuggauugauugaacgaugagagaauuuagcuaagaaaauacaugucuugugcaacaggggagaaagaauaguuuaggcagauccaccuauguagaaaauccagaccucuugaaauuuuuuucuuuucuugggaaaguauuuccagguuguagcaugugccuggcuucaggugugcgugucuuaugucuguggaauccucucgcccaugcuacgcugccucagucacccaugagcucagcccucuuacccuuucagaccucacugaccccugacacugccagcccugucacuugcccucagaauaucuuauuugauuuuuuuugagccggagucuugcucuguugcccaggcuggagugcaguggugcaaccucagcucaccacacccuccgccuccuggguucgagugauucuccugacuucgccucccacguagcugggacuacaggcgcaugccaccacacccagcuagguuuuguauuuuuaauagagaugggguuucacuaugcuggccaggguggucucgaacuccugaccucaugauccacuagccuuggccucccaaaaugcugggauuacaggcgugagccacugcgccuggccuacccucagaauauuucugugaggggugggcuaggauauccgcuuguggacuuuauauuugucauuuuugcccauaacaguuuauucagcaaauacauuuccaaugcccccgagucgucaaagaaaaugugacccugcugucuggagucauagguggcugcugagcaguguaccagggccaucuugguggccuggacagcacauuagagaaacaagagcugcuugccccaggguaaguuucacagaugaggagcgauuugggccgaguguccaaggcuguuuucacuggaggggagggaggaacguuccaugucuggaaagcugcaggugcaaggguaaggagauagcucugaauaauugguuugaugaaagacuugcgggagugugcaggagugauggugaaugaggcuagcaguugugucuuuucugucagauauaagcuugugcguaggagccucauccugcauuccucaggacagucacagagccagcccugggccugguguguggggagcccagccacguggcccaccaugagagcuuuucgucagagcuccaacugucagaagugucagaugugccaguagaaggaugaggccgccuccuaaaggagagggaagaccuggaaagaucaacagcagacgcagucucccaaagcaaacgugauucuguggucaggcagguacggugacggguuggucauuuugcaugacgaggugacugccacaaucaccaagggugccgaguccagucuccuggucaugccagaugcucuuguuuucgugaaauugccagaacaugacugaggcaaccacgauaggacugguuggugcaggcguuaagaucuugggccuuuuuguucucuguaagcuggagccuuugcuggaacuuccugucuuggaaaucagaguugugagaguagguccccugccagcaccaggaaggucgggagagcugguuuccucacuuugcucagggcucaaguacuagcuaguuuguuucaucuuccaaaaagagccucaccuggaccccgcuccuguagguggugccugccugcugcgcccuccccuucaguacuucguuuuguugacggguuuugccuccucccucugcucucccuuuguuuggagccugugcuguuugauuuccgugucuugugugcugcacccuucaggagaauucaggugaauuucuggugcucuccggcuguucuuuucagaguggaggggaguaguacuugcuggucaguugcgacucugucugugaaacagcucuuuguguugcugagaugacgcuagagguguagcguccaugacauguuugucgucugauuaagcuguggugcuggcacuuagacggcagaggaagguguggcccagcuguccaaggccaccaggaggaccuucagcuuaguuaggaccaagggaacugaguuaucugagugccugaaaaagaacacaucaggccgggcgcgguggcucucgucuguaaucccagcacuuugggaggccgagguggguggaucacuugaguucaggaauuugagaccaaccuggccaacauggcgaaaccccgucucuacuaaaaauacaaagaaauuagccagggugguggcaggcgccuguaaucccagauacuugggaggcugaggcacgagaauugcuugaaccugggagguggagguuggagguugcagugagccaagauugugccacugcacucccuccugggcgacagugcaagacucugucuuggaaacaaacacaucaauccgaauguaagagauuagcaaagcguuuauugguuacugggugaguaguuggccuaagcuaagacaaaagaggaaucuccaaguauuuugcuaccccuuggcaggaagagagggaaugcagcuugcgggguggggaugggggugucagguugauaagaaaacugugggaaaauaaacauuuacuccugccccccaugucaguaaauaccaugugacaaaggugaguuccaugaaagaggcuguuacugaggccugugauacuugcuugucucaaaaugcugacauaucuuuuuuuuuuuuuuuuuuuuuuuuuuuuuuuuuugagacagauucuuucugucgccaggcugaagugcaguggcaugaccucagcucacugcaacuuccgccuccugaauucaggcaguucuccugccucagccuccugaguagcugggacuacaggugcaugccaccauggccagccaauuuuuguauuuuuaguagagacgagguuucaccguguugggcaagauggucucaaucuuuugaccuuuugaucugccugcuuuggccucccaaagugcugggauuacagacaugagcuaccacgucgggccugacaaagaaucuugauagcgauugaaaauguauccauucauacucaaaugaaguaaaaagugcuuuuggguucaaagccagagaauguucauggauggcguuuuuggugccucaaguguagccagcuagaacuuuucuuaccaccguccugcuuaguccuacugaagaccugccuucuacuaggaagcugcucuuaguccacaaaguggcuucccuguaguuccacagcauuuaacaaaauagauuucagggaguuuauuugugguguggcugguuauuucugcuaaaaccacuaggaauuaccauaaaagcuguagcuuggagaaacaguaucuacuugcgggaguauuacugccaccuguguuuuuuuuguuuuuguuuugguuuuuguuuuuuuuuuguuuuuuucaagauggagucuugcucuguuucccaggcuggagugcaguggcacgaacucggcucacugcaaucuccaccucccggguucaagcaguucuccugccucagccucccaaguagcuggggcuacaggcaugcacuaccgugcccggcuaauuuuuguauuuuuaguugagguagaguuucaccauguuggccaggcuggucuugaacuucugaccuugugaucugccugccucggccucccaaagugcugggauuacaggugugcgccaccguucccagcccugccauuggcuuuuuaaccaggugaauuccuguagauuggguagauugaaaggacauguagcugaaucauugguuuuaaaaggaauggcucaguuacuucauagccauauaauuaagaaauguggcuagaagguaaaaaauuggccaggccugguagcucaugcuuguaaucccagcacuuugggggcugcggcgggaggauccugugaguuuaggaguuugagaccagccugggcaaccuagagagacccccaucucuaccaaaaaacccuuuuuuuuuuuuuuccaauuagcugggugugccuguggucccagcuacccaagaggcugaagugggaggcucccuuaagccuugagaagucgaggcugcagugagcugugaucacgccacugcacuacagucugggugacagagugacagugucucaaaaaaaaaaauauauauauauauauauauauacacacacacauauaaaagaaauuaauuuugagauagcuaaauuaaaugccauauuaagagcaggaggcuauucagcaaugcugcugagaagaagacagaaggacguggguccuucuaauguaacuaugugugucggguuagugauaugcaccucgaaggagaaauuaagacagcacauugccauguuaguucacacuugccaguauuucagcauuugucaggcaauggaauguucaagcgaauuuuccacgaggcugacuuuaaaacauuucauuuuaaccauuaugaugagaagucuuucuagaacacuccaucauuugauggcccaugacugaaccucucuuggauguuuucagggucauuauuacggguguuaauguuuggucuucuguuuuaauauguaggcucccguagggccauugaaaugugaagaauccuucgucuaugaaguguccccacaucaaaacugcauugugaguguuuauauuuuuggccucucuuacuguggccuuaacuugcaggucugucuggagcccuguucucuccuuuccuaguuugcagauguggcugggaaacuuguuagcaucaaauuguuagaaugagauggauuucauauggggccaguagucuuccaugagcaaagcucagggugagggcuucaggcccauauuuugacuauuccgaggugcccuuucgcuuuuuguucuuuuucuuuauguucaaggaguuauguuuccugaugaaugaaguaucaguauaucauaguagagaacgauuagaccagguucuggaacacaggaaaccucaagaaacagugaguguugagaaugccagagcuaagaacucagacauuugugagggaauacaggucuuucuguucagaauguucauguacuuaagaaucuucucgccaggcgcgguggcucacgccuguaaucccagcacuuuggcaggcugaggcggguggaucaccugagguuaggaguuugagaccagccugaccaacauggagaaacccugucucuacgaaaaauacaaaacuagccgggcgugguggcgcaugccuguaaucccagcuacuuaggaggcugaggcaggagaaucgcuugaaucugggagguggagguuguggugugccgagauggcgccacugcacuccagccuggcaacaagagcgaaaacuccgucucacacacacacacaaaaaaaagggaaacaaagguaaacugggaaggaaccguguguaaucuuccguaccuugcauuuuccacuuauauucugggguuuguuuccugucgccacagagcucugguauuccauagcgaggauguuuuguaauuuauguaacccucucauggcggacauuuagguuguugcugaguuuccccaagauaacagacggcauugccaacaguuucucacaccuucaccagugcuagaaugacaguauuuaaaacaucugucaaucugguagugaaaaugcuaucucguuuuaaagugcauuuccuuaguuaugagugugguaaaacaucuuuuacuaggacguaaagccauugauguuucuuguuuuugugaauggccauuuuucucuugaaccaauggccuuuuucuuuuuuuuuuuuuuuuuuuugagauggaguuuugcacuuggugcccaggcuggagugcaguggcgugaucuuggcucaccguaaccucugcgcuagcccuuuuaaauaacuuuuaaaaauugagacagugucgggccaggcacgguggcucacgccuguaaucccagcacugugggaggccgaggcgggcggaucaugaggucaggagaucgagaccauccuggcuaacacggugaaaccccaucucuacuaaaaauacaaaaaauuaucugggcaugguggcgggcgccuguagucccagcuacuugggaagcugaggcaggagaaugccgugaacccaggaagcggagcuugcagugagccgcgaucgcaccacugcacuccagccucggcaacagagcaaaacuccaucucaaaaaaaaaaaaaaaauugagacagagucugacucuguugcccaggcuggagugcaguggcgccaucucaccuuacuguaaccuccgccucccgagguuaagcaguccucucgccucagccucacaaguagccgggauuacaggcacgcgccaccaugcccggcucauuuauuuuuauuuauuuauuuauuuauuuugagauggagucucgcuccgucgcccaggcuggagugcagugguacaaucuuggcucacugcaaccuccgucucccagguugaagcauuucuccugccucagccucccuaguagcugggacuacaggcacccgucaccacgcccggcuaauuuuuguauuuuuaguagagauggaauuucaccauguugaucaggcuggucuugaacuccugaccucaugauccauccgccucagccucccaaaguguuggcauuacaggugugagccacugcuccuggcuuucuggcuaauuuuuguuuuuuuuuguauuuuuaguagagacaggguuuugccauguuggccaggcuagucucaaacucuugaccucgggaucugcccgcccccaccucccaaagugcugugauuacaggcgugagccacggcacuaaauuuuauuuuagaggcagggucuugcuuugucauccgggcuggagugcaguugugcgauccuggcucgcugcaggccugaccuccuggacucaagugauacuccugccucauccucccaaguggcugugaccucuuccucccaaggagcaugugccaccaugccuggcuaauuaaaaaacauuuuuuuuagagauggggucccacuauauugccccggcuugucuugaacuccuggucucaagugauccuccuacuucugccugccaaaguacugggauuacacgcaggagccgucgugccuggcccccaguuuuuuucuuaauguguuugucuuuuuuuuuuuuuuuuuugaguuagagucucgcucugucuguugcccaggcuggagugcaguggcacgaucuuggcucacugcagccuucgcuucccgagugcaagcaagucuccugccucagccucuggaguagcugggauuacagaugcccgcugcgacucccagcuaauuuuuguauuuuugguagagacgggguuucaccauguuggccaggcuggucucgaacuccugaccucaggcgauccacccaccucagccucccaaagugcugggauuacaggcaugagccaccucacccggguguuugucuuuugacuuaaauuuuuaugugguccuuauauuuauggccuuuuggguuauauauuuuguuuagaaacauuuccucuuaaggccgggcgcgguggcucacgcuuguaauccuagcacuuugggaggcugaggcagguggaucacgaguucaggaguuugagaccauccuggccaacauggugaaaccccgucucuacuaaaaauacaaaacauuagccgggugugguggugggcgccuguagucccagcuacuugggaggcugaggcaggagaauggugugaacccgggaggcggagcuugcagugagccgagaucccgccacugcacuccagccugggcgacagagcgagacuccgccucaaaaaaaaaaaaaaaaaaagauuuccucuuaaaucauuuuuuuuaaaaacucaagaugccuggcaguuuaggaacugcaaagcaaaacuacagugaguuagcacuuccuacucacuaggguggcuauaauuaaaaauuaaagaaacaacaacaaaaaaacaggugauacaaaauggauaacuaggauguggaaaaaucagaacccucccacacugcuggugagaauguaaaacggugcgaccucugcaggaaaacauucuugcagcuccucacacagucaaaccgaauuaccauaugaccccacaguucuacccugaggcacauaccuuguagacaugaaaacauguccacagaacagccuacacaugaauguucauagcagcauuauucauaauaacccgaaaaugaaaacaaucugaagguccaucagaagguggaaacgaggcugggugcgguuggucaugccuguaauugcagcacuucaggaggccaaggcaggaggauugcuugaggccaagaguugaaugccagccuggacaacauagugagacuccaucucgaaaaaaaauuuuuaaaaauugcugggugugguggcacaugccuguggucccagccauuugggaggcugaggugggagaauugcucgagcccaggaguuugaggcuacauugagcugugauugugccacugcacuucagccuggucaaagagcaagaaccuaucucaaaaaaaaaaaaaaaaaaaaaagagugcaaauaggccaggagugguggugcgcccuucuaaucccaccugcuugggaggcugaggugggaggaucgcuuaagccugccaguuggaggcuaccaugcaccaugacagugccuguaaacagccacugcacuccaggcaacauagugagacccccaccccaccccaaaacaaaaguuacaguaaaaaguuggaagcugggccuggugcaguggcucaugucuacaaucucagcacuucgggaggcuaacguggguggauuacuugaggucaggaguuugagacuagccuggccaacauggcaaaacccgucucuacuaaaaauacaaaaauuaacugggcgugguggcgggugccucagcaggagaaucacuugacccugggaauuggagguugcagugagcggagauuacaccacugcagagugagacuccgucucaaaaaaaaaaaaagaaaaaaagggccgggacugguggcucacgccuguaaucccagcacuuugggaggccgaggugggccgaucaccugaggucaggaguuugagaccagccugaccaacauggagaaaccccgucucuacuaaaaaaaaauauauauauauauaaaauuagccgggugugguggcacaugccuguaaucucagcuacucgggaggcugaggcaggagaaucacuugaacccgggaggcagagguugcagugagccaagaucaugucauugcacuccagccuggcaacgagagugaaacucugucucacaaaaaauuuggaagcaacccaguugcccaucauuugaugaauggaaaaaaauaaucuauacagcggagugcucuucaguuauaaaaaggaaugaggugcugauacaugcuauauguggaugaaccccaaagacuuuaugcuaagucaaagaagccagacaaaaaaccauauauuguaugauuucauuucugugaagugcccagaaaaggcaaauccauagagacagacauagaugaguaguugccaagagcuggugggagagggaaaagagagugaacaugaguggcuguagggcuucuuuuggggugauaaaaauguucuguaguuguccgggcaugguggcucaugccuguaaucccagcacuuugggaggccgaugcgggcggaucacgaggucaggagaucgagaccauccuggcuaacauggugaaacccugugucuacuaaaaaaaaaauacaaaaaauuagccgggugugguggcgggcgccuguagucccagcuacucgggacgcugaggcaggagaauggcaugaacccaggacgcagagcuuacagugagcccagauggcuccacugcacuccagccugggcgacagagcgagacuccgucucaaaaaaaaaaauguucugugguuaguggucguggcuguacaacuuugugaauauacuaaaaccacugaauugugcacuugggugaauuauauggcagauguguuacaucucaauaaaguuacuaaaucuuucauguuuucuuucaguacuuuuagcuuuuauuuuuacuucuaugguccaucuggaauucauuuugacuuaauaagugacagcggaaauuaaaaaaaaaaaaauaagagguuggucuugcuauguugcccaggcuggucuagaacuccuggccucaaguguuccucccaacuuggccuuccaaagcacugggguuacaaacaugagccccugugcccugcuggaaauuaauuuaaccuuuuuuuguguguguuuacuuuuugagaguugggggggucucccuauguuaccuaggcuggccucgagcuccugagcucgagggagccuccuccugccuggaucucccucccaaagugcugggauuacaggugugagcagccaugccuggucuggaaauuuauuuuaauauuguagcuuuauauuaauguucuuuaauauuugaugaauuuccucaguuuuuucaaaauuucuuuggcuauuuauguacacuaacuuuuccacaugaauuuuagaaugagaauaguuuaaaaauguguuugaaauuuuguaaauguguuuauguuucucguaaguuuuuaaguguuuuuuauaaugcaacguuuuguuuguuuugagacagagucgugcugucgccuaggcucgagugcagagaugcaauuucagcucacugaaccucugccucccagguucaagcgauucuagugcguuggucucgcgaguagcuaagauuacaggugugcauccccaugcccagcuaauuuuuguauuuuuaguagagacggguuuucaccauuuuggccaggcuguucucaaaccccugaccucagcugaucugccuaccuuggcuucucaaagugcugggauuacaggcgugaggcaccucaccuggccuguaauguaacuuuuguaaauaguuuuguuuuuugauuuuuuuuuuuugagacggggucucgcucugucgcccaggcuggagugcaguggcgcgaucucggcucacugcacgcuccgccucccgcguucacuccauucuccugccucagccucccgaguagcugggaccacaggcacccgccaccacgcccggcuaauuuuuuguauuuucaauagagacuggcuuucaccguguuagccaggaugaucuugaucuccugaccucgugaucugcccgccucggccucccaaagugcugggauuacaggcguaagccaccgcgcccagccuaacuuuuguaaauaguuuuauaaguaggguauuuauuuuguagauuauugauauauguaguccaauaugcaaacgauacagagguauaucugaugaaaaacucgucucccacugacaugccucagacaacaccccuccugguggcaaguccauuagccaguuuuuggguguccuugcagagaucugcguggcauaugagaauagcuaugcaugcauguaucacauaacauguauaugcauuugaacaccaugguagugugugcaaaccgcuguucuaccucuaguguuuuuucuuuguguuagagguaauucagcaucagcacacauuacacagcauugucccauuucucuauaaucccaugcuuuccaaguguuaccuuacgucuguaguuuacuuguuaguccuccgcuugugaguauguagcauauguaacagucuuaaguggguuauuuaaugacagucuuuggcccuaguaguguuucagaguuuucuuaaaagaucuugccaaaaaagaaaaaaaaggaaagauuuugcuuucuugguaaaugcauucuuaauuguuuaguuuuuguuccuggggucucuuaugucauauuuucuaacuaguuuucuguauauaggacguccggguguugauuuuuguauucuaccaucuuacugaaugcuuuuuuuuuuuuuuuuuuuuuuucaagacggaguuucacucuuguucuccaggcuggagugcaauggcagcaucuuggcuuaccacaaccuccaccuccuggguucaagcgauucuccuaccucggccucccaaguagcugggauuacaggcauccacgacaacaccuggcuaauuuuguauuuuuaguagagauggaguuucuccauguuggucaggcuggucucaaacucccaaccucaggugauccgccuaccacagccucccaaagugccaggauuacaggugugagccaccgcacccagcuuuuuaaauuucucuuaaagacagggucucacuuugucacccaggcuagagugcaguggugugaucucggcucacugcagccuuuacccucuggucucaagugauccuuccgccucaaguaccccaaguagcuggaacuacaggugcgugucaccauguccaccuaaguuuuuguauuuuugguagggacgggguuucaccaguuugcccaugcuggucucaaacuccugggcucaagcgaucugccugccucagccuccuagagugcugggauuacaggugugagccacugcccuaggccuuauucuuuaaaaugaucugccucuugaaaaaugaaagucuuuucucaaaaaacuucuucccaggucugugaagcagcacaguggccccuucuggcucucaccuuguaccucguccuuguuugccucgagcauaggaccuugucuguguuugugccucaggcccccucccucuguguuugcuggguccacuuagucuagucauugggccuuggcuccuaagaggccccuagacugaauuccucauccgauguguccauaccagcuuucaagugaccucaacaucgacagcagggaaaacauuagcacuuuugugacagccucauauuuucccccgcccgagauggagucucacugugucgcccaggcugggauuacaggugcacgccaccacacccagcuaauuuuuguauuuuuaguagagacaggguucaccauguuggccacgcuggucucgaacuccugacuuugugauccaccugccuuggccucccaaagugcugggauaacaggugugagccaccgugccgggcagccucauauuuuuaauaauuuaauaucuguuuugaauaaauaaauaugguuugauuaaccaaaaccaugugaacagguaaagcuugagaagucuugcugcuguucagagcaccugcugucuucauaaccacuauuaguugccuguggguccugccacuacuuacuuguaugacuguaguaagugcagauguacauauucccucagggacgcacccuucucuguguucuguuacucacuacauagcucguggagagcuugcuguguucauauauaguuuggugcuccuucgcuuucuguagccacugugaaaugccguucauaucuuuugccccagguuuuucuucuggacugucuggcuauuuuuuuuuuuuuuuuuugggacagggucuuacucugucacccagacuggagugcaggggcgcgaucucagcucacugcaaccucugccucggguucaagcgauucuccuguuucagccucccaaagugcugggauuacaggcgugagcuacugugcccggcuucuguuuuauuuuuugguuugauucugucaguuauugagagaggaguguuaagaucuccagcugugauuguggaauuguuuugucuuuaauucuuuccguuuuaacuucauauauguugaagcucuguuauuaggcaaauacacacuugugauuacauuuuccugaugaauuguuuguuguaguauucugaaauauccuucuuuuuuccuaauaauauuuuuuauuuugaaauguauuuuacuugauauuaauagagccacuccagcuuucuuaaacacacuuuuuggaugguauguauuuuuccauucauuugucuuaaguguaucuuuuucuuuauguuuaaagugucuuguagauagcauguaauuaggucuuccuuuaccaauucugacaauccuugccuuauaauuagaguucagucuguuaauguaagaguaaauaucgauguggcuggauuuauugcuaccauuuuauuauuugccuuuuauuuguccuuuuggauuuuuucccuguuuuuccuuuccuuaucaaugaaauguauuugagauuuccauugugguuuaucuaaugcuuuuuaaagcuauucuucuuugaauuauuauuuuagugguuacucugguguuugaaauaugcacccuuggccaggugcgguggcucacuucuguaaucccaccacuuugggaggcugaggcaggaggaucccuugagccccagaguuugagaccagccugggcaacauggagaaaccccaucucuacuaaaaauauaaaaauuagccuggcguggugaugugcaucuguagucccagcuacucgggcggcugaggcccgagaauggcuugaacugggaggcggaguuugcagugagccgagauugugccagugcacuccagccugggcaacagagugagacugcaucucaaacaaacaaacaaaaaagucugggcgugguggcucacaccuguaauccuagcacuuugggaggccgaugugggcggaucaccugaggucaggaguuagagagcagccugaccaacauggagaaaccccgucucuacaaaaaaugcaaaauuagccaggcgugguggcacaugccuguaaucucagcuacucgggaggcugaggcaggagaaucgcuugaacccgggaggaggaggauggggugagcugagaucgcgccauugcacuccagccugggcaacaagagggaaacuccaucucaaaaaaaaaaguuuguaaagaguagcuuuugugauagauacuuuggcauaccaagaaauauggauguuccugucuucaaagaguguuacugagaaauacaagcuuuuuccugcccuaauuuggugagauaaauuauacauuaaccaaaaaauuaacagugggaaaugucauaugcuggcauauagcagcaguuucaaaugagcagcacaggcugggcgugguggcucagaccuguaaucccagcagcuuugggaggcuaagguaggaagauugcuugagaccaggagcuuaagaccagccuggucaacauggaaacacccuaucucuaggaaaaaaaaaaaaaaaagaauuuaguccugugugauggugcuuaccugcagucccagcuguucaggagaguaaagcaggaaggucccuugagcccaggaguucaagacugcagugagccaugacuguaccacugcacuccagccugggugacagagcaaucucuuuucuaagaaagaaagaaauaguaaauacaugaauaaaucuuuuuuuuuuuuuuuuuuuuuugagacggaguuucacucuugucacccaggcugcuggagugcaauggcacaaucucggcucaccgcaaccucugccucguggguucaagugauucuccugccucagccucccgaguagcggggauuacaggcacccagugcuaauuuuguauuuuuaguagagaugggguuucacccuguuggucacgcuggucuugaacuccugaccucaggugauccacccgccucggccucccaaagugcugggauuauggugugagccacugcgccuggccaguauaaaauuuuuuuaaaugggcagcauaaaaaguuaagugcagugaacucauaggaagagauuauugugaacugcuggggccagggaggccugaaugggagagagggccugcagccaggcccugcagcaacucggaugggaaggagucccagcuacugagacugcagcugcagaguggaggagcugcaugggcacuggcaguaguggguagggaugugggggguggaaggggagggguguguggugucacauucaaacuaucagugcuucccauuuugugcgaccccaaaccaccagauaguuuaacaguaagaucuuguagccugacauugagguuugugguuuuuccuuuaggguguaggagaaacacaaagacggaaauuguacagcuagcguguuugguaucugguucaggcagauuuauuccucuaaugguuuauuuuuuuuuuaauuuuuaauuuuuuuuuugagacagggccuggcugcaucucccacccugaaaugcaguggcgugaucuuggcucacugcaaccucugccuugcaggcucaagugauccucccaaguagcugagacuacaggcaugcaccaccacaccuggcuguuuuuuuguagagaugggguuuugccauguuacccaggcuaauuucaaacuccugagcugaagcgaccccccggccuuggccucccaaagugcugggauuacaggcaugagccacugcaccugaguuagugauuaaaaguuguuguagaagccgggcgcgguggcucacgccuguaaucccagcacuuugggaggcugaggcgggcagaucacgaggucaggagaucaagaccauccuggcuaacacggugaaaccccaucucuacuaaaaauacaaaaaauuagccgggcaugguggcgggcgccuguagucuugggaggcugaggcaggagaauggcaugaauccgggaggcggagcuugcagugagccgagauggcgcccugcacugcagccugggcaacagagugagacucuaaaaaaaaaaaaaaaaguuguuguggaaaguuuacauaaccugaaaucaaaucugcuuuuaagaaugcugucaauucaauuaauguaaucuuggcguuaugauacuaagucuugcaauucuggcuggaaauauagauuucuuauuuuuuucuuuuucccaauugugaggacuucuauauacuccucccauaaugaauauuauauuaaauccuuucaaaaauauaggcuggguguagugguuugugccuguaaucccagcacuuugggagacugaggcagacggaucacgaggucaggaguucgagaccauccuggccaacauggugaaacccugucucuacuuaaaaaagaaaaacaaaaaaacaaaaaaacacaaaaguuagccgggcaugguggugcacaccugcaaucccagcuacuugggaggcugaggcaggagaauugcuugaaccugggaggcagagguugcagugagccgagaucacgccauuucacuccagcucugggcaacagagcaagaccuucucgaggaaaaaaaaaaaaaauucugcauauuaauuggggaaaaaccaaaaagacuagaaaaaugaaacauggggaaaucauguuuaaucuuagagugaggaaggcuuuuacaaccaaaagacuaauuuccuuuuuuuuuuuuuuuugagacagagucuugcucuguugcccaggguggagugcaguggcgccaucucagcucgcugcaaacuccgucucccggguucaugccauucuccugccucagccucccaaguagcugggacuacaggcgcccaccacuacgccuggcuaauuuuuuguauuuuuaguagagacgggguuucaccguguuagccaggauggucucaaucuccugaccucgugauccucccgccucggccucccaaagugcugggauuacaggugugagccaccgcuccuggcgacuaauuuccuuaauauauaaaaagcucuuacaaaucaauaagaagaagauuuaaaauguaguagaaaaauuaucagaggauaccaacagucccuuaacaaaaaaggaaauaggaaauauuuaaaaauacgggacagugcucaguuuugcuuauaauaagagaaauguaagugaaaacugcagugaaaauuuuaucugaccaauaggcaaagauccaagaguuucaucucaacacugacuuggcaggaauguaggaugauaugcacuuuaguacauugcugugggaacguaaacugauaggaucucuguggagugugacuuggcaguaucuaccacugcuucaaauacauaaccuuaggcugggcguggugucuuacggcucuaaucccagcgcuugggaggcagaggccgggggaucacuugagcucaggaguuugagaccagccugggcaacauggugaaucccugucucuacagaaaacacaaaaauuagccggguaugguggcaugagccuguagucucagcuacucggaagguugaggugggaggaucacuugaauccggaggguugaggcugcugugagccaagaucacucuacugcacuucagccugggcgacagagugagacccagucaaaaaaaaaaagaaaaaaaaaauuagcuaggagugguaauacacggccuauagucccagcuacucaggaggcugaggugggaggaucaccugagcccgggaaggucgaggcugcagugagcugugauugugccauugugauccagccugggcaacagagugagacccugucucaaaauaguaguaacuuacaccagccaguuauugcugugguguuuccugauggugugcuuucuguuuucugccauuccuuguguuuauucauuggaauucugcugugaugaagagcugcugcuccuccucuguuuaagugugcaccgauguuugcuugauuugccgggucacagcuuacaauccauuauugucguucguuauuuugccgcacagauuguccuagauucugccacugggagcccuucuggcugggcuguguguucuccugacacaccccguccuuucucguccuucugcacaccacuggguguccuaggcuccucugugugcuccgcagggaucucugguuccuguuuuuggagagagguauucacaaaccaagaucuggcugccagguagggugaccagccguccuaguuugccaggacaaaggcuuucccugggacgugggacuuuagagugcugaaacuggaacagcuuuuggacuuugcucucuguagccuaaguggggggucaucgcgccugggcccugucacgcgucaguggacagagcugggaaauguguguguguaaauguuccgguauugauuucugcauccagucuguacacauggcaaagguugugagccuguacugaugccuguaccuccagugccgccccgcaggguuuauuccugccccuuccuuaucagugacuuuucuucaacugugaggaccccaacucaguagccacaaucagcuuuuccgcuugaucuuggcacaugcguaaaucgggcucagaccugcugacuccgcaggggacacaucuccugcccgagccuggugauggugugcuguccucugagguuaguuuuacaguaacagucaaagugcuauuuucugaagucucuuagguuaguucuucuuucagaguggugaugucaucgucacagcucugcauauuugcuguuuguauuucauuuuguguucaugugcgcccuguuuuguuuucacgguuucuuuuucuuuuucuuuuucuuuucuuuuuuuuuuuuuuucgagacagagucucacucugucgccaagucuggaguacaguggugcgaccucggcucacugcaaccuccaccuccuguguucgagcaguccuuccaccucggccucccgaguagcugauaacuagaagugcgccaccacgucuggcuaaguaaugguuuguuuuuugaguaugagaaaccugaccaugguucuaagagagacauacgaaaagauguauguggaagugucauguucccucagcucugccagcccucuccccuucccgcuuucuuugcauucucuguacauaugcugguuggggguugaauugugucuccccacgaaagauguugaagucccagcucucaguaccugugaaugugaccauauuuggaaauagggucuuugcaggugaucaaguuaagaugaguucacuugggugggcccuaauccaguaugacuguguccuuauaaaauggggacauuugaacagacagacauguguagagggagaagggcagacguccugaagggaagacacagggagaagaugaccacccacaagccaagcaacgccagaggcugcagaggcuggaagaggcgcaaacagacccucccucccagccucaggaggaaccagcccuaguggcaccuugaucuuggacuucuugcuuccaggacugugagagaauaagugucuguuacuguaagcuaccggguuugugccacggggaguuuaauacacaccuccuguagguaaccaagcugugggguuugaaggccggguacaguggcucauaccugucauccuagugcuuuaagaggccaaagugggaggauuacuugaguccaggaguucaagaccaggcugggcaacaaagagaaaccuugucucuauuuuuauucuuuuuuaaaaagaggccagguaugguggcucacgucuguaaucccagcacuuugggaggccaaggugggcagaucacuugaggucaggaguuggagaccagccuggccaacauggugaaaccaugucucuuuuaaaaauaaaagccaggcaugguggugcgugccuguaaucccagcuacuagggaggcugaggcaggagaaucgccugaacccaggaggcagagguugcagugagcugagaucaugccccugcacuccagccuggaugacagagcgagacucugucucaaaaaaaaaaagagaaagauacguucgcguccucaucccugguacuugugagugugagcuuauuugggucauuucagauguaucagguugugaugaggucacacugcauggggguggggccuaacuccaguauuccugguauccguauaagaagagggaaaucuggacacagccaggacucacauagagaagagcuugccaugugacaagagacagagccuggagggucugcaaagcaugaaacaccaaggaugccggcuacugccagaagcuggggagaggugcgggauggacucucccucggcaccuccagugggaagcaccgcugcccagaaccugggaccuuuuuuuuuuuuuuuuugagacagagucucgcugucucacccagccugaagugcagaagugcgguagugugaucuuggcucacuacagccucaacauccugggcucaagugaucuucccaccucagccucacaaguagcugggacuacaggugcacaccacuacaccuggcuaguuuuuguguuuuuugcagagauggagucucacuuucuugcccaggcuggucuuaaaccccugggcucaagcgauucuccugccuuggccucccaaagugcugggauuacaggugugagguugugugccuggcucagaacuguggaccuuuuugaaacugccuaguuuguggugcuguguuucaguaguccuaggaaacaaaauacacagucacaucaguuucugguuuauccuuuuuguguuucuuuuacacaaauggugagaaacacugauaugcucugugggcagguguuggcacuuggacacuucccuccugugcccccagggcuggcugugcuuuggaaggaggcacagagacuucagcacccugguuugauguagacuguucgcgaacuccucuaaugccaaauaccauuuaauuccagaagaaaugucccgggauuuuuuuuuuuuuuuuaacuguacgaauaaagugaacaaugcaauuacaugggcccaaauaacuggauguuuacaugguuuggaauuugaauacuuucugaauugugguagauguuuuuaagguaucugcauagagauaaagacaggcuaggguuggccgggcaugguggcucacgccuguaaucccagcacuuugggaggccuagguggguggaucaccugaggucaauaguucgagagcagccugaccaauaaggugaaaccucgucucuacuaaaaauacaaaaauuaggcaugguggcuggugccuguagucccagcuacuuuggaggcugagacaggagaaucgcuugaacccagaagauggagguugcagugagccgagaucacugcacuccagccugggcgacagagcgagacuccaucucaaaaaaaaacaaaaacaaaaggccagguuugugcuguuuguaaguccaggaauaagccuaaagaauaggcaaguuuuggcugggcacgguggcucaugccuguaauccuagcacuuugggaggcugaggugggcagaucgccugaggucaagaguucgagaccagccuggccaacauggugaaacccugucucuacuaaaacuacaaaaauuagcugggugugguggcaggcgccuguaaacccagcuacucgggaggcugaggcaggagaaucgcuugaacccgggagguggagguugcaaugagccgagauugcaccauugcacugcagccugggcaacaagagugagacuucaucucaaaaaaaaaaaaaaaaaaaaggcaaguuuuuguaccuuuuaggaguaugaaaguugauauguuaauuuuuuuuuuuuuuugagacagaauguugcucugucacccagccuguagugcagcggcacgaucucggcucacugcaaccuccacuucccaaguucaagccauuccccugccucagucucccgaguagcugggauuacaggugccugccaccaugcccggcuaacuuuuguauuuuuaguacagaugggguuucuccauguuggccaggcuggucucgaacuccugaccucaugugauccgccuaccucagccucccaaagugcuggguuuacgggcgugagccaccgcaccccuggcugauaugcugauuuuuaaaaccuugauuccuggauauucuguugucuuuccuuucuacuuguuacaaauuugugaagaacaggagaggcucccaguuagaugcgguucauuuaggcuuagacuuugacacggcguggcuggcuggccacauauccuugacaccaucacguauugcaaaucuacugaccaaggcaggguccugguauguggucccuggggucaguggguguugguguugggucgguccaguccuguguuggagugaaagugucugguuucugggccugcgucggugaacugcgugcggcuggggacacauuggcugcuuuccucccucgcugggcucugccggcaacuuucucagcccacuggacugagcaggaaguuacagaagacaagucuccuucuuaguuagaagguagaacccaucgucagcuguuuuucaguuuuuaaaguacacaaauuuuuuuuaaaaaaucuguuuuggaugaaaaagcaaugggaaagaaucaacuuuuagaagaugagacaguuucagaauauuaacauuuaaauauuuggaucccuuuugggaggauuuuuuuuuugcuugacugucaagagcaaagaaguguggcccaucgggggcuucugcaggggcugcgagggucgagacagguuucaguuugguagguugaugcgaggugucacccgugaggcgaaugugggaagugcugucagcaggcaucugccagcugggcaugguggcucacgccugucaucccagcucuuuguaaggccaaggcgggaagaugguuucagcccaggaguucgagaccagucuuggcaacauagcaaaaccccauuucuacaaaaaauuuuuuaaaaaauuaugggggcaugguggucugugccuguggucccagcuacucgugaggcggaggcaggagcauugccugaguccaggagguuggggcugcagugagcugugaucgcagugacagagcgagacccccucugaaaagaaggcagcagcccacccccuccaguuucgcuucugcgguucugagaagacacaguaucuuacacugaugacaucugugagggcuccuugccaaaaccacacccugacacuguggcauuugguccuguggauuucucuuucagcaacagcccgacuuagagauguccacgcuagcuucugcuagacacccuugaugggacgaauuaccauauuguuucucgugucuuccuaauucucauucuuucugcauauuugucuuuucaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguagccuuggcucgugcuuuggucugggagggcuuuuugguucacugcugugcguaaaggggcauuuucaggguggaggcagugauugguagagccaccgccuuaggugugaaaucagaaggucuuggcuguagggagugcugcgcccuccauuucugucccagcgagggacuucugccagugucgggugugucuugcccccucugguggccacccgugaguuugccguccggcaccuccccugaguggugauucauggcacaucugcuaauaaucauggaagcgggaggggaaacucagcauuggcccagucugcgcaggaccgaauucuggagcugucuuuucauucccucugaaguauaaaaaagcagucuuuggagccaguccugaaguggcuccauuucuggcuuuuaagugggucgacaagaguagaaucuuugaaguuaaaaagagaagugagguuuucuuguuauuuugauuucuaacuaauuaauuuggaaaccgcuuuuuugaagaauauaguccaggcacaguggcucacacuuguaaucccagcacuuugggaggccgaggcaggaggauugcuugaggccaaguggucgagaccaaccugggcaagauagacccuuucucuacagaaaaaaauuaaaaaguuagccaggcaugguagcacacaccagugguuccagguacuugagaggcugaggcaggagaaucgguugagcccaggaaguugaggcugcagugagcacgauccugccacugcauagcagccugggcaacagagccagauccugccucuaaaaaaaaaagaaagaacauauaaucugguucuuagaggcaguccaguucucguaaccaugcacauugggaaaccaggcucagcauucccucgacauagcccgaggcaugucuggccucagcagugggaggauuuguccugcccugagaccuccuuucugagagacuuuuuguuuuguuuuguuuugagacagggucuuucucugucacccaggccgagugcuguagugcaaucauggcucacugaagccucgaccucccuggcucaagugauccucccaccucagcccccugagucacugggaccacaagugugugccaccaccgucagcuacuuuguguauuuuuuguagagauggcgggaucccucuguguugcccaggcuggucuugagcuccugggcuuaagugauucuccugccuuggccucccaaagugcugggauuacaggcaugagccauggugcccagccagacuuuguuucugucugcuucuuucuuuuuguucaugaucuuaaaugugugggaggccgaggcgggccaaucaugaggucaggagaucgaggcuauccuggcuaacaugguaaaaccccgucucuacuaaaacuacaaaaaauuagccgggcgugguggcaggcaccuguagucccagcuacucgggaggcugaggcaagagaauggcgugaacccgggaggcagagcuugcagugagccgagaucgugccacuguacuccagccugggugacagagcgagacuccgucucaaaaaaaaaaaaaaaaaaaaguuuaaaacucauaaacuuaagcuuucuuuggaaugugacguagcguauucuugcacaaaaauagaaguuaaacuuuguugguugugucuguguuucauuacuagguuccacuuccaaacaugaguuccaggccgagacaaagaagcuuuuggacauuguugcccggucccuguacucagaaaaagaggugcguucccugcuaaccaugcccgaugcuagcaaaguuucuuuucacaaagcugguuuuuaugccauucuggagaauugccagauaauauauuagcugugagaaagcauuaaacuuuggacagguccucaucuuaagcuaccagugagaggaguuuuaccagaaucuguuuugguuuccuggauaaguguauccagaugguucuuugggcuggaucaacucugggaauuaauugaauuuugccaauaauuuuaaaaguucccgaaauacaggccuggugugguggcucaugccugggaacucagugcuuugggaggucgaggcaggaggaucacuugagcccaggaguuugagaccagccuggucaacacagcaagacuccgucucuacaaaaaauuuaaaaaauuagccagcuaugggggcacugaccuguggucccagcuacucaggaggcuggggugggaggaugacuugagccuggcagacuuuggggcugcagugagccaugauuguguuacuacacugaccugcacaacagaguaagacccucucuccaaaaaaaaagucccccaaauccuagcgugcagcucugcugaauuccgucucuguggagcuuuggauacgcucugaggccccuuugccuggugggacuaccugcaggucuuggcggcuuuggcugccggaggaagaagguuccccaguccuguguguauggagcagggaggaguuacugaggaaauuaaaacgcauuuggggccaggugcggugacccacaccuguaaucccggcacuuuaggaggccaagguaggaggauugugugaguccaggagucugagaccagccuaggcaacgugaagagaccccaucucuauuaaaaaaaaccccgcaaaacucauuuggggugacaggacaaggaaaaagaaagaugaaggccaccaucguugacaugcugauuauugcuggaaggcaaaggagaguccugaagaaaguuuguaaagcagcagauuucaaagcucagagggccuucuaggagcuguuuccggguuucguacugaugagugcugcauuccugacucccagugaccuccagcuuccgcccagaucagccaccgcuuccucuucaccuaugugcucuugcggacuuaauuuuucuauuuuuaauuguguggguuuuuguuuuuuuuuuuuuugguuuuuuaauuuuuuggaacagggucugggucugacgcccaggcuggagugcagugguaugaucucggcucgcugcaaccuccgccuccugagcucaagccauccuuccuccucagccucuggcugauauuuguauuuuuuuguagagacggaguuuugccguguugcccaggcuggucuugaacuccugggcugaggugaucugccuguuucagccucccaaagugcugagaucacaggugugagccaccacacccggccucucucacugauuuuaaauggaaggucuguuugaggucagugugcuuuucagcuccugagggacagcugggcccugaggccuguuuuucuccgggugugguagaccugguguuuggugguccccacuagaugagaugaagcuagggaaccuguuuuuguggaguaggaguguauuaguccauuuucacguugcugauaaagacauaccugagacugggcaauuuaccaaagaaggagcuuuaauuggacuuacaccuccauguggcuggggaagucucacagucaugguggaaggcaaggaggaacaagucccgucuuacauggaugacagcaggcaaagagagaaugagcaagacacaaaagcagaaaccccaaaaaacugucagaucucaugagacuuacucacuaccacgagaacaguacuggggaaacggcccccaugauucacuuaucucccaccagguccuucccacaacacgugggaauuaugggaguacaauucaaggugagauuuucguggggacacagccaaaccauaucaaggagaaauggauguuugagugauaugccgucaucccugugcaggaguugggaaagaaauuguuccucgcaggccucuuuuguuuguuuuuuugagacagagucucucucugucggggcuggagugcaguggugccaucucggcucacugcaaccuccgccuuguggguugaagcgauucuccugccucagccuccugaguagcugggauuacagguguguuccaucacgcccagcuaauuuuaauauuuuuaguagagacuggguuuugccauguuggccaugcuggucuugagcuccugaccucaagugauccaccugcuucagccucccaaagugccuggauuacaagcaugagcccccaaccccagccagagggcucuucuuaaaguuauaauuaacagauggacacguaacuucaggcuugauuaaaaauccugaaaagggccaggcaccguggcucacgucuguaaucccaacacuuugggaggcggaggcacaacgaucacuugagccugggagaucaagaccagccugggcaacauagcgagacccugugucuauaaaaauuuuaaaacaauuagcuggguguggugcaugccugugggcccagcuacuuaggaggcugaggugggaggauugcuuggguccaggagguuaaagcugcaauaagccgugauugcagccuccagccugagugacagagugagacucucaaagaaauccugaaaggaaagucagcaccuucagucacuuugugaccggcccagaggaacugccuuugacuaaagcagaaacucuuuaugcuuugagaauugacuauucuccucuaccuuuuaacaguuauuggaagugcagcugaccagauagauccugcaggaugaguguccuucauugucugugccucccauuucuauuccuguagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccagguaccucccucaguguccaggcguguggcaggcccggccaugcagcaaggacaggauccgccuucuagugaugucucgggucccagggacguacuggccguccguaccaccaggauaacucuggcuauaauuuaguguuacaguagcacucauucauuauagaaaauuuuggaaaagcagguaagcagaaaagaagaaaauuugaaaucaccccaucauccagcaauaacuacugguaacaucuuagcauauggccacacaggguuuugguauaugcagguauuaacauaucuaaacauaucuuauuuuuaauguacucuuuucauauuuuuaacugcguuuuccccucaaaaugccgacgaagcagugcuguggcugcugcuguagccuuguggaaauuuuaaggcugaaaaguuaggccaaagaggaucagguaggggcccugagagacauugcauccaaagacagcugccucaggaccugucaucccagggucacggcgucauugcgggggugucugucucuguggagagguggacagacuggccucggugggaucugaguauucccuuuuagggugcuggcuugcucugaaggucaugccacauaaaugaaugcaggcacgcgugaaugaauggacuugugaagggauggcuguuuuaauuaaaggaggggcuuuugugaggugucagcuuuacgcacucccucuuggguuuagagaauccagacugagccccgugguacgugccagcuguuugucauagcccuuggucauaaggauuggguggggaguggguuucuucucucccugccuuugcugagcuggccuggcuguggaaugggcccugugggcagggcugcagcgcccugugcuuuccuccuguuuucagcacagagguuccuugcagaugauugaaaauggaugugcuggggcaaggggucauggggacaugauucuuggucuuuagcagaggggccaguccucaugugccaguacuuccugguacuaagaccauuuauguuacaauaaugauuuuugguuuugucuuuugucuucuuuuuucuuaaagaacaguucuagauuuacagaaaauuugagcagguaauuuagagcuccauuauauccuuugggacccaguuuuucuauucucaauagccgaugggagcgucaugguccauuuguuucaucuuuuuuccuuuuuuuuggagacagaguguggcugugucgcccaggcuggagugcaguagugugaucucagcucacugcagccuccgccucccagguccaagcaacucucgugccucagcuuccugaguagcugggauuacggaugugugccaugaugcccaacuaauuuuuguauuuuuaguagagaugggguuucaccacguuggccaggcugggcuugaacuccugcccucaagugaucugcccgccuuggccucccaaguguuagauuacaggcaugagccaccauacccagcccauuuauuacaauuaauuaacuaauauugauagauuauucuuaccuaaaguuuuagaaaaggaagcuuucuuguggggucucagagguauuaugccauuccaucucaucuacugauaucucagcuacauugcuuuuuguuauuuuuaggggauuuucuagggaauaaaauaugcagccuuaauuuaucacugucuagcuugaauugauauuuaacacuucauuguaagaaucuuacaacaguaucauuccgguggcaaaaucaucuuuuucuuuugaugucaaauauuuuauguauauaccuguuguaaacccucacaaauuccuuuuuauuuuuguuugagacagagucucauuuuauugccuaggcuggagugcagugguaugaucucaccucacugcagugaggccucugccccccggauuuaagugauucuccugccucagccccccaaguagcuggguuuacaggcacaugccaccacacccggcuaauuuuuguauuuuuaguagagaugggguuucaccauguuggucaggcuggucucaaacuccugaccucaagugaucugacugccuuggccucccaaagugcugggauuacaggcgggagccaccgcgccuagucucaccauuuccuuuuaaaaucacauugugcgggucgccuggcaacagaugauuucugucuacaucugaaaaaucuauaguuuuuuuuuuuuuuuaguaaauauuuuagaacagauuucaauuuucagaaaaauuuuaaagauaguacagcguugccaucuacuccaacacccagcuucccuuaugauugaaaccuuauggccgggugcaguggcucacgcuuguaaucccagcacuuugagaggccaaggugggcggaucaccugaggucaggaguucaagaccagccuggccagcacggugaaaccccaucucuaauaaaaauacaaaaauuagccagaugugguggugugcaccuguaaucccagcugcucaggaggcugaggcaggagaauugcuugaacccgggaggcggagguuguggugagcugagaucgcgccauugcacucuagcuugggcaacaagagugaaacucgucucaaaaaaaaaaaaaaagaaauguuaguauauuacauugguuacaguuaaucaaccgguauggauauauuauucuuaacacaagucuauucagguuuccuuaguuuuuaccucauguccuuuuucucucccagcaucccacaugacauuuaguuguccuggccccuuagcuccucuuggcugugacaguuucucagacuuuccuuguuuuugaugaccgggaagauuuuuuuuuuugaaaugggguuuugcucuuguugcccacgcuggagugcaguggugugauuucagcucacugcaaccuccgccucccggguucaagcaauucucuugccuucagucucucgaguagcugggauuacagguaugugccaccaugccuggcuaauuuuguauuuuuaauagagacagaguuucuccaugucggucaggcugaucuuaaacucccggccucgugugaucugccugccucggccucccaaagugcugggauuauaggcaugagcuaccgcacccagccugaccuggaagguuuuuauguuuguuuagagucaggaucuucuuccgucuccagguuggggugcauuggugcuaucaggguucgcugcagccuugaccuccugggcucaagugaucuaccacaucagcccccuguagcuagggccacaggcacaugccaccaugccuggcuaacuuuaaaaaaauuauuuuuuuugccaggcaugguggcucacgccuguaauccuagcacuuugggaggccguggcgggcagauugucugagcucaggaguucaagaccagccugggcaacguggugaaacccugucucugcugaaaauacaaaagaaauuagcuggguguggcagcgugugccgguagucccagcuacucgggaggcugaggcaggagaauugcuugaacucgggaggcggaaggugcagugagcggagaucacaccacugcacuccagcacucuagccugcgugacagagcgagaaauuuuuuuuuuuuuuuuuuuguagaggcagggucuugcuuuguggcccaggcuggugucaaacuccugggcucaagcaauuuucccaccuugaccuuccaaagugcugggauuacagaugugagcuguuguguccagcccuauguuuucuucuagagguuuuauagcuuuagcucuuauauuuagaucuaugauccauuucaaguuaauuuuuguguauggugugagguagggcuugagguuuauguuuuguuuauggguguacaguuguuucaguacuaucuguuaauagaccuaucaucccccauugaauuaccuuggaaucuuugucaaaaaucaaguaauacacucucugugcaucucuguuccugugcucuguuugguucuuucauccaugugucgauccuuaaaugcccacaucgcacugucuuaauuauuguagcuuuauaggaagucuuaaaauuagguauuuuaaauucuccaacuucguucuucaaaauauuuugaaaauuuucuaaguucuuuguauuuccauauacauuuuagaaucggcuugucauuuucuacaaaaccugugaggauuuagacugggauugcagugcagaucaguuugggaaaaaauaaaaauaaauugaaaauaggagcuauuaguugcauuuuuuccuuuaccuuggucuaacauuaaccuuucccuuaaggacucuauuuaaguuucugauguauuaaacacuuaaaugaaacuuauauuuaaugacugauaucaacuagauacuaauuuuaaguaguuuuuuauucauaauuauuacaugaucuacaauaaaugaaucaggcuggauuuuggacuauucaaaccggcaccucagaaauaauugcccagaagccucuuggugccauguuucuuguuggcugcuggggcccgugaaacaugcacacaugugugcacugcaguaacugguggugaugugguuuuggcacccauucugccugugcugccuacaaugggaaggcugacagcuggccagucucccuggccugcugcuugcuguggauuauuugcugaguggcacugaccacccuugcuuugccaauggagacagcacuggcgccuggugcuagugggcucccauggcuccugcaggcuguccuggagaggaagucuuuagaaaggaacuuccuagaaggaaguucagaaaacuguuucugagggccuuugucccaauucauagauguggaggcuuggagugagcucuuuuauuuaagguggucugcacaucauagcagagcaagcuggggcuguggcuacauuaugggcauguugagcgaggaucugcagaugggagucugacugggcuuugaggaaggaggagcccauggucaguaaggccuuguguguucaccagcgcguuggucuguauugugauucaggcugcuauagccgaauaccuuagacugggcaauuuauaaacaacagaacccuauugcuuacaguucuagaggcugggagguccaagagcaaggggccagcagauugggcaucuggcgagggcccuuugacucaggcagugccucuugcaucuucauacagaagguggaaggggcaggcaagcucccucaagccuguuuucuaagggcccuacucccauucaugagaguggagccgucgugacuugaucaccuccccaaggccccccucccagugccauccccuugggacuuaggucuuaauauauggauuugggugacacuggcacucagagcagagcagcugcaacaggauaggccagauagaggcuccaacgcaagggcucugccuucccgcaggagaggcgucugugcccgcuguucccauggugguagggugggaguaggugccgcgugcagagcugcguucccaacaccugcuuccugguguccucagucagaucauucugcuggauugagagagccaccagaggggaucacuguuccccagaaccacagccagggagaaggcgugggggccacaucuugauggugggagagcugugcuuuuccuaauugcugguguaauauuuucuuuucggaaugguuuuuaacaaacaaagcaacuuucugcugucccuuccuguuuucucuggugaggccaagcugcuaugacuagaauuagucuuuucguuuuuucuuuuuuuuuuuuugagauggagucucacucugucacccaggcuggagugcaguggcgcaaucucaguucacugcagucucugccuccuggguucacugggcucaagcaauuuuccugccucagccuccgaguagcuggaaccacaggugcucgccaucaugccuggcuaauuucuuuuuuaguagagaugggguuuuaccauguuggccaggcuggucuugaacuccuggccucaagugauccgccugccuuggccucccauagugcugggauuacaggcaugaaccaucacucccggccccuagaauuagucuuuucugaugagcaucuggugcuaccuggcugggcccugucuggccaaugucauugacaccacuugagucccugggacugcuggugcacucacccggcuccccaggugcugggggcuuggcacuuagugcgucucucuccucaggauacugguaucgggaugacacaggaagagcugguguccaaccuggggacgauugccagaucggggucaaagguaagcguggggcccccacacagccucccccuuccccucagggugcaaggaucccuccaguagggguggcccugggugccagauuaaguaagaacguugucaguugcaugccacgcaguggguacugugggaacaccucaugacaugacagccaucccucaguaucuggggguuggucccucaguaucuagggguugguuucaggaccccccuuggauagcaaagucugcagaugcuccagucccggauuaaauuggugccguauauuguagacacaucuucuuguaugcuuuagauggucucuagguuaguuauaauaccugauagaauguaaaugcuagauauagauauaacauaguuauguuuuuuauacuacuuuuuaucauuguguuguuuuuuauuuuuuuucugaguauuuucgauccuuggcugguugaaucugcaaauguggaacccguagauaggaggaccaacuguauuggcucacugcaaccucugccucccgguucaagcaacucuccugccucagccucccaaguagcugggauuacaggcacgagccaccacgccuggccaauuuuuuguaucuuuaguagagacgggguuucaccauguuggccgggcuauccuccagccucagccuccugaggcgugacuacaggugcacgucacuaugcccagacccacagagcaguucugaccagaaccaucaaacccacagacgccgcaucccaagcccguucucaucacggcgcugugugagaggggacugaucccucugacccucucugcgucaagcccacaaggcucagggaaucgacuuugcagaaaagugcugugaggcagagcaacacauuuggacucagaccaacagccugggaaccuccagcggucgcccuuuuccagcucugggcaaagcacuuacuucagucuccucaucuguaagaugaaaacacuaggucgggugcgguggcucacgccuguaaccccaguacuuugggaggccgaggcagguggaucacgaggucaggagauggagaccauccuggcuaacacggugaaaccccgucucuacuaaaaauacaaaaauuagcugggcgugguggugguaccugucaucccagcuacucgggaggcugaggcgggagaaucacuugaacccgggaggcagagguugcagugagcugagaucacgccaccgcgcuccagccugcgcgacagagcgacacuccaucucaaaaacaacaacaacaacaacaacaaacaaaaaacccacccuaacugugacuugacccccacguuacgucuuuuguuguauuucucucgagguuggucugcuguccuguguagcggccaccagcugcauguggcaguuuaaauguaaaugcauucaaauuaaauaaaaggggacauugugcuccucagcugcacaggccacauugcaggugcucggcaggcugucgcauugcaccuggcagaacguuccuguuguuggagaaaguuccaucggacaacgugggccagggcagugggcguguguauuuuacuugacuuuggccuuaggaccuuuggcaguauuauaguagaaaaaugaagugcugugcggugcuuacagacgcaugcgcgugauuucuacucuuuuucccacaaaguguagaguccaggagacuugaauauggaagccaguuuggagccucuccucacuccuggccuuccuauggaaggagcuuauucaagggaaagagcuuauucaagcugcucuuuccccacccccaggugugacccacaggccuccaccugucugggacaggcaggacugugagcuuugggaaucaaauggaaaacacacuugucccacugcugccagcugguuguccuagggcuaaugugucaccucucugugacuuagcucuucacguguagaaugggguggaaaaguacucgguguggcuguuuucaggaugaaggggucuuagcggugcucgcagaagagccacgguguugggagugucugcucucuggaggggaggcugccucacuaacuggccucugccccacaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugggugagugacgaaugucgccugacaggcagcucaaagcugagcuggagcccuuagcauggaguuuggaaagggauggacucagaaaacguacacaggcauuuucugggcuuuuuauaugaaaucugacucucccauuuuggggaguuagugacuuuuguggcuccagguggccuauggcaccugucuggucccaugugguuggucaccaccacugcgcucgggaaggcagguccggcccgcgcugagcuccuuucucaguggcugagcugcaggacuggccugucgccugguggacacuaugcagccuccugugaccgaccuucugcaagagcucauucugcuuccucccagcccuggcauuuccuggcuuugucuccccagcccacuucugccucuauagggugaggagccugcugggggcuuuuuuuuuuuuuuuuuccuuugggacggaguuuuacucuuguugccuaggcuggagugcaauggcacaaucuuggcucacugccaccuccgccucccagguucaagcaauuggccugccucagccuccugaguagcugggacuacaggcgcaugccaccacgcccagcuaauuuuguauuuuuaguagagacaggguuucuccauguuggucagacuggucucgaaccccgaccucaggugaucugcccgucuuggccucccaaagugcugggauuauagacgugagccaccacgccuggcuccgagggcuuuuuagcaggugagccgcuuccagccagccgaggcguccucccuccgugaugccauuucugcuccacagugugugcacugugcucagcuugacuccccacucucccaaaacuaacauuccuguuuaauuccaugggagcggggcucagaguaaacuuaggccaaggcaucaacauggcccugccgggggauuccccccuccugugcuucggagaugguuuucugcucuucuuagggggcgccugucccccuggccuuuguuuuugccccugggcaucuggcacccgauuuggagcugggccagucccccacagugccccaggccugcuuuugggguaagcccagaagcuucuucgaagcccagggucgguggaggacccccgcccccccgccccccgcccgagggaaccaggagaacucugccgccugcgacaggcucaucguuccugaugggcaugugauggccugaguggugcgcuggggucagaaauggggcauuugagguguguuguguguuguuugggcucugccuaugaaacccucgggaaccgcuggagucccaugcaggguaugucccagugucacauccaccuggcuuuuccuuucuuugccugccuuaguucuggaguguuugaaaucgccgaagcuucgggaguuagaaccgggacaaaaaucaucauccaccugaaauccgacugcaaggaguuuuccagcgaggcccgggugcgaggugagcgggagcccgggcccaggcucacucugggauccauguguggccuggaggccaccaggucagcaggcauuuucccugguucuaccugcacguagggugcacaggcagagccgugaagggccgagccgcugcgggacugggaggggggcugcccgccagggcugcguagcaucgagcuccugcugggacugggaggaagcuggccuggcugaggcggaccuccuccuccuuccucugcguggcccuuggccuuuagugcaccuggggguuuggcgcaguccugucccaggaugugggcguggccuucccucuuuguguccugcuggacacucagggaggcccugaguacccccaggagucagcccagaaagccauguuccagccacaagcugacauugcagucucgcagcagccggggccuccacagcucugguucucacgugggcuccgcugcugcccccgugagacuggggggaggacagguguccccacugugcccuguuucuguaccugugaaguguacacagcauggaggacccuucccagcaggcuggcgcucauccuggagcugcugcaaagcuugcguuuccacaagcauuguagaugcagugugguuuuucuuuugucccuuccagaugugguaacgaaguacagcaacuucgucagcuuccccuuguacuugaauggaaggcggaugaacaccuugcaggugagcccugaguuccucuagggacuggucaaacauggagacaaaucuguacguuucagggcagcggagaagagaugagcccaggggaugcggcccagagucacagggcgagcugcucuguggagaugagaccuggguguggggaugagacaggggcccagcucuaccacagcccugccccugugcaccgggcagccggggucaggggucaggguucacugaggcguaacgcccaucccagcuggcucaccacaucagugugcagccaugguguucagugcagccacagagcugugcagccaccccgcaucaauuccagaacaucccaucaccccaaaaagcagcccuuuccccacugccccucccccagucccagcagccacggucuccuuucuguccauugugcugccuguuccagacguuucuccuggauggagucacacggcaugcuguccucagugacugacuucccccucgcggcucagcugcggugcagcgugggucgucaucgcucucacggcccacacuguauucgucagcucgccccugcugggcagcgucauccucucccacaggcccccucaggucccggcugguccuccugacauguuguccugaggagcuccugccccagagccuugugugucuccccugcacuacccggcauagcccagcgguggggcuggagaggggucuacgccugagaccaccgcccgucugucccaggagccuguccagggccaggcgcugcacuggcucaggccugcacggugguggagaagacgugcguggugaacacgacgcccuccccgccgaucuccguuuccaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacauggugaggcacuguggcagucccacggcccucagggugacucuguuguccccuguggcaucagcucugcagaugucacaugauuaacauggcagugugagggcaugaaaaacauagguagugcugggugugguggcucacgccuguuaucccagcacuuugggaggcugaggaggguggaucaccugagcccaggaguugcagaccaggcuggccaacauagugagaccccaucucugaaaaaaaagaaaaaaagaacagaugccucuggguggguaaccacagagguuuccucugucucaggggucacacauggcgagggaaggauugaugggcaucucagugcaggcugggguggaggcuuguggacuggggugugccuggggagggcccucagagccuacaucaucugcuguggaucaguggaugcuguccugccaggcgcucugggaagggccuguggucuugccucuccguuggccucucugugugcuuccuccacacccuccaccuccccugguuuccuuuaccacauugaaguucccgcaaauccugccguaaggagaccuauucggggcugagagccagcccguccugcccccaggcucuucuguccuuggcugccuggaaacucuccuaauguccugcacagcuggcauccaucuuggaaagagccagccagguguggccuccaggggcuuguuagagucucaggccccacccagggcuccugcgugggagcccacauuuuaauaagaucuccccgcauuuuaaccggaucccccccauuuuaaccaggucgccccacauuuuaaccaggucucccaacauuugaacuagauacccgccgcauuuuaaccagaucccgugaugaggugugggucccgguucgggaaguaccaguguggagcagguguuggcaggcacguuccacgagggccagacaggagcuggucccagcguuucgggcccggugucuuucguagccacuaacccugccgggugaggaagcagcacugcccugcugcccucugagcacacagggccgggucccaugagcugcguagacacugaaauuugaguuucaucuucacgucucaugagaucauccuuuuugaaaucuuuccucaacuguuugaaaguguaaaaaccacucuuaggcuacacagagguaggcagugagcuggaucuggucggagggcucuuugcugaucccugaccuguagcaagguuuggcuguguucaguguguucagggguacgugcaagguucacucucuuguguccuccuuagggggugggcuggggagggcggcagcugccagagaaggccuucagccccugcagagccacaguguggggcaucguggggccccugcacugggcuucaacucagagcagacgcugggggagggcgaggcgggagugggcucuggauucaucguguccgcccccaccucccagccagggccugccuggggagggucagugcugcaugauggcguguucuccucacccccagaaaccguccauguuugaugugagccgggagcugggcuccagcguugcacuguacagccgcaaaguccucauccagaccaaggccacggacauccugcccaaguggcugcgcuucauccgagguacgcugcucagaguccgugagcagugcccccguggcccagugucgcccgcugcaucugugagggaccgugcugauuccauucucagcagcccucugcagcgagagcaccgccgucggccugcgcugccugugugucagucgcguuuacagaccccgggagcugccccaccucccuacgcacaugacugaucuggggggagcacugggguguucagauugaggucuuuccauauguagggauacugaguuucagauugauaugugaguuguguuacguuugagugagauuauaguuuaagaaagacuucaguauuuaagccuugguacacagaggugcgaaccaucccugauagaguuuuguuuguuuguuuuuugagacgagucuugcucugucacccaggcuggagugcgguggugcaaucguggcucacugcaaccuccuuaagugauucuccugccuuagccucccgaguagcugggauuacaggcgcccgccaccacacccggcuaauuuuuguauuuuuaguagagaugggguuucaccauaauugccgggcuggucucgaacuccugaccucaugauccgcccaccucggccucccaaagcgcugggauuacaggcgucagacacugugcccagccagaguugugauuuuuaacauaaagcccaggcugucauuuuccgaguguuaccccgaggcugucccggccacccacagcccaggucacuguucugggagguggcaggacguagaggaagcuccggcagugccgccucccugcuucccucuuagcacacgugcuggguugaaggccaggccugaagacaaagggcagguuaauggggaauguugggugguguggagggccgcagccccgggagaagcugacugccgugucucccaggugugguggacagugaggacauuccccugaaccucagccgggagcugcugcaggagagcgcacucaucaggugagccucgggccgcggggagaggacccugcuggggacaaggccccuaccugcuccuuugcccccagagggcccuagccguggcccauggagcugagagcagagguggucggggaagcccggccugcacaugggggcccucaggagccuuccaggugcuggccuggccucugaagcuugugguccagaagaagguggggguggcuggucauggcugaggcuggagucuggauagggggaggggccgcagagccagaccugcccaccugugccccaggguugugacugcagcccugcagcaggccagcccuguguggaggggacuccagugugcuggcuccagguucuccaucaguagcuaucacuuccccacucuggccccaggcucaccaaauagucuuuauucaaaaccucgcuuacuggcuuuuuuuccccuaaugcaaguaguauuuccuuacuagagcacauucaagugaccugugcucucaccuagagaugacugcuguugaugguuuagggugggguagauuggcagccacauagggcagguuucagagggagccuguggggugaggauucagcuggaauuuggagcccuggaggucucucaagagcccaccacgugcagcaugccauggaacgggccuuguuggagcccccaacgugccugcaguguuucucugcccaccgguuucucuccaguguugaaauggaagcagauccucggaaaaaggaugagucuggguaauugguguguguuggggcugcgcugugggcauggcgagaggcccacaccgagaggcacugguccucagagauucuguccugugccgcgggcaggagcaggucuggggagauggugggcagugugguuuccugccugguggguccaugcccagcccugcgaggucacauggccugccggugauauccuccugccucaccuucagaggcagaaagccauggagauuuuuuucuuuuuucaaccaagcaagccgcagugauguuuuauugguugacugauagggucuuucuuguuguccagguuggaaugcaguggugugaucacagcucacugcagccucaaccucuugggcucaagcaauccuuccaccucagccucccaaguagcugggacuacaagugugagcuaccaugccuggcuaauuuuuuuguauuuuuuuguagaguugggaucucacuauguugcccaggcugaucuugaacuccugggcucaagcgauccuuuggccucagccucccaaagugcugggauuccaggcaugagccacugcaccuggccacuuagauuuuuuuuuuuuuuuuuuuuuuuuuuuuugagacggagucuugcucugucgcccaggcuggagugcaguggcgcagucucggcucacugcaaccuucgccuccuagguucacgccauucuccugucucagccucccgucucagcugggacuacaggugccugccaccaugcccggcugauuuuuuauaucuuuaguagagacaggguuucaccguguuagccaggauggucucgaucuccugacuucgugauccgccugccuuggccucccaaagugcugggauuacggguuugagccacugcgcccggccuguuuuuguuuuucaugcaauugaauucauauugcuuauacuguuuccuuuuuucuaccuaguuuauuugcaccacuucccauguuguuuuuuggaagcacuuuuaauugcuacaucaugggacaucacagggauguaccauaguuuacugaucccgucccucggggcugcacagcugggcugucucaguguuucugcaguuaugacacugcagugcauguuuaucuuuguucugaaaucuuuuuuuuuuuuuuuuuuuuuuuuuuuugagacggagucuuggucuguugcccaggcuggagugcaguggcacgaucucggcucacugcaagcuccgccucccggguucaugccauucuccugucucagccucccgaguagcugggauacaggcacccaccaccacgcccagcuaauuuuuuguauauuuaguagagacaggguuucacuguguuagccgggauggucuugaucuccugaccuugugaucugccugccucggccucccaaaguucugggauuacaggugugagccaccgcgccuggccuguucugaaaucuuuaccugcagcuguauuuccuuaggauagaauacuaggggugggguuacuuggucggaagauauaacuauauaaaagguauuuuccuugcugacuaaagagauguuauauaaucaaugaaaagggggccucagugcuuguuuccccacacagccgugcuggcuucugacagcaggaccccgacuugcugccgacaugaccacagggcagcaguugugcugaccucaacaggaugcauccccgccccacagcagcgacuguucuguggucguuagagucgugcucuuugguguacugacccugugcacuucgagugcgccuguggguuacuggugaucugcccaauguuucaguucacuucagugaagagagggcuuggggcugacucccggauuauuauugcuggugcuggaguuguccccaccuuguccauccccaucacccugcccaggaguggccacaggaggggagguuccagguacaaugucccugggcuggauaaggcaaaggacacccacugaacugaggacacgucuggccucaucugggaagcucacggaugaaguggaggcaggggccaggcccuguggagagggagcuccuggcgucccugcgggccgaggcggcugcguuccucuccccauccugaauguguuuccugaguauuucuucuccacugagaacugugcugagccugcauaaacacguguuucauccugugaggggagccgugaguccucacucauaguuguggaaacugagucacagaggggugguccugcucaguaagggagcugcauuccuggcuguggcaggcaugcuggcccacugguagugcccgaagcugcagagcagggguccucaucccagcuugugguugucaaagguugcguugucagucugagaacucaucucgaucagaaaagagucagccgaaauuagagcuuuugaaagaaucacaggcuuaaaaguuggaagcaugguaccaagaacauguuuuuccucgaauccugugagaggaaguugccuucucgaugccuuuggggugcauuuccaacaaacaaggauguccuucccuuuguaauuaacagauguuauagguauuuugaagcuauguaaaugucacauucuucaugaaacucucaauacauucauuuauuuacuuaaaauauuuauguguuggccgggcgcgguggcucacgccuguaaucccagcacuuugggaggccgaggcaggcagaucaccugaggucaggaguucgagaccagccuagccaacaugguaaaaccccgucucuacuuaaaaaauagaaaaauuaggcugggcgcaauggcucacuccuguaaucccagcacuuugggaggccgaggcggguggaucacgaggucaggaguuaccagccugccaagauggugaaaccccaucucuacuaaaaacacaaaauuuuagccagucgugguggcaggcagguguaaucccagccacucgggaggcugaggcagagaauugcuugaaccugggagguggagauugcagugcgccaaaaucacgccacugcacuccagccugggcgacagagcgagacucaucucaaaaaaaaaaaaaaaaaaaaaaucagccggguaugguggcaggugccuguaaucccagcuacuugggaggcugaggcaggagaauugcuugaacccgggaggcagagguugcagugagccgagaucacgccacugcacuccagccugggggacaagagcaagauucgucggauggaaaaaaaaaaaaaaauugauguguuauauuuauacuauuuauaauuuauuuauaugggcugauuuccuguuuuauucaagaguuuauaaucuugcuaucauuaauaaaauuuuuuuauuuuuauuuauuuauuuauuuauuuauuuuugagauggagucuuacucuguugcucaggcuggagugcaguggcgagguauuggcucaccgaaaccucugccucccggauucaagcgauucuccugccucagccuuucaaguagcugggacuacagucacccaccaccaugcccugguaauuuuuuguauuuuuaguagagacgggggcuuaccauguugaccaggcuggucucaaacuccugaccucuggugauccgcccgccucagccucccaaaguggugcgauuacaggcaggagccaccaugccccguugauuauucuuagcacgguuacccauuugaccaaucccccuccauguaaccaaucuaccauugccacugcccucuucugcgggugucccugucaccuacuugggcucugacucuucacggugggcuggucacgcccccagccuggacacccuucucugggguucuugggcucugacacccauaccaggcucuucccaaccauggcccugcauagacaccuucccugggcucugcaccgcauccugggcuacuguccccccgcucccaggcacgaaggcauguccugucccauucugcccuguggcugaaggacugagucacuggggauggagugugggaggaaaggcucuaaaugaacucgagagaguguuguucccaugcucuggauuauugaaauacauuguaauuuaccugcuuaaaggaaagacuaaauauuaagaagaaaauaaaaauaucccuagucccagugauaaaguuguuccuaauuuuaggccauuauguaaugcugcaguaaauauccugaucccuaaaaucccaauuuugaaaaauuagaguauacauauauucaguauaaaucccaaauuacaguguacauauauaguauauacagugcugcuccuaaugauggaaaauuguuauguacauguagaaugugcauucuuugccuguaucuauagacguacuguaauuuacccacauugggauuuuucuggguuuucuuucaacacagcuaacuuucucaugucauugaggauuauuaaaagaugcaguuuuuuuuuuuuauggccauuuagcauuacauaauuuuagccuauauucuugaacaugagguuguucauaauuguuauauuuuaugugccacagugaaaauccugguacauaaaucuuggugugcucacauguuuccuaaggugcaguuccuauaauuggaacaacuggcucaaagguuggaaggguuuuccgggcguggguaucuugucucugggggcaucgguucuccuacugccuccagggggugucugcccuccacccugcugccuccuguccggccacugcccaggguuucugucuuucugcucagucuuuuucaguuuggccaauaacgguaccuuguuguuuucacuucuuugauucuuagcggggcugaacauuuuuucguacccucuggccauuuguauuucauagaggcugcuuguauguauuaaaugcauuucuuuucuguaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaagguauaggagcuguguuccaggccuuuuucugggccaccuugucccuggggcugcugaggaagcugguggagguguccccugauguggcgacggugcagcuggguacccuggcugcugcugcugcugccaccagggucaggaaauggaaggccaggcuucugggccucuggcaccuuccaggcacauccuuacccucccaccagugcugugcugugcucugaagggcucagccucacugcugugugaaggugcagcccagggaguggcaggaagagggcgugcacacacugucuccccucagaggauguugggggcuggggagccacagacaggugggacaagccaaggacuccgaucccguggguggggaaguggguggucucagugucuguugagggacuauucaucauguacuggauaucagucuccaaauacuaugcuacaggggccagucguucaguuaauccaauaguggauggcugaaaaacgaaacauuuguuccauaaacauuuuuuguccauuuuuuauugagauacaacuuacauagcaucagauucacagaauucaccuuuuaacacguaaaauucaguggcauuuagugcauucacagugugguguggcugccuccacuguaaccccagaacauuucaucccaggagcccaucccgugcuggugucccuucuccccagcagcaggaggagggugaccacguguguggggucccaaggaggccguguucugguuguuugccgacuucggcagcuucugacacaggccucuucauucuccuuuaucuucauuugaguuaacagcacacagguaagagucagagacauuucuaggucuuuguaggugugcacgugugacaugucuuaucaaugcagacccaccaugugugcagggguggccugggcccugcugguuggguguccagcuccuugcuuuucccucuuucuguuuucccccugcguccuuccagcugcagcucccaugagcucuagaggucacagcugcguucagcugauggggaggagggcaaaccccuccccuaagggcccuucuccaaaucccacugaaacccacugggcaaagccagucucugccauagccagcugugaggagggccgggaaccguggacuucacccguguccgugugcccaccagagacugacucugucacugagggcagagggaagacgcuggguccaggccgggcucugcuguugggugggguccccucccagggcguggugcgcguagcucccuggagagccccugggccaccuggggcaggaggugcuuccuaagcccccagagcucccaaaaggggccugaugggcagagcaaggccugcucucggacaacccccgaguccacuaccgucccucgggucagggccagccuggagugccaggaggccaugggcaucggaggguuugcgcccaguuaguugggcaacauugagcccaugggccuggaauaaguggugaccugccccgucccuucuaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagaggugggugagcgguggguggggcgggcuccgggggcugcaaccuggggagggucuugaccuucucagcucugugcugggugaaccugcccaagacuccgggcagggcugcacagugggucagggucacgggcacagaggccggaccgacugugacggcuguuucccacuuggaggucacaugugguuuuuuuuguuuguuuuuuguuuuuuugagauggagucuugcucucucgcccaggcuagagugcaguggugcgaucucggcucacugcaacuuccgccuccuggguucaggucauucuccugccucagccuccugaguagcugggacuacaggugcacaccaccacacccagcaaauuuuuguauuuuuaauagagacggcauuucaccauguuggucucgaacuccugaccucaugaucugccugcuuuggccucccaaagugcugggauuacaggcgugagccacugcacucagccacauguggauuucuuuaugcguggagugcuucugccuugaaggcagucagagccuuccuuagacccaggugucguaguaacugucaugcaggccuaggaaccccaacugccccgguguuccccaguguggcccgcuuggcucccccagcccuccugccgcccucauccuuucuucugugguggcuggaggcccccggggucugauggagcugcucuuggccaccugcagguucucuucugcuuugagcaguuugaugagcucacccugcugcaccuucgugaguuugacaagaagaagcugaucucuguggagacggacauagucguggaucacuacaaggaggagaaguuugaggacagguccccaggucggcauccccugcucucuaggcguggggcugguuuccacuccccgcacgccucuccugccccgcagcgagggcuuccuuuggguuuucgucaguugaccugggcucagccacccccgagaagagccuugugggagcacccuggugacuggaggaaggugccuccugguuuagauaucaggggucuguccagugcuccugccacgguggcuucuggagcuggcccagcuucuugagaggcuguguauuuuuuuaaagcccuaaccaaguuguaugggccucaggcaaccugaagcauccuuugagguuuuacuuuuagaugaaaagcaucuugcuagcuugugucuccauccuggugggagaggaggugggagcuggaagcaugcugcguggcccccauggaagccggggaguugggaugcaggccugagcucccugucgccugcucuuccgcagccgccgagugccuaucagagaaggagacggaggagcucauggccuggaugagaaaugugcuggggucgcgugucaccaacgugaaggugaggcuuucccggggauggaccaccacuuggccgcagugucccuaacaggcuggccagcugguggcucccaguaccuggcccguuggguguccuuccagcagcagcagaagcccuuggugucagguggagacccugugggucccugcucggcacguguugcucgggagugccgcugaggcaggaaggccgugucuuucucccagcccugcuccagagcaggugugaacugagaacugaaaaaccagcauccugagugggagcugcaauggcugaggacguggggguuccaaacaagggacaugcuaccccagcccucaggagcucacaugcucacuugggugcuuagucggggguuuugggugggcuucagagagcuaagacuccccccaccaaccugucuagcucagagugagaaaugagcgucccaugcauggucacuuggaggaaggggccucaugcagggugggcuggcauggagcagaggacgauggauucgggcagcuccuggaggcagcagcggggcaccagggugguggagccccucgggcacaguaucuuugcguggggcaucagcucagggcccacaaguuaguggguaauggggagggagcagcgcugguccaggggaguccuugagaccccgccugcuaccucguggucugggugaccuucaccccugguaagauccugccagcccucucacauugggaaccucuaucacccucaaccccgggcuuugcucacaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggugaggccacgcuccuggcucuuccagccugugggauuccccagaauccugugugugguguucuuuuguuguggaaugugacacagaagaaaagugcgugaggccuguggacauguggguaacuauaaggagcuguaugcaguuuaggcugcacccaugugaaauggaaccuggccagccccuuaccauccccaggugucaccugggagguuagccacaucccagccugugaccauguccucguuuugcuuuauggcuuugccaccugugcguguccuggacaugcucaguuuugccuguuuugagcuuuguacguggaucuugguguuugcugaagucucacguugcucacuuggcaugaggguugcccaugcagaggggcugccacaaguucauuuucauagccgaauaauguccgcugcagaaacccaccucggcacagcagacugcuccguucugcucugcugggccuccggugguucuuggucagaaguuguggagagccaggcugcucugaguauucuuguccacgugucuggggcuuguguggguuucucuguggccccgguggugggagcugcuuccagggugcaccgagaaccccccagcccugacaguggcugagccguaagauuucccucguuucuuccuguuguucuuuauaugcccuuuaucuguuguaaaugucuuuucaccugccuuuagguaucuuuugaguuucuuucuuuuuacaguaucacuucuuugcacccaugaaugugaucuauuuaggucuuuaacauccuuugguaccuuacauucucuguaggguucugguaccauuuuuaaagaauuauucuuugaugugucuuaugggguauuuuaaaauuucauuuucuaacuuguauaugaacuaacuuguauaugaaguuucuuuuuugggggaaauuuugaauguagcaauuuuuuaaaaaaugaaguuacauaaacauguuaccaaaaauagaaaacagcaaaaaggaaaucaaaauccauagacuuaccaccccccccacaauguagccuaaguaguauuuuaauuuuugagacagggucucacucugucccccagguuggagugcaguggggcaaucucagcucacugcaacuucuaccuccuggccucaaacaauccaccugccuuagccucccgaagugcugggauuacaagugugggcuaccacccccagccaguuuuuguuuuguucuuuaguacaugucuaguuuuuuucuuuugucauuuuacaaccauaacuuuuaaaauuauacuggaggcgagggagaugcaucuuccuagccauggcacuccuggggaaaggcugacuuggcuuauggcugucagugcacagcagcgccaguaugcagaaugccugugccucugcuggagcagcucagugaggcggacaccaggucacuuuaacuaguuuugguggcaaacuaguuuugugagauagcugcagaagugcucguuucugucuguugccacuucacuuuuggagacagggucuugcucugucaccuaggcuggaguguaccaguggcgccaucagagcucacugcagccuuggccucccaaaguggugggauuacaggcgagagccacugugcccagccagcuucacuuucauuuguuuuaaaauuugguguucuguccacauaguucagaauucaaaacugcuuacaggggaaaauuuccuccuaccuguguccccagugcagccagcauuagggcuuuuguauuucugcagagauuaugugcauuugugggcagcugcgcccgugggcuuccaagggggaacuugcugugcaguggguccuugccuugcuuuucucccuuaggguaacuaggugaccuccacauuagcauauuaagaauguccuuuuuuuccagcuacguagacuagaaaugugaggaugugcauuugaaguguuuccucuguuagguugggugcggugccucacgccuguaaucccaacauuuugggaggccuaggcggguggaucacuugaggucaggaguucgagaccucaucucuacuaaaaauacaaaaacuagcugggggugguggugggugccuguaaucccaguuacuugggaggcugaggcaagagaaccucuugaaaccaggaggcugcggugagccaagaucaugccauuucacucuagcuugggugaaggagugagagucuaucuaucuaucuaucuaucuaucuaucuaaaaaaaaaaguguuuaaagggaugcaguuaggaaauggaauggcugagucucagcauaucauccacaugugguuuucccgacuccaguuguccucuggagagguuguacaaauuuacaguuccccagagcccucgguuuuaucagacuucuaagugaaaaauuauaauauucauguuaagguuaaauacuacaugaugcuuuuuccuaugcagaaaaaaauauuguucugacgucaaauaugucaaucauucuuuacuuuuugguuugugguuuugcuuggaaaggcuuuccccuucugagaugaugaaacauuucuucccuagaauugugcuugucaucuuugaucccucuggaauuuacucuggucuaaaugguuuucugcauggcucccagucaucccagugcugcuggauggagugaucugucuccucccucuucugugaaauacuguccucaucagacacucaguguccacccucguuacauggaguuguuugccuucccccuuuccagaccuaaacuguuuuauuuacuagagcccuauaauauguuucaacaugugggucuuacucccuucucuuuuauuauuuaucuaggaaccaaggcaugucuucacguacuaagcuccuuuugucccuuuaguguauauuaaucuuggaguuuggcuaccuuacagcauuuucuaauacugacacuccugauucucuuggguuuucuggguauauaaugauauuaucuauaaaugaucauuaacauaccuuauuuaaaaaacuacagacagucuuacugugcuucuuuaaauauccugauaaucccaaaacaugaagggagggucacagcacgugguacugagcugcuuuuucugguggguucuguguugcaggcacgcgcucaucaagaagcugaaucagcugcgcgcaagcgagccuggccuggcucagcugcugguggaucaggugagugcagcagcuuaggaugacugcagggacccaggcuaccagcccugccagccugccuucaggguggaacagcgguuuccucuaaaauccugucuuuuuguuuguuuguuuguuuuuugagauggaguguugcucuguugccaggcuggagugcaguggcgcgaucuuggcucacuacaaccucugccucccggguucaagcaauuccccugccucagccucccgaguagcugggacuacaggcaugcgccuggcuaauuuuguauuuuaguagagaugggguuuucaccaucuuggccaggauggucucaaucuccugaccucgugagccaccgugcccagccaaauucuguuuuaaaaacggaaaaauggccaggcgugguggcucacgccuguaaucccagcacuuugggaggcggggggaucaccugagguugcagugagccgagaucgugccucugcacuccagccucggcaacagugagacucugucucaaaaaaaaaaaaaugaaaaggugccccaugccccucauaauggguuucuccucuugccuuucagauauacgagaacgccaugauugcugcuggacuuguugacgacccuagggccauggugggccgcuugaaugagcugcuugucaaggcccuggagcgacacugacagccagggggccagaaggacugacaccacagaugacagccccaccuccuugagcuuuauuuaccuaaauuuaaagguauuucuuaacccga

SEQ ID NO: 192595 - RNA, 153537 nt, Homo sapiens
uauauuuaaauuuuagaauauuuuaauguccauuucuucagugaaugcauuuugaaauuauuagaauuaacaauuuaaaaagagcagauaaaaggauauauggaaaaugcaaacagucgguucuugcuaauucaauuucagauucuaggcaugaugugauuuuccaaacaaccaauuaaaaaaaacuccuuaccucgaaaaucuagaaauucaaaugcagacgugucuuuggaaacuacaaaugauuacagcccaugugacaggaagcacgcggccuucggcucuccggaucgugugcaaaugugcagggggagcccccgcgggugacgucaguguggaugaagucacggguguggcagagccuguggggcucucaagcuauucgaggguuuuguaacugaugcucuacauuuguuugcauuggauaaaauugugugugcuuguuuaccauauauauauauauauauauauauauauauauauauauauauauauggauauauaauucgaucugagcugggacugagaagaaaauagcaauugcaacucaaagcaacuauuuacacacauucaaugcugaaguauugcuuccugcccuaaguuccuaagagguauugccacccugaagcacgacccaugccgucagcagcccucgugccagcugcuuagaaacucgugucuccagcacgaugugcucgcugccaacagacaagagaugcacggcguuuccgcugcagagauucugugguucugcacugagguaugcaucggagcaggggacggggaggacccgaggggcuucguggcccagagagaacgucugcacuggcuguuuaggaaggcucaggguguuugaaagacaacguuaagcucugggugagucugcacggggcugaaccagacuccacuuugcagcuccuugguuucccggggugaggaaucacaaacaccuuugugguuggggaaggaaaugggcuugauggggaagaagugugugcggagaacuuugcggagcauguucugagcgagacagcaaggucgugagcaaacgcccagccccucaaagcuacacagccuggaggggaaaggggaggggaggacauucaaauauacaccuuaauacugaugcagaaagagcuucaugugaccacaauccccacgaacaaggaaagcaucagguaguguuuuuuaaggaaaaaaaaaaaucugcgguguuuuauaauacauucuuuagaagcaagagguauugucacaaccacccuuucuucgguauuggaagaccagcaaacugacagucacaccugacaggaaaccuuacagcuaauggggggaggugcccuggacucucaggacgccgggacccuggcucuggcuguccugauggguggccaucccaggcaccgccccuggagagguggcgggucagaauugugacuucuucaugccggggagggcaaucuguaugucucuggggaggaguagugaugauggggacugaugcggugugaaaacgagacagugagauuugacagcggaaagcaaaaugcacagggacaacgggcaagacugacaaggagugcacccugggccucaucagcgucccgggguccccugaaagacuggcuacaacuccgaccggacaacucgggcgagcucacuuccacacaaacuucagacucaauauggcaaaacauaaucagacaggaccagcagccaacugcccggacggagcucccccacaccacccucgggauuccgccccuaacaaaccccgcguuugcauccagaugccucugucccuagauacggugugagaacuccauuucagagcuggaauuugcuccccagauuaaauccugccacugauaggcccugugccaucugagagcgggaggcagccaagaaacuucuggaauuuguggaagccaagauggcaccggugcugccggcacagacccccgugguucugagcuggaccccggcagggaggagcccccguggguggcaggggcagcuggugggcuucuccuauuccccuagccucagaauugcacuggccaugcuuugaggucccacucagaccccucuugggguggggagguugggggcggccccagguggccaaaacacaaaagagacaucugguuaccuuccugggaacugcccuccccuguggcuaugaccccccacccugaggacccagcaccccucccgggagcgcacaugcuuccggguaaauaaauaaauaaauaaaugcaaccucggauguuuauuugguauuucccucuccgaugagucagcuuccaggaccaacaccuccacucccgauggggagaccccuggguggagggucgggggugagaggcggcucugagacccccgaggccugggcacacgggcgucgugcccggcuggcauuugcugucuuggccugcaugcaugugggcgagccccuaaacccgcucagugcagggagcgcggcucacccacagcccacggggcgcggugcucgggaaagugcgggugggcaaugggggguggcggagcugucgugacaugcccccuucgcacccccucuuggcggauuacuggcacuuuauaucagauucaugaaugcaagugugugugcgcaugugugcuuacauagagaggucgggucguagaggaacacugugacauagacagaaacaaaauaaacucaaaaacaggguauuagccagagaaccgaaaauagugucucgugggacgugggaaaaagcaauaaaaaugagaucuuaaccacagcuuuuguucuaaaagucaaauaauacccaaagccaugaucuccacuggcggccucugucccgagacucgaggccgaggccagcccugaaggcacuuguucuccaccacgugcugaacggaugacccagaggcagcgggguuuccagggaagggagcgaaagggaagaauggaugaaaaugaacccugaauaacugugauccacacagaaguuagggcugaaaugaccacauaacaccacguccggggagggcaacuguggcgcuuggaaagcacaacagccaaauacaaauauuacuguguuucgacaaacagagcaccucgggcagcgggugggcgccgccucacacacucuuugaaacguugagcuuggugaguucguuggcuucuucuauuccuguuucgucacagucgucuuucucuauggcuuugccaaaucgaccccuuucuucggcuuugacgggcuccuuccacggucucuugggggacaggugggcauccuuggccugcgugcugcugucagaacccagagaugucuuguccacauacuggacagaaggcaccagguuggcaaucucgucugugggagaccguccgaugcugccauccaccuggacgcggaugucuggggagauggacagcuggugcugugggaugacccugugauccgugcacuuuggguacagguaggucuucaucuggccuuuccccuugacauucacggucccucuguagucgaagucauagcccaucuugcucaagacgcgguagcucucuucgcucaccuggaugcggcacuccacgccggugguguccauccugcuggcgauguugacggugucuccccagaugucguacagcagcuugguggugccgaugaccccggccgugaggggcccaugguugaagccgacgcggagcuugaaguugaaccacagcauguuguuguugaagucguccaccacgcgcaucaucuccuuggcgaacucgaacaggaucugcaggugcuccugcggguggcugccguccugggccugcgcgguguucagcccugacgccgccauguacguggcuccgauggucuugaucuucucgaugcugcuguaguccggcuugcuuaggagcucgucaaaguccccgaugagcucguugaggacccgguagcacuccuugccgcccucguaguucuccucguagaacucgcugaaguugacgaugcuggcgaagaucaccccuccgcugucaugguucuuggaguaggucugggacaccuucagcugcucagccacgugguaggggaugauguuccucagcagccagucugccuggucccgcaugcucuggaucuuggugcggugaagauccgcuuccacgucuccgugguaguggaggcgguagcugacuucaaauucgcgauucaggaaccagaccaacaagagcaggagaaagaagacgagaaccaccuccuggccgaugaggcuggcgggccgccggaggucacgcggcaccgaacuauugcacggguuccucucggaacuggagagcaaagacacgggaaagggagagguuacugcucggcgcuuccaagcucagaacagccccgcuagcuacgcaaagcuuuguugaguccaggccuucaacaaccugaagcugucaagcugcccauuccugguuugggcuggcugaagguauggagggauaaagacuaacuuuugaaacugauugauuucauuuuguuaaauagagguggggucucacuguguugcccaggcuggucuugcacuccugggcucaagcaauuuuccugccuuggccucccaaagugcuggaauuacaggcgugagcugcugugcccagcccuguaacuaacaucuuuaguaagugcuugguaaucguuuuucuuuucuuuuucuuuuucuuuuuuuuuagaagucuuuagcuucuuucaaaaaucuuuucuuuucucucucuccuuuguuuuuuuagagacaugguuguuguccaggcuggagugcaauggcacaaucauggcucacugcagccuuaaacuccugggcucaaacgauccuccugcccagccuccuaaguagcugggauuacacgcauguaccaccacaccuagcuaauuaaaaaauuuuuuuuuugaagagacagggucuugcugguugccaaggcuggucuuaaacucguaacuucaagccauccucccaccuuggccuuccaaagugcugggauuacaggcuugaacugugcuuggccuaacaucuuuuuuuuuuuuuuuuuuuaagauugagucuugcucuguugcccaggcuagagugcaguggugcgaucuuggcucacugcacccucugcuuccugaguucaagugauccuccugccucagccuccugaauagcugggacuauaggugugugccaccaugccuggcuaauuuuuguauuuuuaguagagacaggguuucaucauguuggccaggcuggucucaaacuccugaucucaaagugaucagcuugccuuaaagugcugggauuacaggugugagccacugcacccggcuuuuugcugaaugaacuuuuugaaaguaaguugcugacauggcacuucagcucuaaauauuucagcauguaucuccuaagaauaaggauauuucccuauguaacuacaauaucaucaucauacccaagaaauuuaacauucucugauauauuugguucuuagauuucuuuuuuuuugagacggaguuuugcucuuguugcuggugagaucuuggcucacuacaaccuccgccucccggguucaagugauucuccugccucagccuccccaguagcuggguucacagacaugugccaccacacccagcuaauuuuguauuuuuaguagagacgggguuucuccauguuggucaggcuugucucaaacucccgaccucaggugauccgcccaccucagccucccaaagugcugggauuacaggugugagccaccgcgccuggccuugguucuuagauuucuaauccaauaaacuuaucauuuuacaaauagcuuuuaugaguucuauacucucuaccuguauaaaaaaguuugacaagacgccaucuccccugauucuggguuaguucuuuuugccgaaaucacucaggacaaugcuaacaucugaaccagugccauuauuuucucauggcugugcaguguuccagcacucggaaauucuguaauuuagccagauucccccugauggaacugggcccgagucugucuuuucuuaccacaaacagugucacagggaauauuccccuaccccuaucuuugugcguauggaagugcugagucauuuuaaauauugcacauuuagaauuuccuuagaaauuuccaaauugcccuucuaaacaaggcugaaccaguuucugcuuuuuuuuuucuuuuuuuugagaaggagucucgcuuuguugcccagguuaaagugcaguggcgugaucucgccucaccacaaacuccgccuccuggguucaagcaauucuccugcuucagccuucuguguagcucggacuacaggugcacgccaccaugcccagauuauuuuuguacuuuuacuagagacagguuggucucaaacucgugaccucgugauccacccgccucggccucccaaagugcugggaucacaggcgugagccaccgcgcccagucucugcucccuuugauaacugagccugcuuucagcggggcugucuccacuucaguggcacugauggagacagccauggucagggggcugcagaugaguggugaguagcacaauuucuuuuuuucuuuuucuuuuuucuuuuuugagacagagucucacucucuagcccgggcuggcaugcaguggugugaucucagcucacugcaaccuccaccuccugggcucaacgauucuugcggcccagccuccugaguagugugcgccaccaggcccagcuaauuuuuguauuuuuuuuuugguagaaacgggguuucaccauguuggcugggcuggucucaaacuccugaccuaaagugaucugcccgccucgaccucccaaagugcugggauuacaggugugagccaccacaccuggcugaguagcacaauuucuuaaaguuuguuugaaauauauauauauauauauauauauauauauauauauauauguauuuuuuuuuuuuuuuaagaagagacagggucugucucugucauccaagcuggacugcaguggugcgauccuagcucacugcagcuuugaccucccaggcuaaagcgauccucccgccucagccuccagauuagcugggacuacaggcacacaccaccacaccuggcuaauuuuuugaacuuuuuguagagaugaggucuuacuauguugcccaggcuggucucaaacuccuggguucaaacuguucugcuucugccuccccagugugcuggaauacauuuuuucccauuuaaaaauacuacauacucaucauagaaaauguagaaaaaaauagacaaaaaagauuuguccaucguccugccauccagaggcaaucacuauuaacauuuguugaacugcauucuagucuuuuucuuuuuuacaacaccgugacuguucuguucauguaaaugcuguacccugaugcauuccucccgcgcacagaguaggccaguugauuugaugcaauaaugggcuuggucacuauauacuuauauaugcgacuggcggauccacaguuuagacagcuccaucacacuggaaagcucaauucuuuuucuuuuagagacagggucucgccaucuugcccaggcuggucuugaacuccugagcucaaccaaucugccugccuuagccuccccaagugcugggauuacagggaugagccaccacgccuggccaaaacucaauucuucuuuuuucuuucuugcucuguugcccuggcuggagugcaauggcgcgaccuuggcucacugcaaccuccgcuuccagguucaagugauucucuugccucagccucccgaguagcugggacuacaggugugcgccaccauacuuggcuaauuuuuguauuuuuuaguagagacaggguuucaccauguugaccagguuggucuggaacuccugaccucaggugauccacccgccuuggccucccaaagugcugggauuacaggcacgagccaccaugcccggccaaaagcucaguccuuuaaucaaagugucuaauaaguuucacuaacuguucuugggauauuaaaaaacaaugagcuugaccuguguggccaucacggcccucugcgaagcacaaccgccaaaagcccuggccguggguggaacagaaccccugggccccauccuggcuggaccgcgggggaguuucagaaucuuggguaagccaugccaucuuucugggucucaguuuccucgcuuguaagcugugaagauggacuggagcauggcuacgucccuuccagccuaagguuccgugcaggaaaggccugaggcugccauccuuggaaagaccugccugcaaaggugguggcuggcaccagggagcugggauuuggggaggguuccugccauuccuugauaagagcggcucacacugccuacacugucuaaauaaggagguuuacgcugaauacccgcuuuccugcuggaagucuggaauuuaggcacgugcugggcagaggcgggagaccugaacagccccuaauacaagccuggacaccgagacuuuaaugagcuucccugguaggcagcauguuacaaguguugucaccacucacugcuggaggaauuaagcccaucccgugugacucuaccgggagaggacucuuggaagcuggugccggcuuccuccaaacgucaacucacacacccuucccuuugcugauucugccuuaugucuuuucgcuguaaucacagcggugagagagcagauugcggaguccugaguccaccuggggcuggucuugggagcccugauacgggcuuugugacucaacgccuaugaccaggaaccaagaguccucagugggaagacacccugugcuucacugacucauuucgugaacugcuauugaaacagaugacauuacauauccuacaucucaaguacuaagcaaaauaaccauuuguuacgaugaugacucaaacauauuucuguccagcuccaugagcccucugguugauuguaaauagagcaggaagagaauauggacugggggaagguuuugugagccccgcucguuggguuaggaguugaccuuucuuuugguuucucaaaguggugacaccaagaacaguccccuuuaggagcaggugucaccaaggucuaacauccccauuaugugcaggggguguuuccagucucugugguggaaaugggagacuguaucugggcuucucaaucaguuaucgcuuguacagcucacucuaaucugcgggagccggagccagcagcacagcugacucgagacgggcgcaggccaggccccuccaggcagaggagggacagcagcacaugggcuagugccagagggagaggaaggcagagcacagcguuugcuuuccaccuuugcuuccaaggaagaaaagccaucacacacagcaugugcacucagaaaccaagggggcugccucgcaacagaaggcaucuguaagaaacagguacgaggacagcuucccagcuagaauguguguuuccuauuuuaauaccaaaggaacaaaggagccgauccuauuccuaaauucaaauagcaaagauccacuucaaaaagaagaauuucuuuuucuuuucuuuuuuuuuuuuugagauggagucuugcucugucccccaggcuggagugcaguggugcgaucuaggcucacugcaaccucugccucccggguucuagcaauucuccugccucagccucccgaguagcugggauuacaggugcccgccaccacguccagcuaauuuuuguauuuuuaguagagaugggguuucacaaacauguuggucaggcuggucucgaacuccugaccucaggugauccaccugccucagccucccaaaguguugggauuacaggcgugagccaccacaccuggcucaaaaagaggcauuucaugugacuaaaugcaggaguuaauuuauaagucauaaauggaaguuagaguaaaauacaguguaauccguuaucauggagaagagggauugaaaaacugaaaaaaauagaaagcaaacaucacuugcaguccuaaccagccaaacguggcuucgguugacacuuugguauauuucagugccauuuaaaaucugccccuagggagguggucaggucgggggagagggggucagcagcggugggguuggagggcuucugggguagugguaaugcucuacuucuuggucugggugguaguuaaauggguguguucucuggugaaaaugcacugagcuguccuuuuaugaucagguacucuucugugcauacugacauacacaucaauaaaagguuaaaaaaagaugcuaggugcuuuacuuuuaaguacuaaagcuguaaucaucacucauucauuauauccuaaguauaaaucuuguacauauuuuuacuauauauaaauaccuaguuguaccuauaguacauauauaguuucaccuaguaaaugaaaaucuuaaauguuuuccauauuuacugcauuuuaacaguuguauuauuugaguaaauguauaaucaguuaauuuauuuauuauugacaacuacaguugcuaaugaaucuuuuuuuuauuuuauuuuauuuuuugagacagagucucacucugucgcccaggcuggagugcaguggccgaucuuggcucacugcaaccuccgcuucccagguucaagcaauucuccugccucagccucccaaguggcuaggauuacaggugcccaccaccaccccagcuaauuuuuguauuuuuaguagagacgggguuuugccauguuggccaggcuggucuugaacuccugaucucaggugauccaccugccuuggccucccaaagugcuggaauuacaggcaugagccaacgugccuggccuuuuuuuucugagacagagucuugcugugacaaccaggcuggggugcaaggacaccaucacagcucaaugcagccucaaauucccggccucaagcccaccuuagcuucccgaguagcugggacuacaggugcauaccaccauaccuggcuaauuuuuacaauuuuuugccaaaacaggauuucgcuauguugcccaggcuggucuagaacuccaggccucaaguaaucuuccugccuuggccucccaaagugcugggauuacaggcgggagucaccgagcccgguccuuuucugugugcuuugauuuucucucccuuccucucaaaucuguccaucuuuucguugugguucuauuuauuauuuguaagccuggaaaguuaucucaguuuuagaggcuugaaaacuauugaauuuuacuuuuucuagauuuuauauaguuuaauuuuuauuuccgacucuucaauuuauuuagaauuuauucugcuguuuauaguaaagcaagggucaaacauuuaguauuuuggauuucaagucaguuauuuuauuacuuuuugagacacagucucauucugucacccaggcuggagugcaguggcacaaucuuggcucacugcaagcuccgccucccggguucacgccauucucccgccucagccuccugaguagcugggacuacaggcgcccgccaccaugcccagcuaauuuuuuguauuuuguuuaguagagacgggguuucaccguguuagccaggauggucuccaucuccugaccucgugauccgcccgccucggccucccaaaaugcugggauuacaggcgugagccaccgugccuggcugauuucaagucgguuauuuuaaaauauuuuacaaaauaacuuuuuucuuugauuugcgagauuuccuuuguugcaugcgaaagucuuacauaaaauuacaugacuguaaugucuuauuaaaauaauaaaacuaauuuuauuuuccccauuagacauuauaacuaugauacaguucaacgaggagauauuuuccacuuucuauucuaagaaugcacguauuguuccuuuuauucaagaucccauuguuuucaggaagcuucgaaaugggcaggguaauacagucacucucguuuauucagacagaagugcaauauuaaaagcuuaccugaaauucuguacugcgucaaggggcgaaguuaauacagaacugaaauuaaaaugcagaaaaauauuaucauaaagagcaaagaaggcauuccacaaggcaaccugagaagagcuugaacaaacuauguuccuuuuuuagacgugguuguacauccacauaaagccaccugcucccaccucuuucuucacaucugugucucccaaugcugggggcaguucccuugguaaagcugaguuuacgucuuuguuuaccaucccgcauccucucuauccugcugaggcuuagcaaccgugaugggauuaggggcucugaggccucaaguggauggaggaguucugggccgaguggaacuucaaccaucaucccuaccccagaucugcuauuugaacucugggcacaaaggcggcagaggggucccccaucacuguggcucuccagcuccagguagaaaagccccgcagccaugacuaaaggccacggugaaugcccgaugagggaccugugauggauuuaaaagguaaaaagcaguuugcuggauuucauacucucgagaaagagcucaucgugaccaucguucuagauggccauaccuucagaaaaauccaagucugcuuuauuuugcuuaaucuauucauuaaaguuuccuuucaaguacugaaugacaguccuauuuuaaauucccuuuuugaucuuaauuugcagggaauuuaaaugucuuuuguauugugauucuuuucuuaaguaaacugaggacggaugcucacacugcccauggcuggacuguugcuuugcuaauaaccaaagacaccccgugccuacuccgucugauacugacaauacugcggcaaauagaaucauuuugugcuuuugaaugaauucaagcagagguccuuggcaacagcaaugccacuccaacggggcauuucggaaaugccaggggucccucugguucucuuaauaacucagggagccagaauguuagaucuccugcaaggacaaggaagaaaugucccaugugacuuuaaaacauucugcgcaccuaaacccucuguaauuguaaacaggcgguucuucaauacacacuaauagugaaacauuuuuauaagcaguuauaggaaaagcccaauauuugggagaaauuuauuacaugaauggaagcuuaauggguuuaagauaucacgaaauauuugaauaaauuguucacugcuuacauucuguuauacaagguauuacuguauuuccaacaacacauuuaguugaaaaggcuuaaaauacccugaaaccaguagcaaauguguaauaggcaauuuugagacuuauuuuuuauuuuuauuuuuggagacugagucuugcucugucacccaggcuggagugcaguggcgcgaucucgguucacugcaaccuccgccucccagggucaaccaauucuccugccucagccuccugaguagcugggacuacaggugcacaccgccaugccuggcuaauuuuuuguauuuuuaguagagacaggguuucaccguguugcccaggcugucuugaacuccugagcucagacaauccacccgcuucagccucccaaaagugguaggauuacaggcgugagcaccaagaccggcugggacuuauuuuuaacaaaucaagaauuauucaguuagugcaacacaugaaagauagggaucuuacuggaugucgcuaauggcaaauauuuuaaauauagcaccuaucacugccauccuguaaguuuuuacauuuuuuguaguacaaugaugagaacugggcuuguccccagaggucuaccggccucccugacuccuguuucugugucugcgccaucccauuccucagcaccuaccagugauacgguucugaaggccagcguccuccucaguaugcagaggauuucaaaauaaaagaccuauguucagugacuggucauuaauccuacgucucaugacaucauauggggaacuguuuugaccuauuuauuauuuuuuguuuuugagauggaaucucacucuugucacccaggcuggagugcaauggcacaaucucagcucacugcaaccuccgccucccggguacaagcgguucuccuaccucagccucccaaguagcugcgauuacaggugcacgcccccaugccugacuaauuuuuguauuuuucguagagacgggguuucaccauguuggccaggcuggucuugaacuccugaccucaggugaucugccugccuuggccucccaaagugcugggauuacaggcaugagccacugugcccagccugacauaauauuuugaaauaagccccaggugacuugcaagaucauccuacgucuucaccuccuccuuccaggcugugaccugucccgguucaugaacccuaccccacucaaggaaagucagcaccagcuuccucuccaccuucacauccaucugcagcuccgcucuuucauggccuugaccaucuucuaugaaauccuucagguccuacuuucuuagauuccagcccauucaucagaagucaccucgguauaaugcaauggcagcauuauguuuuccaggaugucuacauucaacuacccagagugcuguucuaaaugauauucuuuuucuuucuuuugcauauuacucugagggcaucucauuagcucuuugguaugaugugugcugacagcuauuuugggucaugaugggaaauaucucuaucggggcgugagaagcaaugugcaaaugcagccaggcccuacgcaaccucgggcaagguggccacgcacccuggugcccgcaagcagugcuggccgcguaccugucugggcacagggagacguagagcaggagcagcggcccggcccccacgacgguggcgagggaggaccucauccaggagcugagcuggcagaaguuacaguagugcacgacggcaaucagcgcggccgagccugugaacacugggaacugcaagaggcgaaggguuaggacagccgcccagggccaccccgccaccccugcuauacccggccgccaaaacauucgccacuaauccauguuuccuuuuuuuuuugacugagucucacucugucgcccaggcuggagugcaguggugcaaucucagcucacugcaaccucugccuuccggguucaagugauucuccuaccucagccucaugaguagcugggaugacaggcucccggcaccacaccucgcuaauuuuuguauuuuuaguaaagacuggguuucaccauguuggccaggcuggucucgaacuccugaccucaggugauccaccugccucggccucucaaagugccugggauuacagguaugagccaccgcucccggccuaauccauguuucuguguaaccuaaaaauaucaccgauaccagcuaauugcucacuaucugcagucagucuuacuuuugcuagugggcagugucaaggacagaucaagccucuagguucccuacccggcgugaggcucccuguucacauggcaucacacucuucugcaggugugggaaauggcacgugucuucguggaaaggaaagggaggccucccuguuugagaaacgcugugugaucaguuuccuucaaaacacuuuuccuuggggcccagugagaugugauuuggggcuaaagugucaaacaccaucagcccgcccggaagcucaugcucacuugcaccagaaggaucaucucccacggccgugcugguucccucuccacggaguuuagcacaguucccuuccugaucagcagcagccgacccgggcacaagucaauucugugugccagguaugcuucucgcaugguuaggaaaggugggacagacgcuucuuuguaaaaugugaaggaaaauaacugauuuggaacuugaugaagaagaagccacacuggcagggacucgugcccaccggggacuccccagcccggccacugcccgggcgugagcaucugggcaggccaaugcuaagucggcuucuaaaaaagcuggcucaggagaguaaaagaguucgugccucuucaaggguuuauuuuauuuuauuuauuuuauuuuauuuugugacgcagucucgcuccaucacccaggcugcagugugguggugcaaccucagcucacugcaaccucugccucccagguucaagcgauucuccugccucagccucccaaguagcugggauuaaaggcgccugccaccaugaccagcuaauuguauuuuuaguagagacgggguuucaccauguuggccaggauggucucgaucucuugaccuugugaucugcccaccuccaccucccacagugcugggauuacaggcgugagccaccaugccuggccaaaggguuuauuuuuaaauugcuaucccaagugauuuaaagaaaagagagauuagggaguccaggagagcguggaaauaaaacggcugagccuuuacuuacguguauguuggucucauauucggaggugacaugggaguagacggccagugcgggaagcgacaccaggauggccccgaugcagugacgugguagccagccggcgauccacuccagcaggcgcuuggugcaggccaugacguccuccaggaagaacaccauccugcgagaggcauggggguuagcaggagcgacggggcccggggugggucaucggccaggagacaggugcgaggccgcagccagcgccgcccucugcucucucccguguugccccugggaugggcgugagagcaggcguggggugggagucuaccucccucacuuuugguagaaggcaaggaagccaggcuuagcucauuguaccugauucuagggucacauguugcguugugauaaaauaugcuugugaaaagcacaugcuucgcucgccuaacagaacacgugagaguaucacaggcccugaggagagucuccugggggccaccacguugccgucaccggcucccaucagcuucugaggcaggaggucuugacgggggcagcuuuggaggcguccuggaauucuguggagcccgugcaguugucgcagcagaagaggcgguccuggcaucuggugggcaggcgccagggacagagcuguccugcaugugggcaggugccacccagggagguucugcccugcaccccacacagcagccaagccccugggcaccugcaaaggcagaaggcugcugacagcaucuuagcccagaggcugugucccagcuacaaacagggugcucugugguggugcugacacacccuggauuuucuuggagcgcagcuccuguggaaacugagugacaguggucucugcuguuuggggcaucaucaucaguguuucagaaaaucacaccacaggcugaaccuggcucguggcgcuuagaccaccaaacccgcacacgcgugccgucugcaucugggcugucauguucaucgugcauguucaccucuagcuggcggcuucaggacucuccagacagcggggcucuguuguacgugagguccagcaccacguauuucauuuuaaaagacuuuguccuucuaagcagagcgacuguauucacugacuccuuuugcaggcgugugucuagcgggcuucguuucaggagugugauguugacacaauaaaaguuucuguauaaagaagcagcugagugugcgggccaagaaccacugugaggaggaggaacaggucuuggcugaguccaaggaccccugggccaugguggggccacauggggaggugaagagaaggugugggguccucguggggagacaguccuucucucaagcuugcugccagggagcuggggauaggccugcugucccugccucaggagaggcugggcgggggccgcuguugugacugaacagcaaaaaagccucuggcacagagccccccgcccccagccuucgggccugaacaccuaccaugccucucccucuuggcugcgugguguggccaggcgagggaacgcucacucuccagccauuccccacauggacgcaggcacagccucacccuuuuaggguccuggacagcccuggcuuccugauauuuaaaggauaaugaagacuuuggaauacuuccaagaauaaccacaaauaugcagaauacagaggcccuaggaggggggacagagggaaccaaguucccagucagcagcgggaaagaugugagguuggagggggccuucaugcuggucccugagacugcagggaucugaaaaugagaccucacgccugcuggggcagagcagagagggugaugcaggaagccuccuggaggcaacgggcggggccugggccagucacugaggaggcgccuggcuuuccuccuguacaggaaagggauggggugcccguauaccccacagcgcagguucccgucaaccugggguccucaacacggcccucagaggggccagggaagccuuucagggucugggccucucccaggcuugacgauuccugguaaauggaaccaaaucccaccacaggccuguucaggggugcagcagccaccaccuucaccagauccuuggggaguaugucugugcaggcaguuccagcgcaccucaccccagcccucggcagucuacaccgggguugcccucaaugcuuuagaauugggucugaaggagcagggaauaauagcuaaagggugaaaguaaaaaggaauggagacaaugcuggccucagagcccucaagacgcuacagcuacccacauuagaggaaaaccuggggguggaccagggaaggcagaccugggggagugacugcccaugaggauggguuucuuuuuggggugauggaggugcccgauaguuacauaguggugauauucauacaauucuucaaauuugcuaaaaaucacugaguuguccacuugaaugaguuuauuguauauaaaucaugucacaauaaagcagaucuucuuuuuuuucuuuuuugagauggaguuuugcucgucacccagaauggagugcaauggugcgaucucagcucacugcaaucuccaccuccuggguucaaguugauucuccugccucagccucccgaguagcugggguuacacgugcccacaaccaagaauggcuauuuuuuuuuuuuugguauuuuuuaguagagaugagguuucaccaugcuguccaggcuggucucgaacucccagccucaggugauccaccugccuuggccucccaaagugcugggauuacaggcaugagccaccaugcccagccuaaagcugaucuuuuuaaagaggaaaaacaaaccaaccaggggccugaggaugucugguuuggguucuggggaaguggacccugaaaggguuugcaggcgacggcuccuuugggagggguccccagaagcacaggagggcacugaggcaggaggggaggcugugccaggaagagggcugcucgcugggggugauggggcaugagcccacagggaguucugggaaacacugagcacacgccacagacagcauggcccauggcggccucggaggaagcugaaaggguccuggguacagugcaggugggaaggagggggcaggaaucccagccugcccaccccagaugggagaagccagcauuccggcgccucacgccagacucaaagccauucauuucugcccugggauguuggauaagggcagcagacgcucaaggucagggcugccuccccaugucuguuugaagcccagcuccggggcaccguugcuagugggacucugcuaggccggcagccauccuguugagggugacaggaccacccaaggggcuuguggugcccaggacggggaccacacagggccaccuuccugcucaggaauacagagccgcugcgagcccccucagggagccaggcuggucccgagggcccagcuuucccaagacgcaccuguggucuauucggagccucuguccccuuuaaaaugagcugucuuuuuauuaucaggcuaugugugcucuuuauccauucuagauguuagaccuuguccgaggccugaucugcaaguguucccucccguucuguggguucuuucucuuucuugaugguguucuuuguagcgcaacagcuuaacuucugaggaaguugggcuugucuauucuuucuucuguuggcgucacauccaagagaccacugccugaggcaagugcguggagaugcuguuuggcuccgguacucugaagaggcgccugcugucccaggcccacuacccccgcucaugucuuuuccuuuccuuccuccagauuguuuccuaucuucucaccuucuccuuugcagucucugaaccuggaaaucuggggacaagcuggcagcgguuggggcuguggaggcaccgcccccuccagcgaggugguccccccgcaucugggccaacgucagggagggaggaugcuggggcacagggcucggggaggacacggggacccaucuccagaaaucagccagcagggacagcuggcuggggaccaguccaaccgcucagccauaagccauggagccagaagagggagcuaacggcucagagcuggagacccaguccacgcggcgcuuaccugauggacaccgcgagggacagcaccuccagcagcagggcugcacugaagaccgccagggcggcgggcgggggaggcacgguggccgccucguacuucaggaagcaggugguggacagcgucagaaacacuguggucgacagaaacacauccaggagggagcugaaggugggacuagcaaacgucuucacgggggaguucuuuaugaccuguguggagcaggaguggagcagaaugacugggaggccaugggcggccaggagcgcaguucagauggagaaacaggcaacacgugcggagcacugcugcucugggccaggcacagggcaggaaggcucucggagggcugucucccucuacuaccccauuuaacacuggggaguccaaggcacagagaaguuaaacuugcccagggggcugggcacgguggcucacgccuguaaucccgacacuuugggaggcugacguaggagggucgcuggagcccaggaguucccggccagcguaacacagugagacuccaucucuacaaaaaacuuuaaaauuagccaggcauggcagugcgugaguguggucccagcuacucaggaggaugacgcaggaggauugugugagcccaggaguuucaggccgcagugagcuauaaucaugccacugcacuccagccugggcaacauagcgagaccccgucuaccaaaaaauaaaauaauuagcugggcauagugguuugugccuguagucccagguacuugggaucugaggugggaggauugcuugagcccaggaguuugaagccgcagugaacuaugaucacaccacugcagaauuauaccguuuccgaaaacaaaaaaacacaaaaaaaacccugccagggucacagagcaacugauuaugacccagcacauucucauagacacauuauauauuuagcugcaagaugaguuacugacuggcgcaggugaggucccugcaucuguaaggcaguuggacgagagcaaugugcagggcgguccugcugcauggcggaguccuagguucagcaggugcgaaagcggggcuucguggcggaaguggccgacggggauuuaaguggcacaucaucgccugggaaccuacggggccuggcucugugcugggggccaguacacuagagaggcacacacuaguguucggcaauugagggggagaaauaacgaugcugacacguccaagaggugaccaggcccaggcccugcaaggcucuggggaggugcgaucuccauugacgcucacggcaccccacaggcaggaacuaccacccaucucgguguacagauugggaggccaaggccaggggcuaccccuagggcacacagcgaacaaggagccaggccaggacuuggcauggaccgguugacuccugagugugucccuaaccuagaggaagguguaggauccaaaggcagaggcugugguugggagaggaagggauguagccaguucagcugcuuuccauuuggccuugcaaccuucuggcaaccccugagaggccauggguguccacucagcaucccggccaggcucggggcugagggcaggagcuggagacgcacggagcggaaaggucuccuggcagcccugggugcggugugcguucuuugggacaaaccagcuccgggugccucgaccacucccaggaacuaggugggagggcaggaggggcacuuggacggugggagcaaggcugccagucagcccugaugccaggcuggacccugccagggcaaccuggggguuaggguuugguuccaaauucucuccaaggaagcuggaggcucuguagugcccaaaagggcaagucaggucccagcccuggaauccccucagaaggugugggaauuucuuuuuuuucauuuuucuuuucuuuuccuuuuuuuuuuuuuuuuuuuugagaugggaucuggcugucgccaggcuggagugcaguggcgcgaucuuggcucacugcaaccuccgccucccagguucaagcaauucuccugccucagccucuggaguagcugggaggacaggcacccgccaccacgcccagcuaauuuuuguaugauuaguagagaugggauuucaccaaguuggcuaggauggucucuaucucgaccucgugaucugccugccucggccucccaaagugcugggauuacaggccugagccacuguacccggccagguguaggaauuucaggggcgacacugcccaugcccacucaccuuggcagaggcccacgcacguccccuuucuguggggcuccaucuagugcccgucagggguucgagucagggccgggugcaugcaugugaugucccugagacaucacugccuugcccacaugugaggccggaagguuuccacgugggcugccguccuucugagagcccacaccucccaccuuccaagccaagggcucggguacagggccuuuccugauuggggcugccaucuccucuguagaacugccccauccauggacgcugccagaggccccgcuccucccuccaccucccuugcagucucuccugccugcccugcuacuugccagagacaccugucccugccacagccucccccucugggccaccccuggcccugaugccagaggcucccaggcccaucugccccaccccugugcaucccgggagugccaccugucccagucccacugagaacgacgcucccccacaucaugacacucuuucgcccucucuccccaugggcgaaacccagggacagugccacuggcugccagggcaccgugggccaggcuccgcccugcucacuacccacaucccagggccuccgggugcggccgucccaccaucaucagagcacaggcucugcagccgggcugucugggcucaaggccacuccaccaugauuagcuaugauacccacgcguccaugccucagucucuuuauccaaaaccagggauaaaccaguacuugcaccuugugggcggugggaugcucggcuaagaacgcacccacguggagcccccagcacaaugaguccccaaacgcgggccagcugggaggcucccuuguccuggcaucucuccuuuccuccccaccgggacccuguggccaccugcccugaguuucgguaacagccucccaccugucauguggccuccugucuuguccacacucuuaucacccuccgaaacucagcugauacauguuuguuuuuuuucuuuuuuugagacggaguuucacucuucuugcccaggccggagugcaauagugcaacggcauggucucggcucacugcaaccuccgccucccggguucaggcgauuuuccugucucagcuucccaaguagcugggauuacaggcgcccgccaccauaccuggcuaaguuuuguauuuuuaguagagacgggguuucacuauguuggccaggcuggucucgaacuccugaccucaggugaucugcccgccucagccucccaaagugcugggauuacaggcaugagccaccgcgcccggccauguuuuucuucuuuuuguuggaagagacagggucucacuauguugcccaggcuggucuaucuacuggccucaagugauccuccugccucagcuuccugaguaauugggauuacaggugugagcugugugaucuuuguaacacaaccuguuccagauccuucaacagcuccccauggccuguggcauaaaguccauggcaugggagccgugaccuggccccugccacguccugccacuccugccccacccugccccggaugcgccugcaacucccuggacgaaccaggcucuuugguaucucuaacguuugugggugcuggccccacucuccagaauguucccucaucccacauuccauuaauuccuaguccccccacugaggcaggcucaggaguuccccccuuggagcccccagccugggcuuggugccucgccgugugcugggagggcacucgcagaccuccagcuccggauguuguuucuaauuccugcuccccaucaggccacgucuuucccccuuccccagcaccaagaacagucccuggcagagcagaggcugagcguacauuuggugccuggaggaaggcauggcaaaggugucugcuguuugggaggcucagcagugcagggcgagaagcggcccggacgccugguuuggcagccagaccacucguguccgaccccggcuaugggaccacagccaccuguucagccuugcucagcgucagcucuuugguaaaaggaggauaaucaucagcuucccuacagcauugcuaugagcauuaaaugagacgauauuuugccuuacgggccaccaaccagccaacugccaacuugcaaguccacuccgggagccaugucugggacauuaacggauauucacugucccuuggaggcugacggaagggggcaccucccaccccacgaggcaugaacuggcucuacugggcucaccagggucucucuagagcccaagccaggacaccacggaguuuaaugaagaccugcuggaggaaccaagggaaucagagugagaaaucccuuuuguuccggguggggagggcauccacucuugacuugggaacacucagagguuagguuugggcccagaggagagaaugcagucuggaagccgccaggauucaaaccaggcucuagguucuuguauuauuccuuccagcaacccccuaaggagcacuugugagcgcugggacucugcuggaggcugugaggaggggcuggaggagagagauggguguugggacugugcuggaggcuguaaggaggggcuggaggagagagacggggguccuaccucacagagcugagcaucuagggagggaggaacacgaauccagaaccacacacggaaagauuccaaaauggggcacacacggagaaggaaguguaugaagggaaguacaauccagucugcagucggggagagcuucuuggaggaagugggauugggugaugggcugagaagucaaguacaagggguuaaggcggugggggcgggagagggaacauggagccggaguuagagagagaggugaaggccuccugggcccuucucaggggaagaaagcagggagggcaacagagaagagucucacccaagacuccaggacaggugggacgggggcucuuccagggcaggucgguggggaguucccuuccagggcaggugggggguucccuuccagggcaggugugggggauucccuuccagggcaggugugggggguucccuuccagggcaggugucgggguuccuuuccagggcagguggggagggguuccuuuccagggcaggugggggaccccuuccauggcaggugggggggguuccuuuaccagggcaggugugggggccccuuccaaggcagguggggggguuuccuuccagggcagguuggggguuuccuuucaggacagguuguggugggggggccccuuccaaggcuggggauagccuggagaugccacggcagaggaaaggggcuaguaauggcgaggcugcgcuuuaagacaaaggacuaaagaaaggguuuuuuuccuccuuugcaaagagacauuucauguacaguugccacuuaggguuuacagagugugggaaaucaauguucgccuucguguucccaucccuugguaaagcacaaaacuaacagugaaugaccaugugagaacaacaaacacauucuuuaguaaaagcgcaaggagaaaugaacgcaccucuuccugauagcugguccuguaggaucgcuccagcuccugauccaggaaguucaggcugaacugauuaaugggcggcuuaaaaaaguaaucuuucaucaggcuagaagacacaacaaaugcagucgaucaauacccagcaccauaacugugccaauguuuucagaucauaauuagcuaccaaaacgcugcucauuagguauauuacaacagcugcgucuaaaagcgccuguggaacagacgccacucagcugccccuuguuaaaacagaucuguggaaaguccuucgcaccucaaagcauaaucauauuuuguguuucaccuucguuaaagaaugaccauccaccaugauuauagcacacaucaucagaaccuugguuuuuugggguuuuuuuuuuuugaggcaaggucucacucugucgcccaggcuggagugcaauggcgcagcgaucuuggcucacugcaaucuccgccucccagguucaagcaauucuccugccucagccuccugaguagcugggauuacaggcgccugccaccgcacccagcuaauuuuuguauuuuuuagcagacgcgggguuucaccauguuggucaggcuggucucgaacuccugggcucaagagauccacccaucucggccucccaaagugcugggaugacagcgugagcugcugaggcuuguuuuugaaaacacauuccuaaugucuaggauuaggagaagaugaaggcagcuuuucuguucuuugaaacaaucuuuugugaagaacacgcagaucacugugcugagaguacuuacauggauuuggaggcuucaaacgaaaacauaauucagaaccggcgguccugucauucagagcacugacaguaauugccaccguaaaagcuaacagguuguuaucacaaaauuguguuuauaguuagcguaauuuuggugcuauugucacauaugcagauugcaugugaaaccugcagaaugauaaagcucagugauuuuaauagcagggaaaucaaccccgcuuuccaugacucuuucauucauuuaugaauugccagcaaauaguaauauccuuucuauacugcagaaaauuacuagaaacuaagggaacguuaacaugauuucagaaagcaaauauagcuguguuagccucucucccucauacagugacuaucagaaguaaauuagacgaggcugggcgcgguggcucauccuuguaauccccagaccuuugggaggccgaggcaagcggaucaccugaggucaggagcucgggaccagccuggccaacauggugaacccccguuucuacaaaaaauacaaaaauuagccaggccugguggcaggugccuguaaucccagcuacucggguggcuaaggcaggagaaucacuugaaccugggagauggagguugcaaugagccaagauggcgccacugcauuacagccugggugacacagcaagacuaugucucaaaaaaaaaaaaaaagaguaaaucaggugaaauaugucaagugccucaugugccccccacacaaaguacggcucaucacguguguuccuuccuguccuugcagcacggcggacacucuccuuucugugacagguauccaguaacuuccaacauucucagacucagaagagaaauaauucugucccaggacacugacccucucuccuccccugacucagggaguguggacugagggaagagcaaccacgcagcugcagagaggaugugcacaaggccacauuuuagcagucaaguggcagaagcgacacugcuauuagcugugcugcuccauuuauuucuuauuuguuuuuugagauggagacucgcucuguugcccaggcuggaguugcagugcugcgaucucagcucauugcagccucugccuccuggguucaagcgauucuccuaccucagccuccugaguagcugggaugacaggcacccgccaccacgcccagcuaauuuuuguacuuuuaguagagacgggguuucaccuuguuggccaggcuggucuugaaccccugacuucaggugaucuaccugccucggccucccaaaguguugggauuauaggcgugagccacagcgccuggcugaaaaucacccuuugaggcauuauagugaagacagaggcaagaaucaucaaugaauguuaaaucuagggaauucugauggggaaugaaauauguacaagaucuucaaguauuuucucacagauugcuuauuagucauaagaggaauauaauaacccuagaugagacaacccggcaccaccuugccuaauuaaucaaaauuaguaucacuaaugaggaacagacgggcacugcgugucccuggagaggacacccugaggaggacacggcaucccuucugcagucucugccuggccagagggagagccugaaucuaaccaauccaacuucaggaauauuugauaaaaggacuggaccuguauuuuucaaaaauguuaccauuaggccaggcacaggcucacaccuguaaucccagcacuuuaggaggccgaggcgggcagaucaccugaggccaagaguucgagacccgccuggccaacauguuaaaaacccaucucuacuaaaaacacaaaaauuagcugggcaugguuguguaugccuguagucccagcuacuugagagaccuaggcaggagaauuacuugaaccugggagguggagguugcagugagccgagauugagccacugcacuccagccugggcaacacagcaagaccuaguccuuauaaaaaaaaaaaaaaaaaaaaaaaaagccaggcgugguggcucacgccuauaaucccagcacucugggagggugggguagguggaucacccgaggucaggaguauggagaccagccuggccaacaugaugaaacuccaucucuacuaaaaauacaaaaccuagccaggcaugguggugggugccaguaaccccagcuacuugggaggcugaggcaggagcaucguuugaaccugggagauagaggcugcagugagccaagaucgcgccacugcacugcagccuggaugacagagcgagacucagucuuaaagaaaagaaaagaaaaaggcagagaggcuucugccugcaaccuuugcuuuuucccagacagccccagucguaccugucuucuuugauaacguccacaaagugggcguccguuuucucccggauguucuugaaccucagcggaaggagagccgacugguccaggcucaccccugcccaccuucccuucuccugcaagaucucacacagagaagucugacuguuggugagcuucuccucuuggggagggcugaggagcccguucugaguuuugggauuagguccuccagaagccugccucgagacaaagaggacgcagacacgggaagugaaguggcaccgggcacugggcacacacgccugucccaccccgaccuccgcugcggggcgcugcugcacugggcgugggacuuucugaccugcgaggaacccccaccccccugcgccuacagaccugcuccaaucccagcccugacugcccgucugcuccuuccuguuacccaacagugcccagugguaacgcuggguguucaggcugccaggacauugagacaugggaagagucggugcggagguggaggggaagggaggaaagugaggagccgaggcccccagagucugcuuaggccagaaccacgguucugggagcagggugcaugggucggggguccaggagaaguaugacgagggguccagggcugucagggcacaggcaagguggauggaaacgggcucgugucgugggugucccccguggcugugggaaggcaugggaugaccugcaccugcaauccuuuggcagauggagagcagauggaggacgagagcccgcgccccaggugagucgccugcaugagcccccgccgacaggcucucgcgggugggcugaguccuggcccugguguccaagucugguuuuccugaaagccuuccugccaccggcccuaacucccaaccucucucuucacccagccuuucucgccgugaagacccccucuugucucugcccgucuauauucucucauaaacugaguccagcuuccaguaccacaaauccccucccggcacucgaauccacgcauuuuaaacccuuauuggccuuuaaaggaaucccgcccagcucagccccugagcgcugguuuccacguggguugcugcugacccucccucgagcucccugccggucucuucaacacccggaggacccgcgggugcggagugcuguuacccaagaggaguuacucucagaacuaagaagucgacaagacaggaaugucaccuuggguggaugcgccaggagaggaacugacaggaacaacagccaugagcuuguuaccuuggugcuguuuuuaugcucgucuuggcagccguuuugaggugcuccucccucggcgccggcuucagauuugggagcaaaugugauuccgcacgaagggcaggucuagaagaaaaacacagacuguggggacacacccagaaaccgcgacugccacccugaauucaggcagguccgcuguugccaucugccgucacgcagcaugguggugagcaaggggaaggcacacagaaccgcucggggaugagcugaaagccaacgggcaaagugacaguggaaacacacagaaacccgggcacgaacgcaacaggacccaaaaauggaaccgggaauguucacugacugaacaauggaucaacaaacuguggucuauucgaacaaugggauauuacucagccacgaaaaagacggaagcacugacgccugccacagcauggugaaccucgaaaacauuaugcucggggagggaagccagacacagcacagauauuacgugaucccgucuaugugaaauauucagaaaaggugaauccuuggagggagaaggcagauuccuggcugccaggcgggaccgggggcaggaagggggaguggcugcuaaggggcgugggguuugcuacgauucgaauguuugugcccccucaaaagucagacgcugaaauccuaauucccaaggggauggcauuggggggcaaagccuugggagguaauuaggucaugggggacaagccuucaaaauaggauuagugcccucauaaaagaggccccagaggaaucccucgucccuucgcccugggagaaggcaccaucugugaagcaggaacggguccucacuggacacugaaucuuccgggaccuugaucucggacuucccagccuccagaacccugagaaauacauuucuguuguuuaaaagccaccugguuugugguauuucaacaggguuucucuuugggaugauaaaaauguucugaaauugaucacggugaugguugcacaaccuugcuaaauauacuaaaaaccacugaacuguacacuuuaaaaagaucgauuuuuaaauauuuuuugagauggaguuucacucuugucacccaggcuggaguacagugucacgaucuuggcucacugcaacguccaccuccuggguucaagcgauucuccugccucagccuccugaguagcugcgauuacaggugccugccaccacgcccggcuacuuguuuuguguuuuuaguagaaacgggguuucgccauguuggccaggcuggucuugaacuccugaccucaggugauccacccgucuuggccucccaaagugcugggauuacaagcaugagccacugugccuggccaaaaagaucgauuuuauaguaugugaauuauaucucaacaaagcuguuauuaaguaaagaaacuggccaccaacuaugcgaggacacaaauccaagguucuuaagcuccgugugauggugagcuagucucauaagaugggcugaauaaucaaagguacacgauuuccagaucuaggcguacuuaaaaguuuauaggaauuaauggaccuagaaaagagaaggcaagauuuaauacagguacccuaaaaagagcaaagccuuuauuucucauaaacuaggauucaaacccuagucaaguacuuacuaguuuggagacucuguucaaaucacuuuaccucaguucccucaucuauaaacaaagagugaagauauguugcuaagaauuaaaugaaauuggcuggguguggcggcuguaaucccagcacuuugggaagcuggggugggaggauggcuugaguccaggaauuugaggccagccugggcaacauggcaaaacccugccucaacaaaaagcauaaaaauuagccuggccugguggcaugugccuguagucccagcuacuuguggggcugaggugggagggcugcuugagucugggaggucaaggccgcagugagcuuugauggugccacugcacuccagccuggggcaaaagagaaagacccugucuuaaaaaaauaauaauuaaaugaaauaaguauauauauagccuagcacaguuccuggcauacaguauacccguaauaaacuuauuauuauuauuaaugugaccagguaaccuaggaaccaucuaagaaagcaacuaacagcuuccaaugaagaagacaaaccguggcaagaaauauauuuuuuuuuuuuuuuggacucaaaagcaauuuccuugcagcaagaaguguaaaacauugaaauaaauuaugggaggccagauauuauuuuggaaauuuaaaguaagugucacuaccuaagggcaaagauaugacccagguuguauuuaaaguuagacugcagaccuguacuauauuaaauaaaagaaacaaagauucuacaggguuguauaguuugggaaucugauguaacauacaagcuaaauuugaacauuuguaugcauucaaaaaaugaaaauauacaugccaaaacagcuagcgaaaucauuaauuaacauaucugagcaaauaauggcaucuagauaacauuugcuuacagcucuuuaaaaacugacauuaucaacagagguaaaauguucuaguuaucaauaacauacagugagucuauuugaaagcaccucuugguauugacuggcagaguuaaacuucuaaacauuuugcuggugugcuggcucacaccuguaaucccagaacuuugggaggccgaagcaggaggacugcuuagggccaggaguucaagaccagccugggcaacauagggagaccuugucucuacuaaaaauaaaaccaauuagcugaccuugauggcacgugccuguggucccagccacucgggaggcugaggcaggaggauugcuucagcgaaggaagucaaggcugcagugcacugugauugugccacugcacuccagcgugggugacagagcaaacccauucucaaaauacauauauauauguauaaauauguauauauuugccaaugagaccacugcucuuauuaaauguaaaaaaaucuaacaccaagagaagaauaaaauaggugugccugauacccaugccuaaaagaugccugagggaacucucugguguggcuaagguggggggcuuggugcuugauggggcacaccagccauuucagggcccaaccgguagaccaggaaaggaagcuggagguguggaagcgucugcugcacuuggcucagccaaagcccgaagugcaagugcgugcucaguaaaugcugguagugaauaugaaaacuucuguuaacuaugcucucuggucauuaaaguucaucugguaauucaauguccuugauuacagacagaacagcccuugguaucuauucuucuguagccauuuagucacaggaaucuccuggcgucagucuguuucagguauuuuucuugccucaaguucaucugcugugcuuuucucucuuuuuuuguuuguuuguuuuuuugggacugagucucgcucugucacccaggcuggagugcaguggggagaucuuggcucacugcaaccuccaccuccuggguucaagcaauucugcugccucaaccuccugaguagcugggauuacaggcgcccaccaccacgccuggcuuauuuuuguauuuucaguagagaugggguuucaccacguuggucaggcuggucucgaacuccuggccucaagugaucugccugccuugcccucccaaagugcugggauuacaggcgugagccaccgugcccggccaacccuccugugcuuuaagacgaggccgccugcuucuucagugccccccacggcacacuggcuuuaugagauuuucuaagcauuuagagccaugaaugugucaccgugacagucaaaccaacuuggcaccagagggcacacugaggacagggggcuccaugcccuccacaagggcuucccucagaggggcuggaaggccggugcagcccgggcaugcccacugggaugaggcugagcucugggggccuggggcaguggucuccacagguggggaacucagugcuuugcuuacauccccuugaacagaggccgaggccugcacccugcagugauaagaaguucugauacagaagugaggucuggcagagccgcccacaaauggcaaaugaggcugcgcuugcagaaggaagggggcugucugggucacauggccagcuguagacacccacgcucgggccuccugagggccgggacagugcucacugccuauuccauucccagcagguuuguccgggaagugggaguaugggagguggggggagagccaggugcagacuccaggccgcgcuggguggcauggucccacagaccugugucacccggacccagcagccaucauuuuacugcacuuugaaaaugcggauuuuggcugggcgcaguggcucaucccuguaaucccagcccuuugggaggcugaggcggguggaucaccugaggucaggaguuuaagaccagccuggucaacauggcaaaacccugucucuauuaaaaauacaaaaauuagcugggugugguggcacacaccuguaaucccagcuacuggggagacugaggcaggagagucgcuuggacccgggaggcggagguugcagugagcccagauugugccacugcacuccagccugggcgacagagcaagauuccucagcuaccuuccuuuugagggauaauuuucuagauaaaaacuuucaaacaaaugaaacaaaagaaaucuuagagcugggugugguggcuugcuugagcccaggaguuugagaucaaccugggcaauguaucaagaccccaucucuacaaaagcuuuuuaaaaauuuuagaaauuagcugggcacaguggugugugcuuguagucccagcuacucaggaggcugaagugggagggucgcuugagcccaggagggagaggcugccaugagcuauggucaugccacuguacugcagacugggucauagagcaagaccuugucucuuuaaaaaagaaaaaagaagccaggcgcaguggcucaugccuguaaucccagcacuuugggaggccaacauggguggaucacaaggucaggagauugagaccauccuggccaagauggugaaagcccgucucuacuaaaauacaaaaaauuagccuggcgugguggugcacaccuguaguuucagcuacuagggaggcugaggcaggggaaucucuugaacccgggagguggagguuccagugagccgagauggugccacugcacuccagcccgggcaaaagagcaaaacucugucucaaaaaaaaaaaaaaaaaaaaaaaaaaagaaaagaaagaaagaaagaaaagaaaagaaaagaaaagaaaagaaaagaaaagaaaagaaaagaaaaaaagagaaauccaucuacccaauggagagauucucacaucucaacauccccuucugagcuguaguuagaggccccuucuguaccaggagggucccaccaugcaaugguggguggguuuguuucccuccccugaccuccuaccccccaacccccauggcaauuuuccuugagcgauucauuagcuuaauuuuaaucuggauuaagacauuucacaacauguuuuuugccaaguacagaugccucugugaaauguuucccagccggcuaaacagcgucucccccugcacagcugcaggcaucuccaccccugcugagaagcccucccugggaagaguauuucugacuccaggaagcugcaggcauggaagcaccucacugccuugggagacaacccuagcagcuggcucacagggagccacacgggcaggcacauuagagaaaaagcagugucauaaugacaguagcuacuaugacuuaggaaugucuaugggccaagauccuacccgugaacaagucgggcccccauccacgcaauaucugcagucucgacuguaugaucucguccuuugcagccacacugugaggcagcaaugaucauuccgcagacggccacagacuccagggcccugggacccggaccaccgucauauggcucuggcccccuuuccuggcacaaggaggacccaggaauaauccuggcaccuugcucuccugggccuuguuucccuagagugaccugagcagcuaugccuguccuccugguucuuccaagcagcacccugggcccuccggcaucaagggaagucucaagacuucuaagguccucccagcagcacgccuggcgggccagggaguuugcuggcuguugccuggguaaccugagauucccuggagaacgcccaagagcaaacucugcauuuuuccggauuaucuuugcuccuucccccauguggacgugggcuuuggagggaagaguguagccauuucucuaacacacuugggcacauuugcauuuguuuuuaacacauuucaggacgugcacccuacauuccggucaaaauauauggcacaaagcuauaaaaucguuuuuucuucaagguuauuucucaucacaagauaaaucauuucuaagccaacagcugucccuuuucaaaacugucaagggagggaguggggaaaccucuuuucucagaaaugaggaggauacaccaguagaagagcccuggcuuugccugcuucgucuucucaacacgacuguuuugcaagaugucguguuaucagaagcauccuuugcucccaaacucaaaaugauguuaacauggugagcaggaauagucaugauauugcaaccacaauaaccacaaacacaauuuccugagguguucuuugaaacuccuuguaucugcuuaacccucguaagcaaccacgaugcagguacuaugaucgguuccauuuuacagaugaggacacugagacagagcaagcacuggcccagagccacacgguacggucggaaccgcguaaagaggcggugagcccaggcagcagagcuccuggccccaacgaucuccaggugaacggggcagccugucagugcggcagagccauggggcuaacucuaugucccuggcauugcuguuuaagcuaacagguuagguacgggcauaaguacaaaauagaguauuucugcuaaugcaacauuagagaaaaauagaagcagaauauuagaagaaaagauaagcaguaauuaucacagaaaaagaaauuuucuuacauccccaaagcaguaagaacagacagcagauggccugagaauacuagacaagucaccacaugaacacacacguguaaaacucacacacacaaucucagagccacacggggcggagucgaaaagucccuggaccucucacucaaucccuuagcccuaaaggaccacugggcucaauaaccaggcuggugauggcgauccgagucaagaauagaugaaaauauacucagcagacugucaggcaggaagacuguuaccagcuguggaaacaguccaucaugaagucaagauaagaaaauauuuggcaucuggggaaauuucauggaaaugcaauauuucacucucuggcaaugccaguucaaugauuccgcacauacauuuccaucccucucucuacacacacacacacacacacacacacacacacacacacacauauauaauuucuuacuuugaaauaauuuuagacuugcagagagugggaaagacaguucaaggacucugcauauauccuccguacauacucaccguacaguuaucaaaaccaaagcaacucaugcuggcgcgauaccguuaacuaagcugcuggcuuuauucugauguccccaguuuccgcaccgucccuuugcuguucgggucuccucuaggucccguguugcauuuagcccucaugcccccugcucacccccagccuauggggguuccucugucuuucucugucucuucuggcccugcugcguuugaagucccggccaggcauuuugucaaauguccagaucuggaccugccuggugcuuucucagagcagacugagguuugggguuugcggaaagaaugccgcagaggugacaugcccuucucagcacaccacacuaggguaccggauggcagugagcagggaggcucaccuggaucauuuggugaagguggcaucugcccgguuuguccacugugaaguuccuauuccuaccccgccccccaccuuucuuuuuugagauggggucucauucuagugcccaggcuagagugcaauggugcaaucuuggcucacugcagccucugccucccagacucaagcgauccucccaccucagccucccagguagcugggauuacagguggauaccaacaugccuggcuaacuuuuauaguuuuuguagagaugguuuuuuuuuuuuauuguuuuuuuuuuuugagauggaaucucacucuguugcccaggcuagagggcagugacaugaucucagcucacugcaaccuccgccuccagguucaagagauucuccugccucagucucccaaguagcugggacuacaggcaccagccaccacacccggcuaauuuuuaaauuuuuaguagacaugggguuucaccauguuggccaggcuggucucgaacucuugaccucaggugauccaucugccuuggccucccaaagugcuggaauuacaggugugaccaccucaccuggcggagacuacccuuuaguuuuacaacagcuuucuuaagaugucauuugcaaagcauauaaugcacccauuuaaaguauauaacuccaggguuuauagcauauucacagggaugugcaagcaucaccacuaucaauucagacuaccacuuauaauaaauaccuauuuaauuucuaagcuauauauauuuauauauguaugugucuauaaaauaugaaaucauuuuuucaauuucuauaacgaaugaaaagccccuuacuuccucaaauugggccaacugagccuacucauaaugacuugacacauagaaaacaaguagauaaaagaaguuaucauuuagggucauuuucaaaauucacugucacaaaaggaugguuccugaggugaguggccuuaaaggggaaggagaaaccuuuugaaagcaggacagguccucucugaaucauccccguauggguaaaucuacaucacuagcuucauuacugacugguccauguagaaacacccaguggccaagcagcccgggguucugaauaauagaugaagguaaacucaggaagaccagccacgcaggugcgcuccagggaggccuuucagagauguacuaagaugcuuucacagcucaaaugguucccugaucagaaguaaugugauacaaguaauucaauuuuggguuuucuuuucuuuucgagauggagucucacucuauugcccagucugaagugcaguggcguggucucagcucacugcaaccuucaccuacuagguucaagggauccuccugccucagccuccugaguggcuuaggacuacaggcauaugccaccacaccuggcuaauuuuuguauuuuuaguagagaugggguuucaccauguuggccaggcuggccuugaacuccugaccgcaggugaucucucugccucggccucccaaaguguugggauuacaggcaugagccacugagcccaguuggguuuucuuuuucuucaugaagauguuggaaaagcuguuuuuauugauauauggcaucuagauccacucaucacccacaggguucaugagaaaauggaaagcaaaugccugcuggagcgcugacgucacauucaacaggccaaggcacacaugcucccgugucauacaagugacuugguuacggccgagagcauccaacccacagcaaugcucagccgcaaucacugugagaaucucccucgaaucggaaccguggagaagaugggaccuuccccagagagucagugacuuccugcaggcaagcugggaccgucucucggccccucccaguccuccauggcuccgucuguggucacugucccugcucugcguggagugaaggcgugcgugccgagugugagcgaggcuucuucucagcccuggcguccacaggcaccauuccggcucaucucccagcaaucccgagaggucucuuccuuaucaccaccgcacugaagaggaaaacucucacuuagaggaauuaaguguguguuugcucuuucuuuucuuuuuuuuuuuuuuuuuuugagacagugucucauucugucacccugguuggagugcaguggcaucaucacagcucacugcagccucuaacuccugggcucaagcgaucuuccugccucagcugucugaguggcuaggacuacaggcaugagccacugcaccuggcugcaguuucuucacagucgcaaagccaaggcuugagaagggucuugcuucaaguugcgccccugcccgccgugguccgccuccccuccgcgacgcugacaguggcguccucaugucuaaugcuuacuccuugguuuccuucuugaccucuccuuccuucacucgggcaguaucugucccccacauuaugcaaugucagggcccuuaggaugaggaccucucacugcuggucauuucaagaacccaaggccaggcacaguggcucaugacuguaaucccagcauuuuaagaggccaaggcaggaggaugguauaaccccaggaguuggcaaccauccugggcaauauagcaaaaaaaaaaaaauuuaaaaauuagcuaggcauaguggcacaugccugugguccuagcuacucagcagguugacuugggaggaucacuugagccugagaguuucgagcugcagugagcuaagaucauaccacugguacucuagccugggcaacagagcgagaucccaucucuuuaaaaaaaaaaaaaaaaaaaaaagaagccaacacuuggguguagaaaggguucccuuugagcuaugacuucaggaccaaagcccuggccuuugacaucacuaucauuuccugguaggucguuacaguacacagguuauguuacauuagauaagaauuuuccagcuaugaccuaggagaugacuuaaggucacagaggacacacaugcuaagggcaggaaauaaacccuucgugggcgcugcccugguucuacacaguucugcucgggcuucugacuucaguccuucgccuggcucugcagagcugcaucgcuccauguguuuaauuaaagaauuaaaaagccaaaaagaaacuguuaauuacuacaugccaggcaccaugcucgacacuugggaaauauuuaaguuauuuaacacucagucucugaaugcaaagagcucccaggaagacgcauaagaaacaaagauuuaagaucguguauguuacagccaagugggacagacugaagggacugagaauuuggagacgagggaacagcguuaucagcugcggaggcacgggaaggcgugguggagcugaacggugaaugcagacaggaguucaggggaaagagaagccaugaguaucucaagugagcagcagcaggaacaggacacacgugaaaaucuacgcaugcuccuucagggaacguuuccugaacaccuuuucucuaauguauugguccuuggcaugaaacuccuuuuacuacaugagcauucccccaaaaggugugaccacauuagcccugcaaggugcagcuugaaaaaaaacaauugugcucaaagaggccugagaaugcuguauauaccgcguccuccucugaaggccuagcuacugucuacuagccuagugaaggcuccgagaaguccugcaguaaagaaacccuuucuguguugaauaucccaagcuucccgaauuuacuuuaccacugagcacccuccucccuuuuuuuggagacaggacaaggucucacucuguggccuaagcuggagugcaguggcaaaaucauagcucaugcagccuaaauuccugggcucaagugauccucuuggcucagccucccaaguagcugggaccgcaggcacaggccaccaagcccaguuaauuuuuaaaauuuuuuuguagagaugaugucuugcuacgaugaccaggcuggucuggaaauccuagccucaggcaucccucccaccucggccgcccacagcaccaggauuacaggcgugagccaccaugcccggccuucugucaacuugauagaucacaagauucucagaaacuuucaacaauauuuggaaaaucuccacaugccaagaagauacgcuaaaugguuuuugcucauuccgaccaaaacaaauauauaugacuagagugcaauguaguguagaaucgccauugcuaaaaccguggucacuaaacccgugagcaugugauauggugaacucugcgaccgcauccccuaacggacagaaacacacauauguggaagcuaaaauggcaaacacaacgaauuauauauuuuuggcucggggcugucuuucacgacuuaaauacagcucaguuugcaggcuggaggaaacaauucuuccccaaauagcaaaaccauucccgauuccaccccacgccagccccucccugcccggguccgcugucuaggagcccagagcuccauuuucugacuccugcacaacgucagcccaggcaaggcggcugucucuaaaguuugcaggcauccagggaaucucagauacaugagcuuuacacaugugccaagaguacagggaagagaggguccaacaccacugucccggugguuuucacccaggggugacucugcacccccaggggacacugggccaugucuggagacauuuuugguuggcacagcuggggaguaggguacggguggguaugcugccaucuggcagguggcggcuagggaugcugccagccaucugacagugcacaggacagccccacaacacaugacuaccugguccaaaaugccagcggugccaaggugagaagcccugcauuacacuaacaaagcacccaacgaccgcgauccacgagcggaguugacagaacccgagugcaaucauuacguguaacugggcgacaggcacuauguauucugacccaguaaguaaucugcauaccccagcugacugccacauaaugaagacuguuccucguaaauaccaauagcggcuuucaaaccugugaaugaauguggagaggcagggacguauugggugaagcuguaaccacuggccgccauccucacacauaccccacuguguuaucugagaacacaaagcagcauaggagagcuguuuugauucucugucucauuuuaagaauggagacaguagauguuuaaacuauaaaaauaaacagaagguaccaguggggaaacuaaaucaaaugugaaagcaaaggaacagcucauaaacugaaaugauuucacacacccaaggucgaccgcgccaauucccugguaguuuaugaugacaggucaguccagaaacgggcacuucuaggcagcuaccaggagaucccgguuccaauaaugaaauacuacaauguucucggcagccuguccucucagugagcuguguccuaggauucacccacaccaacaucauuucaaguaaucauaaaauaguggauuucaagagacguagaaguauuugagaaaguggucucugaaaucagauuaucaacuagcucuccacccaaggugccaaggaaagccaccuuuacugucauuuaucaccagcuucuagaaaucccaaaaggcaccacaggucccaggaagagaaaauaacuaauaauucaaaugagaagcauccuugugcaauggaaaggcaauggaggugcgucauaugucaaaaagcaaggauguuaaaaaugcagaaugcuacuaacuuuagacuaaauauuaaaaucgugaaaaccaaaucgaaggucauuccaaguuguuugccucagaccuggaggcugcuuauuauuucacgugcucuacugcagaauuaauagaaaguuuuagaaguaggaaaaaaaaaacaaaaaaacuaaccuuaagguuaucaaagguuuugacagucugcgccaagucacugacauucccugaugacgcuguccccuguccccuagggccugaggacaccugugagccgucaaugaccucaaagccagaaagcaaggccucugcacagcugcagcgagacuccuuggcucucugacccgauaucagguaugucuucaaaccuaugauggauaaaaguuacagucagcacagauugaaagcaccgucuguugaaacgcagcuccgucuugcucucuggagaggacucacuccuggaaaguugagaguaaagugaaaaugugaauaggucauaguuuacgacggacguccacgaucucuccagagagaugcggccucagggagaccgugggcccccgagacacaccacucacccacguuacguuuucuuggaguaauggcugcauguuucauguuuuaccuucaggguuaaaauaagcauuaaaaaguuccuccaugaaagggucccaggaccuccccgugaaggcagcaaagcagauugguugacccuagacacugcuuugguuuauuuccaucugugaauaccaguccagugaguaccuuccuaacggucagucuagacgucauggcagcuuccgguacugaccaucuuaccugugucagaggcugcaaaacuaccccgaaaaacaagacccuaccagggaccaagaggccauuaaaaccuccccagacucagagcuguugagcaucuauuuccuguuggauucaaacacucaccccaggaacauucagcuuuuguuaagcugagguccacaugcauuuuauugucucacaaaaucccgcauauagaaaaaaaaaaaaaagguggucaaaaggacacuugaccuguaucuuuacaauucuccuuugaggcugagcuaacagccggacccacacugcgcuggaaggagcugugaacagguggguggauccugccccgggaaucugcugggaagauggcaaaggagcagcuuuucuagaaagagcccaaggaauuuuugaaaaagaagcaaacuuuauuuaaagaaauccauccuuugacuucacuggaauuuaaccagauggcaaauguaucggaaggagggacaauguaauuuaacauuuaaauaacauuuauuucaggccuaguguaugccacacaccgagaauaaaaucaugaacaaagcagggucccuucuuuuuuuuuuuuuuaauugagauggagucucacucucucacccaggauggagugcaauggugcgaucucagcucacugcagccuccaccuccuggguucaagcaauucuccugacucagccugugagcaggcagguguccaccaccacgccuggcuaauuuuuguauuuuuaguagagacaggguuucuccaugucggccagacuggccuagaacuccuagugaucugcccaccuuggccucccaaagaugacaggugugagccacugcacccggucgcagggacccuucuugaaggguuuaagcuccagcuucaggucgugaaggguguggcauggaaagaugccaucgagaggcgacgugucuacaacacugaucgacucuggcuucuuacgcuggguacauauuuggucagcgcuuuaaaauuaauuaaucagaaaccuagggacuacuucaucaauaaucccgaaucauuuuauaaguauggccccaucucaucacuucaccucccucucuccuuguaaaaauacuacguggcuaaucuuuuuaagucaacuguucugagaauuugccaagaguccuagaaacacguaaagacagccuagaacguagccaggucauagcugagaaucaaaagacuuagauauuuuuagaugccaacuggccccaagaaacucuucauguuuuguuuuguuuuguuuuguuuuguuuuuccuuuagagauagggucuugcucuguugcccaggcuggagcgcaguggugcaaccauggcucccuacagcccccaccuccuauagccucagccuccugaguagcugggacuacaaacguccgccacuauguccaacuauuucuuucuuucuuuuuugagaugggggucucacuguguuggccaggcuggucucgaacuccuagacucaagugauccgcccaucuuggccucccaaagugcugggauugcaggugugagccaccacaccugguccaaugaaaaucuuucacucuuacuuagcuccugaacuuuugugcauuuuuuucuccaacaaaaacccacaucccaauuuaugcacaggaucaaucacgacuguaacauguauacacugaaauggaaacgugaacuggaauacgacgcaggagugaagccaucuuuauacuaauuucucggaccugucccaggcgacaccagacugacuuuguaacuucacuuugccagaguuaaaaaaugcaaccuauguggacucaagagaggacaaugagcugccagggcuuauacccgccuucaucaaagaaguacacgcaaggaggccuguccuggggcugcucuaagggucuccuucccaugacuccugaguguggcccacaagucaccagguggcaggguggugacaggagccacugacagccagugugacuguggauggccacucuggagaccgcaguccccacauacugagagaggagggacauuuuuuugaugggagguaggaaaaguugcggcugaaggaugagguuuuccauuaugucuguggcuggcccugcaaggugcuguuggcucagggugccccugccugaggcuacggcuccccaugcacaagggcugcccugggagcaugaacugggcugccucugaaacccaggaaggggcccucacccaggugacugcgcaccugcucccuguguggcuccgggacugcaagagaaagucaagauggccucuccuagaagugcguggcaacugaagcugagagaggcugagcagggaggccugaagagcuggagcacgacgggacagccagcacauucacagcgcucagcacggcaguccacggggagcacggaguggcagcggcggccucugcucacaagcugggcacgugccucaagcacaucuccaacgucugcuguugcuuuuuuguacugggauuacugagucacucuuaauucaucaaacauuuauuaagcacuuccuguuuacuacacacugaugggugcagggacgaugugugacuauuuuggccgagaucgugaccuguguggagcccauuaccugaagaggggccaagaggacaagcagguaugacuauggucaggcgugccaagucccaggacaaggaaggacgggugcuccaggaagcacaggagggggcaucuugagaagccucaggaaggaaggggcuguggcucgaacguguccccuccaaaguucaggcguuguggagugagagucuuaaggaagcagggcuuuaagaggugacgaggccaggagggcuccuccccugcgaugggaucaggcgccugcauaaaggggcuugcuguaaggggcucucucgcuugcccuccaguuuccuucucccuuccagaagaugcagcccuccccagacaccugaaccugcuggugccuugaucuuggacuucccagccuccugaagcaugaggacagaaauuuccgugcuguauagauuacccagccuaugcuguucuguuauugcuucacaagcagauggagacggacggaucagcacccuccacacggagaacugaaagacggggcgaggucagcccggcaauagcaaaccaggccaggggcggggguggcugacaccaggcagggggguuacuagaacaggucaugaaaggcccucuacagagguggccugcagcaggcauagcuaaaggauggcuuggagcucaguguggcuggagcagagaacguguggagggaauggccagggcugagccacagcaccugugcagggcacugugugggccauccugggaagccuccauucuggggccacgggcagcaggggggcgggaggagaaagaagagccacauaggaggcaugaggcguaggacaagccagggagccgguggaaaugccagccacagcgggugggaaguugggaggcacgggagucaggaaauaacaguggaaacgggaaaccuacuccccacaaacugcuggcgagaggcaaggcucccauuacaagcaaccaagcgugaugggcgagggccuggcugcuggagggggccucggagucggguccagguccgcccccuaaucccgugaucuaagugagcugcuucaucucugccucucaguuuccucaucucuaaggggagggcaggagcagagcuagugagcugcuucaucgcugccucucaguuuccucaucucuaaggggaggacaggagcagggcuagugagcuguuucaucgcugccucucaguuuccucaucucuaaggggaggacaggagcagggcuagugagcugcuucaucgcugccucucaguuuccucaucucuaaggcgagggcaggaggagggcuuaccacacagcucgcaugugaggcuuaaaugaucaacacgcacgcagcaagcacucgacauuagcugugauuaucgacgcaguguuugaucugcguaucacuggaaucuuuuucaugcaccuucuacauacaaaagcauuugcaaaacuguuaaaucaauaauugcuccugauuuguuucugacuugaguuuuucuuuaggaagcgcugaaugaccaacccauagugauaacaugauccuacuagcuuuacgaaggucaaacacaccuccguguccacaacgagcaaaaucgggaaguaaauuaucuuuuuauuuaugcuucaauauggaaagcuaaauuuaaagugaaaccuuuugucagaaccagaaggguuaucacccugacagguaaggcagagcccagcugccuaaucacaaacgccugagaaauacaucaggacagguuacugaguucaagcccagcgaaagucuuaagucaggagacucugcaggcgacaugauuuaaugaauaaccacacacauggacccugggguccaaguucauuagaauggcucuuuugcagcagaagguccaaaaaaaaaaaaaagacagcuaaaugauuuaaguguaguguaaacaggagaauaauuaauaugauuucuuauauucuuuccugguuauccauugauuuuaaaccucaacaacagcgaugucuuuuaucagcuuaauuuuacaaaggcuacagagaggggugggcauuuccuaaugggcuccugucugacgggggaauuugucuauggcugugugcguggagguuaacgcaguuaacguucuuaaguauucuuaaguauagugucacuucuuugaaaacuaaaacugcacuuugcacauaguggugaucagguuuggugacccaaguauaggaagagugacugacaaagcccauuuuggaaaagagugaugggcgaggcccauuucuggccucauuugucccagucucuuucugugggauucuugccuuggacugagauacccucagccaccaagaaucaaggaccugacugccaacucaacagaaagagaacaacagcgaggcacggggaucacagcugugaccccggcacucucggaggccgcggcaggaggaucacuugagcccaggaguuugagaccagccuggacaacauagcgagaucccaucucuauaaaaaauuuaaaaaucagcugggugugguggcaccuguggucccagcuacccaggaggcuaagaugggaggaucacuugagcccgggagguugaggcugcagugagcugugagugcgccguugcacuccagccugggcaagagagugagacccugucucaaaaaaaaaaagaaaaagaaaaacaagccaggcguggcggcacacgccuguaaaucccagcuacuugggaggcugaggcaggagaaucgcuuaaacuugagaggcggagguugcagugagcugagaucgugccauugcacuucagccugggcaacaagagugaaacuccgucucaaaaaagaaaaaaaaauuaaaagaaaaagaagaaaagaaaaacaagaaagagaagaauaaucaggaaggaaagaauguuuuaagacaugacuuugggagccagccacauagcauaacaaaugccuagaagcuuacgucacuuaugacuuaaaacaauaaacagaaaagaggcaaucagcuugggcugguucagaaacauuccaaaaacgucuuucacuuugcauugcauucuuccucacgacuaggucggaaacgaccaagcggcaugagaguuauuuaaacuaaacuguaaucagccaauaagaaaaauaaagauaaaaauacucuuaaucuaccaaauagccaaagccuauggagucauagauauauuuuauaauuaucuauucuuucugcguaagaagaacaaaaguuuugguacaaaagagagaauaucuuucauauguuaacauuaaaaugcucuccggaggguuguaaguccuuccuacucauaugcaccauaaauaaucauaagaacugauuuguucuuguugucccaauauuugaugauaaaucucaaguuccuacuacaaauggcugcuggugaaacuuaaccucuucuuaacaaaugaagucccaggucaggcgcgguagcucacuccuguaaucccagcacuuagggaggccgagacgggagcaucaguugugcucaggaguuugagaccagccuggccaacauggcgaaaucccgucucuacuaaaaauacaaaaauuaacugggcgugguggcacaugccuguaaucccagcuacucaggagguugaggcaggagaauugcuugaacccaggaggcggagguugcagucagccgagaucgcaccauugcacuccagccugggugacagagugagacuuugucucaaaaaagaaaaaaaaaaaaaaagaagucccaaauaauaaaauaugagauggauuuauggaagaaagugaaagaaacaaaggguaggcaccuugccuguuuaauuugaucuucugcuuaaccaaaaaaaaauuuuuuuguuuuuuuuugagacagagucuugcucuguugcccaggcuggagcguaguggcgcgaucucagcucacugcaaccuccgccucccggguucaaggaauacuccugccucagccuccugaguagcuggaauuacaggugugugccaccaugccuggcuaauuuuuguguuuuuagcagagaggggguuuugccaugcuggacaggcuggucucgaacuccugaccucaaaugauccgccugccucugucucccaaagugcugggauuaaaggcgugagccaccacacccagccagaaaauaaaauuuuagagcaugugcacgcauucucucucucucucccucccgcuuccccaccccugcuucuaaacagguaccuucuauacccagcuucccucucucucccaguaauggcuaaacagcugccaucacagccaaaugggaaugacaggcauccccugagugaccacauuccccuguuuuggccuuuuuuuuuuuuuuuuuuuugagacagagucucgcuguguggcccaggcuggaguacaguggcucccucagcucacugcaagcucugccucccggguucacgccauucuccugccucagccucccgagcagcugggacuacaggcacccaccacuaugccuggcuaauuuuuuuuguauuuuuaguagagaugggguuucaccguguuagccaggauggucucgaucuccugaccucaugauccgcccaccucagccucccaaagugcugggauuacaggcgugagcgaccgugccuggcuuggcuucuuaucuucuguauuccgaguuaauaaaugccccacugcuaaaugcuacauuccagaaugcuaacauagggagaguccaggaguccacacacuucagagaccuucgccucccaccucuaagaaaccucuugaauuaggguuuacuagcacgagccuucacaaagacuguagaaaugagucucugagagacgacacccagcacacccagcacacccagcacaccagcgaacagcccaccaggugcuaucgcugucauucauuugcucauucgcucguucaugcacccagcagacuaaauguuuacugaguacuuaccgaagguuaggaucugggcuaaggguugaaagaaauaaauagguuaaaaaagaaaaaaagccaccuaggugacuuucacuccaaugcuugaccucaguucccuugucuagauaauggaaaugcuggccggcgcggugacucacgccuauaaucccaggacuuugagaggccgaggugggcagaucacuugaggucgggaguucaagaccagcuuggccaacauggcaaaacccugucucuacuaaaacuacaaaaauuagccagcugugguggcaggugccuguaagucccagcuacucgggaggcuaaggcaggaaaaucucucgaacccgggaggcagagguugcagauagccgagaucacgccacugcacucuagccugggugacagaaugagacccugucucaaaaaaauaaaagaaaaagaaaacgaaaaugcugugauaugauggucauaucauagcacagggcuguugugaggauuaaaugaguugauucagguaaacagggacauccgaaaaagggaaagacggugcuuguccugagaacagcugugaaugugaggacagucagugagugacgaucuggacccacaagaagagagucauaugcauucaaguccaagugucuaugggcuguucagaagcaacaaauggcacuucaacaaugaguugcagacaacaaaauggaaaugaaggucugcaauaacuauuaagaauccuguaacagagcagaguuuaaauaaugggaagaggcuaugaaacaagagagcuggggaaagauaccagaacugaaacagaccaccagcugaucaccuuuuauuugugaaaugacagcaccaaaugcaccagaugccacagacgggagggagggggauaggucacgucggcagagggagggggucaggucacaccugcagcagggacgggggucccagaccguguucuugucccuagagagcuaacagcucauccguagguuucuaagaggugcugauucaagcacacaguguagaugaugaaaaauagauuauagaaagaagagaaaggaaaaacuaaauuuaaaaucugagacuagguagccacuaaauacuugaaaacaaaaaaagggaauacacugaaaauggaaauaaagcuguaugauguuuaguuaaagaagccagucccaaaaggccacgaacuaggugauccccuuuauaugaaaugucuggcauagggagaucuguagacacagaaagcagaugaguggcugccauggguuuaggagagagaggguguaacugcuaacggaugcaggguuacuuuuuggggugacgaaaauguaaaauuagguuguggugaugguugcacaacaccaugaauauacuaaaaaccaccaaaucauacacuugagagggugaauugcaucauaugugaauuauacgucaauaaagcuguuuuuuugaaaaagaaaaggaagcugggugugguggugcauuucugugaucucagcuacuugggaggcugaggcaggaggacugcuugagcccaggaaaugaaggcugcagugagcuaugacugugucacuaugcuccagccuaggugauagggugagacccugucucaaauauaauaauaauauuaauaauacaauaaaauaaacuaaauacaguaaugugaacaucaacaaggugcaauaauucugagauuuagagaagaaauaaaauaaagcugggaagaaauacacccucccugagaauacaagguagagugagcaguagcagguaaaugaaaaauauuaaaggcuuagaaauagauaaugugggccaggcaugguggcucacaccuguaaucccagcacuuugggaggccgaggcgggggguugcuugaggucaggaguucaagaccagccugaccaacaugguaaaacccugucucuacugaaaauacgaaaauuagccaggcguggugaugcacgccuguaaucccagcuacuugggaggcugaggcaggaggaucacuugaacccaggaggcagagguugcagugagccaagaucgcaccauugcacuccagccugggcagcagagugaaacuccuucucaaaaaaaaaaaaaaaaagauaaugugguagagcuagggcagaaaaacaugcaagucaagaauaaggccaaauaaccuugaagaacuaaaaauucaacauagcaaaaguucagaagucugggagagauuaaauaaaacaaaacaaaagaaaauuugaccuucaugaaauagcuccaagaaucauccaauuugcagcucucacuauuguaguccaaccuaaaaacgccgggccgacacccacauugucuucuucgagcacaaacacacuucuccugcagcagguguagcccgcacagcauggugagcccagccacacccgcacgccagacgcuuggccacagaaacgcagaagcggccacuguccuugccuggaacacagaugggccuuuucauccaggaggagauuuacuugcaaaggcauuuucuucugacccacaggugguuauaccugcacugacaccuccugugggcaucuucagcuggaagaaaggccaccgaggcugcggagccaccucgccuguaaacaucauaucaugcaaaggaaaagcucuaaguugcggaauauucuucucuuuuuuuuuuuuuuuuugagauggagucucgcucuguugcccaggcaggagugcaguggcaugaucucggcucacugcaaccucugccucccggguucaagcaauucucuuccacagccuccugaguagcugggauuacaggcaccugccaccaugcccggcuaauuuuuguguuuuuaguacaguugggguuucaccauguuggccaggcuggucuugaacuccugaccucaagugauccacccgccucggccucccaaagugcuggaauuacaggcgugagccaccgcgcccggcugaugcugaacaugcgugacuaaccuuccgcgggagcagucaugccgcugccuucaccaccuguugcuucugggaaauguggauccaggcugcuggcucucucccagaucguaucugcagcacaggcacaugcuugcugugaauuuccacacuugucagaucacccgguuuucaacuuguuuucuaguuuucucucuuuugaagaguauuuugcacacuggcuggggcagaggcugacaguuucccagacuguguuuucuuguuuacagagcacaugcagacuuguucgagucaucuaacggagaaacccaaaaaccuccauuuucuccugagauaucucugcuaucucuaauuucacuucagcagcacugguggcugaaauacuauggacuauguauuucggacuuccuuuuucugaacuuuucuggaagaaucgcaguuguguguguguguguguguuuuguuuuguuuuguuuuuuuaagagaaaaggucuuucucugucacccaggcugcagugcaguggcaugaucacggcucacugcagccucgacguccugggcucaagugauccucccaccucaucuucccaaguagcugggaugacaggugugcaccaccaagcccaccuucuuuuaaaaaaaaauuuuuuuuuaaagauggaaucucacuauguugcccaggcugggcuugaacuccuggccugaagugauccuccggccucagccugccaaagugcuggaauuacaggcaugaaccaccaugcccagacucagguauuuauuaauaaccucaagguguugcugcacauuccauaaguugagagcagguccacucugccacccagggaugucccaggcugggcgauuuguucucccacugcacaccaugcaacugucauuuaugccuuaagaaaaucccauugaaguuguggacucaaugcacaaucaaaacugaaagcaaaaccgaggcagugaguagugagugcccaagcacgagaggaggggacaaaggcuggguccccggccaucaacaaacggagagcuagcucauaaaacagugaccuggagcuucagucagcagcccucacucccaaaaggggugaggagucuucagaaacuccccugucuuauggcagaaagcugagcucugcacagacccuggaaaaaccacuguugucaaaggagagauggaagugggcagaaagcccaggaaggaggguuccagacuaguggagguacuagccucaaacaagacagcugaguacuuagagaagaagagauacaugccaggcaugguagcucaugccuauaaucccagcacuuugggaggccaagguggaaggaucacgugaggucaagaguuugagaccagccuggccaacauggugaaacccugucuccacuaaaaauacaaaaauuaaccgggcgugguggcgggagccuguaaucccagcuacucgggaggcugaggcauaagaaucacuugaacccagugggugaaggcugcagugagcugagaucgcgccacugcacuccagccugggcaacacagcagacuccaucucaaaaaaagaaaaagaaaaagaaaaagaacuuucuaugaacuucccgugaugauggguacauccuguagccguccaguucuguggccuccaggcacauguggcuacugaccacucgaaauguagcuaguaugaacaaggaauuaauuuuuuaaugauuucaauuauaauuuaaauuuuaaacagcuacaugaggcuggcagcuauguaggaagcagugaagauccacauccuuccuuauuggugaaaggaaugaauuggaaacagaaaguucuuuuuuaccuuuauuaaauaaacgugaagucauaagaacuacuaaaagaaaaugggugggauaaaaguaaaacuaaauaugaaaccaguaaguauucacuguuauuuauuauagaugacauuuagacgcaaauacgagagggagaguacccuguauauuaauagcagggauagccaauuacaaaguggaauaagccaggcgugguggcucacgucuguaaucccagcacuuugagaggcugaggcggguggaucacuugaggccaggaguucgagaccagccuggccaacaaggugaaaaccccucucuacuaaaaaauauacaaaaaauuagcugggcuugguggcacacgucuguagucccagcugcuugggaggcugaggcaggagaauggcgugaacccaggaggcggagcuugcagugagcuaagaucgcgccacugcacuccagccugggcgacagagcgagacuccgucucaaaaaaaaaaaaagaaaguggaauagaaacaguuacucuaucgaacaaaauagcagauaauguuuuagaauaaagaaacaaaagagcuggaaacauuugaacguuuucaaaaaaaacccuauaagugggaugagauacugguucacaacucuaauuuagagccuauauaaacacauuagcuugaccuugcuugacauacauuauuucuaaaaaauguuuuaaaugugaauauuuagaagauacaccauauuuucugcuuuuuauauacuauaaauuuuacuaugugaguuuaaaaagugguugguaaaacacacacccaagcucucugaucuuucacacccauuaaaagcagcacauguauuaaacacacugcugcacaaugggcgugccaugggugcucuccaaccgcauugggcuugaauguuuaacuaggccugaagccacagugcuaacaagaucuggcagagacagacaaggccacgccggcagcagguguuucaggaaagguauuacuccaccaucccuugcgcugaagccuuagccucaggcaaauucaugaaccagguagaaucuaauucaggucacuuuggccaaucuccacuuucuaccagccuccuccaggucccuacugccucgggaggcccccuacccaccugccaaccuauccccucaccaucuaccggcaccaagucugugugagcacacuguagauacacgagcuccgucccaacucagagcuaggagaguaucagaggccaaacgccugcccccugcuucugggcuccaccagcagccugggaggccacccccugcagcugacucaucugcauacugagacuuccugacacaaauggaggugacaauauucguucccccaucauaucccagaaauucccuuauugccgacauccauucuggguuuuuacugcgcuucacacgaggacaauuccaggcugaaguggcaggucccagcaccagacuccacuucaucagaacacuucuguuagagucuuugaaacgcaugaaauccccuuuaggguccauaauaacgccuucuggaaacucgacggcaagccacucacccucagcccuaucagaccccauggcuccuuacauuucugugacauacuuaauuugcaauguccucuuuuccaucaugaaauaaaauuaaauucauggacaacauaaccuuuaaucacugagaccauaaaggacaccuccagcagcugacuagccuucccucagccaccuuugugcccagccuaagggcaggguggcaccggagccuccaugcuucaaagguggccaccagggcccaucccccuuuccaugcuucucccugcccagagagaaacagccugaggacagguuaaagacuaaauacaaccaggcaugguggcucaugcuuguaaucccagcaauuugggaggccgaggugggaggaucacuugaggucaugaguuugagaccagccuggccaacauggugaaaccccaucucuacuaaaaacacaaaaauuagccaggccugguggcccaugcuguaaucacaguuccucaggaggcugaggcaugagaauggcgugaacccgggaagcggagcuugcagugagccgagauugcaccacugcacuccagccugggcaccagagcgagacuccgucucaaaaaaaaaaaaaaaaaaaaaaaagacuaagacuaugccacaauuccgcauaugcauguauuuauuauauacauauauguauaagguacauauuuguauguguauauccgugcauauguguauaccugcagcaauuuuuuuuaaaaggagaaaauaggccagagccaguggcucaugcuuguaauccccgcaauuugggaggcugaagcagaaggauugcuugaacccaggaauucaaagccucagugagcugugacugcaccauugcacuccagccuggguaucagaguaagacccugucucuaaaauauaaauuaauaaauaaaaauuaaacggagaaaauuucuuaacaacuuuuauccuauucauucuuucaacacauaauaagcuccugaaauccguuaagaaugagauuagaccuauucuaaauccuacuaacaccuuacauugacucugucuuauuaaucucaguacuguaguaccugggggaaggcgcagcaccguggacacucagaaacgucaagaaucaaaucacaucucuacaacggugguccaucugcaaacagcguggagaucaaggaagggcagaacaaaguacugaaagugcugucauuucucuggagggugaauuacacagaccaacuuucuucacauaauaagaaacaagaaguuguuuguuuauggguucuaugggagcacccgcugcaggccacgcuagacgcuggugauaaaacugugaacauggcguccaucaccugacucagugguaggaaccaguggcagggagaauccacaagcaaggacccgagucaccagcugugauuaagagccaggaagaaagcaaaagcuuccugcaauagagaauacccaacaugcgguuuggacagagucagggacguccuuucugaagaaaugagacugaaguggagauaucacagugagauggaggcaauugcggugguguaggucuggggaaggcacgagggaugcagggaucagcauggaaaggacggucccagcaugcucacguggcugaaagguggcaacuguucccgaugcagacugagggaagaaaguguggcaugagaggaggcuggggaggugggccaggcccugggagccauuaagagguuucugccuggccaggugcagugauucacaccuguaaucccagcacuuugggaggccgagguaggcggaucacuugagguaaggaguucgagaccauccuggcuagcaugaugaaaccccgugucuacuaaaaauacaaaaauuagccaggcgggguacaugccugugaucccagcuacuugggaggcugaggcacgagcaucgcuugaacccaggagguggaggcugcagugggccgagauuacgccacugcacuccagccugggggacgguaggagacucugucucaaaacgacaagaggcaucugacuuacaugcuaggcacacacaagagcucugcaguguuuuaaguaagacagcacacaguucgauucuuucuuauuuugcauuuuaauuuuuuaacuuuuuuuuuuucucuugagacugagucuugcucuguugcccaggcuggagugcaaugacacaaucucggcucacugcaaccuccgccuccuggguucgagugauucuccugccucagccuccugaguagcugggauuacaggcaccaaccaccaugccuggcuaauuuuuguauuuuuaguagagacgggguuucaccauguuggucaggcucgucucaaaguccugaccucaugauccggccaccucagccucccaaagugccgggauuauaggcauaagccacugcacccauccaauuuuuuaaaacuuuuuaauucaaacuaauguuaaucauauaggaaaguuacauauacgguacagggaguucucauauaucccucgcuccacuucuccuaacgugaaugucuuauuguacgacgucaagcacagcuugauaaucaagaacaggaaauuaacuagacgaugaacuugauuugaguuucaccaauuuuucaccugauuuauguuccaggaucccauccaggaucccacgcggcuggcuggcucuuuuuaaagccuacacagcucuggguggcgaauggcuccggaggugucaggaguagaagcgggggcucacuccuggccuuuugcugugguccaggcaaaagcuggaguggccuuaggucagguucaugauuuaaggucuaggcagaaccgacaggaugugaacaaagggaacaaggacacuuccuggguuccuggguucugccuucaguacguggacggaugagugagaccagaagaaguaaaaguuuagggggcaaaaucaggagcucaguucuggaccucccaagcugaagaugcuggugacacgcucaagcgauagggacaaggagguggccauaccaugaaaucagaagggagcucagggccagagauccacuguccauaauaucaccagggagaagacagcagguggggaggccugggaagcagccuuggagcugcaauguuuugaacggccagggaagugggccagcagggcucugaggagggacaaagggguagggaggggggcugggugugauggcuaaagccuguaaucccagcacuuugagaggccgaggcggguggaucaccugagcucaggaguuugagaccagccuggcuaacauggugaaacccccgucucuauuaaaaaauauauauauacaaaaauuagccaggcauggugguguaugacuguaaucccagcuacucaggaggcugaggcaggagaauugccuugaacccgggagguggagguugcagugagcggacauuggugccacugcacuccagccagggcaacagagcaagacucugucuccaaaaaaaaaaaaaaagaaguggaucacugugaacgcugcagagagaagaugaggccacuagcaaagccagccuggguuuggccacuggccacgcaaagacugucagugaccacaccagggagaggugcguuugggcggcgaagagcacaggccaggcuggcagguuggugugcgagugugugcaagguggagaaggcacacgcggucaguccuuuggagaagucuggcacgaggccugccgaggaaauggcccggggguguggcagggcggagguccugugccauguccugcacugaccagggcagcccacgggaaggcagcugcagagaaggcagaacccgcagcuccagaagguuuggggcaugaccagcagaggccaacuucuauugugaagaagaaaccgacucccagacuuucagggaaggggguguguuuggucugguggcaguggggacagcaaaguaggacccuuggguguggcuacgauugagaggaugucagguagugugagauucaggcugguguagaaucacucaugagaaaguaucuaaaaucuuccagaugacagugcuaccagcuggacagcugacagugggcgcuggcucuuucaaaacagugcuccaaaggcaaagaaauagcaaagacagaaguaaggcacuuaacuauuuguugggugaauauagaaaugaaugaaugaauggauggaugagcagauacaucaagaaguuaauucacaaauuaaagcccauuaugaaacuaaaguagaggcugggcgcgguggaucacgccuauaaucccagcacuuugggaggucaaggcagguggaucaccugaggucaggagucugagaccagcguaggcaacauggugaaacccugucucuacuaaaaauacaaaaauuagcugggcaugguggcgucaccuguagucccagcuacucgggaggcugagacaggagaacuacuugaacccgggaggcggacauugcagugagcugagaucacgccauugcacuccagccugagccaacaacagcaagacuccgucucaaaaaaaaaaaaaaaaaaaaaguuaauccugcaaugaccauacacccagaaaccccaaucauggauauuuacccuagagaaaucaaaccuuauguuuacaaaaaacgcuguacgcaaauguuuguagcggcacuauucauaauugccaaaaccuggaaaccaaccuaauguccuucccaggaugaauggauaaacacacuguggucccuccccacaauggggcacuacucagcaucacaaggaaugaacuagagacccaugcagcauccaggacgaaucucaauagcucuagacuaaguggaagaaaccagucuucaaaggguacaugcugugugguuccauuuuaaugacaggcucccaaaggcaaaacuacagggaauggauaguuguugcugggucggcaggggccuggaggcagggaacuuaaggccgauucacccugacuuuuuagaacugaaucaaaaggaaaaccauacccagguaacaaaaggaucagaggcuacuacucccuuugcaccucguggcagaugaaaaauggaaaguaccucugauugguucccucccgcaaccaaccagacuggucccaggccaggucuucagguguaacguugcaacuucacuucaaccucugauuggucgccuccugcaaccaaucagacuggucacaggccacuccuucacuuacauaggguguaaccaaguaaccaaugguaaaccucuacaggguauuaaggcuccagaaaauucucuaaucagccacuugcuccugcucgagccugcucccacuccguggaguguacuuucauuucaguaaaucugugcuucccuugcuucguuuucucguugcuuucuuugugcauuuuguccaauucuuuguucaaaaugccaagaaucugguuaagaacccagacaacuuguagucaagacccuccacugguaacacccauaaaggguguauuagucuguuuucacacuguucauaaagacuuuauaauuauccgagacuggguaauuacgaaggaaagguuuaacuggcuugcaguuccccauggcuagggaggccucacaaucauggcagagggcaaggaggagcaagucacgucuuccaugacggcagggaagagagagagugugugcaggggaacuccucuuuauaaaaccaucagaucaacuggacgugguggcucacgccuguaaucccagcacugugggaggccgaggugggcauaucaccugagcucaagaguucgagaccagccuggccaacauggugaaaccccaucucuacuaguaaaacaaaaauuagcuggguguggugguccaugccuguaaucccagcuacuugggaggcugaggcaggagaaucgcuugaacccaggaggcagagguuguggugagccaagaucaugccauugcacuccagccugggugacaagagcaaaauuccguuucaaaaaaaaaaaaaagaaaaaaaacccaucagaucucgugagacuuauucacuaucacgagaacagcaugggaaugaccugcccccacgauucaauuaccucccacugggucccucccacaacaugugggaauugugggagucacaauucaagaugagauuuggguggggacacagccaaaucauauuaaaaggucaacccuugggaaagauuuuuggggggugauuaaacuguucuguauccugauuguacugguggcuacaaaaccuauacauguguuaugauccuuagaaccguauagcaagagaaaaaagucaguucacaaaugauaauuagcaaaauaaaauuauacguuaccauacaaucuugcaauuccaauccaagccucuacucacgagaaauggaaacaacuaagacuugcaagcgauguucagagcagcucuguuuauuacagccaagacgugggaauaauccacguguccagcagcuggugaauggauggacacacugugauauauccacaccaccgaauuuaacucacgaaaaaggaccuaaauacuugaucugugcuacaauacagaagaaccucaaaaacaauaagcuaauugagaagucagcuacaaaagacuacaauagugcaugauuccaauuauaugaaaugucuagaaaaagcaaaucuauagacacagaaaguagauuugugguuugggacuggaagcagguauugccugaaaccagauaugauggaccucaugggaugauggaaauguucuaaaaccagaugauacccuaaauuuucuaaaaauaaaauuguauacuuuucacagcugagcuucauagugugcaaaugauaccuuaguaaaacugucuuuaauaaaaagugcucaauucguuaucuauuuucuuuuuuucuuuuuuuuuucuuugagauggagucuugcucugucacccaagcuagagugcaguggcgcgaucucggcucacugcaaccucugccucccggguucaagcaauucuccugccucagucucuugaguagcuaggacuacaggcaccugccacugcacgcggcuaauuuucguauuuuuaguagagacgggguuucaccaucuuggucaggcuggucucgaacuccucaccucgugauccacccuccucggccucccaaagugcugggauuacagacgugagccacugcgcccggccuagcuauauauuuuuuaaaguaaaacuugaucccuaccucauaguguacacaaaaaauaucaguucacauuucacguggauuauagacauaaaucugaaaagugaaacaauagaguaucuaggaaauaauauuauaguuucaugaccucagaaguagagaaauaggacaaaaaaaguccucaccuaacaaagaaaaaaaguggaucaauuuuaugguaggcugaaccauaugccaauugccaauauuugaccauuucgaucuacaaaaauggcaauuucguaguaaaaaggcaaaacuagagugggagaagguauuugccucacauauaacugacaaagggcugguagccugaauauaaagaacuccucaaaaucaguaagaggccaggcccgggggcucacacauguaaucucagcacuuuaggaggccaagguugguggaccacccgaggucgggaguugaagagcagccuggccaacauggugaaaccccaucucuacuaaaaauacaaaaauuagcugggugagguggcacgugccuguaaucccagcuacuggggagacugaggcaaaagaauguugaacccgggagguggagguugcaaugagccgagauugugccacugcacuccagccugggcgacagagugagacucugucucaagacaauacaaaacaaaacaaaacaagcccaacaauaagaaaacaaaaccagaccacucaguagaaaaauguguaagaaagcugaacaggcacuucacugaagagccaacccagguggccagcagacauaugaaaagacacucagccagggaacugcaaaucaaauacagaaucacaaaugaaaauuaccaaaagaaacugcacccacccaccagaguggcugcaauucaacagagugacaagcgcuggugaggaugcagagccacccacaggaacccucauacucugcugacggguaugaggugauaacaauguuaucaccauuuguuaucaccauuuguaaaacaagucgguauuaccgauggaaguugaagacacucacacucuauggcucaauaauuccccuucuagacauugauuucggccaaagaaaugcaugcaagugugcaccaggauacaguacguaaguauucacagggauuauuguaaaagucaaagcccagaaacaacccauguauccaucaagaggaggaucgauggauacguugugauaugaccgagaaggcacaacagcagugacgaugaaggaaccccagcguaagcaacaggcaacaggaaugaagcucacaaacuuuacacugagugacagaggcagccacaaaagaauauauacugaccaggggcaguggcucaaguccguaaucccagcacuuugggaggccuaggcggguggauuaccugaggucaggaguuugagaccaaccuggccaacauggugaaaccccgucucuacuaaaaauacaaaaaaucagccaggcaugguggugggugccuguagucccagcuccucaggaagcugaggcaggagaaucacuugaaccugggagguggagguugcagugagucgaggucauggcaucgcgcuccagccugggcaacaacagcaaaacucggucucaaaaaaaaaaaaagaauacacacugcagguuccauuuguacgaaauucaaacacaggcaaacgcaauuuauggugccagaagucaggacaugguuaccuuuagaaggaggaaguggguagcguugggagggacacgagggaggcuucugggauauucuguuucaucugggugcugguuuaguggauguguuccuuuugugauaauucuucaaacuguacacuuaugcauuuuauguaugcauauuacacuucaaugcaaaauuuauuuuaagaaacaggaaaccaaacucuucaaaaaugccaauagcaguaaagaaaaaaaaaugugcggaacuguucuagaucuagaucuugaguguccucuuuuaggaaaagaucaucccugauuggauccuggaugaacaccauaaaagcucuaaaggauacuguuagaugcuggggaaauuugaacaugaacuauauauuuuauaagaguauucugucaauguuauauuucuugaguaggauaauuuguuuugucuguacaggagaauguccuuguucauaggagauacaugcugaagaauuuaagggugcagggccacaaugucugcaauuuagucaguuaacgguucaauggcucagcaaagaaaaaagaggacaaauauagauacacacacauacacauaugcacauacauauguguguacuguauuauaucccauucaggguucuugcacaaauguguguauaauuauauucacacauacauauauacacaccuacacugagacagccaaagaaauuuggcaaaauguuaaccacgggucaaucaggugaagugggauauuaguguucauuauacuauuauuucaacuuuucuguagguuugaaauuuaucaaaaugaaaaguugcgaaggccaggcacaguagcucacaccuggaaucgcagcacuuugggaggccgaggcggguggauuguuugagcccaggaguuugagaccagccuggguaacauggcgaaaccacuggcuaauacaaaaauuaaucaggcaugguggugcacaccuguaguuccaguuccucagggggcagaggugagaggaucaucugagccugggaggucgaggcagaggugagccaucaucgugccacuacacuccagccugagugacagacugagacccugucucaauaaauaaauaaaauuaauuaauuaaaauuaaauuaaaaguuggagaaaaaagcaaaagcaagccaaaaaacagacaagccaaacacccgacgccaaguguugaaggacucacaguuggauaagaaaaccaaaaaguccgggcgcaguggcucacaccuccccagcacuuugggaggccgagccgggcagaucacagggucaggaguucgagaccagccuggccaacauggugaaaccccaucucuacuaaaaauacaaaaauuagccaggcaugguggcccgugccuguaaucccagcuacucgggaggcugaggcaauagaauugcuugaacccagcagguggagguuguggugagcagagauggcaccacugcacuccagccugggcaacagagcaagacuccaucucaaaaaaaaaaagaaagaacgaaagaaagaaaaccaagaagagcagagacgggaccaccaggaauggcaagaucuggcccccugcggcagguggagggcaggacggcugcuggguggcuggcugugcucuccugcaaccugccugguagauaugcaaaggcggucaccuuauaacaaucagauuguacauuuauuuuacguggucuuccaucuauaucacacaauuuuuuuuuuuuuuugagauggaguuuugcucuuguugcccaggcuggagugcaauggugagaucucggcucacugcaaccucugccucccugguucaagagauucucgugccucagccucccauguagcugggauuacaggugcccaccaccaugcccggcuaauuuuuuguauuuuuaguacaggugagguuucaccauguuggccaggcuggucuugaacuccugaccucaagugauccaccugccuuggcuucccaaagugcucggauuacaggcaugagccaccgugcccagccuguaucauauacuuuuuuaaaaagagacuuuacagaaaaacagacugagcaaacagagcugcaugccggugcaugagcaacaaguuauaaucgcacgcuggaggaagaaagaggaagccgucggccacacagcuccgcucugccaaggcucugcugccgucccucacccgccccaccacguggcaacccaaucacaacaaugccgccgucccccagcugcuaaaugcucucaccauuugguugcugugcaaacacaccuaacuuagacuucagacugauguccuggaggugcuacaagauggccauucuuuaugaguaaggcugccuuccaggguaaaaauuaugauuuucccauaaaucacauauaagcacuuagcaaaaaauauuuaaaacucucauaaguuuugguccuaaauucuuuucucuugcuguuacuacaaaaaugacagagacaaaaaauuuauuauuuauaacggcuuggaaucuaauuccaaaugaguugcuuccguagauucacguaauacugcagaacuaaauaugcaagauucccgauuccaaauggaggccaaauuccauccacacaggagacagaggaacccucagcagucucuccuugaaguaauuuuuuuuuuuuuuuuuuuugagacggagucuugcucugucgccaggccagagugcagugguguaaucuuggcucacugcaacuuccaccaccgagguucaagcgacuccccugccucagccuccugaguagcugggacuacagacgcuaauuuuuuaugauuuaguagagauaggguuucaccaugguggccaggauggucucaaucuccugaccuugugauccacccgccucggccucccaaagugcugggauuacaggcaugagccuugacaagcugacaacaguuaucuauguucuucgucaguucauggacucgacaccaaaaugccuggguucagaucccaauuccugugaaggcuuaagcaauuacuuaaccucuuugugccucaguuucugagucugacagauuauggcaacaucagugacuuuacaggguuuugaggauuaaaugaguaaauacucuaaagggcucagaucugugccuggcacauauuagcaccgaugcuggccuguucaaaaauucuauuauuauuugcucaacaauugccugaaaacauagaaaaacugucugccacauacgcagaugaggggaacaacgaaagauuugguggguuucagaagagguacaggccugauggcugccgugcgccaacaaggugagccugcagaucagagaccacgugcaugagccacagugcauguggcugcuguguccccucugccuucucggucuuacacaaauggucucuuguggcucaaguuacauacagagcuccaacuuagccaaggugacgcaaaacgaacucacuacacguaccccuugucaacuugguguccauaucuacuccucuuuucaaccguacuuaacuuccaaaucaaguaaauagcaacuaggcuuccaugccauauaaugcuacuauccgucuuacaaccaaaaccaugcuaacccucuccccagaagaggagccaaaguccuuuuaugaacuuuuuuugagacaaggucucacucugucacccaggcuggagugcacugguacgauuucggcucacugcaaccuccgccucccagguucaagaguuucuccugccucagccuccugaguagcugggauuacaggcaccugccaccaggcccagcuaauuuuuguauuauuaguagggguuuauuagaugggguuucaccauauuggccaggcuggugucaaacuccugaccucaagugaucugccuaccucagccucccaaagcgcugggauuacaggcaugagccacugcaccuggcccaaaguccuuuuacauucuaucugagugguuauccguuggcaccccauggaaugaagaaggagacugaagugauaacauaaggcugguagcugacagaccccugaaguguaacuaugaaggcgggcuguggaccuugccggcuggaagcaagacccuucuggucaucuuuacuaccagguagagaaggagaagacacucaccgcauaccagguaccaggaaauguguugauuuguuccagcaacaaaaacacaucuggcacagcagcuguaacugcagucaccgccuaguuuaaguuuaugacaaccugcugucauucucuaagauccauccgucuucuagacaagccaaauauggauuaaacggagaugugacacgaucaccacccuugcaucuuucaagucccugaugguggcacuaaucucugccauccucccaggaaugugauaauugcuuuggguugacuauuuugguagacagaggcaguucuggcagcuuccacuuggccuuugcuaccacaacagcccucacuccagggaaccagugucagaauucugccaggugcuaaguagauauauauuuacuuaugcauugcagaacugcagaaagaaccacaggacagcuauuauaucuuaauaauuacuuaauauauaauacacaaugauauguggguauuaaauauuaugagucauuacucugaaauggauuaaaguuaauauaaguguaauugccauacagagugauuaugggugcccacucaaaagucagccauacucaauuauacacaaaaacacaaaacacacgugcacacaugcuuagauugccucgcaaagccuauaugcaugggaagccaaugacacacacgaggaaagaugggaacacagagcugcuucuugguuucagggaauccucacuucuuucuuccuucucagggaaauuucgcuuuguuucaugcucgaccuccagccucccaggucuuggccuuaaagauuccaagggggccgggcacgguggcucacaccuggaaucccagcacuuugggaugccgaggcaggcggaucaccugaggucgggaguuuugagaccagccugaccaacauggaaaaaccccgucucuacuaaaaauacaaaauuagacaggcgugguggcacaugauuguaaucccagcuacuugggaggcugaggguggagaaucacuugaacccggaaggcggagguuguggugagcccaaaucgugccauugcacuccagccugggcaaaugagugaaacuccaucucaaaaaaaaaaaaaaaaaaaaaaaaaaagauuccaaggggccccagccccccucccuucacuaaagacaagccagcuccuuagaucccaugaugccagagcugugaucuuccaguacacuggagaagcuccuuguaucuuccuaucuccuaguaggcugauuucauccaccaacagccacagcaccuugaagcaacccaggagcugcuguuucccgugaucauguggucaacccugguccuucaaacuucuuucagaacucacacacacaccacguccccuuaugaguuuugagcagaaugcuuuuucuuugaaagucuguauucaacacccccuuuuuauuuauacaaacuuggaggguaugugagaaauuuuauggcauguauauaaugcgcagugaugaagucagggcauucagggugcccaucacucaaauacaauacauuuugguuuugggguuuguuuguuuuuuuuuuuuuuuuuuuugagacaaucucgcucugucacccaggcuggagugcaguggugcaaucucggcucacugcaaccuccgccucccagguucaagcaauucuccugccucagccuccagaguagcugggauuacaggcacccaccaaccacccggcuaauuuuuguauuuuuaguagagaaaggguuucgccauguuggccaggcuggucucgaacuccugaccucaggugaucugccugucuuggccucccaaagugcugggauuauaggcgggagccaccaugcccagccacaauacauuuuuuguuaggugagaauauauauaauauuagaauaauauuacucugcucucaagccuugaacuuauuccuucuacguuacugcaugaugguacccuuuaaccgacuucucuugacccuucuccuccccgccacucacccuucccagccucuguuacccuucuugccacucucuaccuccaugugaucaaaccuuuuagcucccacauauaagaacaugcaauaugucuuuugugucuggcuuccuucacuuaaugacuuccaagcugggcaugguggcucaugccuguaacuccagaacuucgagaggccaaggugggacaaucgcuugagccccaggaguucaagaccagccugggcaacauagugagaccccaugucuacaaaaaauaaacaaaauuagacaggcauggugguacaugccuguggucccaacuacucguguggcugaggugggaggaucauuugagcccaggaggucaaggcugcagugagcuaugauugugccacugcacucuaaccugggcaacagagcaagacucuucucuaaaaaauaaaaauaaaaaauaaucauaauaauaaugaccuucaguuccauccauguuauuguaaauaacaggguuuuguuccccuugauggcuggacaguaucccacugcauauacauauaccacaguuucuuuacccauccauucgaugauggccacauugauuccauaccuuugcuauugccaacauugcugugaugaacauacaagugcagguaucccuuugauagaucgauuucuuuuccucuggguagauaucuaguagugggauuaauaauagccauugugcccaguaagaccccacuucuuaauauuauucucauauaauucuaauagccauucugacuggcauaaggugauauuuccuucugguuuugauuugcauuucucugugaugagugaugcugagcauuuuuuauuguaaugcucuugacuaacugugccacguuuacaacugucuuugagcggagaccuguacuacagaguccuacacaggguuaaggaggagcaucagaaggcagugaacagacgugaggccuaucagcugguacuagaaaagagacaauccauuuaaggcuuugacucauuuuugaaaccuaugugcuauggucuaaaugucccccaaaauugacguguuuaaacuucaucacgaagggaugguauuaaguggggucuuacuggcacaguggcucaacaccuguaaucccaacaguuugggaggcugagguggaagaaucacuugaguccaggaguccaagaccagccuaggcaacacagcgaagacuccgucucuacaaaaacaaaauuguuuuuaaugagccagacgugguggcacacgccuguggucucagcuacaagggaggcugagguggggggaucgccugagcccaggagguccaggcugcagugagccgugauugcaccccugcacuccagcuugggcgacagaguacgauucugucucaaaaaaaaaaaaaaaggcaguggggucuuuaggagguaaggaagaagucaugagugcuccaccuucucaaaugggaugaagacccuaauacgagagggcuuaggggugagcaaccgcaugaaaggccugagggaacgaguccguagccuuugcucuucugucaugugaggacauggcaccagacacccaaugccaaggccucgauccuggacuucucggccuccagaacugccuccagaacuguaagaaauaaauuucuauuguuuggaaaucacccaguugcagguauuuuguugcagcaguaaaacggacugagauaccgugucgcuguacacucuuugcaguaugaagucagcaugguuucaguugagaaaagaggaacagaguaguugggucucauccucacaacccuguuucucuccucucuucucucggggucaucacuccccaaccauccaaaccagaagccuccaggucacuuucuucuccuuccuuucccucaccaucaagcccugccaagucucgcuguggaauccacuacuuuccuuccacucccacugccugaacccugaaugucucucgggccccagcaaagagcuuccaaaccauucuccaggcuuccaguuucuccucuuccaauucauccuccauuauauuaucaccccauaagccuugcucugaaacucguaaugcuugcccuuuuauaaaaauaauagcaacaacaucuccuacaacuaagauuuagagaauacggauuaugugucaaacacuguucuaagcaccuuacacgcauuacccucacaguuaacccgcaccagucugugaauagguacuacuacaaacuccugcuaacagaacagagcagagacucuaacguggcaugcaaagucuuucacuaccaggccccaagccccuuuccacccccaucucccauguccuccaucuuugccgcuuccccacguacuugcggugcuguuucucaaacacccaccccuuucuguguuacacgcccucaugccguuuccuugccauuuuagguguucugcuacuguuuuaauucuugucuuuuuaaguguuccaacgacacuuuaaaaaugcuuuaaaugcaggauugcaggccaggugcgguggcucacgccuguaaucccagcacuuugggaggcugaggcaggcagauguucugaggucaggaguucgaggccagccugaccaauaagaugaaacuccaucucuacuaaaaauacaaaaauuagccaggcacgguggcauguaucuguaaucucaacuacucgggacgcugagauaggagaaucacuugaaccugggaggcagagguugcagugagccgagaucgcaccauuucauuccagccugggcaacaagagugaaacucugucucaaaaaaaaaaaaaaaaaaaaaagcaggauugcacccuugaaaguuaaaauuuuacuuuugcugaaaggaacaauugaggucaggugcagggacucacgccuguaaucccagcccuuugggaggucgaggcaggcggaucguuugagcucggguguucaagaccagccuggguaacauagugagaucccaucucuacgaaaaaugcaaaaauuagcugggcaugauggugcacaccuguagucccagcuacuugggaggcugaagugggaggaucaccugagcccaggagguaggggcugcggugacccaugauugcaccacugcacuccaggcuggguggcagagcaaaacccugucucaaauccaaaagaaaagaaaacaagagaagagaagagaagaccauugagcuuaacacgccuuuucauauaaauaacuccaauggcggcauucaucuaggcuaaaauuuugguuucugagaacaaaucauuuugcuaauaauucaguggacauuuauacucaaagauaggcagagccccuaaaucugcaggugcaugaaaaauucagguguagggacauuacacuacacaauuaccucagacuaggguaguuuguugcggugagguuggguuuuucuuuccuuccuuuuaaauuuuuacuuaaucaagaaagcuucuuuuaagacaaacacuuggugagguggccaagcacuaucauauuuccugguuuccucuucuucuuuacuuaacaaagaacugcucauuaaaaugacaucuucuuaauuuuuuuuuuuuuuuugagauagagucucgcucugucacccaagcuagagugcaguggcgcaaucucggcucacugcaaucuccaccuccuggguucaugcgauccucccacuucggccucccgaguagcuaggauuacaggcagccgccaccacaccugguuaauuuuuguauuuuuaguagagacgagauuucaccauguuggccagacuggucucgaacuccugaccucaggugauccacccgccuuggccucccacagugcugguauuauaggaguaaugacaucuuuaaacucacaucuaaggagugucuacugaguauaagacauugauuccagguuaaauaaaguaucuacacgagucuuuucaccuauugacugaacugucuuuaauaaucacacuuguguaguacuuuucauuuccauuaccucauuugauuuuccaacgagacaggugaaacaauucugcuuccaguagacaugggaggguggaaacagcagggccacuacuuaccuguaguagucaguuuuaaguugaagguaaauaccccuucaaaauuucuggauggaaaagaccacaggagauaaagcagagaaucaaagcccagggaggaaaaucauauaggggacauuaaagaccagcagggucauaagacuucccaagaaauggcauauucuagaaauagagcaaggaagccacuccacacucauccuucucugaauuucuacccuuauuuuuuccuucuaaagagcuagacuugggcugggcaugguggcucacgccuguaaucccagcacugugggaggccaaggcagguggaucaccugaggucaggaguuugagaccagccuggccaauauggugacaccuccgucucuacuaaaaacacaaaauguagcugggcguagugguuuacgccugucaucccagcuacuugggagccugaagcaggaggaucacuuaaacccaggaggcagaaguugcagugagcugagaucacugggcgaucgagcaagggcgacaaagcaaggccccguauuaaaaccaaaaaaaaaaaaaaaaaaaaaagaggcucuuucuaaacuuuuaaaucuauugcuaaauucaaggaagacuugauugcaguagcauuuaacucuggaaucacaaauaaaguacuagcaaauuccaucuucauauacuacugcuuuaaugccaagcuaauacuuaaaaaagaaaaugggcaaagaaaaagaaaaaguugaugauucaugagucuaaacaauuuuuuguuuuuauuuaucugauuuuuuuuguuuuuuuuuuuuuugagacaagguuucaccguguugcccaugcuggaguacgguggaguaaucacagcucacuaaagccucgaucaccugggcccaagccaucuucccaccucggccucccaaguagcugggaccucagggaugugccacugcccccagcuaaguuuuuuuuuuuuuuuuuuuuuugagacggagucuugcucugucgcccaggcugaaguguacuggugugauuucgacucacugcaaccucugccucccggguucaagcagaucuccugccucauccuccugaguagcugggacuacaggcguccgccaccacuccuggcuaauuuuuguuuuuuuagcagagacggggguuucaccauguuggccaggcuggucucaaacuccugaccuuaugauccauccaccucagccuccgaaagugcugggauuacaagcgugagccacggcgcccagcugacucagcuguuuuuaaauucuuuuguagagacaggguuuuccuauguugcacaggcuggucucaaacucuugggcuuaagcaauucucccgcuuggccucucaaagugcugggauuacaugugaaccagcaugucuggccuucaauucauuucuaaaaagagaggaaaaauauauggcuucuuccccgccccauuguuauuugauucaauuauuuacaaaaugaauucuuaggauauuuugcauuuuuauuuccuucugaaaaaucaguuuuuacaccaugaccuuaaucuagcuaauucuguuaaaauaggauuuaauuuuagauaaguucccagaggaccugcauuccauucaauuguugguugaacuauauuuccuagugacuaggauuuauaaauauuaauuaucugaaagaguggaaaugaacauauaguuauuuuuagaauauacugugauaacaacaacaaaaaauccugcaaaacggagcuagaccagcgcugacaugaaaauccaacagccaccuggcgaacucuguguuccaagagguuuuuauuuacaguguaggaugugacuuuaccuauaaaaugcuuucuggcugccacuccguuuggacgauuccgguuuuggucugcuaacuuaucaacuguaugauuugggcaaguuccuaaacuucucugugcuucguuucuccccuuuguaaaacaggacuaaaaauauuaaaacucggccgggcgcaguggcucacgccuguaaucccagcacuuugggaggccgaggcgggcagaucacgaggucaggagaucgagaccauccugacuaacaugcugaaaccucaucucuacuaaaaauacaaaaaauuagccgggcgugguggcgggcgacugaagucccagcuacuugggaggcugaggcaggagaauggcgugaacccgggaggcggagcuugcagugagcccagauggcgccacugcacuccagccugggcgacagagcaagacucugucucaaaaacaaacaaacaaaaaauuaaaacucuucccugugggguugcuuuaaaaaucguauaauguguuauauguaaacauaaagcauuauaacaagacagaggaauacaccacuggagcaaaaucagaagcgguucccucguuuuuucacaauguggagucuggcccggcgcgguggcucacaccuauaaucccagcacuuugggaagccgaggcaggaggaucacuugaggucaggaguucgagaccagccuggccaacauggugaaaccccaucucuacuaaaaauacaaaaauuagccaggcaugguggcacgugccuguaaucucagcugcccguaaucucaucuacuugggaggccgaggcaggagacucacuugaacaugagaggcagagguugcagugaaccaagauuccgccacugcauuccaaccugagcaacagagcaagacuacaucucaaaaauaauaauaauaaacaauguggagucuuuuauucuuugccuagaauuuucugugcauugcuggaaugaguauauccagaauucauuccaaaguuaauuaagaaaaguacaguuaggcuuugguaaaacagucugccaaaauuuaacaaaaaagagaaggagaagaaaaguucauuaaaaaauaacaucacuaggaacucugcaaccuugaguggggcacuuaagugccacagaccucaguuucuuccuuuuuuguuguuuuuuuauuuuuguuuucuaggcagacauugaaugcuaguuucuuccuuuuuaaaaaaaugaaauagcuuaacuagaaccaucuaaacuacaaagaaucuuuuuaaaauucuaggccaggcacgguggcucaugccuguaaucccagcacuuugggagacccaggugggcggaucaccugagaucaggaguucgacaccagucuagccaacauggugcaaccccaucucuacuaaaaauacaaaaauuagccaggugugguggugugugccuguaaucccagcuacuccggaggcugaagcaggagaaucgcuugaacccaggaggcggagguugcagugggcugagaucgcaccacugcacuccauccugagcaacagagugagacuccaucucaaaaaaaacaaaaaaacaaaaaaacaaaaaaaaaauucuaaaacacuagguuuaugaaguaaauaauaaaauucugugauaggacggagccauuuucuuccaggcuauuuaccaaacacagcaaaggaaaucaaaaaaaggcuucccauauaguaaaacuuacauuuuggagaucuggauuucuccauuauaaaccuauggaaucaaaucauuuaaaaucuaguuaccagagaaaccucgguuuaauauuaacaaacauacuuccuuuaaccacgagccacuuuaauguauaucaguuuuaucucuggagcuucauagaucccaacagagaaggcugaucuauuuucagagaaacauagcaagagagugucacuucugaaccauuauacauuuaaacaaucucucuacauguagagccugcaucuaaaucccagcaauuuuucaggaccuagcucugaggccacaucagcacuccaggcaggcggagggacucuccaccccgccucuuuugcccccagaaaauaaaucuuuccccagaccaacaauccacuucccggccucacagcaacgggcucccggcucccgcacgugacugccaacucuuuacgagaugaggcugugcuggcucgguaugguugauaagacaagcaugcaagaaauauuuauuaaugcaaacucguauaaauucguaucaucugaguuuaugggaaugaggauaaaucacaaaagcauuauaaagugaggcuuuggacaaaguccugaauggaagagucuaguaccauuuuuagagccucuuuuguuuuuuaaacuccuuuuacuaucauucccagccuugguagacacuugacaaauauuugaggggaagcugaggacaaagagaugaaaauaaagugacugcuaugaaaaaaugaaagcccagguaacaauaaacaguuuaaucucuguuuaguuaggaaggagccaaacgcggcugggcacggugguucacgccuguaaucccagcacuuucagaggccaagacgggcagaucacaaggucaggaguucgcgaccagccugacuaacauggugaaacccugucucuacuaaaaauacaaaaauuagccaggugugguggcguguaccuguaaucccagcuacucaggaggcugaggcaggagaauugcuugaauccaggaggcugagguugcagugagcugagaucggaccacugcacuccagccugggcaacagagcaagacucugccuuaaaaaaaaaaaaaaaaaaaaaaaaagagccaaauaauuuugccucccaauuugcugcauccauccaagaggggaagauggucucaggcaguaacuagcuuugaaaacccuugugaauuuuuugagauagggucucacucuguugcccaggcugcaguacaguggcgcgaucuuggcucacugcagccucgaccuccuuggcucaagugauccuuucaccucagccgcccgaguagcugggacuacagacaugcaccaccaugcuuuuuuucuuucuuuuuuuuuuuuuuuuuuuuuguagagaugagguuucaucauguugcccaggcuggucuugaacuccuaggcucaagcgauccucccauuucagccuccccaguagcugggacuacaguugcauaccaccacaccuggcuaaacuuuuuuucauauuuuuuguagaguugggggucuuccuauguuucccgggcuggccuccaaauccugggcucaagugauacuccugccucggccucccaaagugcugggaucacaggugugagccacggcaccaggucugaauuugugauucguguuaaugacgaaccugagcugagccuuaaguaucuguccggagucgcagaagcaaucagcacagugcccagcacugaaccacggcacacagugcccagcacugaaccacaacacccagugcccagcacugaaccauagcacaugcgcauuccccccacgcccccgaacuuauauucgucaccauauguugugcagauccacgaaugggcagagucacaauucucacaugagcuuuguaaauaaggaaaaacugcaugggccagcacacguugcuuguguguguguguccuaagcacugaugacaaaugcagaaccaacaacauucccacucauccagaggaaaucgugaguucucaaugagcaggcugggaguagcuuaguagucauuuccaaagcacugugaaacuugucuacuucaugaaaaaguacugaggcuguuuuacagcccuuuaacuuaaaucuaguaauugugccuaucagaguucugaagaaaauaagacucaauaaucuaagcuacuaguucacgcagaucaucuuaaagcaagauuuuccacagaccucacauaucgaggugacaugauccuuuucuaaaaugaaagagcuucgcuagagcccagaaguucgagaccagccugggcaacauaagugagaccccgucucaacaaaacaacaaaaaaaaaguuuuuuuuuuaaauuauccaagugugcuggcaugcaccugcagucccagcuacuugggaggcugagguaggaggacugacugagcucuggaggucgaggcugcaguaagcuauaaguacgccacuggacuccagccuggucaacagagcaagacccaaucuaaaacaaaaaacaaaaaacuacgaaaacauauuccacaaaaaagauuuguacauaaggacuguauauaagauuguuucuaggcagacauugaaugcuaauuucuucguuuuuuaaaaaaaaugaaauagcuuaacuauaaccaucuaaacuacaaaguaucuuuuuuaaguucuaaaauauuaggauuuauaaaguaaauaaaauucuaugacagcauggagccauuuucauccaggauguuuggacacccuucuccuuuuuuugagacuccaucaaagaaagaaagaaaagagagaaaggaagagauaaaaagaaagagagagcuagcuuagcaaaaaucaucuaaacuacaaauuaucuuaauucuaaaauauuagaauuuauaaaguaaauaaaauucugugaugugguuucucuaguuaagggccugggggacuuacacagcuguuacgaagacauuauuuaaaaaaaucuucaguucucccuggggggcaauuggauugacaauugcaauuccuuuguaaccaaugggcuucugugugagcuguuagacgcacacugguauucguucaagauggaaaaccaaacaacauggacacaacccaugacagccuucaaaguucugucugcaugaccaaucagguccuuugguugaaauccaugaccaaucagguccuuugguugaaauccaugaccaaucagguccuucgguugaaaucuaugaccaagcagguccuugguugaaauccacguuggccaggcugaucucgaacuccugaccucaggugauccgcccgccucggccucccaaagugcugggauuacaggcgugagccaccgcauccggccagaguguguuguuuucucauugcagucccuaacuugcccugaacccucccuuacccagguagccacgaagcaucuggugacugaggccugggagugagcccuggagguucuggcugacgcucugccgugacccacuuggggcuucugugacguccccuucagccugacaagaggacccaguucuccucugugcucacccugaacaaaacagguccuagucugggaagggcgccaaagagagaucuuuucacugguuucuguucccugucauuuuugggggagggugggcuggggaacacaaacacccaauaauuggaaauugucagacauacaaaaaagaaauguaauuagucauaaacccuauuuuaagguuauauuugcacugccauuuuaaaaugagaaaacacuaauaacauuaaaaugaagucuuuguuaaaaguaaccaugcauuguucaaauuuccauuuguucuuuguuugacaaugaaaaaucauucuaaauuaguuccauacacuuacugugaaacacaacaguuuauuccugggucacauucucccccuucugugguuuauauaacuucucuuuguuccgcaaauggcaguacaauggcaaacaaaauaaaauggaguuuauuaugaaaauggauccauuaagcuaccuaagaauaacauagcccuacaacuccugcacuuguagagggacacgggugagaugaaacggacgucaguaccccugcaagaaucacacagauaggccccucggugcaccuggagagggaggccacaauggcaaauaauaggagacacagcgaugccccacucccuucuuucccaagagcugccauuucugcccuugcuggauaagcucagugucucacacagcgugagcguccacuagaugcuggcuuggacaggcgaugcugaggguucccauagacggcacucuaguagggcugcucaagucccuccucacaauccagaggaucucaccuaggcagggcccauggucacuccccaggagaagagccaggaauguccccaucaagcaaaaccccuggucuccagcucacaacucaaaacccaagcaaaugaaggaaaagcuccugggaccaucaggacucauaacgaccaagggucagucaugguaucaggaaaucguaauccuggcucagaaagguuuuaaauacagggaagcagaaggcuggggcagcaaaggacacuacuaagagcaagcgacucacagggcucacccggaaggcauuacaaacuggaauuccuaaaagagugguugccaagcucacccagaagaggaggucccacuggucccugagucugcuccaaacggccacgcacagcgugggcauccucuccccugcuuuccauugcuguacagaaccugaccugggaccagagagaagaggguccagggaaaugcugcugaaggcuucgucucugcaguggagagaaagucggaaggggcagcacccaccccuagcugcccauagaugaccaggcacaggcacccaccaccgacacuggcacaaucccccaacauguucucagaccagaccaagacccuagccgagcccaaggaugcuggcuaaucaaauaguaaacaccuuuggccagauuauccuuaaaaagucucuggaaugucaccuucagucucuguagucuacuuucuaacauacuucugagccgaaaccacgugaaaagauuuuucuucugacuacaaggcagaacaauaaaagugacccucugagucaaaaacaccacaugaaacucaccucccgccuccaacccaucccuuccgcauccuucauguccaccgucccuuuaccaacaaccagcugauucuuccagacuucaaaaucuuucagauuaacccagaaauaucgauaagggaggccuuuuucuuagcuuauguuguauauguuuuucuguuuaggcuacugcuauaaagaacuauccaccagccugggcaacaagguaagaccgacccuguuucuacaaaaaauacaaaaguagacgggcaugaugguguacaccuguagucccugcuacucaggaagcuagggugggaggacugcuugaacccaggaguuaguggcugcagugagccgagaucacaccacuauacuccagccugggugacagagugagacugugucucaaaaaaaaaaaaagaacuaucccgagaguccacuguugggggccgaaguggggguggggacccuuggcugccauguuccugggccaggaacauggacuggauggccugcaugucagaagacuggugacauacaagggucaauaaauaaaaacaguuaauaugauaagagcuguuacuguuauuguuagaaaagaggggcacagccaaggaaaggggagaaagcugaaacaaaccauuugacuuggaugguaucaugauuuuuauaugagaugaauggauacauagauacgagcgggacagauggauacaaagaacuacaaacgcaugugugcccguguguguauguacaaacauauguguacguguagggaaguacaugcauauguuuaauuuccuagcuaugccaggcgcgguggcucaugccuguaaucccagcacucugggaagccaagauggaugggucaccugaggucaggaguuugagacccagccugaccaacauggugaaaccccgucucuacuaaaaauacaaaauuagccggacgugguggcgcaugccuguaaucccagcuacuagggaggcugaggcaggagaacugcuugaaccgggaggcagagguugcggugagccaaguuccugccacugcaugccagucuuggcaacaagagugaaacuccgucucaaaaaaaaaaaaaaaaaaaaaaaauuccuaacuacgcugcuugagaaguccuuguagccguaauagcccaguagcgugaacacaccuaauacuuagauccugguuucuaaaaaccacuuucuacuaaaaggaaccagggcuuauuggagaaauggcugauuccagggcuggagcaaggaaaguuccgggugagccuagaaccaagaacuaaacauguggccgggagcaguggcucacaccugucaucccagcacuuugggaggacgaggcaggcagaucaccugagguuacaaguuggagaucagccuggccaacauggugaaaccccaucucuacuaaauauacaaaaauuagcugggugugguggcgcacgccuguaaucccagcuacaugggaggcugaggcaggagaauugcauggacccaggaggcagagguuucagugagccaugaucacgccauugcacuccagccggggcaacagagugagauuccaucucaaaaaaaacaaaaacaaaaacgaaaaaaccuggccaggcaugguggcucucaccuguaaucccaacacuuugggaggcugaggcaggcagaucacgaggucaggggauugagaccauccugguuaacacagugaaaccccgucucuacuaaaaauacaaaaauuagccgggcgugguggcgggcgccuguagucccagcuacucgggagacugaggcgggagaauggcgugaacccgggaggcggagcuugcaaugagcagagaucacgccacugaacucccaccugggcaacagagcaagacuccaucuaaaaaaaaaaaaaaaagaagaagaaguaaagaugugcucaaagaaugacaugaacacaucaaaagaacacaggggccagcuuggaggcgcugcuuuuggccaaaucugggacaaucuggguaucgaagcaaaugauaaugguaaugaauuauaacccaauggguaaaauaggagucuaugaguguauugauaggaaggagagaaagacagcaggcaagcuccagcuugcaguggaaugccaacuaaucaaugcaaaagaaacaaugcaacuagaaacaucaccauuuggcaaugcucauacuaauucccucaggcaagaaucaucccaggaugcuaaaacaaaugggcaaaaagcuuaaugagaaacaggauauuuuccgaguccccaaaaaaucuccccaccagaaacaguacuuuuuaacugauaauuacaaaauaccaacaaauuaauuuuacaguggagaaaccugguagacaccaccucaaccaaaugauaaguuaacuucuccagaaaugggacugaucagaccugugugcguuccugucgugacaacccugcagggacucuccugccaggaaccuaccaccugauucucaucaugaaggaauaugagaccagcccaaaccgagggacauucuacaaaguaacuggccuguucucuuaaaaaaaugucaaggucgugaaagacagagacgaaggaacagccccagauugaaggagacucgagagccauugacacagacggcgccugugguccugggcgggcuccggggccucugcauuugguggcauggugugacagugcccacguccugauuugggcaggucggugcaggcuauccgggacagcguccuuguuuuuaggaaacccacacaggagaaucuagaggcacucucugcagucuauucucaaauuauuccggaaaaaagggauguguguauguggagagacagacagacaaacaugucggaauguuaauucagggaaucugggugaagaguauuugggaauucuuuauacuguuugggagcaucucuguaaauuuaaacuuacuucaaaauuagaauauaacgccaccaaaacccccucuaucacucacuccgcauuccuagauaacaacuaguguggaauucuguucuuugaaucacuagauaucaacuagcguguaacucuguuguuugaagccaccugguuugagguacuuugguacaguagcccuaggaaauaaauaugcuacucaaagaauauugaauguggcuuuuucuacaauacuaaaaucugaccuaccauguuaacuuaguaaggcaaacugcuggggcggggucccguuucagccgaacgcaucugacaaugccuuaagucacacauugcauaaucacaaguugcuucuugacaugagcggcucuucaagugcacggggaacaacagauucuuugucagggacucacaagagucacaugcuguuauucuuuucuccuuaagagacaaacugauuuuuuaaucacugagagccuauuacaugcguggcauaguuuuaagauguuuugacaugucacacguaaacgauaguaaacaugucuuggaagaggggcuaagaugugggacgaacgugauuauucaaugggcaugcgcuuccggccacgcaucacacgcacauacaccagcgcgguuauccauaacucuaccauuucaagugagccgcaagagacuguaaaucgcagugaagugggccgucaggcaaugauuacuaaauaagcaugggaaacaucuaagauuaacagugaagagagaagaugcguuuggaauggaauccuggagacaguuaaguuaccaggugcuuucacagucguuuuuucaaauucagucacugagacauaaaauaauauugaucuuugagaagagcucucgacggaaacagcaguuggcaguguccccagagcacuugcccuuccucuggagcgcuucacgugcgagcccgccgucuauuuauaacaguugggcacuugucgccacaauggcugauuguguggcccagcugucugugucuaucaagaagggcaggaguggacagccugcacuuugauguuucccuuuuuuggagacugaaaauaacauuuuuaaaaaacugccaaccggcaaggucacaaaauauuuuuggauggcacggggacccgauugcaaagcugugguucacaucagaugcggaggccugggaagaagccagugagccccauugcacaauauccugcucaugccaacuucaaaaguuauuugccucggagagcucccagacgacucuuucucgguaauaaaacacagcauuuuagaaauuugcaagggucuucuggauagggcauuacccagaggagcaaggauuucccuggccacucugguuacaguugcaaccagcagccccaggccucuugccacccuugccccgccccaccccacaucccucacccccacuccacaaacuccugcccuucccugaugagcucucaagcacuuaccagcgacacgcuacauauuuuucuaaugcaugugucaauuucuugacucgcccauucuauuauagauggcucacgaaagcaggauuagcgucuguuuuguucacugaugcaaccacagagccgagaauagugccuggcucacaauauuuacugagugcauacuuguggaauuaauuaauuuaaauagcagagacaaugggaucaggaaacacauggaaauaccgaugaccaguauuagaugucaggguucugucgcccuucccuccgcccccgacgaagaucccagcuuuguuuacauauuuguggugcacaaaaauagaaauggacuaaacaaaauucccgauuuucccaaacugugguggauugcagaaaccaagacuucgcagggcucgguucugaaaugauuuucacucaaaccaucuuccugaaacucuuccuauuacucucugcccauuucgcaaaccuucuugcuggagguauuagauacgggaagcaccuguaguaaucaacaaguauggcucugauuaaauggauuuuuuucuuuuuuuuuuuuugagacggacucucgcucugucacccaggcuggagugcaguggcacaaucucggcucacugcaagcuacgccucccggguucaagcaauucuccugcuucagccucccgaguagcugggacuacaggugcccgccaccaugcccggcuaauuuuguauuguuaguagagacggguuucacuguguuagccaggauggucuaaaucuccugaccucgugauccaccugccucgaccucccaaagugcugggauuacaggugugagccacugugcccagccgaaauggauauuuugaaaaucaucaaguuauacaaaagaaucccacaugcuguacaacaccacucgagauuuuaggguuuuugcggguuuuacaucaguagaucaugaaacccugacucuuuaauuauuauguaaaugaaauucaacaacacacucacaccucaaaaacucuggaaggucagaaagaggcagagagcagggcccccgcggaaggggaggcacacaaggcagacagaggcagaggaggugggaguacaggccccagcacugugguagccaacagcagagccauucuuccacaccgggaagggcccccaggccucaggaagccagcucuauucagcagauuucacaagugaaaaagccuuuuuagaugucuuuuggggucaggcgugguggcuuacaccuguaaucccaguacuuugggaggcugaggcgagcagaucacuugaggucaggaguucaagaccaaccuggccaacauggugaaacccugucucuacuaaacauacaaaaaauuagcugggcauaguggcacacaccuauaaucccagcuacucgggaggcugagacaggagaauugcuugaacccaggagguagagguugcagugagucaagaucaggccauuguacuccagccugggcagcagagcaagacucugucucaaaaaggaaaaaaaaaaaggccagacgcgguggcucacaccuacaaucccagcacuuugggaggccgggguggggggaucacgaggucaggagaucgagaccaucccggcuaacacggugaaaccccgucucuacuaaaaauacaaaaaaauuagccaggcguggcgccgggcgccuguagucccagcuacuugggaggcugaggcaggagaacggcaugaacccagaaggcagagcuugcagugagccgagauggugccacugcacuccagcgugggcgacagagcgaggauccguuucaaaaaaaaaaaaagauaccuuuugggaacaauuccccagcagaacaaaggugccacuucuaaguaugaggaauuccuuaucaaagaugccugagccugcaagacagcucccacaaguacaagcgcugcaacgacugggugacugcgcgucucuggcaagcgguuuugaagccacuuccuuagcucccauagacaggcagugcuggaaacacacaugcagggagcucccagccgguguugugcgauacagaacccgaaagcugcgcccuccccgcaaggagguugucuauagaaaauucugugacaucaggauucuucaauaaucucuucaacaucagcucucaacauauuuauagaagaucuccaggcccagcaguuuuccuaccugugcaaaaugcuguggcuucaaaguaauguuuuguuguguuuuguuuuguuuuugagacgagucucacucugucauccaggcuggagugcagugaugcaaucucagcucacuguaaccuccgcucccgggcuccagggauucuccugccucagccucccaaguagcugggacgauaggcgugcaccaccacacuuagguaauuuuuguauuuuuaguagagaugguguuucaccauguuggccaggcuggucugaaaaugcugaccucaagugauccacccaccucggccucccagagugcugggauuacagccgugagccaccacacccagccaaaguaaauuuaaaaggggcuuucguccuccuaggagucagaaucaguccucacuguaagaagcagaauucuaaccucaaaacuggucuccugggaacacuggaaagcagugcgugauccgaaggggcagaaaugacugacacucucaaauuccccucugcaucaugggcacucagcacugugccuagugcauaguaagacuucaacaaauaugugcuguuguuauaauucggcaugacgauggaggugcagagguuuaccuguguuuuuauuaucucugguugacaaggcggccacacccagguugccuguucugaagcugucucaagacagugaccaucacccaggcugagguccaggaugaugugagugcaaauugcuaaagcucuccuucaggugccaggccugccaugacacauggcgaguccuagcagaggucagaccaacaacucaguucuuucagguaaccuguacugaugaaaccgccccccccccccccgccaaucuuacucuucuguuauuucaugucuaugaaggguuuuggcauaaaaaaaacaaaaagccucauuuuaaaaaaaucuacaauuguuuagguuuuuguuuaaagagaagcgucugguucuguugccuaggcuggagugccguggugcaaucucggcucacugcagccuccaaccccuggccucaagcaauacuccugccucagcuuccugaguagcugggacuguccaucuuuuuuuuaauaacagcuuuauugagauauaauucacauaccguacaauucaucuguuuccaggguacaauucaguggugucuagcauauucacacagggcugugcaaccaucaccaccaucaaccuagaacacuuucaucaccccagaaagaaacuccgcacccggcugcagugacaccaucauccuggcuuauugucguuuguccgccggccaccguucugucucuguuucuuucccaacaccagccucucuuuucacgcacuaucuccccgccagcccugcucccugcauucuguaggaaaugcuuggcuccuacagugguugacgaauaccaaagcuucugugagcacgccagagggcccccacaaagcucucuccucugucugaaacauuacucugaaggagugauuucuuguucauucugaauaaggaugacgacaccaggaagcggaggcccggggagcauuuacggcguguucucgaugugugagcacuguggccagcacguuccaacccagugcugcaagaguugcucccagccccacuucagagaugagaaaaccaaggcccagggaacccaaggucacaaaggacucuaagaaggagaguugaguaaucccagcacuuugggaggccaaggugggcagaucgcuucaggucaagaguucgagaccagccuggccaacauagugaaaccccaucucuacuaaaaauacaaaaauuagccaggcgugguggugggcaccuguaaucccagcuacuugggaggucgaggcagaagaaucgcuugaacccaggagguggagguugcagugagccgagaucaugccacugcacuccagccugagugacagagugagacucugucuaaaaaaaaaaaaaaagagaguugaggcugggcgcaguggcucaugccuguaaucccaacacuuugggaggccaagguggcaagaucacuugaggucagggguucaaaaccacccuggccaacacgguaaaacccccgucucuacuaaaaauacaaaaauuagccaggcaugguggcgugcaccuguaguaccagcuacucaggaggcugaggcaggagaaucacuugaaccugggaggcagagguugcagugagccaagaucgccccacugcacuccagccugggaaacagagaaacucuugucuccaagaaaaaaaaaaaaaaaagaagaagaauugaaauuugaacuccaagcaaugugacaccagagcucaggcccggaaccccaugcuacacugacucuuguugagagaacacuccaagauguaaucaugccuacaaugacguugcagggggaagugacugauccacuacuuuccuggagaaccugggaagguaugugugaucaggaggauaaaaggccagggaacaagaaaacugcagagaggagacccagcaggcaagaugcugcaaaaggugcagcggaacugaguccaccgaggagcuaaaaaucccuccgucuuagaauucuguccuugccaggaaagggcuccucaucuccugauugcuaauuaacuuuaucuccuugaaucaagggagcuaaaggaagucucugaauuagaaaccuuuguggugagggguaaaggaacuuugguaagaggauauaaucaaaaauaugaugauuaaagaaagaugauuaaagcuuggaaagcaagucacuaacuuauuaacaguggcuaucuuuaagggaugggauuaguaaagauuuucauuuccauuuuauacauuucuauauugccaaauuuuacaacaagcuuauaguacuuagaaaguuggaagaaaaaccggccgugcacgauggcucacgccuuuaaucccagcacucugggaggccgaggugggcagaucaccugaggucaggaguucgagaccagccuggccaacaugaugaaacuccaucucuacuaaaaaauacaaaaauuagcugguggcgggugccuguaaucccagcaaccugggaggcugaggcaggagaagugcuagaaccuggaaggcagaggcugcagugagccgagaucaugccacugcacuccagccugggcgacacagcgagaauccaucgaaaaaaaaaaaaaaagaaaaaaaaagaaagaaagaaaguuagaagaaaaaaccaaaaagaugaccuggggagaggggaagaacuucuggaauaaugaagugagaagcuuggcaaaaccucuccucaaaaaguaacaacaaaacuagacaagucggucaaaaacaaccaccacaggguuggaaaucaaccaaagacauacaaaaaauugaaaaauguuuauucaagaaaaacuacgcagcugggcaugguggcucccaccugcaauuguagcacuuugggaggccgaggcaggaggauugcuugaggcugggagucagagaccagccugggcaacauaucaagaccccgucucaacgaaaaacaaaaaagucagccuggcguggugaugcacaccuguagucucagccacucaggaggcugaggugggaaaaucucuugagccugggagcuugagguuacagugaacuaugauugugccacugcacgccagcuugagugacagaggaaggccucaucucaagaauuaaaaaauaaaaugaagaagaaaaaugaccaaaucuugaguuagagcggugguguucugugaugcuuuggcuugaggggcuccccuccuuccccucagcucacccaugcugcuacaucuaccagggugggacgagcugugaaaauugguggcuccacugcuggagggguugacuugauuuggaggagagcacaugcccaaaggcacugacauaaaccacggugauuuccuguaaacaacaggaaauguacagaaggucaacaucucagccacccugagccugcaaugccgguuguggcaaccaacagaucaggagaccagccaaaaaccuagccggaagauacagagaauaagggagcuaucacgggcagugguaaagucccugaagucccacacauucuucgugcucuggaaggcugcacacaggcaggaaagacugaagagggcccugguuauccacucauccuuggcuaaagugaggccuaccccacgcacaaaggaggccagaaaaggccuggcaaaaaggaaaaaccaagacaggcucguauaauauaugccugaauucugaacaugucccuaaacguacacacauauccaccgcaaacugugaaaagcauuaguagcucaagguguuucagcacaccucugaauaaucauugccugaccacuaagcuaugcugaccuggguuaaccccugcaaagccaggcuuaaacacauuuuaaaaauaagaaaaaaaaaaugagcaggaucaucagcagcugcuacagagacagacuucacagaauuaauccaggcaagucacaaacaaaaagaaauaaacaacaaaccugcguuuugccaaaggugaucauaauccagaguugcuacaacguauuaacuaaaauacagagcuuaaaaaaauaaaauauaagacaugcaaagaaacauaaaguauugugaauuauacucaggcaagagucauaacuggaaacucuaagggggcccagauauuggacuuaacaaagauuucaaaguuauaagaaacuacuguaagaauggaacugaaggaauucauguuuaaagaacuaaaggaaaguauguaacaaugacucaucaaauagagaauacuaauaaagagacagaaauuauaaaaagaaaccaaacagaaauucuagaguucaaaaguauaauaacuguaaugaaaaguucacuagaggggcucaacaacagaguugacaugggagaagaaagaaucagugaacuuaaaauuauccaaucugaagaagaaauaaaaaagcauaaagaaaaauaaaaagaaccucagaaacacagggauaccaucaagcaugccaacauauauauaaaggaaguuucaaaagaaaacgaagcaaaaggaagcagaaaaaauuuuuugaaaaacuaauggcauaaacuucucacauuugauuuuaaaaaauuaauguucacauccaacaaacucaaaguaagcucaaaaaacuccaacucaauaaagugagccaccaugacacaucauagccaaacugcuggaagccaaaaacaaagagaaaaucuugacugcaugaagacaaaaugguucuucaugaaaaggagcacuaccauaagauuaacagcugacuucacguuagaaauuaacagagaccagaaaacaguaaaaugacauauucaaagcacugaaagaaaaacuuccaaucaagaauuccauauccaucaaaaccauaccccaaaacuaacaaguagaaauaaagauauuccuagauaaacaaagacagaaaauuuguuacuggcagacccuacuuacaagaaauacuaaaggaagcccuucaagaugaaagaaaaaaacaccagauuauauccugaauccacaugaagaaauaaagaaugcuaguaauacuaauuacauaggcaaauauacagcagauuuauaaauagucucuuuuuuacacuuaacugauuuaaaagacaaguacauauaacaauaacuacagacuuuuacuacugggcuuaugacauacaaagauaucauauacaugacauaauaccacagaggagguagauagacauagacauuuaauggaacaaaguuucuauauuuuauugaaaaugaauuagcauuaaucuacaguagacugugagcucuaggcacaguggcucaugccuguaaucccagcacuuugggaggcugagauggaaggaucacuugaauccaggaguuugaaaccagccugggcaacauggcaaaaccccaucucuacuuuuuaaaagcuauauauagaucuuuaaaaaguagacugugaugagaugcauauugcaauccuuagaguaaccacuaaaaauauaaccaaaaaauauuaaaaaccucaccaaacagaugaaaacagaacacuagaaaauaucuauuuaacacaaaagaaaacaguaaggagaaacagaacaaaaagaugugagacagagaaaacauagcaaaauguuagauguaauccaagcauaucaauaauugcauuaaauguaaauggauuaaacacuccaauaaaaggugaagacugucagauuaaauuuuuuagaaguucuaaccaugugcugucugcaagagaugcagauggagaaaaauguacuaugcaaacaaaaccauaagaaaguugcaguggcuauaauaauaucaaaguaaguaugggaggcuguggcagguggauugcuugaguacaggaauucaagguuauagugagcuaugauugugccacugcacuccagccugggugacagagugauacccugucucaaaacaaacaaacaaaaacacaaaaaaaucccacagacugaauaaacuuuaagacaaaaaaguuauaagagaaaaagaaauuuuguaacaauaaaagggucaacucaugaggaauauauaaaaacauaaauacauaagcacuuaauagcagagcacaaaauacaauaaagcaaacacugacugaaccaaagggagaaauaggcaauucacaauaauguuuggagacuucaauaucccacucucaauaauugacauaauaguuaaacagaaaaucagcaaggauauacagacuuugaacagcauugucaaccaaccugacguaacuaacaucuguagaccaugucaagcaacaacaaauagaauauauauucuuuucaaguguacauaucgcauugucuagaaugaaucaugggcuaggucauaaaacaaguaucaauaaauuuaaaagaauuaaaaucauauaaagcauguucucuaccaaaaugaaauuuuuaaaaaucaagaacagaaauaaauuuguggacuccccaacuacuuagaaauuagaaaacauaucuaaaggauucaaaggucaaagaagaaaucacaagggaaguuuaaaaauacuucaaacuggaugaaaagaaaaacacagcagaucaaaauuuaggaugcagcuaugagaaguacuuagggagaaauuuauaauguuaaaagccuguaucaggaaaaaaaaaagaaaagucucaaguuaauaaacugagcaucagcagggaacaguggcucacaccuguaaucucaacacuuuggaaggccaagcugggacgaucgcucaagcccaggaguugaagaagagccuugguaauauagugagacccugugucuacaaaaaauaaaaauaaaaauuagcuggcccaaugguacacaccuguagccucagcuccuuggggggcugaggugagagaaucucuugagccuggaagguggaagcugcagugagccaguaucgcaccacugcacuccagccugggccacggggcgagaucaugucucaaaaaaaaaaaacacaaaccugaguuuccaccuuaagaaacuauaaaaaggagaguaaacuaaaucccaaaaaaagcagaaggaaggcaauaauaaauacuagaccagaaaucaaugaauuagggaaaguaauagagaaaacugaugaaaccaaaaguugguucuuuguucagaaacaaaacaaggaugucuacucucaccauuucuacucaacauuguacuggaggugcuauccagaacaauaaggcaggaaaaagaaauuuaaaagacacagauuggaaaacaaguaaaacucuucauauucacuagcucuauauauagaaaaucuucaggagucuacaaaaaacuacuagaacuaauaagcaaguuuaacauguucauaagauacaaaaucaauaucaggaaaucaacuguuuuguguauaccagcaaugaacaauccaaaaacaaaauuaagaaauaauuccauuuguaauagcaucaaaauuaguaaguuaaaauuacaaaacuuuguugauacauuaaauaauaucuaaauaaauguaaggagauaccagguucuuggauugaaggacucaguauuguuaagauggcauuucuucccaaauugaucaacagauucaacaagacccagcaagcuuuuuguagaaauuaacaagaaagguuaugaguggguaacugaagcuggguaacguguaccugagaguugauuauacuacucucuucacuuuuguuuauguuugaaaucauccauaauaaaguguuguuuuuuguuuuugagagacagggucucacucugucacucgggcuggaguacaauggcacaaucagagcucacugcagccucaguuuccugggcucaagcaauccucccaccucagucuccccauuagcugggacuccagguggguaccacuaugcccagcuaauuuuuuuaauuuauuuguuuauagagacagggucucaccauguugcccaggcuggucucaaacuccuggacucaagcaauccucccaccuggaccucccaaagugcugggaucacaggcaugagccacuacauuuggccagcaacgugguuuuuguuugcuuacaaaaaaaaaagaagacuacacaaaagaaaaaaauguacaacuaauucaagggcugccuuaauuauuccucacucuuuacccucggcccacaucauuucccuacaggcugauccuugcccaguccacuccugauucauggcuggugaauaggugagggaggaaaauggagagagcgaauacacagagugacagagggaggagaagugaaaggucauaggcauucgcugcagccaugccuguaguacguccaucaccaggcuucaauuuauagcagcuacaugacugcgugugucaaucucuaacuggcucaugugccagaccagaagcuacuauuggaaaaugccccucucucgucaugucguuugcacaguaauucacuuagaucugaacugaguacaaaugaguggugcucuaagaucaaagcaccagggucuuuaaaaugaucuucacucuccccgcaaccugccccgaacacgugcaugcuccuuucacuuucaauuccaaacugcacccuucuaacgcuggccgaaagggaaaguaagcccuguuuucguuuccuuucaaauacuugaugcuuuccaauuuuauuccuauuuucccuaauggaauaauacuuacuacuuggaaagcaucauucaucuccucucaagauccucacagcaacaccauguugccagaagggcaggugcgaaaucugaaauaauggcagaagucgaaugucgcacgucaauguacagccucccaucgaggcccauggcuuuauuuuuauguauuuauuuauuuauugagacggagucucacucugucacccaggcugcagggcaauggcgcuauuuuggcucacugcaaccuccaccucccggauuuaagcaauucugccucagccucccgaacagcugggauuacaggcaugagccaccacaccuggcuaauuuuuguauuuuuaguagaggcgggguuucgccauguuggccaggcugaucucgaacuccugaccucaggugaucugcccgccucggccucccaaaguccugggauuacaggcgcccacugccacacccggcucaguuuuguauuuuuaguagagacugggucucaccauguuggccaggcuggucucgaacuccugaccucaggugaucugcccgccuuggccucccaaagugcugggauuacaggcgugagccuccgcgccuggacuaaggcccaugacuuuagcaagcgggauguuguuuuccaccuccugcugcugccucuuaaggaacaggggcgcuucuucaccgcagaggagacgguucuccauucuaggaauggguaugaacuugccugaauagucuaugaugggcaauggggacguuccaucuacaucucauuaugaaaauccccaaaaaccuuacaaaaccauauaaucgugaaguuuuaagaagucuuaaauaguucuaauauauaauucuccacaaaucuuuucucucuaaaaaacacuuauuuuucucauuuugauaugccacuucaaagcuuuucccacuccuugaguauauuuacuuuucucucuccucucucuagugacugagcagugauuuuaccuuuaccuauuuauuuagagauggaggucucacucuguugcccaggcuggagugcaggggcacgaucagggcucacugcaggcuccaccucucagguucaaacaauccuccuaccucagccuccagaguagcuuggaccaaagaugcaugucaccacacccagcuaauguuuuuauuauuuguagaaaugaggucucgcuguugcccaggcuggucucaaaugccugggcucaggugauccucccgccucagccucccaaagugcuggaauuauaagugugagccacagcuucccacuaacaauuucacuuuuuaaagagaugggucauauuguccaguaacauuuacaugagauccaugaaaaaaaagugaauauuauucuuuagaauaauaaacaauucauaucacaaaauuagcuuuaaaagauucccgcuuguaggagcuauuagaauuucaaaacugcccaguuaaacauaaccugguucaucccaacguuuucauuuacauauaauucaaaaagauuuacuuuuccauaaauuucaaaugcucuucagaugaaggaaacauucaucauuacaucaaagcaagugcaacuucaauacuaaauuuccugaucuuuuauacaauuagacugcaagugcucaucugagacagauuuagagaaaauugcggcugaugcccagcucuaugaaagaguuuuaagaacugaaauaacuuaaaaaaaauuagaaucacagaauggggggagaugagaaaaaauucauccuaaauuagaaauacgaacuccugcccaaagugcaggguuuuuaaaaaauggaauuguuaaacagauugaaauaauauuuagaaacaacaccagcucacaaggguaguaaaauacuaauucuuaaaaucguuaaacagauugaaauaauguuugucaauaacaccagcucacaaggauaguaaaauacuaauucuuaaaauccucccucuugcgcuaugccugcuucugaguuggcugagcaaguuccuucccuuccccaggcuucuaacagugaacaugaucuggcagcauuagacacaccacaacuccacuccagaccaagaugggucugggucaaacccaggacuucugcuucaaauuaggagaguuaccaaauuaagacaauucugccucaacugagucacccuccagggacagcugaguccauuuccaggguaaguacugggguagcucuacccaccccagagagauguauuuuauggucuguccuaaacagaacuggacccccagagaaguuccgagaucagcacagccugcagcugacccucgggagagggucaauucagggcauuugcugaccaaaaggauggaucucccucaccgggagguggacugcaaccucccaaacacuuugccacuguagcuaaugugugcaaacauuuacuuugugaauuuguaucuuaguagcuucacuaagucagcaaaauccaaucucugaaucuuuuuguggugacugaacuaacucuauguugcacuuuuggugaaaaacugcaacauagaauuuaauuaauucuuuaauuaaauggguuaagggaaaaaccguggcaauaauuuuuuuuuuccucuuucacuuuugggauuugaggucuucaaauaaguuuuucuaauuguagggaaaacaaagucuuuuaauaauuaccauuaaugauuuauaauuuaagcaguuuaggaaauaaaaaaugcauagaacaugauauucucauacccagacaagcucauaucccaccugcaccccuuuacagucaaggaugauuuugcaucuccuuuccucacuuaagugccuuuuuugccaacuaggauaacucauauaaugaauuuuugccaacuaggaaaacucauauaauggcuuuuuuuaaaucugguuuuucuaauaauaaaaucauaucuguugcaaaaaaaaaacaaagcaaaaaaaauauuaguacaaguuccucuaaucccacuguaaagaacacgcgcuauauauaaauuuguauauauccuucaaugcauguauuauuaucucucuagacccacauuauuaaacacgcuauuuuauggaaaaugagaucauguuuuacauaugguacaguugcuugcuuuuuucaauucacaguucauggccgggcacgguggcucacaccuguaaucccggcacuuugggaggccuagaugagcggaucaugaggucaggagaucgagaccauccuggcuaacacggugaaaccccgucucuacuaaaaauacaaaaaaaaauuagcugggcaugguggcgggcgccuguagucccagcuacucaggaggcugaggcaggagaauggugugaacccaggaggcggagcuugcagugagccaagaucgagccacugcacuccagcaugagugacaaagcgagacuccaucucaaaaaaaaaaaaaaacaauucacgguggcucuuuugcacauauggguacacgcagaucuaucucauucuuacaaaugguuacaacuauuccaccauaaggacagaccauaauuuccaccuaauagauguucaagugauuucccacuuucugcuauuacaagaaagacaguaaccaagauucucauacauacauuuuuguacuugugcaaauauugccauaggguaaaucccuaaaagugaaaggacuuggucaaauggcaugacaugugaaauucugaagauaugcaaaauguccucaaaaagguuucugcaauucguagucccaccaacaguguuucagagggccugcguucccuuuccucucaccaccaacaacuagaaucaauuuuuucaucuuuacgaaucaaagagauuuuucaaauuuuuuuucuuauuucaauaugcuguuguuguaaguuauuauuauuauuauuauuauuauuauuagggggauuguacauuuagcccaccgcacacuagcugcaugaccuagagaaguaauuuaauaucccgguuccuugguuguaaaaugcagauaaugaaaguaacaucuacuucucgggggagccgugaagauguaaugagcgaaggcaucucagacacuuggugccgagucugacagaguggggcuucaacaaagguuggaagaacaacgaauaaauagaauauauucuaugaacaaugaauaaauggaauauauucuaucagggugacuuaccagaguuaccucacucaucaccaauuuggcugcuguucaauuuuugcuauucucaauuauauucguaucauugaguaaauuauucucuuguaucuacaggaccaucuucuaaggcgacucucccaggauucggacaguguuacaguucuuacuucuguucuuuagaagaagugaaccagcaacaacaggccacccaucaaguuuuagaaaauuuucucugccuuaaaaaguauauaaugcggccaggcaugguggcucacacuuguaaucccagcacuuugggaggcugaggcagguggaucacuugagggcaggaguuugagaccagucugcccaagauggugaaacccugucucuacuaaaaguacaaaaaaauuagccaggcgugguggcacaugccuguaaucccagccacucaggagggugaggcacaagaauugcuugaacccgggaggcaaagguugcagugaguuaagauugcgcuacugcacuccagccucggcaacagagugagacucugucucaaaaaaauauguauguguguguauguguguguguguguguguguguguacuuuuaaggcauucucuuuuguacuuuuaaaauuacuaguaaggacauacauuuccauaucacucacuguuuguuguauagaaaauaagcuuuaucguuauaauuuucacgcauauauuuuucuccaaauuaugaccuggaaaaaaaacuugcagcuaguaacuggaaaacuggguaacauauauuuauaaaagacaaacacacauguauuucuuauauguggcuuuucucuaccaguaaagaauaggauguggaugaaaguuucaaauaauauuauguuauaaaccuuauauaauuacugaacucaacaaaacuuuugaaaaauaaccaaguagaaguuauuuuuagaaaccuggaaugucauuccaccuaacagaaauuaaaacuggcugggccugguggcucacaccuguaaucccagugcuuucgaagaccaaggcaggaggaucgcuugaguccaggaguucaaguccagccugggcaacauagagagauccuuucucuuuaaaaagaaaaaagcgaagugcaguggcucacaccuguaauccuaucacuuugggaggccgaggcaggaggacuacuugaccccaggaguuccagaccagccugaguaacauaagaccccaucuacacacaaaaauacauaaaaaugagcugggugugaugaugcaugcauguaguccuagcuacucaggagucugagaugggaggauuacuuugagcccagaaggucaaggcuucagugagccaugaucagaccacugcacuccagucuuggcaacagagagagucuccgucucaaaaaauaaaauaauaauaauaauaaaaaccaagauaaauaauauaaccacaacuuuucuugacccaucaaagaggcgggguuacaaaguaaccaaguaguagccaggcgugguggcucacaccuguaaucccggcacuuugggaggcccaggugggcagaucacuugaggccaggaguucgaggccagccuggccaauaugguaauaucccaucucuccuaaaaauacaaaaaucagccagccauggugauccaugucuguaauccuagcuacucgggaggcugaggcgggagaaucaauugaacccgggaagcggagguugcagugagcagagauggugcuacuugcacuccagccugggcaacaaaagcgaaacucagucuccaaaaaaaaaaaaaaaaaaaaaaaaaaaaaaaaucaaaaaaguugaaaacagaucaauaucuggcauugaggcuuuuaaaaagucaaauccaaaauuccuuauaaagguuccugcaaagccaacuuaaaaaggguccguaugguggaucacaauucuugcuacauuugaugcaaaucuucaggccaaguauaaagcaacuaaaauuuguuuugcaaauaaauuggucuuacuauuauauauauaauuuaucccugguagaaauggggaaacuggagaaagaaaaauuuagauucuagccuuaaccauuguuugugaguuuuuauuaucugccuacaauuugggcuaauccugaaccauuuccuggcugcaacaagucucuaaagaagaaccgaguuuuaauuuucaucaugaugcauuuuaguuggcuucuuaacagaauacguucuuuuuucauuguuguucuggcccacgaauucuggguuuuuuuguuugguuuuugagacagagucucacugucauccaggcgggagugcgguggugcggucucggcucccugcaaccuccaccucccggguucaagcgauucucgcgccucagccuccugaguagcugggauuacaggcgauucucuuucuauugcaaucucugugugcacagaauucuacuauccgagugaucgauguuauauaucucacauuguuuugccuauucugacagaaccaaagccacugcauucugaagacugaagacgauuuaaaagccugugaaucucccuuguuuggaaucccacugggcccgaucuguuuuccaugaccaaggcacugcugcuaaagcuauacaguaucaagcacccuccuuaaaggcucagggaccaugaaggaagaagagggcaugugagauuacaagagcuggauuacaagaguggacuguggaggcugaaguagcuccaucguggaugcuacuccgccauguggcuucugauuaaccccaguuccaggaaacccucugagauuuccagcuuaugcgcuguuccucguguaagaccaagaacuuaccauaaagccugaccuuaggucaaacaacuuugauguuauuguacucacacugaccuacacaucccucugaaucaccccuucccuacgguauacaagcccugggaccaggggauaauggugcagggauccacugucucuucucgcugcagccccaguucacagacuaaugaacagaagcuugagaacagacauagcuucugugcauaagccccuauuaaauguuucuaagaaaaaagaaaaugcuugaagaagaaagaaaggauagaaggaaauauuugaagagauaauggccaauaauuuuuuaaacauaauaaaagacaucaaagcacagauccaagaaguuuagaggacuccaaaaaagagaaauaccaaaacaacaucauguccaaauugucgaaaacuaaaaauaaagagaaaaucuuaaaagcugccggggugacagugggaauugggaaacauauuacauucagaggaacaaagaaaagaauuauagcagacuucucaccaaaacaacaaaagccagaaggcaguggugugauaucuuuaaaguacuaaaagaauaaguugcaaaaaaaauuuuucaacacaaaccuucauauccuaaaagaaaaaaaaaaaaaaaagaaacaaacaaaaccaaaaaaaagaaaaaaccgacucuuaaaaaugagugucucuuggaucuccuugguaugaaauuuuucuuuaaacauuuucuuuuuuuucagaaagagucucacucuauugcccaggcuggaaugcagugacgugaucucagcucucugcaaccuccgccuccuggguucaaguaauucuccugccucggccucccaaguagcuggaacuacaggcaugcgccaccaugcccagcuaauuuuugguagagacgggguuucgccuugucagccaggcaggucuccaacuccuggccucaagugaucaacucuccucagccucccaaagugcuggaauuacaagcaugagucaccgcacccagcccucuuuaaaaacuuuuuuuuuuuuuugagacaaaagucucacucaguugcccagacuggaaugcaauggcgcgaucucagcucacugcaaccuccaccuccuggguucaaaugacucuccugccucagccucccaaguagcugggaugacaggcucucaccaccauauccagcuaauuuuuguauuuuuaguagagacaggguuuugccauguuggccaggcuggucuugaacuccugacugcaggugauccaccuaccucggcuucccaaagugcugggaauaacaggcaugagccauugugcccggccuaaaaacauuuucuaaugggagggaaauaaaaacuuuuucagacagacaaaggcugagaucauuuauucccagaagaccuguagcauaaaaaauguuaaaggaaguuuuucagucgggagaugagacagaaaccuauagaucuacacaaagaaacgaagaguuccugaaguggccuaaaaagaagaaagauuuucaaaauaauuuucaaaaguauuuugaaaaucuuccauuguucuaaaacuacacugucuauauggcagccgcuuaaauuuaaauuacuuaaauuaaacuaguuuauuuaaaauucaguuguuuucagguacucaauggucacacauggauaguagcuaccauauuguauagucuagauauaaaacauuuccaucauugcaggaaguuucaucaaacagcauugcucuaaaagguaauuuucuguaaaaauaacauguuaugagguuuauaauauauauaaaauacauuauuaugacacuauuagcaucauaaacauuuacaagguucucauagaaccuuguaguaacuuacaguuaugaagaauucuuacgagguucuuauauaauaaaugguauaauauuuggaggcagacugauaaaaaauguacuuuguaaauuucgggcaaugacuuaaaauaagugagaaaaaauauauaagaaauaaaucgauagaagagauaaaaauagaaucaugacaaaaaucuggcugggcacaguggcucaugccuguaaucccagcacuuugggagguagaggugggaggagcacuugaggccaggaguucaagaccacgcugggcaacauagugaggaucugccuccgcaaaaaaaaaaaaacaaaauuuaaauuaaaaaaacaauuagccgggcauggugguguacgccuauauucccagcuacuugggcgacagaggcgggugggucgcuugagcccaggaggucgaggcuucagugagcuacgaucaugccauuguaccccagucuggaugacagggcaauacccaguggcaaaaaaaaaaaaaaauagaaaacacacuagcaaauugucuacaaaguggaagguuaaaaagugaucgaggggaaaaaaaagcaguucgguauuucuuuacauagacaauucaaaagguuguucugaaucucacaaagauuuauugaaaguuguuacacuuuuaaguacuacuuuauggccggguauaguggcucacaccuguaaucccaauacuuuugagaggcugaggcaggaggaucgcuugagcccaggaguucaaggccagccugggcaacauggugagaccccgucuccacaaaaaaauagaaaaauuagccagcuaugguggugcaugccuguagucccagcuacucaggaagcugagguaggaggaucacuucagcccaggaagcugaggcuacagugagcugugaucaugccacuccacuccagccugggugacaaggugagaccuguuacuauauauauauggagugcaguggcaccaucuuggcucacugcaaccuccgccucccggguucaagcaauucuccugucccagccucccaaguagcugggauuacaggcaugugccaccacgcccagauaauuuuuguauuuuuaguagagaugggguuuugccauguuggccaggcuagucucgaacuccugaccucuggugaucuguccacaucagccucccaaagugcugggauuacaggcaugagccaccgugccuggccagugccuaauuuuaaucucuuacuaaauuaaccacuaaauuaauuuuuuaaaccccagaggaacauuaauuuacagcagaagagguaagggaaaacuggauguacuggcaagaaauguacccggucccaugugugcaaucugucaacauguaaauacugagcgucugcuaaacaccauacaccagggacacaaaaauguugcaaaauguguccuggagagcucagugaaggggagacacaacuccaaagacccauuaacgcaaaaggagguaaaaagagaccuggcaaggaauggcggcuggggcagcgggggggccaggcgggagggcucaggaaaagcuuuccaacggagaugcuacuggaucuuguaaggugggcagggguccaaccugcacagauaccuggcugagaguaucuggcuuauuugggaaaaaugcaggcaguguuuuuuggagaaacagauaaauuuuaagucuggaagaguucauagggguucuauuauccugaaaugcaucgcuguuauuucuuuaagugacagauaucuaguuaaugaggagaaaaggcaggcacaaaagcacaacgugaugacagagcaaaugcaaaauaacagcuggguggcguagcacaugccuguggucccagcuacuugggaggcugaggugggaggaucacuugagcccacgaguucgaggcugcagugcgcuaccaucacaccugugaacagccacuguacugcagccugugcaacacagcaagacccccgucuuacaaaacaaaaaugcaaaacaaaauuagugcccaauuucucagguuuaugccuaguugcuaaucugugacaucucuguuagaaaagcuaacaagagccuaaaagaaaaauucaagucagcuccaggacugaugguggcaaaucuacaacuccuuccacuuaaaaauucaacaaaauaagagauuuagauuuuugcauuuuugugugcccaaagaaaaaggcuccaguuuucuguuucguguuccaucagcuuacauaaccuaacucgucccacacaaagacagacgaaugauuuuucuugcagaugaaauauucccaagcucucaccucuaaggucuaaguggaucuugugauaaccagcacaaagugaggcuggggauuugaaaagaaaauaccagaaaugguuaccaaaaacugacaagagcacccaaacagcaucugugaucgcuagaagauagacgcacugacaaauuaaggagccauuaauuaguuucaaagagaaccaaauggcaucaauaauuuuuuuuuuagacaaggucuugcucuguugcccaggcugcagugcaucaauaauuaagaaucagccuccuggcugggggcgguggcucacgccuguaaucccagcacuuugggaggccaagggaggaggaucaccugaggugaggaguccgagaccagcuuggccaacauggugaaaccccgucucuacuaaaaauacaaaaauuagccgggcaugguggcaggcaccuguaaucccagcuacucagggggcugaagaaggagaaucgcuugaaccucagagguggacguugcagugagccgagaucacgccauugcauuccagccugggggacaagguugagacuucgucucaaaaaaaaaaaaaaagaaucagccuccuuucuguacacgcuuuccacagcuagcaugcggacucacuggacuacaggguguaagaugaggccaacuguaagcccuauacagggaaguuacaguuuuguucaaaacucacucacaauugggaacagccugagaccaugccugcauggaacagcacagccuuguccccccccgaggacacuuccugugacaucuggagagaugagcagauucacgaggcccaggaggguuuucagguggucuuucuggcuguagagagaucaaacacacccuuccccaacguccuuuaggaguaaaugaccaauuuagcaacaaugagcacucaagaaguacgccagcauucucuuuauuaugauuauuuccugcacauuacaucaugccuucuuuucuuacagcgggaaaacacccacacacacgcacacagguauaugcacacacacacaucaaaaguuacuguaacuccuaagcagagaauaggcauauuuuuggccuuuaccuuucaguccaauuuuuuaaaaugagauauaaaaacugaaaaggaggggauuuuaaauuuauaugauuuucugccaagaaaaaucuaaggcuaucugauuuuuaaaaaucagacacaggccaggcgcggugacucacaccuguaaucccaacacuuuggaaggcugagguggguggauuacuugaggucaggaguuugagaccagccuggccagcauggcaaaacgccaucucuacuaaaaauacaaaagaaauuagccaggcgugguggugcacaccuguaauccuaguacuugggagucuucggcagaauugcuugaacccaggaggcagaggugguagugagccaagauggugccacugcacuccagccugggcaauaaagugagacucugcuucagaaaaaaaaaaaaaauucagacacaauaagcauucaauuaaguguccaguuacaaagaaaaauaacauguucagcuucauaguuucuuauaaaguuaaacacacucaucauacaacccagucacuccacuccuaugcauuuaaccgaaacaaauaaaaauauacauccacggaagacuugugaauguucacagcaacucuauucauaauagccaagaacugcaagcaacucaaauauucaucaacugauaaacugauuuuuuaaaauggugguauauccaguccaggcacaaugguucaugcuuguuaucccaacacuuugggaggccaaggugggaggauugcuugaacucagaaguuugagaccagacugggcaauauaaugagaccuccaucucuacaaaauacuuaaaaauuagccagguguggugguguacaccuguagucccagcuacuugggaggcugaggugggaagaucaccuaagccuaggaggucaaagcugcagugagaucacgccacugcacuccagccugccuagagugagacccugucucaaaaaaagaaaaaaaaaaaagaaaacaaaaacauaaaaguauuagaagaaaauauagguuaauauuuuacauaguccucagguggggaaggcuuuucuaaccaugauacuaaagguagaaaccauaaacaaugauugauagauaagaccaacauaaagauuuuaaauuuccacauaucaagaaauaucacgauugaaagacaaauuagaaaaugggaggcauuuuacaacauauauggaagacaaagauuuaagauacuuacauaaauaaagaacuuucacaaaucaguaaggaaaagacaaccaauucacaagcaacucaugaagaaauacaaaagggcaacacacauaugaaaaagagauuuggccccacuacuaauuaucgugggcaaagacaacggcaaauaaggauauucaucacacuguuauaauugacaauauuauauuucaucgagucuaagaugccaaugaugauguuucauuacuuuuuguucuauuaaaauauaaugcaaagugcugccaauuaaacuaugacauaccauuaaauuauacaaugcauccugaugugagggauggcuggauuauuaacaguuucauauugugauauacaaugauucaaagcuggaaacaaucuacauuuccaacaagagauauuuccugaauaaauuauaguacauccccagaauaaaaucuaagucauuuaaaaugaugauacagauguauguacagacuuggccaggcaugguggcucacgcauguaaucccagcacuuugggaggccaagguggguggaucaccugaggucaggaguuggagaccauccuggccaacauguugaaaccccgucucuacuaaaaauacaaaaauuagcugggugugguggcggacgccuguagucccagcuacuggggagucugaggcaggagaaucucuugaacccgggaggcagagguugcagugagccgagaucaugccccugcacuucagccuggaugacagagcaagacucugucucaaaaaaauaaaauaaaauaaaauaaacaaagauguacauacagauuuaaguggaaagguauucaugauccaugaaugguguuuaaugguguuaaugguguuuaaugguguuaaugguguuuaaugguguuaaugguguuucauaugacaccauuauaucuauauauauuuauaugcauugauauauauuugauuuugaauaaauauuugauauauaucguauaugcacugaaaaagucuaaaaaccucauguugaaacauucaaaauggcuaucucuaguugguaaauguuuuuuuaaucuucuuuuugcuuaucugucuuuucuaaaacaccaaaaacauguuuuacuuuuauaauaaaaaauuaauaaaaauaagauggucacccccuuugccaucugccaaaacagagagcuucaaaagucacacauuccuuaaagcugcaguauuuacaaaggaaagaaaaaccuucaagcaaucuaaaaagcucaaacaggaaaugauuaaacuauggcauauuaauucaaagaaauacuauauuauguagaugcacaggaaaauccccaugaaauagcaacagaaaacucaaacacaaaaugaccaacaucaauuuuaacaaagaaaaaaauuaccaccuguaccuaagaauuuaaagaaguuaacagagguaauuuuucuuuucuuuacuuuuuuuuugagacagucuugcucuguugcccaggcucuagugcaguggcaugcucuugguucacugcaaccuccaucucccaggcucaagugauucuccugccuuagccucccgaguagcugagacuacaggcgugcgccaccacacccgauuaauuuuuguauauauauauacauuuuuugauagaaaugggguuuugccacguuggccaggcuagucucaaacucuuggccucaagagugauccucccgccucaaccucccaaagugcugggauuucaggcaugacccaccguucccagcccaacggaagaaauuuuucuaauaggcuucagagaauuauguguuuugaccuuuccauuaaugucuuauauaaaauuaguuugacagaaacaauaaaaaauauauacaccuucagaaucaugacggcguucuccaggccucuaccagaaacauuuuuuucguuuuuuuuuuuuuguaaaaauaucaauuuuaugcuccaaaaacauuccacauggcaaccaaggucccguagagagcacuuuuucccccuugccucuucuuuaaacuccuaauucaaaauuuugguuucugauaaccugcucaggauaaaaagaaaaucucacauagaaaugccuuuacuacagggaaauggagcaagaaauuucccuugucucugggauugcuuuuuucuguuuucugguuaaggaaaacauuucaaaguucauaaaaacaaggaacuaaaauuagagagaugagaacugaaccuugacucgagguagggaaaacacuauuuuuaaaccgagaaauauuucuaggucugugcuuuaugagaaaggaagacgagcgugcucauguguguggaugguguggccuggggagggacgguggcaggagaaaaccaucucccgcagcggggcauucccugcaccucacacacaucugcucucguggaacacaaacuggaacuaaucagcaggcggcaccugggaauucuagucacuuaacagcagggagaagguugcacguugcucacagcagaucaugaagccaucuccaccuccugcugucaccauccucagaaccagcaguggcuccauggcucccugacuccagaggagcuggccgcacaggagacccucugucauuccugcagaacagcuaaugcuuugcagagcuccagauguaaguuuaagaaauacguuuguuauaagguuucuuaacaagacacaucagugauaucuaagacucuuaacaggugacuauuaaagaaauaaaucucuuccacauauuaaaaccacauucauccugacagucauagcccagcucgaaagccuucgagagugcuuuuaccucccaccacaucaaaucuagauuucuuccuuucauccugacacccacauguucaacaucacagcacaugcggggagcccccagggugcaggaggggaggagggcgcugugucugcaggggcguguggguaaaagcaagagaggguguaacgguggguggggggagggugcugugucugcaggggcguguggguaagagcaagaggggggcagcaggggaggagggcgcugugucugcaguggcguguggguaagagcaagaaagggggcggcgggggagucuuggagaagggaggggugcggaggggcacugccuugugaggucacugguggugauguggguuccaagcagcaagaaaaagggauugaggccaagcuggagaacugaaggcaagucacgcacaggcagaguugguuaaaugauccaauuucacaaguuucuccuagaacaagcagcuacauuuucauuuuuuaaaaugcugcaugaagguugggcaguggcucacaccuguaaucccagcacuuugggagacugaggcaagagugucacuugacaccaggaguuaaagaccagccucggcaacauagcgagacccugucucuacaaaaaaaaaauugaaaauuagccaggcauggugguacacgacuguauucccagauacucaagaggcugaggcaggaggauggcuagagcccaggagaucaaggcuacagugagccacuauugccacugcacaccagccagggcaacagaacaggacccugucucaaaagaaaaaaaacaaacaaaauucuauguuuuaacuaaagucacagccacuaaugcauugcaucccuaagaaucauuuucuuucuucauguccuccccguucccacacaccuaccuuccuuaccagcagaagccugauucugcuugggguaucucccuucuaccugcuuaggaaggagaugcacacacgcacacacacacaugcaugcaugcacacaggcacacccaugcaagcacgcacacacacaugcaggcacacccacgcaugcacgcacacauauaugcacacccaugcacacccaugcaugcaugcacacauauaugcacacccacgcaugcacgcacacacaugcacacccacgcauggacgcacacgcacacacaccaugcaugcgcacacacagcccacccgcaguaaguagcuggagcaggguaaguucaccccaauggggcuucccuccccuuuccaguaacuaaggaggauguggcacauggccccgccuuggccaaagggagcugagagaugucugcuuaguuuccaugccaguaaaauaagacaugcaggauuggaaaagccccucuucuuuacuagauaucacugugucauucggaauggcugcagccacuuugugccacaagggaagacaucucccacguggcaaagacagcagagagcaaagaugaaaagcaccugggguccuggaaaugucaucacaccucugaauuaaucaacccuggaacugccauacuucuuguuacaugagauaguaaaugcguuuuuuuguuuguuuguuuuagguaauuuuaguuagguuuucguuaacucacaacaaaaaccaucuuaaccaauauaacaugcuuauuuuaucaaaacauaaagucuuuuuuuuagaaaaaucaccuauacauaaguuuucuguuugugugggauacaaaagugucuuuccacuaguguggcuauaauaaaaaagacgaacagcagcaaguguuuauggagacguggggaaaucagggcccgcacacacucuggugggaagagaaaauggcauagccacuuuaaaacaaacuccagacauuccucaaaaaguuaaacagaguuaccauaugacccagcaauuccacuccuagguacauacccaagagaaaugaaaacauauguccacaggaaaacgugucugccaacauucauagaaacacuauucaucauagucaaaaagugaaacaacccaaauauccaucaacugaggaauggauaaucaacaaagauaaacaaaacgcaauggaauauuauucagccaugaaaaggaagaaagcacuaauacaugcuacaccaugggugaacccagaaaacauuaggcucagugagagaagccagucaugaagggccacauaugaugugauuccauuuuuaugaaauguccagaacaggcaaaugcaaagagacagaaagcagcuuaggggcugccaggggcugggagcacuggggguggcagcucgggugugccgggcuucucugucgagugaagaaaacguccccaaauugucuguagugauggaugucaaaguauaggaacuguacacuuaaacugcugaauugugugacaugugaauuacaucucaauaaagcuuucuuuuguuuguuuuguguuuuucuuuuugacacagggucucacccugucacccaggcugggugacaggugaauuacaucucaauaaagcuuucuuuuguuuguuuuguuuuguuuuuguuuuugacacagggucucacccugucacccaggcuggaaugcaguggcacaaucucggcucacagcaaccuccgccuccuggguucaagugauucuccugccucagccucccaaguagcugggauuacaggcacccaccaccacgcccagcuaauuuuuauauuuuuaguagagacaggguuuuaccauguuggccaggcuggucucgaacuccugaccucaagugaucugccugccucagccucccaaagugcuggguuuacaggccugagccaccgggcccagccucaauaaagcauuuuuuaaaaaaugaaauguuggcugggcacgguggcucacaccuguaaucucaacacucugggaggccaagguggggguauugcuugaggccaggagauugaaaccagacuggacaacacagugagaccccaucucuacaaaaaauucagaaaguuuaaaaauuagguggugcacaccucuagcuccagcuacucaggaggcugagguggaaggaucacuugagccuggguggucgaggcuucagugagccaugauugcaccacugcacuccagccuggaugacagagugagacugucucaaaaacaaaaacaaaaacaaacaaacaggaaaugugauagaaucaguggcaaucucuguguuucuguuauuaacauagccaaacugagccgccugcuaguuaucagaaacccaacaaggaacgacccauauuccugugacuucuuaaguaacuacuuaacuugcgcauuuaugauacucauaucaacuucaacucccggccuucuaacugguuuagcuacagccaaauaaaguacacauuuuuaaaagucuucagacgccugucucuccauuuacccauuggugccuuagguauaaacagugcugagugguggcacuggcuggcaacacccagaggcugaaagggaggacacuggaagcuggacgcaguggcucacgccuguaaucccagcacuuugggaggucaaggugggcagaucgcuugaggucaggaguucgagaccagccuggccaacauggccaaacccugucucuacuaaaaauacaaaaauuagcggggcaugguggcgcauaccuauaaucccagcuacuugggaagcugagguggaagaaucacuuaagccugggacgcagagauugccaugagccgagaucgcaccacugcacuccagccugggcgacagagcaagacucugccucaaaaaugaaggagagagagaaggcaccagguuccaaaagagagccgcaccaagugugugcacccagcccccaggagcccuccguaaauguguguuaaaugaaugugugugugaacaccaucagcugaggugguauagaaaaagcaacuccuggucagagcagggaggaacucaucuaaaggggaggcucccaagagcugcagcagagggucaccaaaggaggggaacuccaugugggauuccaacccugacugguuacauggaagugaacaggaccucgucgaagagggagaggucugcguugccuccaagcagugcuucuugaaaugguauccccccagcagccgccucaguaucaccugggaacuugcaggaaugcacauucuugccccacccuggacccgcugagccagacucucuaggguggggcccagacgucuguguuuugacucagaugacaucggugcaggcucgagagugagcuacucuuccagggacaaccagugugguccuuccacccaugcguguccagggaugaccagugggugcugguguucaggguggugugcggacauccauucauuuauugcauaauuauuaaaaaaaaaacaacacucgcugaguaucuacugugcccuaaaaaaugagaaagacuccgcuaauguguaggcagucaaccagcccuggucagcguacucacagguaggcagacggccgcgcggagagcaccaaggggcagaaggaugcugcuuggggguggggaagguggcgacgcaaugaaaacagaugaaggacaaggagaaaaaaaaucaagugcugccagacacuggcacaaagcuggaagggaggucacaucuaucgagggggaggagggcaacacaggaggagaagagacagggaaaccgccucuccggugccuuccacagaggguccauugcaagcaaguggagaaucagccacaugccauguacuacguggcagggguggcagcccgagcccugagaucggagagccuaucccaugugacgcaugucagccacacaucacccaggccugugaugaaggacaagcgcacgcuccgcucugaugacacgcgcagcuggcacggacccaggagggaucauggacgugaggagacgucaguguccaaagagggcccaucagcccagagaaaguugacacagaaucaugaaacauaaucuacuuaggggacagcucacucucagcaccaguacaaaauguagauuuuauccauuaauacuuccauaauuagcucaaaaaaauuggacuguguuuuuuauuuuuauuaauuuuuuuaagacagggucuuacucugucacccaggcugaagugcaauggcaugaucuuggcucacugcaaccucugccuccuggguucaaacgauccuccugccucagccucucuaguagcuggaauuacaggcaugcgccaccacgcccggcuaauuuuuguauuuuuaguagagaugggguuucaccauguuucccaagcugaucucaaaccccugaccucaggugauccgcccaccuaggccucccagagugcuggaauuacaggcgugagccaccacgcccagcccuccaaagcuucuucauucuccccuaaucaaggugcugcuccuucuucaaauccugccauccuaggagcucaccugaacccuauuccauucugauacugcgcccuacaucccaacaaguuaugucuuuuaccugcauucuauuaaugugaaauccacucuggcuuucuuggugagcguuucuacauuuaccugcaccccucaugaagcagggaguuuccucuuuuauggugagguuuuguuuuguauggagauucguuuguucuguaacaucuccuucuuuaagaacaaggaaggccgggcacgguggcucacgucugucaucccagcacuuugggaggcugaggcaggcagacugguugagaccaggaguucgagaccagccuggccaacacagcaaaacccugucucuauuaaaaauacaaaaaauuagccacaugugguggcacaugccuguaaucccagcuucuugggaggccgagacaugagaauuguuugaacccaagagguggaugcuguagugagcuaugaucacauugcugcacuccagccugggcaacagagcgagauuccaucucaaaaagauaaaaaaaaaaaaaaaaaaaagaagaacaacaacagcuaagaguuuggcagaguuuacucugcacaguucagggagggcacugagucugugggcauaaacacucagucccucgugggaugugcuggaucaaaucagauccuuugcucagauacuacaguccugaagcaauccuguuacuauuugcucggauacuacaguccugaagcaauccuguuacuauuugcucggauacuacaguccugaagcaauccuguuacuauuuauuuucuuucuuucucucucucucuuccuuccuuccuucuuucucuuuucuuuguuucucuuuguuucugucucucucgcucucucccucucuuucucccuuucuuucguuucuuucuuccuuucuucuucuuuuuuuuuguuuuuuugcgacagagucucacucugucacccaggcuggugugcagcagugugagcucaagcaaugcuccugccucaaccuccccaguagcugagacuacagguaugugccaccaugcccggcuaacuuguuacuauuaaugaggccucacagauaccuugaucucauggaggaacugccuugggaaguagauauuaauauuccagccacuggaaaaguacaucauauuccccaaaguaacuuaauacacuggcaccugcuuuauacaucggucucauggucagcaugaaucacaacuccuaaacucacacaguucugaagacugauggaaaugaagauucugguuuguuuuugucuuuguuuuagauagggucuugcugugcugcccaggcuggagugcagcagcaugaucucagcucacuguagccucaacuucccaggcucaagcgacccucccaccucagccuccagaguaguugggacuacaggcacgugccaccauucccaucuaguuuuugcauuuugcagcgacaggauuucaccaugugaaccaggcuggucuugaacuccugagcucaagcgaucugcccaccuuggccucccgaagugcugggaugacaggcaugggauuccaaaccaagauucuuaaucucaaaauuaugaacaagauccugaagcucggugaucaccucaggaucucugucccuccuaagaggcuguaacagcaccguccaccucaucccucuccgcuccacaaucuacaaaaucucuauguccaaucuuaucuugccaaucuacaacugucuuguacuacaauauacucuaauuguuaauguuggucugguagguucgcuuuucauaacagcuuuauauagagagaauucauauacuguguaauucucucguuuauaguuuauaauucagggagguuucgcacacagaguugugcaaccaucaccauagcccauucgagaacauuuucaucaccccgaaaggaaaccccauccauacccaucggcggucaccucccauuucccuucaguuuccccagcccuggccaucacuaaucuacuuuguguguauggauuugccuguaguucuagaguuccuagaaauggaaucauauaaaacguggcauuuggguuuuuguuuuguuuuguuuugagacagagauugcucugucacccaggcaaucucagcucacugcaaccuccaccuccugggcucaggugauccucccgccucagccucccgaggggcugggaccacaggugcaugccaccaugccuggcuaauuuuugaguugacaggauuuugacauguugcccaggcuggucucgaacuccugggcucaagcgaucgaaacguggccuuuguggucuggcuuuuuucacugggcauguuuucaguauucguccacguugucacauguaucagaacuccauuccuuuuuaaggcugaaucguaugcuauccuacagaggugcuacguuuuguugauguguuacuuguuuuguuuauguguucaucagcagacaggcauuugggcuguuuccacuuuuuggcaauuguggauaauguugcuaugaacauuccuauaaguuuuuguguggauguguguuuuucaccucuuaggcacaaacccaggaguggcauggcugggcccuacgguagcuccgugcuuaaccuuuuggggaccugccagacugucuucugcagcaagugaaccauuucacguucucaccagccguaaaggggaaagucugggaggcucccgagacaagaccaugguuucuucgugcucacaucuucaaccuccagcagguacuccaaaauuuuccaccagugccugcgugccaagguggcuuccaaagagagagcaaaucaagccuggccacaggggaccagggcacuucccagaacaguccucucccuggugggauccuuuuguucccuggaaaagccaaccccccuuaauccuggguaguuuuaccuacccacaggcuugaauuacauccuaacaaacaguaaaccacacuugcugggacuccgugggcccgagggcugcuuaacagcuuggcaggcauccccggcagccacugugacccagcugcccuacaggccauuccaagcucccccaacaagggcacuuuucaggugaacucauacaaaugugugccgagcgauaccccugacuuggaggggacuccagcugaggucagcccuggagcaggccccccacgcccuauggauacuuccaagcccaacuuagcaaauacagcuggaggcguccaaccucacccaguuguucaaggagggaccuugccccuuccuuugccuuuaaggaugaacagauuuuuuuucuacuuagaaacucaauguguuccucuucuauccuaaacacuacugauguucgguaaugcagacauguuuacaugcuauuucuuguuuuaacaacaugaaaacaaaauaaaaaugaacuaugaacugaugacaguguuugggaguugagcuuuuucuguggccaacgcugcuuuuaaaaacguucuauauuaaggaagugcugugggaacacugcuggccguggaaaccgucccaccucccugugcuccgaagccagccagcaggcagaguccuggcugggcacgagacgcucagggcucacucgaccccacggaaaccagagggaagccuaauuuuaucacgcuguauuuagacgguguggauucauuugaacaaggaaguuccuagaguuguugagauuuuuuuuuuuuggucaauguuuaaauacuacuuuuuuuucaagcuugcccuagauaccaacuguuuaucuaacacacaauuccaguguugccaagccucaugccaauuugaagggaacagccaaaacuuaugcauucauauaaaaagagucucuaggcucuuauaucuacauuauaauuuuuauccuaaucacaaaacuauuccgaaugguagugaacaaaguaauuauuucaaucaagaaacauaauggccagccacaucuaugaccaaauugaccuaagcuuucagauguuuuccaaaacaucggacugccacagguaacuuuuuacagggucuucauauaaguuccuauuuuauuauuuuauuuuauuuuauuauuuuuugagacagagucucacucugucacccaggcuggagcgcaguggcaugaccucggcucacugcaaccucugccuuccagguucaagcgauucuccugccucagccucccgaguagcugggauuauaagcacgcgccaugaugcgcagcugauuuuucuauuuuuaguagacacgggguuucacccuguuggccaggcuggucucgaacuccugaccucaagugauccuccugccucagccucccaaaguguugggauuacaggcgugagccacugcacccagcccaaguuccucauuuuaaaaguggcagagguuugucaaaaaguuaaacagaguuaccgcgugacccagcaacuccaugcccagguaugugccccaaagaacugagaaaacagauacucaaacaaaaacguguacacgaguguucccagcagcaccauccacaauagccaagaggcagaaacaacccuaauguccaucaauggaagaauggaaaaacaaaaugugguuuauccauacaauggaauuuuaugcacccauaacaaaaaggagguacuacuccaugccacaacaugaaugaaccuuggaaacaugcugagcgagagaauccagacacacaaagccacguauccuacgauuccaaguauaagaaacgcccagacucgguaaauccugcagaugcaaagugcagcacagcggcugccaggugcuagggcuugggagcugggaaguggcugcuuaguggguguaggguuuccuucuaggggugaugaaaacgcuucggaauuagacccaggggaugguugcacaacacugugaaugugcgauaugccacugaacuguucaccuuaaaaaucauuaaguuaugugaauuuagcuucaauuaaaaauaaagcaggcuggguacuguggcucacgccuguaaucccagcacuccgggaggccgaggcgggcagaucaucugaagccaggaguacaaggccagccuggccaacauggugaaacccugucucuacuaaaaauacaaaaaauuagacaggugugguggcgggugccuguaaucaccgguacuugggaggcugaggcacgagaauugccugaauccaggaaacggagguugcagugagcugagaucgugccacugcacuccggucuaggcaacagagcaagacccugucucaaaaaacaaacaaacaaaagaaccaaguaggaagaaauguggccaguuccuccugggcaguguuguacagaacacaccaaauuucuacagugacuccuaccagacguuucuugggaaaguaagcaaaguccuuuccugaaauucugguaaauuuucauaaaaaucaauacuucccuaauuuaacauucacauuuuagcuuacaguauaacuaguuauagaauuguucauuaauucuaauugacuuucgauuauacaaucuaauaucuaauuuccauuuucuauuucuaguacauaagcaaaagaaaugcccuuuuggucuuauggaaaacguguccuauuuaauaagacacaaauuugauucaaauuucucuuucuccuccucccccuuaauaauacacuaaaaauaacuguaauaacaucuuacacauccugaacgccuguaccuagcaaccucacuuacucagacuauagcugacaacuaaaaaccugcacaaaggcugacuccuuagcccuuuccaucaaacgauaucugcaggcugaacgagcuuaauuacuuguugguuugguuuuuuaauguaacgaaguaaaaaccaggagcaaaugugauacaggaaagcacaccaacagcuacauacauggauagcaaaagaagccaaaaaaauuauuuuuuaaaauguaagaacuggaaaaacagaaugaucucaguuuuuuuaaaaaagcaaagauuccuauuuuuauagagaaauugcuauauuaguaaaagccaaauaacaagaggcaaaaauaacugagucaucaagaaaauuaccucuuauuuggcacaguccauuuuuaugaaagugcuuuaucuauuucagaaacauaaaaucaaauguuugaauugguuaaaacagaaaauuaucugauugauuaaaagagaaaauccucugcucuucagaaaacucaaccauccagaaagugcuaucacugacauuuauaucuaacaacauggcaaaugagguugguuucauauucaaccauuugcuguccccgaagcucucuauuaaggaucuggcugaucagaaaacuuaauauuuaaucaaccuagagcaggccuagaaaagaggcuacuguuuaaaaacaaacaacugauuauauaaaacauuuacaucaaauuauaauucaguauuaaaucucauggaaucacgccuuucaggaaaacgucuggacacuagugaaaaugaaauggcuaaaucucaaucaaaguauauuauuaaguaauaaaagauuuuaucauucaacuuuuuuuuugucucuacauaaaaaaaguauuuuugucucuacaaaaaauacaaaaauuagucagucguguuggcaugcgccugcagucccagcuacucaggaggcugaagcuggagaauaucacuugagcccaggaggcggaggcugcaaugagcugagaucacgucacugcacuccagccugggcgacagagccagacgcugucucaaaauaauuaauuaauuaauuguuuaaaaaaucaaagaauagcuuaaaauuauuacuaagcuaagaaccuugcugcuauuacuuguucaggaaagcuccacacaccauaggcaguggugcuaaaugcaacagaagccuuagugcgaacuggaacuucucccaggagucuauggaauuggaaacuuaauagcuacuaaauacaguaacaucaugacuggagcuaugaaagcaaacauuuccauuugaacuucaaguggcagaagggacaaaguugauaccuuagacucaucagcccugaaaguguuccuaaucacaauuucuuucaggagccagaaagaacacagcguuaauuauguuaauccagcugagacguucacuaugaaauguguguuagagaaaaguccuuugaaauuucuuauuugcaugguaguucugaaaguuuuuaaccuccugcaguuccuggcacacggagucagucacucacuuguccucaggaagcacaggacagcagcagguucggaaucacacuuucucugugugauuucacaacucgggucuuuguccaggugagauucucacucgggucagagggcaaagguauccaaugacaacccuguccuucagaaccaaguaguguuuucccaucagccgugcaaaucacagcaaaugucauguggcuuuccagcagccucuuugcuguuuguugaggaaggauaagaaaaccauggaggauuaaaaucaccacauucaaauuacuauaaagaaaaggaggccaggcgcuguggcucacgcccguaauccuagcacuuugggaggccaaagugggacgaucgcucgaggccccgcaacacagcaagacccccaucucuaauaagaaaaaaaaaagggagaagaaagaaaaggaaaaaugcagacaagccagaaaauaaaauugaggagauuaauacaauauaauaaucaggcacugcagaucacaccuggaacaccgccucacccaggcaaaggaggaaaagcuuucaugugugcucaucauuugagcaaaaaggaagaaaacacacacagaaacucaggagauccagaagagacacucugaacaaagaaaauggaaaugacagggaaccaaaugauccacaucagggauuuuaagagggaaauuaugcuucugaaugaaaaaaauaaaaucauucaaaacuuuuuauaaaucuuugacaaaauccaagaguuuccuuucaauguugaugacauuuaauuuuuuuuuuuuuuuuuuugagacagucucugucaccuaggcuggagugcaauggcgcaaucucagcucacugcaaccucuacuuaccagguucaagcgauucuccugucucagccucugaguaacugggauuacaggugcgcaccaccaugcccggcuaauuuuuguauuuuuaguagagacaggguuucggacguuggccaggcugaucucgaacuccugaucucaggugauccacaugccucagccucccaaagugcugcgauuacaggcgugagccaccgcgcccagcccucuaauuucuaauuacaacaucuaagguagacacuuuccagaugcauuaaugugggggacaacuagaggacuaacacguccccuugcacacucaauauagggccaguagauccagaagcucaccgucaagagcaacaagagcaagcaaguccuuccucaacagaaucaucgguaagaacacugucaguccaggauucacucaguccuacgagugaaaaacuugccaacacagugaaauucauuuuacuggcaacuaaccuuccaaucucucucuaaaauaauguucacaugggaacugaagcacauuaaaaaaauaauaauuauucacuucacauuuucuccaagccauuucaaaaguguuucucagacuuucaaaaucaaacaggauucccagaccaggcaccaugggucacgccuguaaucacagcacuuuaggaggccaaggcagcuggauugcuugagcucaggaguucaagaccagccugggcaacaugaugaaaccccaucucuacaaaauacacaaaaauuagacgggcaugauguugcaugacuauagucccagcuacucgagaggcugaggcacaagacucacuugaacccaggaggcggaguuugcagugagcugagaucacgccacugcacucuacccugggugacagagcaagacucuaucucaaaaaaaaaaaaaaaaaaaaaaucaaaugggguuccucuaacgauacccugcuuuauucaggaaacgugauccucaggaaaccauguguaaauuauacuucuagaacucaaucuuacguauuuauauuuaaaggaaguaaagaaucuuuuaugaaguuacaaaucucacacacgcccugcaauuuaguggcucuauaaaucggagcuucccuaugcuaaaugugucuaaaugagaguucguaguugaaacaagaggacaaagaaaaaaacacuuuucaaauuaagaaugagcacuaugucccaaucacgugagaaucucagcuauacuuagacaaugguggagauuuuaagcauaucuaucucaaacuuuauauuuuaccaauaugaaaaaagcagaaccagagagauuaaauuauuugcccaaaagugcuuguuaguggaggaaauguauuaagaccaaaagcuaauuuacaaaaacaaauuaaauuuucaaauaagaucaugcuauaaaagugcuucccuuucagaaaccacccucaccacacccaguuuuuaggcagcucauucacacacacaaaaaucacauuaaugaacaucagaagcaguggccuuuccuuaugggaaaaagaacucauuuaugaaguuccagaaugcgaugcaauccacacuuuaaauaguaacacaauaggguacgaacuaacugaaucaacaugcaauaaacacuuucacuuaaagugucauagccuuaaugguauauugcauuuaauauccauacacaaggaaauaaaucacacgcaugugggguuucuuccuuucuccaggcuagaguguuagaaaauguaguuaauauuucccaaacaacucaaacacgaaaauaaaugauucaaaagcugcuuuuuccccgcuuuggaagggggaaaaaaaaaagaacagauuuuaauagcauuacauaaaaauccuggaaauuaugcacaaagacuacccuggagcuuugccagaaacaggcaugcugguuuuccauguguauaaaugguaaucaaauaagaauuaccaggagcuacaauauuauuaagauaaauauacuucuugaaaucuccaucuuacaaagcuuaaaaacaauugccagaacuaggccguucaaccccacauuuccugggccuccccuaagcacucaguccucuguguuucugcccugcgccccacgcccucagcgcagcaccucggagcccacagucccaagcuguccacacucuggcgccccugggcccauucacauucccaggcaccaugcgcuggucagcccucucggccaccaccuuugcuagagccuaucaagacccuccggagccucuauuuaaugaaccacucagucauuccagcaaagcgguuacugccuuuccucuaccuggaggcuuguucuguguagauguuuggggugugguuucacacauaacaggguacucacauguggaguuacauauauauauauauauauauauauauauauauauacacacacacacacuauauauauguauaaauacauauguacauauauauauauauauauauauauauuuuuuuuuuuuuuuuuuaagacagagucuugcucugucauccaggcuggagugcaggggcgcaaucucagcaaccuccaucuccuggguucaagagauucuccugccucagcuucccgaguagcugggauuacaggugcccaccaccaugcccagcugauuuuuguauuuuuaauagagauggcauuucuccacguuggccaggcuguucuugaacuccugaccucagcugaucugccugccuuggccucccaaagugcugggauuacaggcaugagccaccauaccaggcuuauauuuacuuauuuauucauucauuuaucagcaaauauuaucacacauauauuauaugccuggcuauauucccagcgcuaggaacacagcaggaaguaaaacauggaaaauuccugcucuuaagaugcauuccaguggcguggaaacagauuauaaacaaaauuaagucaaauacauaugaugcaagcuggaaaagagaguggcuggcccauagcuccaggaggcacuguugaaagcaaggcuccuacuaagggaauuccuggaguugggccuucuggaauguuccacagcgguccugagggaugggguuugcugggcugggggaggacuccucagucugcaaacaugucaucuacguuuugguuugggauuuuuuguuuuguuuuguuuuuguuuuugguuuuuuuuuuugagacagaaucucacucugucacccaggcuggaauguaguggugcaaucucagcaaccucugccucccggguucaagugauucuccugucucaauuucccgaguagcugggacuacaggugcacgccaccaagcccggcuaauuuuuguauuuuuaguagagaugggguuucaccauguuggccagguuggucucaaacucccgaccucaggugauccgcccgccucggccuuccaaagugcugggauuacaggcaugagccacugugucuggccuguaauauucauucauuuauucauucauucauucagccaauauuaucaggcauguauuauaugccuggcuauauucccagcacuaggaacacagcaggaaguaaaacauggaaaauuccugcucuuaagauacauuccaguggcguggaaacagauuauaaacaaaauaagucaaauacauaugaugcaagauggaaaagagaguggccggcccaucguuccaggaggcacuguugagagcaaggcuccuacuaagggauuuccuagaguugggccuucuagaacauuccgcagcuguccugggggauggaguuugcugcaggacuccucagucugcaaacaggucaucuacauuuugguuugggauuuuuuuuuauuguuuugguuuuguuuuguuuugcuuuguuuuguuuuuggagacagaguucucaccgugucacccaggcuggagugcaguggugugaucucagcucacugcaaccucugccucccagguugaaacaauucuccugccucaguuucccgaguagcugggauuacaggugugcgccacgacacccggcuaauuuuuguauuuccaguacagacaggguuuccccauguuggccaggcuggucucaaacuccugaccucaagugauccacccgccucagcuucccaaagugcugggauuacagacgugaaccaccacgcccggccuuuuuauuguuuuuuuaucacgauuuaccuacauucacagacaccugccccucaacaggcauuagugggaagauacagaaagaaauucuacauugcucucaauuguaggaaugcaaauuaaagcuuccaaggaacucgaagaugcacaaaccguuucuuggguggcauuauuuccucauagaaacaugcauauacuauucauuuucuuuucaaaaaagaugaggguaaacuuuagcucagucucucugaauaaacauaucagacaaacagaauuaaugagauuuuaauaccuauaauuucucaacucuuuaaaaagguuacuaaaaggguaugaaaguuaucaaagaccacugggguugcaugaagaggacucagcagccaacuuaaaggggcucccaugggccccaaaugggacaaucugagcaucaaaaaucauguaucuguaauggaaugaaauacaucaaauaagcuaaaauccaagaguuuauauugauucuugaaaaaaaucaccuuuggaggacguuaagaaaccaucucagcugggugccuuggcucacgccuguaaucccaacacuucgggaggccaaggcaggaggauggcuugagcccaggaguuugagaccagccuaggcaacauggcaagacccugucucucucaaaaauuugaaaaaaucagcugggcgugguggugcacaugugcagucacagggaggcugagguacgaggagcacuugacccugggagguugauauaguuuagcucuguguccccacccaaaucucaucuugaauuguaauccccaugugucgagggagggaccuggugggaggggacuagaucaugggggugguuucccccaugcuguucucgugagagugagggaguucucacgagaccugaugguuuaaaaguggcaguucccccuucgcaugcucucucucucacucucucucucuccugacaccauuuaagaugcgccuuguuucuccuucaucuucugccaugauuguaaguuuccugacgccuccccagccaugcagaacugugccaauuaaaccugcuuucuuuauaaauuacucagucucagguagcaucuuuuuuguuuguuuguuucugagauggggucucacucuguugcccaggcuggaguacaguggcgcgaucugggcucacugcaaccuccaccuucuagguuccagcgauucuccugccucagccucccaaguagcugaaauuagaggcguaugccaccacgccuggcuaauuuuuuguauuuuuaguagacacgggguuuugccaugucggacaggcuggucucgaacuccugagcucaagugauccgcccgccucagccuccgaaagugcugggauuacaggcgugagccaugcaccuggccucagguagcaacuuuauagcaguguuagaauggucugauacagguggaagcuacagugagccgagauuaugccacugcacuccaaccugggcaaaggagugagacucuugucucaaaaaaaaaaaaaaagaaaagaaaaaaacaaacucagucuguaaaugguauagaaagggaaagaaccaagcaaauaaaagcaucuaaacacacacggcucccaggauccuaggauuucacaguggcugagacagcaggauacgugagggcaggguacaugacagcaggguaaaugcagagagcuaaagacagguaucguuguuuuggcuguugcugccacugcuaagaaaauuauuccaacuuucaguaacacuagcucuucucuacugacagguauuaugugccaagaacuuuucuaagaacuuguauuuucucauuuaauccucgcagcaauucugugagauggguacuaguguuuucuaauacagccuuuggguuuaaauacuggcuccaccauuuaguaucccuuucuggcugugugaucaucacaaguuaccuaaccucucugugcuucagucuucucaucuauaaaauagagaucaucucaacccuaucuguaauacagucaggaagucuaguacaauauuuguucaggugauuuuuuuuuuuuuuuuugagacagagucuugcucugucacccaggcugaguacaguggugcaaucacagcucacugcagccucgaccaccugggcucaaacgauccucccaucucagucugccaaguagcuuggaauacaggcacaugccaccaugcacggcuaauuauuuauuauuuuuagagacagggucucacuauguugcccagacuggucucgagcuccuggacucaagcgauccuccuaccuuggccuuccaaagugcugggauuauagacaugaccacugcaccuggccuguacagauuauuugaucacugucuacuucccuuucuaggcgucaugccccaagagggcaggggccaccccucuaucuccagaaccuaguccucgccuugccaaugguaggaacccauucaauauuuaaugaauaaacaaaugaguuuacaguaggauacaguacaguugaaaaaaaccacucuaguucaaaccacggccaauagcuggaguugcacagcugaagaucugcuuauaauuccucaaccaucgaggggcccaucaucuuaagaaccuccaggcucuggggaacugaagcagccuaggaacgagccugcugaacccccgaggguuuucaguaaagaggcugccaaguucggcagcuagaguuuaaccagggcgagcuaucaguauuuuguauuuuggacacuugcccuuuuuauuacgagaaacugacacaaucacagucccuaguguguucuagguuucgguacugaacgacacaagaugugcgccagauugagcgcaggaagaaagaaacacccuuuagugcaauacgaaaugugacucagccagcggggagcguuaguuauugauggaauggcuguccaccaucgagucacuaugcaaauaagugcuuuucuugcauuaucccaguugauucucccaacgacccucugacagagacaccaucauuccuauaaauugcagcgccccuagguagcuugcccaaagucccacaguuaggaaaccauacaaccgagaauuaagcccgaauguaucagaaaucaaaauccaagcacccaaccauucaagggugagcccuuccaaaaaaaauuuacagaaacaaaguugaugguuguuucuuuguuuguuuguuuguuuuugagauggaguuucgcucuuguugcccaggcuagagagcaguggcaugaucucagcucaccgcaaccuccgccuccuggauucaagcaauucuccuaccucagccgcccgaguagcugggaccacaggcaugugccaccaugccuggcuaauuuuguguuuuuaguagagacgggguuucuccauguuggucaggcuggucucgaacucccgaccucaggugauccgcccgccucggccucccaaaguacugggauuacaggcgugacucacugcgcccagccauguguuuguuuuuugaggcagagucucgcucugucgcccaggcuggaaugcaguggugccaucucggcucacugcagccuccgccucccagguucaagugauucuccugccucaaccuccugaguagcugggauuacaggugcccaccaccacgccuggcuaauuauaguauuuuuaggagagacggagcuucaccguguuggccaggcuggucuccaacucuugaccucaggugauccacccaccucggccucccaaagcgcugguauuacaggcacgagccauggccagcucgaaguugauggucuuuaucacacacuuugaacaugagcaacaaagauuuaccagaaucacaaaagauuuuuaaggauuuuguaagaaaaggucaauguaugaacuaaggucacuugcuauuuccacaggcaauauguaaugggugugacaacuccaauuggcguuguuucacacacaugagaaugcguguuuggguggcacauacaaaacccucagucuucccaucuugcagcccagcuagcgaagcaguacucaaagugugauccgcagaucccuagagguccuugaggccuuugcaaggcaucuguggagucuaaacuauuugcacaaugacacuaagacagcauuugccuucuucaguguugacacuugcagugacagugcagaagaagccaugggugaaacugcuagugccugagcaggucccgaugcagggaaaccaaacugcacuagcccucagcuuguccuucacuaccccacacuuacgaaaggaaaggcagacagcuucacuuaagaaugucccugaugggccgggcauaguggcucacgccuguaaucccagcauuuugugaggccgagguagggagaucaccugaggucaggaguucaagaccagccuggccaauauggcgaaaccccgucucuaccauaaagacaaaaauuagccgggcgugguggcacacaucuguaaaucccagcuacuugggaggcugaggcaggagaaucacuugaacccaggaggcggagguugcagugagccaagaucacaccacugcacuccagcccgggcgacagagcgagacucugucacaaaaacagaaaaaagaaaaaaaagaaugucccagaugaagcugucaacaugaaugauugguuaaaucgcaagcuugaguaggugucuucugaauagucugagugaugaaaugagaagcacgccuacgacgacgcugcugcccaucaaagcacagcgguccuggagaaaagcagcugugcagcuguuuggauugcaagcugaacuggccaccuuuuugguagcacauuauuuacacgugaccuacagacaaaccacggucguucaggcuugaguacgggcagaccauuccugggaauaugaaugagucugucgcuucaaggaaaauaacugacaguauuugccgccaaugauaaaaaauuccaguuuucaaguagaguuuuggaaaacuuacaucagccacugugaugaacucaacaucuucagacuauuagacuuuacugacgucaacauguggaagagcugcaucauucaagagaccaauauuuuccaaaugacuagugcaugacguuauaaaaucacaccuggguaaaaacccaacagcauuuaauauaauaguguacaaaaaaagauaauaaaauuucagauuccauauugcaacuaacauuuaagaaacuaccacucaaaauaaaaaaucagcggggugugguggugcaugccuguagucccagcuacuugguaggccaaggcagaaggaucacuugagcccaggaggucaaggcuggagugagcuaugguagcaccacugcacuccagccugggugacagaguaggaccccaucucagaaaaagaaaaagaaacuacuacucacuuguugaauguuucuacagaaucaaagaaaaauauccagaaucacauaaaaaggcuaugaaaaugcucuuccaacuaaagccagauuuucuacacauuuuucaacauauugcaacaaauugaaugccaaagcgguuaagaaaauucagcgaacacacuuaaaaguguuuuaacacgguagauuucuguuguguacauuuuaucacucaaaaaaccucagccgugggucgggcgcaguggcuaacaugcugaaacccuguuucuacuaaaaauacaaaaaauuagccgggugugguggugcgugccuguaaucccagcuacucgagaggcugaggcaggagaaucgcuugaacccaggaggcagagguugcaguaagccgagaucgugccacugcacuccaaugugggcaacaagagggaaaaaaauccaccaaaaaaaaaacaaaaaacuucaaccguuuauuaauccagacauuaaagagauuugcaaaaauguauggcagugccacccuucucaucaaauuuuuucauuuuacaaaauauaguuacuuuuauaaaaauguuacuuacauuaacaugcaaugggugaaaugaauuacuauuuugaaauaaauuuagaaaagauuuuuaagcuucucaguuuguuucaauuucuaauacuguaaauaucaauagacaaccuauauaaauaaugcacauaagccugggaaacauagggagacgucaucucuacaaauaauuuuuaaaauuaggccgggcaugguggcucacaccuauaaucccagcacuuugagaggcugaggcgggcagaucacuugaggccaagauuuugacaccagccuggccaacauggucaaacaccauuucuacuaaaaauacaaaaaaaaaaaaauuggccgggcaugguggcaugcaucuguaaucccagccacacgggagacugagacacgagaauuccuugcacccaggaggcagagguugcaguaaguuaagaucacaccacugcucuccagccugggcaagagugagacuccgucucaaaaaaaaaaaaaaaaaaaaauuaguuggaugugguggcaugcgccuguguccuagcuacugaagaggcugacauggaaggaucaucugagugcaggaggucgaggcugcagugaacugugacugcacacuguacuccagccugggcaacagaggaagacccugucucaaaaagaaaagaaaaaaaaccuacagaaacaacaauuucuacuggauuagaggaaggcauauaagcuaggugcagcuaucccugacugucggggcccagcauuucacccuguuucccagcuucugcccucuaggucacacuacugccaccacuacugcuacaacucauucugccuccacugccaccagcagccucuagcggguuugauguucccaccuaucccagaacauugagccuucccacuuaacuccgcagaaaggaugccaggaauuuuuuacaagugcaaugcuagcaaaggcuggggaaaaugagacaaaaaaccugauuuccaagagcagacaaguuuuacaaggggcagucuucuucgcugaaguugacuaaaauuuagccacggguuggcuuggcuggugugguucacuggguacauccacaagacuacaagaauaucacugcugucugcagucuucccaggggaggaccacccuacccuuggcccacaccacggauggcggccccacauccacccucugaugcagcccagucccuucccuucuguuccgcggcagcaccggugccuggccacuucccuugccaguucccuuccuguuucaaaaacucucaucucuucacaaaauucccuccagggaugcuaguuccuguuggaaaaggucuugaggugugucacaggcaaaguacaaaugauaugcccagggccagauggaugacaggccccuaagcucagcuaguccagagucaggaggggaccugcagaauucuaauggugaaugauuacacucuuacaguuuuggaauuccagcaaaaacaccaauacuaaaaucaccaaccaagacaaagacgagacuuacggcccacgcaggcuucugcacacucugugcccagacauggacagauuaauguggguugguugguugguuuuuuuccaagauuacuauuccacagcaaaguacauaggcaacgcugaccaauaugcagaaacauaauuacuaucucaccaagcuggccagaagacaaaaaucuugaaacuucuugacuugcucuaauuguuccuucuccauguuucccuuccuuaggcauucuaccugaaaagacagcccucccuuccuucuucaucccauuggcaauucagcaaaccuuaaccuucucuugcuuuaccagagguuacuucuacucgaaagcuugucuucagaauuaacagcuguguccuugucacuguaagccaggucucaaagagccugaacaaauggucacugggggcagcuugagugucgacucuacugcuguuuucugucucccaccccagcuguggaggggaacugugugccucaucucaucucugccauuugcuaucugagaggcuguauuuccacgugcauaacagauccugcucaagaaugcaggucaaggcugggcgugguggcucacgccuguaaucccagcccuuugggaggcugaggcugguggaucaccugaggucaggaguucaagaccggccuggccuacauggugaaaccccaucucuacuaaaaauacaaaaauuagccgggcgugguggcgcacaccuguaaucccagcuauuugggaggcugaggcaggagaaccgcuugaaccugggaggcagagguugcaguaagcugagaucacgccauggcauuccagccugggugacacagccagacucugucucaaaaaaaaaaaaaaaaaaaaaaaaaaaagaaugcagugcaggucaacacagaauuuccaagcaaggagacugagcucugcuaacggguuagcaucccaguggcaaggguugcaggcuuagguggggacaagcuaacgggggaaggaaggggaacaccugagcaugcaacugaaccccaaaccaacaccuggcuaggguucugucagcuggcaggcccgugcucaggguuaauggggcgcccagauuuccggcaugagacagguguuuguuugcagaggcuaacgcauacagaaugccuccguccacugucggucugucggcccaccagacagggucuacauaggaacuccucuaaggcaaaggucucgaucacagagguggccaacaggugacaaucugcccaaaugcauaccagcgggucuccuccccaaguugcuccacaagcauaaaguuuggcuggggaaaaaagcuuuuuuaauuucugcaucugacaaugugaucacucccugguauuccccucuucagagauaugaccauggguguggaugagagcggaggagcaucuucauucugucuuccuaauauuuacacgggaaaagaagaugccuguagauauuuucuaacaguuucauuuucugucuuugugacccuguaucuaugacaggaaaagccaacagcucgagauaacacgucucaccauuuuuugcuuguggcccaaggcagaauacaacagccacgguucccucaggccuagcgguuucaucccaaaugcuguggaaggucccucaccuuaaucagaccguuucuucauuuuuuuuuuuuuuuuuuuuuuuuuuuuuuggcgacaaagucucgcccuaucgcccaggcuggagugcaauggcacgaucucggcucacugcaaacuccaccuccuggguucgaacgauucuccugccucagcuucccaaguggcugggacuaaaggcgccugcgaccacacccagccaauuuuugcauuuucaguagagacaggguuucaccauguuggucaggcuggucucaaacuccugaccuccugaucugcccaccucggucucccaaagugcugggauuacaggcaugagccaccacgcccggcccauuucuccauaucuuuaauaacugucccucacacuuuuuuuuuuuuuuuugagacagggucucauucuugucgcccaggcuggagugcaauggugcaaucuuggcucacugcaaccuccgucucccagguucaagcaauucuccugccucagcaucccgaguagcugggauuacagguaccugccaccacaccugguuaauuuuuguauuuuuaguaaauaugggguuucaccacguuggccaggcuggucucaaacuccugaccucaggugauccgccuaccucggccucccaaaguguugagauuacaggcaugagccaccaugccuggccccucacuuuuuagauuauuuccaaaauccuagcaguaugcuaaaaauuccugcaaccuucucccagugacuggccacccuagauaagauuucucacacucguacaccccaucugcuguauccccuuccugcuuuauguuuguucacaaaacacuuuuucuauuuuacuuauuuaugguuugacuccccuguuguccccucuauuagaucuccccuauuugaaggccugguuuuuguuucuuagagacagggucucacucugucgcccaggcuggaaugcaguggugcaaucacggcucucugcaaccucgaccucgugggcuccagcgauccuccuauauuauugacuuaaaaauucuuguccccuauuacaagagcaggaauuguugucuguuuuguuuacggcuguauugccagaacccagaaccgugccuggcacggaguaaaugauuugcugaaugaguaagcaagccagggguuccgggccucuguacucugcaaguccauccugcauucuccauucauaccauagcaacuucaaaggccccucacccauuccugacuccacauugucgccaagucacuuccagaaacuuaaaaugccauuucccauucacauggucaagcccuuccccuccugccagucguuuguuuaaaucuggcuugcagucccaucaagcugcucuuccuaaugccacucagaucccaucaccuccaucacugcuacuguaacuuuggauugggccaccaucaccccuaccugggauuuacucgacaccucauuaaucucuuuccaacccacacucacuagcucugaaagagugaacuuucuaaaacugcaagucagaucaccuaagcccccuguugagugguucccugacaccuauggggucaaaugcaaacuccuucccacgcuacccauggccuuccuuguccugaugaacaacuaacaaucguccgcccccacagagaagcacagggcccagccauacccaccucuccgcucugcccuggugcucuucuguccaccuggagagccacagccugaucucaggacccagcuccagcaggagcccccucuaaagcgcuccccacucccgaacauacuccacaacauuuuuaacugugagcucacggagguugggaacuauuaacgcaggucagacgcgccccaaaguggggccgagcccaagaggguucuuggcuuugcccaggaaauaauucaagggugagccgguggcaggaaagaaaacaccuuuauugaagaggcaggcaguguuauacggcuccaugacugcuccugcagagcugggcuuucccaaaggcggaaaguagcagcucagggcaguuuugcaaucauacuuauaccuacuuuuuuuuuuuuuuuuuuuuuuuuuugagacgcagucucgccuaggcugucgcccaggcuggagugcaguggacaugaucacagcucacugcaaccuccaccuccuggguucaagcgauucuucugccucagccucccgagcaccugggauuacaggcgcacaccaccacaccaggcuaauuuuuguauuuuuaguagagacgggguuucacuauauuggccacacuggucuccaacucaugaccacaggugauccacccgccuuggccucccaaagugcugggauuacaggcaugagccacugcgcccagccuuaccuuauaccuacuuuuaauuuccuguagaguaaagguaggcuuaggcagacacuucuaggaaaagggugguggcuuuuggguugucaggucacggccauggaaagaggcaguaacuccggguguggccauggcgacaguaaacuaacaaggcacacuggugggcgugccuugcagaacgcugcuucugccccaucccuguaucagcuaguccucaauucggucuggcaucugaaccccgccucuggagucgagucccaccuccuaccucacgaucacggauccugcuccacgaucacggauccugcuccacauccacagugccaggugcacagucagugccaggggcacgacacagauuucagagugaaggaaugugcagaaaucaugaaacuacccuucugcaaagccuguucggauaaauuugaaugagaggagcuuccuucugugcucccaggcuaguucuagaagccccuucucauucuauggaugcccauuccugcagggccgcuacuggcugcuuuuuaacccugggaucagaaaaggggguaagagggaaaggcuaauacacccaguauugggguuuuuuuuguuuuuguuguuguuguuuuuuaagacagaguugcucugucgcccaggcuggugugcaguggcgcagccucggcucacuacaaccuucucuucccggguucaaacaauucuccugccucagccucccguaauacccaauauuguauagagaaaacaucugccaccagcccaaaggcagaggcuaaaaucgaucuuacauguagauaagcuuaacuaugugugugaaagggucuucuacaaacugugcugucaucucaauuuagcuuuguaaggacaguuuccaaaagggccaggaaguuguguagacauacucuauuccuggaguccuauccacaaagguuuguaaaaugagcucaagaaaacaaaaucguggucucagagaaagagcuaaaggaaagaauaucacuuuuaaaaaaucagcagcuaagcuaagccuucuaucuucccuacucccuacaguacuaaaacuuuuauaaauauacaauguacacaaaugucaagaaaaguuaauuuaccaaauuuacacuauuugagguuuaaaaaaaaaaaaacacaaacucacucuagcauuuuuuuuuuuuggcucugugucugagaccccugaucuacaaacuuaaaaauaaaacuacucauaaauucacaaaauagguauucaaugacuuggcaauuuccaaacauauuuaauaauuacacccucuucauuuuugaaauucgaguaauacagcauacaaaguacagcuuacaaaacguucucauuguccucugggccaacauauuuaauuuaacguacugccgcccagcuccaccgucccacagucuccaaggacagagcucacaacaccugggcccuaaaaaugccaagguggcaagcaggggguuacacccacagccccguccacugacaccuucagacucaagagcgagugccaccgcccuaaacggaaagacacucaucacggcagcaucuuucaagugaacagaaaguguaguuucugaccuuguuaacauaguccuuaaagugcucuagguuaggggaauucucgggugaaaauaguuuucgucuacauccauaaaaucuucaacagcaaaguuaguaaaauaaagaaaaaucagaagaaagaugauguucccuugccagagaacaaauacauaaaagauacaggagcucagaucacaagccagagaaagagaaugccaacuggacacauaggaugaucucacaccaacgaccuaugcaggcccuaccucaaccacuggacgucucugacugacacuauuacuucugccgucucugauugaaacuauuacuucugccaucucugauuggaacuauuaauuacuucuuccgaggauucccuuuccugaggcuuuuaacuguuuaaguaugcaguguguggggaccacaaaauacaauacagcuucacaaaagcaggcuuuuaaaaaaaaucaguguuauuuucucuacauacuuccacaacagauguuccccucaauccugaagauuuuaguaaaacauaaggacuguuuaaaaaggaggaagugggggaagaaauguagcagauuacuuaaaaucuuucuuuuucguccuacuuauuuuaauaucauuuuccagaucucaaagacuuuuguccuauauuagaaaaaacaagcagcccaguaaaaacaucaagaauagcaguaaggagcuucaaaccagggaccaggcaccagauccaaaccugagaggaugagggaggggaauaccagcucuccggcagguacguuucucccuuccaaaucaccugguggcuggagaagcucaauaugaagcucuucacuuaaggcaaauacuaugauaauaaaauauccuuaaacaaaugauggcugaaagcugaaaaugcaaacuuuuuuuaaaaaaaaaaaaagaccuagauaaaagacaguguguacucagagguaaguaacuccgucuaauucuccagagaccugcaggacugcgccgacuuccuaucccuauuuugaggauaagcaaagugaggccuagagaggagaaagauuuuauucuccacguuuucgcaaaaagggcagagagaaacauuuggaugggacuucagggugaccaaaugaaugcaaaggcaauuuccuuaagugcuaaacagugcugaaugcugaagggcuccauacccuuacauucaccggacgugcccccacauuucagccaaccagugguuaugcacguucaaaguucuccuuccuucuaaaggucgcgucuaggucaucucugcacagcgucccuuucugcagugugaacagaucugugauauuugacccgcugaaagaaaagucacacugacccugagauccccccaugguaaggcauucugagauaccugagcugucugcagacacugaggcuggaagcuuuuuuuuuuaauuuaauacaaucaggaucagggaggggggaugccgagguaaagcagugcacauaccuuucaacuggucagcaaccacgcucuggcccagccguucaauaacuuucccaucuuccauuucguaccggucaucuaaguauuuugcgguggccucagaaaugugaacuuugccggccacucccagcugcuccaugagauuggccagguucacaucguuggaccacacgucaaauuuaaaccuccucaugcccaggaugccgcaaaggacggugcccgugugcaccccgacucucauguucaccaucuccuucuucuccuggcagaacugcucgauggccuugaucaugcccaggcccaucucgaugcagcaguaggcauggucggcccggggcucgggacagcccgccacgcaguaguaacagucucccagggugcugauuuucucacacuuggucuccucacacaggcggucgaagcgaccgaacagaucguucaggagacccaccagggcgugggcagacuuguuggcacucaucuuggugaagcccacgauaucugcaaauaaaauacugacuucuucgaucugcugcaucuuaaaagggcggaaggcuauaggagcuuuuuggauggaagacuuuuucuuccuguucuuggggcucgagguggcaugccucuugacagaauucucacucuccucaucucccugcuucauuaagucaucggcuaugauucuuggcaucacggaaugaaucauccucucuuugagggcuuuuuccacuuccagguccuucccgugcauaauggauugccccaccuugaggaaggugcuccuggaccucaccugggacaugacgaacagguggaccccgauggcguggaugcagccguggagcagcccccugcucagcagcucccagugcagggccccggcuccgggcgaggggaagcaggcuucaucccggaaaugguagccaaaggucucgaaaaggacagaguaggccacccccagacacaaacucagguacaaagguaagugcaugacgguauagagcaaaaagagcacuucgaugcacauggagaagcuccccacuugagauaagcaaguaucugugggccgggcuguggccguaagguuggagcugucgccgcguccugagacaggcgucaagaccuggaacugcgcagccagggucagggcgaacaccagcagggugagagccagcgagguccacgcguaaugccgggcguacagcuuggugaagguaaacagaaagaagcccacacacaccaggaggaagcacagcgcgggggcgaccaugacgaucagucuggaucucauguggaccgcaaaauagaugcuccacagaaggcaggcgaagccgauguagaagagcgcauaccggaaccggcgcugggucugcgggaagcagcgcuccaggcaggccuccuccagguucaccgagucgaacuuggggucccaccagcggcuggaggcccucucgaacagcuggggcagcuucuucugccugcgcagccggccuccgccgcccacucgccgggggacgcccccggaguccccagagcugcugcagcuagaggagaugcuguauuugcagugcuugggguggcuguuggaggacagcugcuugggguugaucuugacgcgcacgcuguugcuguccccgcuggagucgcagcucaccucggugcuguggugaugcagcagcugcuggugggguggggaagccauguugucgagucccggggccugccccggccggggucaccaguaccugccagcaaaacggggagaguuagcggcgcucccaccuaggcaugcacgccuagaggcccgggaccugcuccuguccuaaggggcggcuccagcacgcgaccuggacaggcaccaucuguuccugugguucccggcucagcggugcucccaccgcccccaccgcccccaccuucgaggcgcacgagaaccgcucgggacggaccuagaacgcccggggguccccgccgcguggccgccguggcuccgggaccgcuuugcucgcucgccuuccgcgccucucgccccgaggguggccuccgcgccgcgcggcuucuccuccucgcgcgcucgccuccuccagcugcggcuccggagggaaguucagaccuugagcgcucccagccccgcgagccgccugcgcacaaacaacuccgcuggcggcgcggagcccuccauccugcaggagccgcgcuccgaugcgucaaaggcggcgcgcggccggccccgggcccggaccccgacccggagcagcgagcuucggcgggcgcccccggcucgcgcuccccggccgccccccgcgcuccgggccggcccugcccgcggcggcgggcgcugggggugggggcgccccgggcugcgagugcgcggagcccgucggcgcggcccgucuaguggggccugcuuccccccgagugcgccgccgcucccgccgcggccgc

SEQ ID NO: 192596 - RNA, 11681 nt, Homo sapiens
gacuccggagcccgagcccggggcggguggacgcggacucgaacgcaguugcuucgggacccaggacccccucgggcccgacccgccaggaaagacugaggccgcggccugccccgcccggcucccugcgccgccgccgccucccggugaguuucuguggggcuggggggcugcgggcggggaagggggcgccacggccaggcugugcacacgcgcggggaccgccgccgcgcgcacacacgcacucucgggcgggaccgcggccccagccccacacggucaccugggccgcccggcgggcaggcccuguacgcucccucccccgccguccuggggcgccgacagccccgcggccggccagggugcgcgccugagugugcggugagcccgcgaggcugcaagcagacaaaauaaacaccccgucccaugcuuccuccucccacggcugggccuccggcaugaccaguuuuaugaaucaaaccccuuugagggggauagccaagccacaggcuugggucacuuuucccuccugggguccggcaguaggugcugcugugcagaagggcugcccgggguccucuggacccuugucacucaaagcacagcugggggcuacagauaugcagcccuagggaggggcggggaguggcuggugggcguccgaugcccaucccuccaggugggggauggaccuguacuggccagggcccuuagagcuucggguaucaggcagggugccgggucucugccucugccagggaaggggcuuugcuugggcugcaaacccaguggccuggagccagccuaguccuuugugucccugggcuggcagugcuggggccugaggacugcugagguccccuguggucacuggcaggccagccgauuggugccaaccauucugccucucccccauucguuaacgauugccacaccagggucacugaccgccuccccugcuguggcccagggguggagugugcaggguggaaggaagagguccugggggucuagguguccccaugccugccuuuugcaccaaggacaggugaggcucuggagagaggcagcgggaccuagagcccccuuccccaggcugagagccuccagggcuggggauuggauaaaaucuccaaggucccuucacacuagacuguacuuuggguguugagggcauagagggguggccgggcugggaccuuccaagcaggguccauuagggccaguccagggggcagcaaaguccaggaugggcccagcuauugacaaaaacccaacagagcuggggcaggcgggugggggauggggagcaguccccugaguuuacucucuucucccaggggaguuggccuggagcuucuguaaacagagugucagaggcaggaagaggcucuggugaugagcagcccagcuggauccccuccagaccauuaucuagccuccccugggccuggggagggaggaugcgcacacacaugccagccugggggccgggcacugccuguccccaccccgccccugucuccugcacguuggaacagcuguccugcuaccuguggguccggagggucagauggggauggggcugggggcuggggucccagggcauuuguccagauggcaccucucucuccauauucugggaaugggagaaugggauucagcauaaggagccucucagacacugcccagaccugugcuuacccgaggaaggccccucuggcacgcagcccaggggccagggagauggcaagggagaugccccgggcaggagauggguccgcggcuccuagcucccauuacugucacccccacugacagccccgggggagcugggacaagucccaaguacagaaaauuaaguccuugccugggcuuauaagugggucccaacacaacacugggcagccucugggaacaagaaagcagggcccugcugagcccaggagggagcucccaccucagcaggccagacagccaguccugccagugagcagagguguguagaggggaggcugcccacagggauggcuaucccugaccacuggccagcccugagcucaugggagggcagcaaggccaccuaacucuguuagugaccucuccuggaccccccaucagcugcccuuagaguccccucccugggcuggggagcccaaggcucugugcugccaagaaaaccagcuccccucacugcuguggaauuugcgugaguucuuggagaagggggagggugcacgugugugugugugugugugucugcaggagcacugcccagugggcgugugucuggcgugggcgugucugugugcgcgugacuggagcagggcuguguauuuggggguggguggggguguuugggggagccugcuugcaccaggaggggcagggccucagccuccuuccuuuuaucgguuuccacauuccagagucagccggaucgcuuucccuccgcgcugggccgccggccucccccgcuuuuccucauuccagccucccugggugugaggaggcuggaggaggcucccucaggccaccucgguuuugggcagggggugggggcaggcgaggggccaguuauucuucaggguucgggacggcccccaccagacucuucguggggaaugcaauaagguucugacauuccucaggggcugccugagagauuuaauuaaggagggaggagggagccggccuacaccgggaaggggcuggggcggccgcuggggccccugcuggcccugggccccgagcccggcugggcauugagagcagugcgggggcaggguugugguucaguggccagguccuguucugccucccugaauccaucccgccugcccauugaucagcucacagaccccaggggcgccauuucugccacggguuggccaagaacccugggugauugugggggguucggcauggggagcuugagaagggcaagaccccuuccagggccacuuccuucucagacccccaggcccaggaagcuuagggcuggcggccuuccuuggugacuaagguguucuucuggcaaguucaggguuaauugcagguuagggccuuacuagaugggugcuugccccuggguggggacagggcagugaggaggccccgugugagggcccagcccugguggcaucacaccugccgcgugccgaaaguggcaucuggacuggcccauuucuaguugggcugcagccacugcacagcucccagggccacagguguccucccugacagguugcaccucuugugacuacgauggcacgucccaccgccccaggggcucacuugagcuggggccuggccuuagucacuggucucccugcccugggcuaacaggucuggcagcugccaagucacccacggugcuacugaaggcacccaccuggggccgggccagccuccuggguggagggaggagggaagacccugugccugccccucucccagcccugccagcugguccacaccugcuccaggauacagagccuccucccugcacaggaagacgagcugacauccugacuguccccuuugcaacccucuguccugguguucugaacccuggcugugcggaggacucgcucaaggagcuucuccaaaauacagcucugccugggucucacuccuagacauucuuuuuguuuuugagauggaguauugcucugucacccaggcuggagugcaguggcgcaauauuggcucacugcaagcuccgccucccagguucacaccauucuccugccucagccucccaaguagcugggacuacaggcgccugccaccaggccuggcuaauuuuuuuguauuuuuaguagagacgggguuucaccauguuagccaggauggucucgaucuccugaccucgugaucguccuaccucggccucccaaaguacugggauuacaggcgugagccaccaugcccggcagaauuucuuguuuaauuggccuggggguggggccccagcauggagguuuuuuuuagaaagcuuccuggaugauucugaugugcagcccggcgggcaaagcccuggcgucacaggugggagacggaagcccagagaggggagcuugcuuggaugaggucacaaagcgugugagugccugacugagcuccuggcuguggcauuaucuguggaaugaagagcgccagcuuggggugguggauggaguaagaaagaggcugacacccauggggacccccgcucaaucaccagccagggguccccgcgccuauagggagggucuaccugccgcagucccugaggaacucgaggcccagcccucucugccccuucugugagggcccacgaccccugaccucucugcccugcccuugggacugcugugucccaaggaaggggagacggggcggacccagccgggcccugagccuccucggacacgucagcgaaacuggagccagccguccuggccgccggcacagucccgccugccuggagggguuggcagacucccggggcugggcugcugccaggccugaccggccacacagagccuuggcgggccagcaugaggagcgggggcccggagucucagggucagaccugcagcgccuguccugcacccacgcugaagcauacggcacaggaggggcguacuggccucagacugucuaucugucuguccaagccuguccccuacucagcaggcacaccgccugccccagaaucagugagauguucucgccaggggcugauguggucaccagaugccugggucccaccccagccaugcuauccccuggcccguccccgccugacccugggcgugugugguguaccccagaggugggugggcgucccccugggaguugagaugacgagugccuuguccuccuuacucauagggccccucccugaaguccugugcugaaggggccgccaagggacagcucacccaccacgugcccccuuccagaaccagagauaccccacccccgcuccccagcccccagggugaagggcagccuugguguggggaugucugaucuguguaaagcuggccugaaacccucucccuuaguaguacccacgcccagggggcaggcagaguucugcguuuaugagugacgcccuccgcagugaauguuuaccgaccacuuggcaagugcuccgagcacagaccaagucaccccagacacaggcaccacgagcaccacgagcagcgcccacugcacaaugggggcugagguaggggucguggccgggcuguggacccugucgcccuaugccaguuacugugccagggagggagcaaggccggcagcagcacucagcaaggcugaggaacuuggguggaggacggaggccccagacccuugcgucaucuucccaccccccgacguccccgaaucccaggaaucccagggcugccuccggaacaccuccugcaccaggcagaggaaaaggucucaccucccugccugacuagugaucaaauaucaaagcccagguccugggaucaccgggugggagggugggugggcggcggcaaccaccgugugaccuguagacagcccccagccccacgcacacaccaagcacacgcccagaccccaggcgggcgggacagcucccagaacuuguuaaaagaacuuccccauuugaaaacaaacagaacaacagaaaacuacaacuccagagggugagggggcagggcugcuugcaccaacuccagaggugagaaacugaggcccacaguugagaaaggaacucuggccucuguccccugccaccguccccuccacagucagccuucccucgcuggguuccucucggggcuggcugauggguucucagugccaggagucccuggcggugcccucagagcugccagccuguagcuuacaaacucugggguuuuccaaagcuccagcgcugccuccucccuccucccuuugauguggggguagaauuggggcucaggcaaaagagcucaccgcacauuuuacggggcugggaagcaggcuggcugccgccugcuggauggucagcccaggaccccagcccacaguccugaccuagaccccuguccugcuaacaggaacgcacauuccacagcucacuaccugucagccggaaagccacccuguggccagauggacccacagcauccccucucccuucacaaccuugcugauuaaagacccaacagauuacggagcccagagcuauggcuggucccccuccccagugcagggugaagagcaccccccagcacgugccccuaagagcuggccugcacaccuggccuugcagggcugaggacuccacaugcaucccccacugcagcccugaagugucccagauacucagaugaagaaaccgaggugugagagcaaagucacugucugcggccucacagcuuggacaccucugagcacagggccgccugccuggagugagcgcucuuaacugugaccuuaaacgaggcccaaggggagcugcggccacagugguggccaggcuggccaggcuggccacguggaggauccccucccacucuggaaccuggcugcauccuuccugacccuggucuggcccugcugggagggcuaauucaggcagagguggccucaccccccauauggacauggggugggugggggucacucacagcccacaucuggaggccaggccgcacccgccguccucugagucagugaggguggagcgggucccaugggggaagagaaggcuagggguguggccccagggccuuaggucaucagacacgagccccccuggggugggcuggccgggccagggacgcgugccugggguuuggggugcuaacuucuuccagugcucagugccaggcccuccugggcuguucacucagcagaccugagcuaagugggccuggagacaccuauggcaaaggcaggcugggucucaccuuagggaggugagggggcacacgacagcaagggggacaccgcuagguuggggaggcuuagccugcuggccucugaagggugcuuguugucgcuaacuggcuaggggcucagggucgguagcuccuaggggagacgacucuggcagugcgauacuacacgugggcagggccugcgugggcccaaccccggggacaagggcuucuuccuucaccucgagcuacccgcagaccccaguggucaccucaccagugacuugucuaaucuguccugggaccaccugcuccuccucacauuccaggaacccacguaccugggggagagggagcccuauggacggguccccccagccuggggcggagugcaggcugggucggggucguguucccuggacuaccugcacagccugugugggggaaggggaagcccggacuccagcacaaagggcucuugugugagcugcaggcgccacugggcaggaugcuuccuggggaugggcuggcaccccguaugaggcucagggacuucuaggggugccaaaguggggagggcucuuccuggggacggccccagcggucuccccaggagucuaggugaugggggccagccacagaccugccugacuugggcagugcagcuaagaucuggagccuggagcggcuggugggagcccccgcccccagggccaucuggagggcacgcacccuucacagguggcugcugcacaccugggcucuagcucggacuugcuggcaccgcaauggcagcgagucccugcaccuccaugagcccugcuuucuucugucugcccugacguggcugcuggggggcuaccugaggugacgguaaacacuuaguguuccuucguccuucccacuucgcuggcacaugggaaggacuugcaccaucacugccaaggggauggcugcugcucaucuuucuuggugcccagcucagggcagaccccaagaaacaguagacgaagccgggcacgguggcucaugccuguaaucccagcacuuuuggaggcugaggcgggcagaucaccugaggucaggaguuccagaccaaccugaccaacauggugaaacccugucucuacuaaaaaaaaaaaaaaaaaaaauacaaaaauuagccaugcaugguggcuggcaccuguagucccagcuacaugggaggcugaggcaggagaauugcuugaaccugggaggcagagguugcagugagccgagaucucgccacugcacuccagcuugggugacagagcaagacuccgucucaaaaaaaaaaaaaaaaaaguagaugaaugacucugcagaguuuucccaggccuggcacugccccuggggcugccauguagccaguguccccaccugagcccuguggccccccagcuccagcucugucaccagccucagcuccccgccucccucccucacaggggacaccugccaaugccuguggccucugccccuccuccaggaaccuucccgccggccacuuccuggcggcccgcagcccccagccuaagcaggucugacugcccaaguggaaaaacauggaucccauaguuuccaugugaagucuucccgcugcauucccuccuccaaggagggcgggacacggagcguggcagcaggagccggcggccaaggcagccagcuucucugcuuacacacccacccagcugccugccugcccccucuuccagacccuguagggaggagcugccgcuccaagucccaccauucucuccuuccugguccaucucugaggcaggggaugggggaaccuaccuaggcagaggcaggagggccugggguucaggaggaagcagugcauggucacugcacguucaguggaugucaugccccaugaugaccucugugugcauugacaaggucacacagugagggagugacggggcugggacagaaccugggucggggcacuggcgaccugacucauaaccauuggguucucuugcauuugggggcagaagcagugaauucccucuggcucuuccuggcgugucugccuucuaggccccugacucacagucuucugucucugccuccucucugcucccagggacagaagaugugcuccagggucccucugcugcugccgcugcuccugcuacuggcccuggggccuggggugcagggcugcccauccggcugccagugcagccagccacagacagucuucugcacugcccgccaggggaccacggugccccgagacgugccacccgacacgguggggcuguacgucuuugagaacggcaucaccaugcucgacgcaggcagcuuugccggccugccgggccugcagcuccuggaccugucacagaaccagaucgccagccugcccagcggggucuuccagccacucgccaaccucagcaaccuggaccugacagccaacaggcugcaugaaaucaccaaugagaccuuccguggccugcggcgccucgagcgccucuaccugggcaagaaccgcauccgccacauccagccuggugccuucgacacgcucgaccgccuccuggagcucaagcugcaggacaacgagcugcgggcacugcccccgcugcgccugccccgccugcugcugcuggaccucagccacaacagccuccuggcccuggagcccggcauccuggacacugccaacguggaggcgcugcggcuggcuggucuggggcugcagcagcuggacgaggggcucuucagccgcuugcgcaaccuccacgaccuggauguguccgacaaccagcuggagcgagugccaccugugauccgaggccuccggggccugacgcgccugcggcuggccggcaacacccgcauugcccagcugcggcccgaggaccuggccggccuggcugcccugcaggagcuggaugugagcaaccuaagccugcaggcccugccuggcgaccucucgggccucuucccccgccugcggcugcuggcagcugcccgcaaccccuucaacugcgugugcccccugagcugguuuggccccugggugcgcgagagccacgucacacuggccagcccugaggagacgcgcugccacuucccgcccaagaacgcuggccggcugcuccuggagcuugacuacgccgacuuuggcugcccagccaccaccaccacagccacagugcccaccacgaggcccguggugcgggagcccacagccuugucuucuagcuuggcuccuaccuggcuuagccccacagagccggccacugaggcccccagcccgcccuccacugccccaccgacuguagggccugucccccagccccaggacugcccaccguccaccugccucaaugggggcacaugccaccuggggacacggcaccaccuggcgugcuugugccccgaaggcuucacgggccuguacugugagagccagauggggcaggggacacggcccagcccuacaccagucacgccgaggccaccacggucccugacccugggcaucgagccggugagccccaccucccugcgcguggggcugcagcgcuaccuccaggggagcuccgugcagcucaggagccuccgucucaccuaucgcaaccuaucgggcccugauaagcggcuggugacgcugcgacugccugccucgcucgcugaguacacggucacccagcugcggcccaacgccacuuacuccgucugugucaugccuuuggggcccgggcgggugccggagggcgaggaggccugcggggaggcccauacacccccagccguccacuccaaccacgccccagucacccaggcccgcgagggcaaccugccgcuccucauugcgcccgcccuggccgcggugcuccuggccgcgcuggcugcggugggggcagccuacugugugcggcgggggcgggccauggcagcagcggcucaggacaaagggcagguggggccaggggcugggccccuggaacuggagggagugaagguccccuuggagccaggcccgaaggcaacagagggcgguggagaggcccugcccagcgggucugagugugaggugccacucaugggcuucccagggccuggccuccagucaccccuccacgcaaagcccuacaucuaagccagagagagacagggcagcuggggccgggcucucagccagugagauggccagcccccuccugcugccacaccacguaaguucucagucccaaccucggggaugugugcagacagggcugugugaccacagcugggcccuguucccucuggaccucggucuccucaucugugagaugcuguggcccagcugacgagcccuaacguccccagaaccgagugccuaugaggacaguguccgcccugcccuccgcaacgugcagucccugggcacggcgggcccugccaugugcugguaacgcaugccugggcccugcugggcucucccacuccaggcggacccugggggccagugaaggaagcucccggaaagagcagagggagagcggguaggcggcugugugacucuagucuuggccccaggaagcgaaggaacaaaagaaacuggaaaggaagaugcuuuaggaacauguuuugcuuuuuuaaaauauauauauauuuauaagagauccuuucccauuuauucugggaagauguuuuucaaacucagagacaaggacuuugguuuuuguaagacaaacgaugauaugaaggccuuuuguaagaaaaaauaaaagaugaaguguguuu

SEQ ID NO: 192597 - RNA, 24553 nt, Homo sapiens
gcacgcgggggcggggccgcgccugcgcagaccgccuguuauggcggccgccuaagucccacagagacgggagucgggugggaucccaggcugggccccgcggcggguaagugccugggagaggcggcgggauaggguagggugcagggaaccuccuggcgccgagccugacuuugaaauccgagcucccacagaucggaggcccagaucccuaaggcccgaccccacucuuagcgucaguuuccccuucucaacacggguguuggggaaagaaguccacguccucaccuggguuuccauccuggguccaggcaccucuccuucgguucuagauuaggaagggagggcagugcccgaccugugacuguuuuuugagagggcaauaguuaacccacaaggguggcgucaggaaggcgacaagacaaagagaacgaguagccccacgggggacguccccggagccccucacuaccacucuacgcaccguggccaggccacgucuuuccugcccccagccugggccuucacacccugcccuccccagcuccuggccuaaaucgucaugggaucgcgccaaauuauugauuguugagugaguugcaguuaucagaaagaaagaugaggagggaaguuauuucaacaccgugaucccagcacacugcuuauuugggacaacugacuggggaccuauaggagaagaaagcugguagcgucucagucuagcccccacagccuuagaagagccaagaacacguuagcuccugcugcagggaugagccugcagcccuauggagaggugguggggcagguccccaucugcaaccugggucuccuuucucagcucugcccaguaaagagaggagcccgaagcccauacagacccugcauuuccggaaagagacuuuuccugacuagagaaacuguuaccuuuuuucuuucuucccagcauucacuuuaaucauuauuauauuacuauaaugauaguauuuacuauuguugcuuauugaacguuuacuauaugucguaagcccgaaaagugguaauugucucauauacuccucugaguauaugagggccugagauagguucaagagggccuccuuauucccagauagcugauucuagggaaagccacuuaaagggaaucuccuucaucuggaacuuacauugcagcguacauuucuugggaagccugguuggguugaauuuaaaaauggaaaauucaacuagagauuaagaauuugaguuuuuuugugugugucuauacuuaaaauuugguguguaauauuaugcucacuuuuggaaaaagcaaagaacauugauuuuucugggauguaaguuuuccaacaaaauugcgcuauaggccaugccugguggcucacaccuauaaucccagcacuuugggaggccaagguagauggaucuaccuuggucaggaguucaagacuagccuggccaacauggcaaaaccccaucuuuacuaaaaauacaaaaauuagguggacauuguggugcaugccuguagucccaguuacucgggacucugagguaggaucacuugagcccaggaggcggagguuguagugagccgagauggcaccacugcacucuagccugggcaacagagugagacucugucucagaaaaaaaaaaaaaaaugcgcuauggcaaaaaaagaaauggcauccuuugguucacuuuugauuuuuacagcaauauuagagaggaucuuccccacccccuucaaaaaaaacuguaugugaaaguccucaguuuucccccaggacaucucuaaguccugagagagcuugaucugccuuugaaaugagugguagguauaagcuguauuuucucuucuggaaucuggugugguuuugccaguccgauugauugaguguuggccuucagguccagcauuucuccaucacuuucaaugacaccaugaaauucugcauugauuugccagauucacagacuuucuuuacaacccacuugcauuuugauggcuuuaugguguugaguaggaaagcuagcauggagaugaauaaggaaucaucuuuuucuuaaaaauuuuuuuguugggacagcuuuugcugccccacagcaaccacuuaaauguaggaacuccagcaguguacugggaucauuaggacagccugagucaugaugaccucauuuugcaguugaagaagugggggcccugaagauuucaugacaucuacccagguaggaacagcuccuauaggcagucagggguuacaggcagguuugggucaaauaccugaaaccaaccccaggacaaggagguugcugguguuuuauuaacaccuacugugagccaaggacucugcucagcaguuuacccacccaguaacacugcgugagauuguggcugaagaaacagaugcagagaggcgaagugauuuuccugaaaucacauggcuagaaggugagaaaccagggauccccaccuggucuguccagcuucaaagcccaucagacuacugcuguuugaugaugcuuuuugauuaggugaaacgguuggagggaggucccaccuguucuugaccacuuugccucagccaugguuuuccaaguuuuaguuauuaaugugucaccugcauaauuuugccauaucuguguaucaccaguguagugacucccuuacuacuuuuccuuuaaauccacucacucuuuuuuuuuuuuuuuuaauuucuuuuugagacagggucuugcucugccacccagccuggagugcagagugcagugacgcauucucagcucacugcaaccccugccuuuuggugucaagcgauccucccaccucagccucccaaguagcugggacuaccagcgcgcgccacgacacccgccuaauuccacucaucuuuuuaaauucaguagcagagcuuuaagccaggcaugauggcucacgccuguaaucccagcacuuuaggaagcugauaugggaggauggcuugagcccaagaauuugagaccagccugggaaacauagugagacccuugucucuacaaaaaaaaaaaauuuaaugccaaguaugguggcauagcuguaguccuaacuaugaaggagguugaggcaggaggaucgcgugaaguuugaggcugcagugagccaugauuguaccacugcacuccagccugggcaacagagcaagccccugucuguaaaaagaaauguuuaaaaauaaaacauuguuuaaaauaggaaagcuuuauaacaacaaaugauguggggacaguugauaacagcuucuagaauaaaaaagaaagaguaaagggccauaacaacuaaaugcaaagugcagauugugauuggauacugguuucugggggaaaaaaaaccucaaagaccuuugggagacagauggaggaaauugacuuuaaugcuauuagggaauuauuaauuaacuuagauuugcuaauggucuuaugauuauauagggaaaugcucuuaggggacagacauuaaauaauuuaggggcaaaaugucaugaugucuacaauguacucucagcucaaggagaagaaaccagagagggcaggcacguguggcaaaauggugaggaucauugaaucuaagcaguaguucuacgguuaugauauuccccuguauccuuacuguuugaaauuuuuuuguaauaaguugaaaaaaaagggaaaggaaacuuuauaaauggaaauucauaucccuuucuauaaauaaaagguuacuaugaaaaugaauauaaugaauauaugaaugaauauaaaaugaauauaaugagugaaaugaauauaaacaaaauaacgcauuaauuuccagcuggauucucuucccuggccaagucucugagaucuucucccagggcgaugcaaagcuacucgcuaccagcuuggaccugucugcaguaucuccucugggaccugccaugcugaggacccauucucaccucugagggacuccuguccuaggacuaagguggagccugggccaugguacagcuggcuccugcggcagccauggacgaggucaccuuuaggagcgacacugugcugucagauguccaccucuauaccccgaaccauagacaucucaugguacggcugaacagcguggggcagccagguaagguccugggcccaggugcccugcggauccuauuuuguuuucugcuuucucauacucaucuuuuuggggaaaauauugggaagacuggauuacguaacuguuauccucagaccacuuuuuaagugcccuuuuuuucuuuaugauuuuuuaaaaaccuuguacucugcaauuuuuguauguggggguuuguuuugcuuuuguuuuugcuuuucuuaaagacaaucucacucugucacccagucuggagugcaguggcacagucauggcucacugcagccucaaacuccuggacucaagugaucuuccuuccccugccuccagaguagcugagacuacaggcucacaucaccacaccuggcugguuuuuauuuuguagagcuggagucuugcuagcccaggcugguuuugaacuccaggccugaagcaacccucccaccuuagccucuugagucccugggauuacaggcaagcugcuguccccccacuuucauuaagcaaacuccugugguuuccugagcaccuauugugcgccugacccaggacuugaugcugggaaugcagauacgaaugagccaaacuuugccgucagcaagcccaggguccacuggggagacaaagugcuggggcuccaucuguccucugcucuuuuuuuuuuuuuuuuuuuugagacggaagcucgcucugucacccagggggcagugcaguggcgcgaccucggcucacugcaaccuccgccucccggguucaagcaacucuccugccucagccucccgaguagcugggauuaccggcaccugccaccacgcccagcuaauuuuuguauuuuuaguacagacagaguuucaccauguuggucaggcuggucuugaacuucugaccucaggugauccucccaccccggccucccaaagugcugggauuacgggcaugaaccaccgcauccaacccuguccucuacucuuuuuuuuuuuuuuuuuuuuuuugaggcagucucgcucccucacccaggcuggagugcaguggcaugcgaucucggcucacugcaagcuccgccucccggguucacgccauucuccugccucagccucccaaguagcugggacuacaggcacccgccaccacgccuggcuaauuuuuuuguauuuuugguagacacaggguuucaccguguuaaccagaaugguuuugaucuccugaccucgugccgcccgccucggccucccaaaguguccucugcucuuuauccccacucccuuuacccuaguccagccaccucuguugcuugccuggcugccucugucuucucccacugaguucacugcugcacacccuccccgcuuaucucugcagcagccaaggacgucuuuugaaaaugcagaucaaaucacagcacuuccugaguuagaccuccaguggcuuuccguugcucucagaauaacauccagguuccucagcuuggucugugaggccagccugacccagccucugcuugugugccuacccuuaugucacucucucuugcucuucuguggccacucucagguucuuucugucccucaaacacagggaggggagagaagcaaccauaagauacaaggccagggagaaaacaccugcuuuccuccccuccuggcuccucaaguaucaucuccacagacagccccucccuggccacccucccuaaccccaacuacccuguauuagcuuguuauggugugauuauuaauaauucccauugaccuccugcccuaauuuggaugguacauuauaccagggguauacaaacugcagccugugagccaaaucuggccugcagcuauuuuuauaaagaguuuuaugaagccacagccaugcccagucauuaacguguuuuuacagcuguuuuugugcuauaacggcagaguugaggaguugcaacaaagaucacagggcccacaaagcuugaaaauagauacauuuuaugagacagggucucauucugucacccaagcuggagugcgguggugcagucuugacucacuacagccucgaccuccccaggcucaggugauccucccaucucagccucccaaguagcugggacuauaggcacaugccaccauaccuggauaauuuuuuuguagagaaggggauuuaccauguugcccaggcuggucaaauuccugggcucaagaaaucuuccugucuuggccucccaaagugcuggaauuacagguguaagccaccaugcccagccaaaaaacuuuuuuaucuaaccuguuacaggaaaaguuugcucaccccugccuuaugugguugccacaucugugucacacagaaugcaguuuuacuauauuccugguaauuaacacagccuguaauuaucuuguuuacuugcuuaauguuucuuccccaacuucacuccuaaaauguaaggcccuaacauaccaaauccugcuuuguacccccagcaccuggcaugguacuuggcacacaguguucggugaugaaugaauggaugaucggacagauucaaaaacuggcauaaacccgggaugcugugugagcuuagaggagaggccccugagcucauuccuaaaaguuguguggccuuggucagcuuaguccucuaagccucaguuucugggucuguaagaugaagcugauaaugguaucuucacagcaauuguggagauugaaugagcugauaugagccaagugccucauagauucucaugaaauggcggcugcucuuggugguggccccagccuccuggcuggugguggucacagcugaaucaagugggccuuuucugcuggcauuaguauaucucuaccuggccuuuaaaaaucuuuccuauugguaaucagauauucucaaagaagaagaggaagguaaaaaagaaaacaucuuggaauucucauuuugcguucugucuugccuuucaguuuuccugucccaauucaagcuucuauggagccaagacucuuggacagauucaggagccaaggguggcagucacagagauguucacacaaaggagccuccuucugcugagacaggcagcacaggguccccuccaggaaguggccaugguaaugaggguuucucccuccaggccgggacugacaccacuggccaggaaguggcugaagcucagcuggaugaggauggggauuuggacguggugagaagaccacgagccgccucugauuccaacccagcagggccucugagagacaagguacaucccaugauucuagcacaggaagaagacgacguccugggagaggaagcacaaggcagcccgcacgauaucaucagaauagguaaauagaggugugauguggcccaccugucaccaaggcaacuccgcagugucacugcucagggcucaguaugaucugagcguggacucugcaggcccaggcagcacagguuaugagaaccagcucgggugagacuggggaagcucuccacaaccccgucacuccugcccggcucacaccaccacagccucacccugugcgcuuucuucucugugcugugccuccuugcuggagugcuugcucccagccucugcucccuuaacauguuccccauugccguacaguuuccagcucagccacaccuccuccaggaagccucccugcugcugccucccacaucugugcucuugcucuaacucagcguguugggggugugggacaggcuuggccuggcugggcuggcaguagggagccaugggagguucuggagcuggaguguggcagagggagagggauguaaaugaaaaugaauggggcguggaccagucagauggacugggagcugggagcuagaagccagguaagaaaggggagugaugaaguggcgggaaaagugggacaggagagagguuuggacagauacucagaggugggaucaaagaggaacugcuacccagguaugggggcagagcagagggguuugcugacucuaggauuugaaaucuagggaccuggcacucuagaaacaccgggagcaguagggagcugggccaggaagugaucgguccugguuaagcaccuaucguguuuuggauaucuucacuaguaucgaguggccuagucugcacaaccccuccugagggggugcauggaugaggaagugaaaggccuagcgccaugcugcuuggugguggugagcgagcuucgaauccacacaguguccacaccagggcuuugccucccccuggcgcugcucauuuggggagcggagcugugauuugaggccguucauugagauccaggguccccgauggugucuugaguucccagggaaaggccucccccagcacuggccuuuggucagagaaugggggucagugggucacucucaaaaacagacaaaacagcagcucuguaucuaucugcucagcaaacaguuacuaagcgccuccacggugguaccaagcagccucuguucuagacugucccagagagggcaacguggaacucauaccagaacccaguuccauguaucccaugggugaccucugcccucauggccucugcagauagggaugaguauucccauuucacagaggaagagacugaggcucagcgagguugaggaacuugcuggggucacacagcuagucaguggcagagcugagacuuguaccuaggucugucugacgccacagccugugcugucauuccacaucaugggggcagagcuuucgaaagaggcuuggaaaguccugcuucucaggggggccgacgauggcucauuucccucugagcccucacuguuauuagccuccccaagcuggggagcaaaccugucaguuacuccacagugaauuguugugucuguagugaauguucugggaauuuaccauuguaugagcuaagaacaaagucccucgggaagaggcuggccugugaccagcuuccccuccugcccuguuccggugaccucacggugaggcccccuugucuguauaccuggaaguucacuuuuucagcugucagucacucacuaccugcccugacggaggagaguggaaugguagcuaaugcaugaaccuagguaguaauucgugauuauuucaaacuggcuagagcacuuucaucugcaaaacuugaucuaauccugcagggcuggauuuugagcccagcuccaucuucacaagccaggugaccagagacaaaugucuuacccacucagaaccacauggucagaaccacgugaucaggggaaccacugucccuggguuuuagugauaauuuauugaaacaugcccagugagcgccaggagcagggccuggcgcagaguugaugguaagcagacgucauucgccucacaacccuuuuccucugacccguaaaucaacccauuuuuuucaaguuauagacccauuugagaaacugguuuuucuaaagaaaaagaaaaauagguguuuucuuaacuauuccaagggauugacaaaaccuuaaaaaguuuauccagggaucugccaggaauccacagacccaggauucaaaagaaauuauguucaauucccccacuguagaaauaaagugagaccccaagagaacucgagaaaggcagggcuggaacucaggccgucagauucugagucccgugccuuccugcuggagaaucgggcaagucgcuuagccucucugaguucaguuuccuugucuguacaagggguacaaccuccuccaguuguaaggaauucagagagacagcacauacaaagcucuuagcguaaugccuggcacggauucaguguuccguaaauguaagccucuguccuggggacuggcccaagcugggaggagggagacuggcugacgaacagucuagguuccugcaggucuagagacccaguuugcaaaugagauaagacguaauucuagaaucugauaaggacaggugagauucuaacacugucucaucccauugcuagcccuagaguuucucauggggauaguuccucaggcuggucuuuuauguucucaugauaccuuugggauuauuuaaauauaaacucugacuuuucacaggagugggagccccaagauggcccuggguagggaggucccuaagucaccugggccuccaccccuagacugaauccuucuuccucaccccuaugcagccaccuggaccgcgcccggcccagggcugacauacugggcauuuguugugaucucugacuauccugaugagucaugaagaagcauauuuacccauucgaacacuagcaagugccugaaacggggcaggggucggguagaccucggaaucucugcacuccggagucgaggaugucagacacaagaaaggagagugcccuuaaggucggccacacucagcuuccuggggaauucauucuggcuuuuuccaucuggccccagggaguugcacagcauccgcuucuuccuuugauccaucccugagccucuuguucucucccuuaucaauucgcccugguguuuucucguguuaucagcaucagcagaaagcacaucuuagaucaguucuuggucagacucccaaaugacuucauuuuaaauccucuuuuguuucuauuuggcuuuagaaaaauaugggucucacuuugcacuucguuacccaggcuggucucaaacuccuggcuucaggcgauccuccugcuuuagccuuccaaagugcugggauuauaggugugagccacuacccggccaucucgacacauuuugaucuaauuagauguuuuuuucucagacuaugacccugggcuggucaugucccccuucugggcuucagugaucuccaccugugcaagggcugggguccuugaccaccucaaugguucucagaugucugccgagccugugcucucucagaagcgcugucugguuaaacacuguuacagccuuagaaaugagggaugaggcuacuucugcauuuugcaaaagaggaaacuguagcucugucuccaagaaguuaagugacuugucacccagcuaggaaaugacaaaacuggguugucauacaggucucugaccucagaguccucauucucccucaagggaagcuagccacccauugaggacagcugggaggcagaacuuacguccacgagaccccuggaaggaagugaccaaucacauaggaccaagaucacuaugagaagguuccccuggcagcaggaacccuuaggacagcugggguuagggagcagauggcaaggaggaagcuuucccaggccaauggagggagaggagaggagaggaggcuacgagccacacccaggagauggcaugggugggacuggggaagaggaacugggcagggacgcugacacagagggccuggggucuguagaccacagacaccccuuccccuccacgcacaagcacacaagccuucagccugcccagcgagucccugucccuuucauccugggaggcucugccccaggcuuuuuaaaccgugucccuggcaugguucagauucuacaucucccuuccccaagcaggcugaagagcuagaaaaggccgggcacgguggcucacaccuaugaucccacuuugggaggccaaagcaguguaucacuugagcccaaggguuugaaaccagcccuggcaacaugcugagacccuaucucuacaaaaacuacaaaacuaaaaaaauuuagccuggcauggaggcaugcaccuguagccccagcuacucgagaggcuuagguggcagggucacuugagccugggagguggaggcugcagugagccuuggccgugccaccacacuccagcguagaugacagagugagacccugucucaaaacagaaagagacagaaaacugcagaugaccugacuuggaaccccgcaucugccacucacccucucugugaccacagccugcuaaccucacccagccaccuuuuccucauccaauaauacucgaagcugucauugggugauuuugaggauuaaaugagaaagcauuuagcccagugccucaugcagagaaggugcuuuuuuuucuauuaacuuuacaaacaguaaugcugaaccuuagucagugucuuucucuguaauauacaugugagccaaucagguagaaucucaguggcacccagggcuugcucacagaaugugucugucuagugaauguugguucagugaaggaacuuugcaucaggugguucggcagguguauuucuguuccaguuucaaaccaggugacuacguguuaggacguagcaaucugaagcccuucugaaaggaacauguuuuauuaaaagugccuuguaagccaccaugucaaaucuagccaagaugcugguggacaacccauuagucacuuuauucagagaucagauucuaacugcccauagggcugaaaucuuuggccagauuuucccaggaggagcccucagagaacaguggcccaggugcccaagaggacccuacacagucgauuucuuuccugguucggggacagacagagcgauuggcgauagcuguuaccaucucacuuaaaaauacuugagcaaguuauuuucccuccucgggagcucuuagacaagcaaguucuuacuuaacaacaaaaaaugcuuugcuucauuccuuuucuccuugaucuuauauuuccauuguguuccccccuccaccagaauuugauccuauuaggguauauuauaaauacaaaauauauuauauuuugcacuugagaauacuuauacuacuuuucaacguuuuuaaaaaggauguaaauuuaaacuuauuuuuuuguuaacuucuaauguagauuucuaaguaugagaaaauaaugaaguuaaguauguuucucaguauaagaaaauacuuuugaaugaauugugauuauuaguaguauauaaauuaauauauuaugauuguaacuuugcaauuauuggucaugaaaaaaguagugcacugcaugugggugcaauuaaauugcgugaaaaccuaauugugacccucccuagccuugggcuguagggcagagauacccaguuacaugaaagagugugagccccauuccaaaaagcucccauccucugaguggugcucaaaagucgccuccuaaccaguagcacagccuguguuucugcugcucucuagaacgccucauuccaaccucugacgcccaucugaccgugcuggcgguugccacacuguccugucuugugguuuucuguccauccccauuucacagugggcauuucucuugguuucugucccauccagagcacaccauggccacgccccuggaggauguuggcaagcagguggguaggucuuguccgcuuccuguggcccugaugggucccugcagagccucacgcugcuugucgcuccuuguccucuucccuccagguguggcggggcgcccugcuccuggcagacuacauccuguuccgacaggaccucuuccgaggauguacagcgcuggagcucggggccggcacggggcucgcuagcaucaucgcagccaccauggcacggaccguuuauuguacagguaaugaggugacaucucaggcugcagggaaguagucaccuucacaaagcaugcacugacuguauaaaaaaagaggcagaggcacuggaaauuggauguuagcuguuguugauuuugccauccugguccccuggcccucuccacucuccauuuauucucagugacaucaaaaugacccagcaauacccacucagcagcagcagcgucacccaguggcuauaaggccauugagcuucaggaggugccuagcgccccugcugguaccucucuccccacuccugagaaagagcaaauaucuccaaaaacaggaggaauauacccuuuuagaagccuuugaaagcaaguuuauuauuuuuuuccuggguauagaagccuugcccauucuuuguaggagguuuuuaaaacaguacauaaaaauuacucauaauuuuacaaucccuagauugaaucaacaauaugcaacuuaugggucaccucccgugugccacucauuucuagauguaggaggcccugcggugaauggagcugacuaggcacugcccucagggcgcuuacguuguaagaaucuccuccaaaugauagcugaaaucaagcugcagcagcacuguauucugcugaaaauguugaaaaacauuuuuaagagcauuuucuuuuuuaaauauguauauauuuaggggguacaagugcggguuucugaugugcagcuauauugcagugaugacauccgucugggcuuuuaguggaccuuccacucaaauagugaacauuguacccaauagggaagcuuuaaucccccaccccucccaccgugucaccuucuggaauccccagugucuguguuuccacucaguauguccauguuuacccguuguuuagcucccacucauaagugagaacauuuuaagagcauuuucucaugccauuaaaaaauuauuauauaggccaggugcgguggcugacaucuguaaucccagcccuuugggaggcugaggcaggcagaucaccugaggucaggaguuugagaacagccaggccaacauggugaaacccugucuguacuaaaaauacaagaauuaaccagaugugguagcggcgggcaccuguaaucccagcuacuugggaggcuugaaccugggaggcagagguugcagugagcugagauugcaccacugcacuccagucugggccacagagugagacucugucucaaaaaaaaaaaaaaaaaaacaaacuuuauauaugacuuuuaaugaccagauaauauuucaucuucuuuguaacccuucuccuauugcugagcauuuuggccauuccuauggguuuugguuuuuugguuuuuguuuuuuuuugcauuugucaguuacacugugaugaacaucuuuguauauugucuaauaaucugucaccuagguuccuaggagugggcgguguuaguuacauugcaaugaacaucuuuguguaucguugucuaauaacgugucacuagguuccuagaagugggugagacuauucuuaagcuuuugaugaacauuaccaacuaauuucuuuuuuaguauuuaauuuugaaauaauuucagacucaaaaggaguuguuaaaauaauccagcaagugccauaugcccuuccucuggcuccccaguggugacaucacacacaaccauaguacagugaugaaaaccagccagugaaguuaacuaaacuccuaacgugccagagugcuuucuuuagaacaaauauaccuguuuacaagagaguagugaucucgucaagugaaccuuguuguuauauuuuaaaucuuuaguaucugcuggacaaaaagagguaucagcugaugugguuuacaccucauugcuuccuagugaacguuaccuggcacagacuuuuguuucugagauaggaaggaagaagcuagagaucaccagucccugaggcacuguuuucaaauaugcuguuaaccacuggucaggagucugcagugcagccacgcuauuggcugcuucuugacaaugucauguaaauuaucagugagcucuucucagagucaagccguccaagagcuuugcuucgucccuggugccuaauagcagacuauaaagaagucuuaucccugagagagauuuaccagcauggggaagaaagcuugcauuuagaugccauguuccaguuggaaaaguccuuucagaugcaucagugccuggcuguaacuucacagugacucugggcagagcccaggguuccuaucucuguuguccaaaugggcagacugaggcuggcccaaggucauccacagcugcugaugagacccgaggcccuugauguggaccugcuggcccacagggcagugugcuugucacgugguggaauuucagauuguguugcauggaacagagcucccacaagcuggccgagggaugcuggggagaacgcacucagggcaccagggcuccuaccccacucagccagagcugcuccucucuuaccuguuuuauagguuaaaagcuuuugacagaaacuaucauaaagguuuaaaaacugcugacccuggccaggcgugguggcuaaugcauguaaccccagcacuuugagaggccgaggcagguggaucaccugaggucaggaguuugagagcagcuuggccaacacggugaaaccccaucuguacuaaaaauacaaaaaaaaaaaaaauuagccaggcaugguggcgugugccuauaaucccagcuacuugggaggcugaggcaggagaauugcuugaaccugggaaguggagguugcagugagccaagguugcaccacuguacuucaguuggucaacaagugcgaaacuccguuuccaaaaaacugcuaagcccaucgugugcugucagguacauaucaucaguauucucuuggccuaggagauaggguagaucccucccuucugcaagcagggagcuccucccguacauggcucugugugaccccuggggugcagauguuagucccagggagauugcacuguggguccacgcccacaguggaccaagcaaaugucauuaacaagacauccuguacuuucuacaugcacauucuucuaauuagaaguuuauuuuugguaaagcacugcuucugccagugaggauucacuguaccccaaguuaguucuugaaaugaugagaaaucccacuugucagaguagcaggcggcugggagggagaucuggguggcagcaaagugaaucgcgcucaagagagugggcucagccuguuugaaucugcucuguguucugacgaaucauaagaaaaaauccuucugaccggaaaacugguccagucaguuuuccuagggugucaaagaacgagccuaaauuuggaguuagaaaaaccuggaucaaaucccaacucuugcucucaauagcugcaugacuuugcucaagucacuuaauccgugaaaugggauucaugaucccagcuccuguguggccauaaacaugaaaacgaugaacuagggaagugcacgcguguugcaugugcucggaugauguugggagcucacacuccuucccucuggaaugcgcacugucucuccccaucaggaggagaaucucuuauuuagggaacaagccaaugaaaagagccuuaaggugaggguauuuaauuuuggcaguaagacacauaggagaaacguuucucuaauuucugcaguugugcuguugaucacagcucucucuaggcaaaaaacauggagauaaaagugucguaguggcuggcacuuuauggcuugcccucugucauuccagaugucggugcagaucucuuguccaugugccagcgaaacauugcccucaacagccaccuggcugccacuggaggugaggcccagggggucuucugccagggagggagguuucucuguuuagcagauaggacagacacccaagaccaugacauugggaggcagggcuccgucugugucccuugcagcaggugaguaaggggagcaggcgucgucugggcaucacagagcuucagagcauugaggacgcuccuugggucaccuccucauucccagauccacugcgucauccuacuccagcucuuucucucccggacacuggcggcggccccugagcuggucuccccagcuccuuaguugacccguccaagauguccucaugaaacauccagagugcccuuucucagaugcaagccaguccacuucacuugcugcugaaaaccucccaggggcgucaucaccuguggggugaagucugagcuccuugaauucccaggccucccuggcccagccccggccugcucuccuugccuccuccugacagucuccuuuccagcccugcauccagcacggccaggacucacucacaggccagucccccugcgcagaugggccuccgccuccaucugccugguucucugcucccugcacggccugcagggaugaguguaugugaugggugacgacaguuauguccuaacgccuccuccgagcagccccccaggcuucaggcccuucagugguuuacuguugcuugucucauguucuuggggaucuggccccugucugucugcagcgccccccaccaccaacagccgaccucaccgucuuucaaaucacauucccucgaguccuuugcccuugcucuucccucugccugagugcucugccgucccuccucccggcaaguccucaucacccucggggcuucagaccuccagauuugaggccagagcccccaacagacuccaggcacacguugcaugauugcauuuuaccaucugcucgugugacuaguuauugguguuuuccauucccaccggacuacaagcucugugggugcagguacccugucugcauuugcucugcacugucacaauguuuguugagugcucaggguacaguaggcagucagcagagcugggaggauggagggagcaugcugguggaagccuucccugacauccgcugucugacaugaguuccucucucuccuccugugcguuugccucauccuucuggcaucacccagccacacagucuugccguuguugguuaaccugccagucucuccuaggggagcuggucugcaaggauggggagcaugacucuuaaaucuuuauuuucccuaugucuggcaccgucccugacacguagcacucaaaaaaugcuggaagaauggacggauggauggagggaagggacagaaaauggaugauggaugaggagggaaggaggauaauaaggauggguggguggaugggugggagggcagaaggauggauagauggguagaugagaggauggauggauggauggauggaaagauggguggaugggagggagggagggaaggaagauggguggguggauggauggauggauagauggaagggcaggaagauggguggggggguggguggauggauggauggaucgauggauggcuagaaggaaggaugagaagauggaugggagggaggcagggagggaaggaagauagguggguggguggguggguagauggauggauggauggauggauagaaggaagggccggaagaugggcaggugggugggugggugaauggauggauggauggauggauggauggauggauggauggauggauggauggguggguggauggcuggcuggcuggcuggcuggcuggcuguaaagauggaagggcaggaagguggaugggugagagcaaggguggguggguggauagauggaucuucauauauaguguaaaaguuuaucuuuuuuuccugaugauguuuagaguuuggaaaguucucuuuuuguuuguuuuuacaggugguauaguuagggucaaagaacuggacuggcugaaggacgaccucugcacagguguguguuucucucggacgucccccaguaugauucagugauuccuuuguaauaccucagugccccuggcucugugguuuugacagagcuguagucccagcugcugccacagucccaucggcgcauggcagcuucucuccauuggccgaugagcaccagcugucauucucugagcgccugcugcaugcugggcaccucacguucauuuucuucuccagguguugugguuucccugugugguagcaugauaaucccugaauugugagugcagacugcccaugggcacagcugguacacagcaggguaggggcauagacccgaguuugucagacucuggggcacagaccauuucccaacaaacaguggugccaggaaaccccccggguaggacaguuuccauauuucuuacacagacuacuucagaccugggugcuugcucuuucuuuguauaaagaugucuuuuuuuuuuucccugucagauggcagaugggaaaagucguuccuugaguacuggucaccugccuagcacuuugcgcaccguaggcccuucggcccucccaauaguccugugaggaaguaguacugugcccuuucugugagugcaaaacugaggcuguuuuccugggccacccagcaggcagaagggggagaucauguccugcacugggccacaggccaaggcagcgggugaggcugaaauccgcccgcugcucacuggcuagagcagacacucagcagaaaaggcaccucuuccaccaugacucugcacccgggcagcagugggccugaagcagggagucuggucugccugguggugcccacugcaccgagcuacccccagcccuguuucuucucuugaagugccuuuuggucagucccagugagaguugguggccaggagagaaggcaaugggcacaaagugugcuuuuguucuuucuuagaucccaagguccccuucaguuggucacaagaggaaauuucugacuuguacgaucacaccaccauccuguuugcagccgaagguaagaaaauuucuccuucgccguacacguccuuuguuguagcaugaagucaagugcagucucuccucacuucccccgggaguucaguuuuagaagugacuuucugguacaugccaccacaucugcaguuuuaauucuggaagcugcugcuguuccguggugauaagcauucucucugugcggauugcucugaaaagucgauuucuguaauauuugcguguuuuccucuaaugcuggccuuuuugcuucccacaguguuuuacgacgacgacuugacugaugcuguguuuaaaacgcucucccgacucgcccacagauugaaaaaugccugcacagccauacugucgguggagaagaggugagcuuugcgccacgggaaccgugcugacgucccgagugucagcggaacucucaccuccuaauuguguccuugucagugucauuaugauuguuacucagugccacuuauugagcaccuacuaugugccaggucugugcucauccuuuguguacguuacugcacugaaucugcauccuagcccugugugcaggcgcugcugucccacuugacugaugaagagaggaaggcugggaagcaucaggggccuuggccagggcacggcuaguuagugauagacaaggacuugaaugcagacuguacuggaaccucaacgcuuggccagcacacacuguugagagcuucucuuccugaauguucucucuguggugccgucugucucuucagcucccccaggucucuuucucuugcugaaucggacagcuccucacccaacagccucacccagacauuuccacuagaauauccugaaauguuagguuccauuuauugagugcccaccuugugauagcuacacacauucuccuguaauacuuaacaguaguccacagcuuuucugaagaucguucggaauccacagcaaaagcuguaaaacgaaacagacuucuucacccagcaauucagcaucuggaaauucacacucaggguuguguacaaagcuguauguacuugcauauuuauugcaguguuacuuauaccaauaauaccgagggcuugcuuugaggcacacacugagcaauagcaauguacagaccucauuuggauccugauuucauaaacuguaaaggaaaaacaucaggacaguugggaaaaguugaauacugaauauuugauguuaaagggugauuguuaaacuuuaguugaagaggucuucaucuucuugagacacacacugacauuuccagcuucacagaggaaauggguuggugucuggcauuugcuuuuuaauaacucagugagggcagggggccccgggaagagccaagguggcagaguggcuggaaguggacaguggcugaagcugguaauggguucauuagacaguuuuguuuuuuuuguuuuuuugaggcagagucuugcccugucagcccaggcuggagugugauggugcgaucucggcucagcacaagcgccaccucccggguucacaccauucuccugucucagccucccaaguagcugggauuacaggcaugcgucaccacaccuggcuaauuuuuguauuuuuaguagaaacgggguuucaccaugucguccaggcuggucucaaacuccugaccucaggugaucugcccuccucggccucccacaguacugagauuacaggugggagccaccacgcccagcauagacuguucuuacuccuguugcaugucuggaauuuuucuugauaaaaaaauuuggaaagaaaagggaaaaaggcaaagagcuuuaauuucaagugaaaccaucuuguagacuaagguuuugaaaggcaaguggcaggguugggagaccuguuucugaaggugcucacucucugaaaucucucagaccccagcuucccagcaguuuucucucuguucucugugcucccggaguccucugcaccgcccccugccacugccucucauucauucauuucucagauaguuaugcgcagcuccaggcaccagauucugugcugggugcaggcaggaccuggagggcguccucaaguguugaucugcaggacugucuugaucuuuccagcagugucauugugggcacgugaccugagcuuucugagccuguuuccacaucuguaaagugcuauccacuuccaccuccugggcugucgugcagauguaggaaggaauugcacucacacacucagcaugagacaggcgcucaguaaaagcccguccaggggauaugagaucagugagggauaggaaagcaaggugggcagaaacagcaaaacccuucccauugaugauggcaguuugugcguccgacuggcugguuugcaggcucaacuucacauugagacacuuggacgucacaugugaagccuacgaucacuuccgcuccugccugcacgcgcuggagcagcucgcagauggcaagcugcgcuucgugguggagcccguggaggccuccuucccacagcuccugguuuacgagcgccuccagcaacugguagguccaggccccgaagcagggccguugguugcuuuacugugaagcgggugacuccagggcaaagaggugaugaagcaagcccuccaagcacaggcuccacccuaguccugcagggggugaagccugcgugccuggcaccaucuguaguggaaccuguugggggagcuacauccuguucuuagcagccaccaugucuggagacgggccuacaggcgaaccuugucuuuuacuuuauagcacauauuccccccguuggacaguucagacuccagaggaggcaagaccgaggcagagguuguuuggggaacaggaagucaguggagggaaguuuguggguugcagaucuuggugcaggcgccccgcugugguggccgcugcucacaucuucacuguggaaggauaccagccccucucggacugaacuggcuuuucuauuaacuggaguccaaagauugagaauuaacuucuuuuguucuguuugccuuuuggcuguggccucccuuucucuaugucuguggagacccgggccuaguucuaaggaaaaagggaggaagagggagucacgaggagcugccgcccuugcacucugucucgcguccugagggagggcagcauggaauucgugugguuuugugugcgaggaggaucuuguauuuauugcucugccacuucugggcagcauuaagaguagcgucacaugaccaagaacacacauuucuuacaagucagcagccccaauacaugaugccuaagacgucccaaaaaggccagguacgguggcucccaccuguaaucccagcacucugggaggccauggucggaggguugcuugaagcuaggaguucgagaccagccugggcaucacagacccuaucucgacaaaaaucaagaaaaaaaauuagccaugcaugguggugcacaccuguggucccagcuacucuggaagcugaggugggaggauugcuugagcccagaaguucaaggcugcagcaagcugugauggugccacugcacuccagacugggcaacagaaugagauccugucucuaaaauaaaauuguuuauaaagaucucccccaaaauggagagauacggcaacucacugcuauucuggucucuucugauuguuugacauccucugaugcaccuuccguuaaugcugggacuucauccauccagccucucugccacaguaaaauagaacagcccagagcaacaaagaaaggaggaagccgcccguccgcuccugccccagcucgccugcuccguggcugacguguugucuaacuacucuccuuggugaaucacuuuccuuaaugaaauugugaugcucuuguaugugcacuucagaaaccuguucuuuucucuguuugcugcaggagcucuggaagaucaucgcagaaccaguaacaugacccaucgccuccacaaggcgcggcgucucgacuguucuuagaguguauuucuaguaaaaucagaagcucaccaaagcaa

SEQ ID NO: 192598 - RNA, 51525 nt, Homo sapiens
ugagaaacaggaaacaauaaaaucacuuuaaugugcuacucuucacuuuggaaggucauuacaguaucauucgacaaggaaagaugccgcuggauggcuguguccugugagucacugggaugagcuggcugcuuucaccccaccggauccggggcucagacaguuacaagcccgaguggcugggagguuuggagggaaccagguuuagcugugaugaaagcaccuggcugugggcugggaggcaggagugcagggcagccugggcuccccuggccccagacucaggucggcaagugcccaguggaggccacacaaccccagcaccaagcaauggaggguguauggcucaguguuuccacauccugaaaagugacacaugaaccguuuccuaggaaaguucucuuccaccguguucuagcugagacccgggauccuuccaguuucacgaagaacgugcagaagaugaaaagagugagggacgcggaccuagcuguagcugcacucagccgccuccgugguaaagucugggugaaggccugggugagugcagauaggagagcagcuccucuuacuguucucuggcugggcucucgcuccaucccugagaaacuagaggcgaacgccuccaggaagccagccaggggcaaccagaaaguccuuuuggugaagucugacaucccgcguugguuucucuggaccuggguaagaaccggccccagggcaaggacuguuuugccagcaccaacucuccagcccagcuguugguucccacuaccuccggucucggagacagagaagcagccaggcuauucugaguguagugaacacagagccgguccgaauccggcccagccgaggugcaaacucccuagggucugcucccacuuggccagccaucuguccagcaggccucagccccaaacacgggaaaacgcagagugcgucuagucacuggguaucacacugccccacucacagcccccaucaaggugacaugcaggcgggagcuucguuccaggagguguuuguaaacuucguccugggcugggucacugcagauggccuguccugguuucucauuaccaaacccccauguuugguauugaugcaggggcccauuaaaaaaaccgcuuauguuuccacagacccaccaagagggaggguccaggcacaguuuuucuuucuguaucauccuagaaugauggggaaauuuccgccaaaacuacaugauugcacguaucaggguggguauuagacuagggggcuggggguggguggggaagaccuuuugugcgaggcauuccucugggccauucuugacaagaguuuucuccuuccuucuggaaguuucuggcacuggagguggaaguccagacugcacaugccuggcauagcaugcagagccugccuaggcugcgggugggugagcacgugugggaggacccucggcucuggccaccgaaugcccuaugcuggcuugucagccgggaccccgccccucccgcucccacguuaggagaacagcaguucacagauccugcgcguguccucaggcgcugucacggaguagcccaugguucuggggucugugaagaucucauggucauugccacccuggaaagacacgaaguacagaugaaggcucccccucgucugucccgggccauugcugaugugacccuggaguccaaaaguacccaaaaaacaagauuuaacugggcagggagaguuucuucagcuaccuuccucuuaguuuccaggagaggaacgugaguacaauuguuauuaagaagagauuuauaaccuucucuugaacugcaauuuggcuuggaacacguaauuaugccuaugagagccaucacgauguucuugcgaagaucugucuaaggcuuauuuuucuacacagaaggcaucagcgagugacaguauucucacagccaucaguuuuuuuuuuuuuuuuagcuguaccuacgcuuuucuaacaagucacaagggagcgucaggagggcagagggccgggagcagggcugccagggauauuccugugaugagggacguggcgacaucagcggugauggcagccacuggccaugugucacucugcacacuugaaacguggccaaugcaauggaggaacucaguuaauuugauuuuaauuuaaacagccccacgugggccgggcaugguggcucaugccuguaaucccagcacuuugggaggcugagaaggguggaucacuugaggucaggaauuugagaccaaccuggcuaacacagcaaaacuccauuucuacuuaaaauacaaaaauuagcugggcaugguggcgcacgucugaaaucccagcugcucgggaggcugaggcaggagaauugcuugaacucgggagguggaaguugcaguaagccgagaucgcaccacugcacuccagccugggcgacaaagggagacucuaucuuaaauaaauaaauaaauggccccacaugacuggggucugagcugcuggcuaaaagcagggucucuggaacagguggccugggucagaugcugguucuaccacugagcagcaguguggcugcgccaacuccccaucuccaaaauggggucaugauggaagcuugcucacagcucuguggccagaaguucaggagaugaugguuggggucacaccuugguaagaugacgaaaccgaggccucagaaagucugcaagggcccaugucuaggaggaccugggcauguucugcugggguccugugccugaguugagugcucccaucuguguccccaucacccccaccaaucccacugggcucacguuaaugaaucagguuaucugccgcucccgcaaccccgagcccugcaggaaagcccccguuuuucucauggaauuccuuuauuucccucauaaaauuggauaaucacucuaacucaaaaccuuaaaauaaucuacgauugcuuuacaauacaaugaacacaaccguagaaaaaagggauuuuucucauaaagcaccgagcaugaagccaacguggaaaccaugauuuuguaccaaaaaucugacauccuuuaaaagaauuaauugccucuggaaaugaguguuuucauuuuugcaagaaccuauccccaggcagauggccuccucagguggaggugaauuucaggcuucaggagggaacgucgcugggcccagggagugcuggguggagucagguuaggaggccaugaacuuggcaucucuuccaguccagccacuugggaaccugucagggccuuguacuggccuuacacaguuuuguaccaggccugggggccuucagacagaccugaauugcauggccaccaucugcuaccuacacaugugaaaucaguucugguaauucugauuuugccuuuuuuuuccuucggacauagggucuugcuauguugcccaggcugggcucgagcgaaccuccugccucagccucucgaguagcugagacaaagacuguguccaacagugccaagcuaguuccaguaauucuucuaauuaaaaaaaaaaaaaaaaagauuucuuucaggaauggcacaguggguaaaagucacagagaaccuaacaaaggcacaaccuagcugggugugguggugcgcaccuguaaucccagcugcuuggcaggagaaucacuugaaccugggaggcggagauugcagugagccaagaacagaccacuguacuucagccugggcaacagagcgagacucaaaagaaaaaaaaacaaacaaaaaaccaaaggcacaaccaacucucacaugccucaaaagagccaaacacccuccccgccucagugacugaggaggggagucaguauucacacauuaacacaacacaccuuucuagaacaccuacugucaggccucugagcccaagccaagccaucgcauccccuaugacuuacacguguacauccagauggccugaaguaacuaaagauccacaaaagaaguaaaaauagccuuaacugaugacauuccaccauugugauuuguuucugccccacccgaacugaucaauguacuuuguaaucucccccacccuuaagaagguucuuugaaauucuccccacucuugaggauguacuuugugagauccaccccugcccgcaaaacauugcucuuaacuucaccgccuaucccaaaacccauaagaacuaaugauaauccaccacccuuugccgacucucuuuucggacucagcccgccugcacccaggugaaauaaacagccauguugcucacacaaagccuguuugguggucucuucacauggacgcgcaugaaauuuggugccgugacucagaucgggagaccucccuugggagaucaauccccuauccuccugcucuuugcuccaugagaaagauccaccuacgaccucagguccucagacccaccagcccaagaaacaucucaccaauuucaaauccaauaagcagccucuuuuuacucucuucuccaaccucccuaucccucaccgucuuucuccuuucaaucuaggcgccacacuucaaucucucccuucucuuaauuucaauuccuuucauuuucugguagagacaaaggagacguuuuaucuguggacccaaaaaaccggcgccggucacggacugggaaggcagccuucccuugguguuuaaucauugcaaggacgccucugaucauucacccacguuucagaggugucagaccacgcagggacaccugccuugguccauaacccuuagcggcaagucccgcuuuucugaggaaggggcaaggaccccaaccccuucuuuccgugucucuaccccuucucugauuuucuggggcaggggcaagaaccccccaaccccuucuccuucacccuuagcggcaagucccgcuuuucugggggagaggcaaguaccccaaacucguaucucugugccccaaucccuuauuuccaugccccaaccccuuucccgcuuuucuggaggguaagaacccccaaaccccuucccuccaugucucuacgcucucuuuucucugggcuugccuccuucacuaugggcaaccuuccuacauuccuccuucuucucccuuagccuguguucucaagaacuuaaaaccucuucaacucauaccugaccuaaaaccuaaauaaaugccuuauuuucuucugcaaugccgcuugaccccaauacaaacucgacaguaguuccaaauagccagaaaacggcacuuucaauuuuuccauccugcaagaucuaaauaauucuugucguaaaaugggcaaacagucugaggugccugauguccaggcauucuuuuacacaucagucccuuccuagucucugugcccagugcaacucgucccaaaucuuccuucuuucccucccgccuguccccucagucccaaccccaagcguugcugagucuuucuaaucuuccuuuucuacagacccaucugaccucuccccuccucgccaggccgagcuagguuccaauucuuccucagccccuagacccuaaaaggucaaaaggccgucuuauucucaauauacauuuuauuacccaaucugcucccgacauuaaauaaaacuccaaaaauuagaaucuggcccucaaacuccacaacaggacuuaauuaaccucaccuucaagguguacaauaauagaaaaaaguugcaauuccuugccuccacugugagacaaaccccagccacaucuccagcacacaagaacuuccaaaugccugaaccgcagcggccaggcguuccuccagaaccuccucccccaggagcuugcuacacgugccagaaaucugacuaccagggccaaggaaugccugcagcccaggauuccuccuaagccgugucccaucugugcgggaccccacuggaaaucggacuguucaacucaccuggcagccacucccagagccccuagaacucuggcccaaggcucucugacugacuccuuggcuuagcggcugaagauugacgcugcccaaucgccuuggaagcccccagaccaucacggacgccaagcuuuggguaacucucacaguggaggguaaguccacccacuguuuaaucgaaacggggacuacccacuccauguugccuucuuuucaagggccuguuucccuugccuccauaacuguuguggguauggacggccaggcuucuaaaccucuuaaaacuccccaacucuggugccaacuuagacauuacucuuugaagcacucauuuuuaguuauccccaccugcccaguucccuuauuaggccgagauauuuuaagcaaauuaucugcuucccugacuauuccuggacuacagccgcaucucauugccgcccuucuccccaacccaaagccuccuuugcgucuuccucucauauccccccaccuuaacccacaaauaugggacauuucuacuccuucccugacaacugaucacaugcccauuaccaucccauuaaaaccuaaucacccuuaccccgcucaacgccaauaucccaucccacagcacgcuuuaaaaggauuaaagccuguuaucacuggccugcuacagcauaggcuucuaaaaccuauaaacucuucuuauaauccccccauuuuaccuguccagaaaccggacaagucuuacagauuaguucaggaucugcgccuuaucaaccaaauuguuuugccuauccacccuguggugcccaacccauacacucuuucauccucaauaccuuccuccacaacucacuauuccacacuugaucuuaaagaugcuucuuucagcguuccccugcaccccuugucccagccucucuuugcuuucaccuggacugacccugacacccaucagucccagcagcuuaccugggcugugcugccacaagguuucagggacagcccucauuacuucagccaagcucuuucucaugaucuacuuucuuuccaccccuccgcuucucaccuuauuuaauauauugaugaccuucuucuuuguagccccuccuuugaaucuucucaacaagacacacuucugcuccuucagcauuuacucuccaaaggauaucagguaucccccuccaaagcucaaauuucauccucaucuguuaccuaucucggcauaauucucauaaaaacacacgugcucugccuguugaucuugucugauuaaucucccaaaccucaaucccuuccaaaacaacaacucccuuccuuccuaggcaugguuagugcggucagaauucuuacacaacagccaggaccacacccuguagccuuucuguccaaacaacuugaccuuacuguuuuagccuagcccucaugucugcgugcagcggcugccgcugcuuuaauacuuuuagaggccguaaaaaucacaaacuaugcucaacucacucucuacauuucucauaacuuccaaaauccauuuucuuccucauaccugaugcauauacuuucugcuccccggcuccuucagcuguacucacucuuuguuaagucccacaauuaccauuguuccuggcccggaccucaaucuggccucccacauuauuccugauaccacaccugacccccaugacuguguuucucugauccaccugacauucaccccauuuccccauauuuccuucuuuccuguuccucacccugaucacgcuugauuuauugauggcgguuccaccaggccuaaucgccacauagcagcaaaggcaggcuaugcuauaguacaagccacuagcccgccucuuagaaccucucauuuccuuuccaucguggaaaucuauccucaaggaaauaacuucucaguguuccaucugcuauucuacuacuccucagggauuauucaggccccuucccuucccuacacaucaagcuugaagauuugcccccacccaggacuggcaaauuagcuucacucaacaugccccgagucagauaacuaaaauaccucuuagucuaaguagacacuuucacuagauaaguagaggccuuuccuacagggucugagaaggccaccgcagucauuucuucccuucugucagacauaauuccucaguuuagccuucccaccucuauacagucugauaacggaccagccuuuacuagucaaaucacccaagcaguuucucaggcucuuaguauucaguggaaccuucauaucccuuacaguccucaaucuucaggaaagguagaacggacuaauggucuuuuaaagguacacaucaccaagcucagccuccaacuuaaaaaggauuggacaguacuuuuacuucuugcucuucucagaauuagagccuguucucgagaugcuacaggguagguacaguccauuugaacuuuuauauggacgcacuuucuugcuuggccccaaccucaucccagacaccagcccucuaggcgacugucuuccaguccuccagcaggcuagacaggaaauucgccaggcugcuaagcuucucuugccuacuccagauccccagccauaugaagacacccuagcuggacgaucaguucuuguuaaucugacuccucaaacucuacaaccucgauggaccggacccuacuuagucaucuauaguaccccgacugcuguccgccugcaggauccuccccacuaggcucaccguuccagaauaaagcuguguccaucggacagccagccuaaucccuccucuuccuccuggaaguugcaaguacucuccccuacuucccuuaaacucagucguauuucgaagaacagucauaacccuuaugagccuaauacaucccuucauucuauuagguuuuucguccuuacccuacuuuuugcaacagggcuuuacgaagucacccccaccacuuaggccgagccccaaaaaacuagucaucccuacuaucuucugucuggucauacuccuauucuccauucucaacuacuuauaaaugcccuacucuuguuuacacggccgguuuacacuguuucuucaagccaucacagcugauaucucuuggugcuauccccaaacugccacucuuaacucccucuuagaguggauagaugaucuuugcuggcaaggcacccuccaauauuuccacccugaugaaguucuauucuuuacuuuuauacucacucuuauucucauucccauucuuaugccacccucuaccucuccccagcuaucuccaccacacuaucaaccuuacccauucucuccuagccgcuucuaaucccuccuuagugaacaacugcuggcuuugcauuucccuuucuuccagugccuacacagcuguccccaccuuacagacagacugggcaacaucucccaucucccuacaccuccgaacuuccuguaacagcccucaccuuuacccuccugaagaacucauuuacuuucuagacagguccagcaagacuuccccagacauuucacaucagcaagcugccgcccuccuucacacuuauuuaaaaaaccuuucuccuuucuccuuucuccccccauauucggaccucucacaacacaaacuacuaugccuguggccgcuccuauauguaucucucggcaaagacccacuggaauuccccuagguaaucuuucaccuucucgauguuccuuuacucuucaucuccaaaguccaacuacacacaucacucaaacaaugggagccuuccagcuccauauuacagacaagcccgcuaucaauacugacaaacuuaaaaacauuagcaguaauuauugcuuaggaagacacuugcccuguauuucacuccauccuuggcuacuuuccccuugcucaucagacucuuccucccaggcccuccucuuguuuacuuuuacccagccccgaaaauaauagugaaagguugcuuguagauacucaacguuuucucauacaccaugaaaaucgaaccucccccucuaugcaguuaccccaucaguccccauuacaaccucugacagcugccgcccuagcuggaucccuaggacucuagguacaagacaccccuugcagcacuccucaucuuuuuacuuuacaucuccaguuuugccucgcacaaggucucuucuuccucuguggauccuuuaccuaacaugugucuaccugcuaauuggacaggcacaugcacacuagucuuccuuacucccaaaauucaauuugcaaauaggaacgaagagcucccuguuccccucaugacaccgacacaacaaagaagagucauuccacuaauucccuugauggucgguuuaggacuuucugccuccacuauugcucucgguacuggaauagcaggcauuucaaccucugucaugaccuuccguagccugucuaaugacuucucugcuagcaucacagacaugucacaaacuuuaucaguccuccaggcccaaguugacucuuuagcugcaguuguccuccaaaaccaccgaggccuugcuuacucacuguugaaaaaagaggacucugcauauucuuaaaugaagaguguuguuuuuaccuaaaucaaucuggccugauguaugacaacauaaaaaaacucaagcauagagcccaaaaacuugccaaccaagcaaguaauuacgcugaacccccuuacgcacucucuaauuggauguccuagguccucccaauucuuaguccuuuaauacccauuuuucuccuucuuuuauuuggaccuuggaucuucuguuuaguuucucaauucauccaaaacuguauccagaccaucaccaaucauucuauacaacaaauguuucuucuaacauccccacaauaucaccccuuaccacaagaccucccuucagcuuaaucucucccacucuagguucccacgccgccccuaaucccgcuugaagcagcccugagaaacaucgcccauucugucuccauaccaccccccaaaaauuuucaccgccccaauacuucaacacuauuuuauuuuucuuauuaacauaagaaggcaggaaugucaggccucugagcccaagccaagccaucgcauccccuaugacuugcacguauacauccagauggccugaaguaaaugaagauccacaaaagaaguaaaaauagccuuagcugaugacauuccaccauugugauuuguuucugccccacccgaacugaucaauguacuuuguaaucucccccacccuuaagaagguucuuuguaauucuccccacucuugagaauguacuuugugagauccacuccugcccacaaaacauugcucuuaacuucaccgccuaucccaaaacccauaagaacuaaugauaauccaccacccuuugcugacucucuuuucggacucagcccgccugcacccaggugaaauaaacagccauguugcucacacaaagccuguuugguggucucuucacacggacgcgcaugaaacacuucaaucucucccuuaauuucaauuccuuucauuuucugguagagacaaaggagacacauuuuaucuguggacucaaaacuccggcgccggucagagacugggaaggcagccuucccuugguguuuaaucacugcagggacgccugauuauuuacccacguuucaaaggugucagaccaugcagggacgccugccuugguccuucacccuuagcggcaagucccacuuuucuggcggagaggcaaguacaccaaccccuucucuccgugucucuaccccuucucugcuuuucuaggggagggguaaguaccccaaccccauguaucucugcgccccgaucccuuauuucugcgccccaaucucuuauaucucugugccccaaucccuuauuuccgugccccaaccccuucucugcuuuucuggagggcaagaaccccccaccccuucuccgugucucuacucuuuucucugggcuuaccuccuucacuaugggcaagcuuccaccuuccauuccuuucuucucccuuagccuguguucuuaagaacuuaaaaccucuucaacucacaccugaccuaaaaccuaaauaaaugccuuauuuucuucugcaauuccacuugaccccaauacaaacucgacaguaguuccaaauagccagaaaacggcacuuucaguuuuuccauccuacaagaucuaaauaauucuugucguaaaaugggcaaacggucugaggugccugauguccaggcauucuuuuacacaucagucccuuccuagucucugugcccagugcaacucgucccaaaucuuccuucuuucccucccaccuguccccucagucgcaaccccaagcgucgcugagucuuucuaauauuccuuuucuacagacccaucugaccucuccuccucgccaggcugagcuagguuccaauucuuccucagccuccgcuccuccacccuauaauccuuuuaucaccuccccuccucacaccuggaccagcuuacaguucauucugugacuggcccucccccaccugcccagcaauuuacucuugaaaagguggcuggagcuaaaggcauagucaaaguuaaugcuccuuuuucuuuaucccaaaucagauagcguuuagguucuuuuucaucaaauauaaaaauccagcccaguucauggcucguuuggcagcaacccugacacgcuuuacagcccuagacccuaaaaggucaaaaggccgucuuauucucaauauacauuuuauuacccaaucugcucccgacauuaaauaaaacuccaaaaauuagaaucuggcccucaaaccccauaacaggacuuaacuaaccucaccuucaagguggacaguaauagaaaaaaguggcaauuccuugccuccacugugagacaaaccccagccacaucuccagcacacaagaacuuccaaacgccugaaccgcagcagccaggcguuccuccagaaccuccucccccaggagcuugcuacacgugcuggaaaucuggccacugggccaaggaaugcccacagcccgggauuccuccuaagccgcgucccaucugugcgggaccccaugaaaaucagacuguucaacucaccuggcagccacuccccagagccccuggaacucuggcccaaggcucucugacuccuucccagaucucggcuuagcagcugaagacugacacugcccaauccccucggaagccccauaaaccaucacggacgccgagcaucggguaacucucacaguggaggguaaguccauccccuucuuaaucaauacggaggcuacccacuccacauuaccuucuuuucaagggccuguuucccuugccuccguaacuguuguggguauugacggccaggcuucuaaaccucuuaaaacuccccaacucuggugccaauuuagacauuacucuuuuaagcacuccuuuucaguuauccccaccugcccaguucccuuauuaggccgagacacuuuaaauuaucugcuucccugaguauuccugaacuacagcuacaucucauugccgcccuucuucccaauccaaagccuccuuuguguccuccucuuguaucccccaaccuuaacccacaaguauaagauaccucuacucccuccuuggcaaccaaucaugcaccccuuaccaucucauuaaaaccuaaucacccuuaccccacucaaugucccaucccauggcacgcuuuaaaaggauuaaagccuguuaucacucgccugcuacagcauggccuuuuaaaaccuauaaacucuccuuacaauucccccauuuuaccuguccuaaaaccagacaaggcuuacagguuacuucagaaucugcgcguuaucaaccaaauuguuuugccuauccaccccguggugccaaacccauauacucuccuguccucaauaccuccaucuacuacccauuauucuguucuggaucucaaacaugcuuucuuuacuauuccuuugcacccuucaucccagcgucucuuugcuuucaguuagaugacccugacacccaucaggcucagcaaauuaccugggcuguacggccacaaggcuucacagacagcccccacuacuucagucaagcccaaauuucauccccaucuguuaccuaucucggcauaauucucauaaaaacacacgugcucucccuguugaucgugucugauuaaucucccaaaccucaaucccuuacaaaacaacaacucccuuccuuccuaggcaugguuagugcggucagaauucuuacacaacagccaggaccacacccuguagccuuucuguccaaacaacuugaccuuacuguuuuagccuagcccucaugucugcgugcagcggcugccgcugcuuuaauacuuuuagaggccguaaaaaucacaaacuaugcucaacucacucucuacauuucucguaacuuccaaaaucuacuuucuuccucauaccugaugcauauacuuucugcuccccggcuccuucagcuguacucacucuuuguuaagucccacaauuaccauuguuccuggcccggaccucaaucuggccucccacauuauuccugauaccacaccugacccccaugacuguaucucucugauccaccugauauucaccccauuuccccauauuuccuucuuuccuguuccucacccugaucacgcuugauuuauugauggcgguuccaccaggccuaaucgccacauagcagcaaaggcaggcuaugcuauaguacaagccacuagcccgccucuuagaacgucucauuuccuuuccaucguggaaaucuauccucaaggaaauaacuucucaguguuccaucugcuauucuacuacuccucagggauuauucaggcccccucccuucccuacacaucaagcuugaagauuugcccccacccaggacuggcaaauuagcuucacucaacaugccccgagucagguaacuaaaauaccucuuacucuaaguagacacuuucacuagauaaguagaggccuuuccuacagggucugagaaggccaccgcagucauuucuucccuucugucagacauaauuccucaguuuagccuucccaccucuauacagucugauaacggaccagccuuuacuagucaaaucacccaagcaguuucucaggcucuuaguauucaguggaaccuucauaucccuuacaguccucaaucuucaggaaagguagaauggacuaaaggucuuuuaaaaacacaccucaccaagcucagccuccaacuuaaaaaggacuggacaauacuuuuaccacuuucccuucucagaauucaggccuguccucagaaugcuacaagguacagcccauguaagcuccuguauagacgcuccuuuuuauuaggccccagucucauuccagacaccagaccaacuuagacugugccccccaaaacuugucaucccuacuaucuccugucuagucauauuccuauucgccauucucaacuacucauacaugcccugcucuuguuuacacugccgguuuacacuguuucuccaagccaucacagcugauaucuccuggugcuauccccaaacugccacucuaaacucuugagguaaauaaauaaucuuugcuggcaggacuaugcugaaucuccuuaggcacucucuaaucagaugucauagguccucccaauucuuagaccuuuuauaccuguuuuucuccuucucuuauuccauuuaguuucugaauucauccaaaaccguauccaggccaucaccaaucauucuauacgacagauguuucuucuaacauccccacaauaucaccccuuaccacaagaccucccuucagcuuaaucucucccacucuagguucccacgccgccccuaaucccgcuugaagcagcccugagaaacaucguccauucucucuccauaccacccccuaaaaauuuucaccgccccaacacuucaacacuauuuuauuuuucuuauuaauauaagaaggcaggaaugucaggccucugagcccaagccaagccaucgcauccccugugacuugcacguauacauccagauggccugaaguaacugaagauccgcaaaaguaaaaauagccuuaacugaugacaucccaccauugugauuugcuucugccccacccaaacugaucaauguacuuuguaaucucccccacccuuaagaagguucuuuguaauucuccccacucuugagaauguacuuugugagauccacuccugcccgcaaaacauugcucuuaacuucaccgccuaucccaaaacccauaagaacuaaugauaauccaccacccuuugcugacucucuuuugggacucagcccgccugcacccaggugaaaaaaacagccauguugcucacacaaagcccguuugguggucucuucacacggacgcgcacgaaacccucuacccgccaggcauugcuuuagcagcuggggauacggcgcaaaccaaaaccacaucacagcugcccuggggagaccagucaucaacagacagcucuugggcgccuuguugagcaaagggagggaagggcugccaggccuggagggugagggaacccuggcaucugagggacgugagggcacaggccauguggccaucagagaagacgcugaagagggaggaugggcaggggcuggggccgggccacagcgggccucacagauugugguaagcaccugggauuucacggguagccgccugaagccugcaagcccgggccaugaucagauuacuuuacaacaggaucuuucuggagaacgggugcggggugaggacgcaauugaagggagcaguuaggaggcuccugcagccggccagggugcaaagaggacagaggccauuaccugggaagagaccccugaagcaaaaaggguuuaugcuaguccccugacaguugcuaggccugcccuucccugcagaugucacaugcagggacagaggccuaacggcacgagucuccucccgugguccugcugggggcugguggggaggugucuguggaaucugagugaucugugugcauguaacucgcugacacuuaauaaagcuaggucuggagaaucaauucccauccaggaaggugaaauccucccgacccuggcugcaggagccucucuggguugcuucucagcuccacccgcuuucagagagccgcacggcucgcaggagcaucugcaucacaaacacaaccugccucaggccuuccuuucucucccgccaagggucugcuucuuucuuugugacucucagagcauggugggcuccuuccuggggugcagccuucuuggggcugugucgagcuugcauaccagaguagcugcaaagcaagugaagcggaccccaaaugaaaugaaaggaaagcuggcugcccucuagaauaauaaggcuagagaaccggaaauuucaaaugcuggauuugcauaugcacuaaagguuacuugauucuaguuggggaacucagccaccucccaagcuccaagaacaaaaacccuguucccuggagaagggagggaaggggggagggaagaaugaacgauccaauuucucauuauaguguaccugacaggcaccaaagagaggccagggcucagugaaauccgcgcauuaauauuuaaaucccuaauagucccaaagucugaggaugaaacagaaggcauaguguuggccauguucagaugccagggggcugaugagucuccccaccgcagcccauuucuguacaugcuguugcugaccugugcaguguagcagugaaccccaaucauccaaagagaggaacagugugaucuaucacagccugcgugaacugcuucgcugguagcagugggugugugcuguguggaugccuccuauagcacagauggacucucuguagcucguggucgggacucuuauuuauuuuugagacagggucccacucuugcccaggcuggagugcacuggugcgaccaugucuugcugcagccuccaccuccugggcucaagcgauccucccaccucagccuccugaguagcugggacuacaggugugcaccaccaugccuuauagucgauucuugcuauggauguuuauuuugguuguuuaacaaguauuuaucaaauuucuagguauuauggaugcagggacugaaaccacauuugcaaaaauuauaacugagaaaauguuaacagugaaagagaucuggccugacuccaucuugcuucuaaccuccaagcuguccuuguucauuccagggcacaggcugaacuaaccuugggaggaauucaguuuauaguucaacuuuguuuuuuuuguuuuuggagacggagucucacucugucaccaagguggagugcaguggcacacucucggcucacuggaaucucugccucccagguucaagugauucuccugccucagccucccgaguagcugggauuacaggugugcaccaccacaccuggcuaauuuuuguacuuuuaguagaggcgggguuucacccuguugaccaggcuggugucaaacucccggccucaagugaucggccugccucagccucucaaagugcugggauuacaggcgugagccacccugcccggccuauaguucaacuuugaaacaaaggauaacagcucuuuccugaaauaaacccccuucuugccuggggaccagucugccuuuguaggacuaacaaauuaguuacaagauuagaaauuaugguuuuggagccacggagccucuggcugcaagagucugaaccuccccacauugcuccugagaauaacaucgcuuguaaauccuaagaucagugcuugagguauuuugcagacccugccuuccaaugcagcaguugacgccacccagacagguaauaugauucaaccggcacuuugaucccacccaaggacagaagacagcaagaaaaacucacuucuacccccuaugauuucaucuccaugcugaccaaucagcaauccacaccuccagagccccuacccaccaaguuauccuuaaaaacucaaauccccaaauucuuggagacugauuugaguaauaauaaaacuccagucuccugcacagcuggcucugugugaauuagucuauugcaauucuccugucuugauaaauuggcugucuaggcugugggcaaggagaaccuguggaggggguuacaaauuugggggcucaucugugaucucccuuguggcuaucuuccagcgauucaguagccuccccaaccccccucacuggugauggauccagaggccagcccaggcggccaccuaguucucuucgacugggggcugacacuggcaccaucucuacuaauggggugcugccaacccaugguguauggauuuaacugcaauaaacaguccuggggagacguccuguaacuguagccccaucacaggguaucugucuguagccccaucauugggugucugccuguagccccaucauggggcaucucuagcucuauuaggugguaucuguuuguagccccagcaugggguaucugcccuaauuguacagagaauaggggacuuguuuggaggaauacucuugguuugugauuuagucuggaaacucuuucuggaagguguuuugcuguauguguuuguauauguggaggagaugucuaagggaauugcugaaggaaguccaucaggcucuccuaguuugucugguuggucacauucacugaacccugaaggacuugucagcagaagcucggaaguuugacagggcugccucgagggugaccauccgcucuuccaucuggcucagagaccauccuuugaauucccgguggaaggcgucccuucccaccuugaguggaguggaucaaagaugacagagaccaacgggagcaagugugagccuugccaaguugaugcugggcacugagcauagugacuaguuuugucauguguacucugcucuggccaggauggaaaauguuaauucaguuccccaugcagcccauugggcagcaucuugaaaaauugagaggcuuuugccugugguuccauaaaacagaaacggaugguuuuccuuugcaaugcgacuuggcgcccacagcuagcgugcagcgaucagggucaucaagagcugcuccguucuucuggaagcuacagagaaugggaacccagaaaccugacaugcaggcaaaaaggguaaacauuucuuaccagccaggcuucuggccccucucgccguguaugaauggaaaacaucacuguuugucuccucugcaagggucugauuaauagaaaaaaucuuaugagccuagacuuaggcuguagggaaucuggugcacucugugcugugaauacaaauccccagcuacucuggaggcugaggcaggaaaaucacuggaacccgguggguggaggcugcagugagcuaagaucgcaccacugcacuccagccugggcaauagagugagacuccaucucaaaagaaaaaagaaaaacaaagacaaaggcacaaccagcucucacaugccucagaugaaucacacauccucucuccucacucagugacuuaggagggggagucaguauucacacauuaauacgacacaccuuucuagaacaccuacuaccugccaagcauugcuuuaguagcuggagauacagcgcaaaccaaacccacucacagcugcauccucugucauggagagcaggaccacagaauaggauguggacauaggaccccucuaagcccgcuguucaauccagccuggcagacuggucaguuccaaacuuugcuccaacaaaaaccagauaagguuucccucuucucuuguuuuacguccugaaaaacuugacuuugggaccaugucaggguacccucuuuuggucuccggcauccagagggcaugaauuuuuggguucaugucgguagcuggucugagaggacaugugacagugucaugucuagccuuaagaauuaucuugaguaaaguccuggauucccaggaagaccaguguaacagccuucagcuuuagcucaguagcugaagcuuugcuauuucacagugguagccugggucugguucccagcuuacggaaugggugcucucugguuuguuauuuauguaaguuuuuuuugugugccauuuauugauucuuuccccaccauggacagcuugccuugaaaucugccuuaaauuuucuuuucucuaaacuacguuuggggagauucuaaaucuuguaaaagaaaaaaacaaaaaacugcuuaccaucccuuugagacaucuuauacuucuguaguuaagucauaaucuuagauaagacuuauuaauuuugcuaggagguuaccugugguaaaguucaaaagccagaaauacuggcugucuauccuggcuagagucugguaauaagaaauuuaaaaagauuuuguaaaaaaaaaaaaaaaaaaaaagaguucuacaguuaaaaucugcuuaauuaaaaauggauauccaaguuuuauauauauauauaaauuuauaaauauauauauuuauaaauauauauuauauauaaaacauaauauauauaauauauaucauauauaucauauauuauauaacauauauauaauauauaacauauauauuauauauuauacaauauauauaauauauauuauauaaauauauaaauauguauaaauauauauaaauauauauauauaaaugugugcauauauauauauauauauauauauauauauauauauauauaugcacacauuuaaaaggccuuugugggcugggugcaguggcucaugccuguaaucccagcacuuugagaggcugaggcagggggaucacuugaggucaggaguucaagaccagccuggccaacauagugaaacccugucucuacuaaaaauacaaaaauuagccaggccugguggcgugugccuguggucccagcuacucgggaggcugaggcacgagaaucacuugaacccgggaggcagaggcugcagugagcuuagaucaugccauugcacucuaucuagccugggugacagagcaagacuccauuucaaaaaaaaauaaaaauaaaaauaaaaaaauaaaaaaaaggccuuugugcuuuuucucuuccuggauuuuuuuuuuuucuucgaggaaugaguuuuuguuugucuuucuucucagucaacugaauuauuuccccagucugucuuccugccacucugaaugcccacaugagaggaccuaagguacuuucugacagcuggggacuccuugggaaaaagagagaaggcuccacagacccuguuuugggagaaacucuguuuuccucauaaaaccccaagaaguguaagcagacagaccccucucaaaaucuaaggcucuguucuguuuugaaucacauuacuuggccuuuuucacuuuugagggcaucaggaauuacuuuaguaggggagagagauaugugaaaaaaguugaggcuauaaagauguauuuuugguaaggaugauuauaaaaaaagaaauuuauaugagaaaagaucuuguaugguaaauucuuguccuaaaauagaacgacugauuauucacgaaagagggacacauaggacaagucagacaguccaagcauggcauagauggucucugugagucgugacaagauuuguaaaauggggaaaaaaaaccccuaaaaaaucagcaaaugaaaaaucuuaacuaaugcaucuucuucggucuauauauuuauaauguugugugugugauguuuaagagcuguaauuaauuggcuuaaaaaauaagcacuuaaauauuuuuucaaagaaauagcaacucuaaugcauuuuaguucacaugacguuaguaaucuuugguaaauaaagauaguuuuaaagauuauugaugaaauaaaacugucuucauuuggucugaauuaggcagaucagauacuguuucugcuggaugcuuuaaggucauaaguggcuucugugacuuuuguaauuguucaauuuaccuacuuuagagccauuagauuccagauaaggccuggggacauauggagguagccaugacuccuagcuaggccagagagagucagacuuuaucugcaguucuguccuguauucuaggcucugcacuugguauguaauuaaaacugcuuaaagacaugggaauauggguuuuuuuaaaagagaaaaucuucucuaauuuagagaguuuaaagauuauuuuugguugaaagacaaaauaaaacugaaaguuuaagcaaauuguagguuugugaaaaauuaacuuugugaacaacucugugugugagcaagcuggcuaaaaucgaaaggguauuauuuaauuuuuuccauaaauuaaauauuaaaagcauacugaugcagggccagaaucugggcccauauaucaaaauaauaggguuuuaugccagaugcgguggcacaugccuguaauccuagcacuuuggaaggccgacgcaggcagaucacgaggucagaaguucgaaaccagccuggcccauauggugaaauccugucucuacuaaaaauacaaaaauuagccgggcgugguggcacacgccuguagucccagcuacucgggagguugaggcagaagaauugcuugaaccugagaggcagagguugcagugagcugagaaugugccacugcacuccagccugggcaauggagcaagacuccaucucaaaaaaaaaaaaaaaaauaguguuuuauuuuugaacacugauuuguuaacaaacaauuauaaaggguuauauaaaagguuuacgaaaauguuacccuacagucaaacuaaaaucggauacauuuguuuguaaaauuuuauuaaaaacuagcuuuggcuaggagugguggcucacaacuguaaucccagcgcuuugggaggcugaggugggcgaucacguggggucaggaguucaagaccagccuggccaacauggcgaaacccagucucuacuaaaaaauacaaaaauuagccaggagugguggugggugccuguaaucccagcuacuugggaggcaggagaaucgcuugaacccaggaggcggagggugcagugagccgagaucaugccacugcacuccagccugggugacaagagugaaacuccgucucaaaacuacaacaggccgggcacaguggcucaugccuguaauccuagcacuuugggaggccgagguggguggaucacgaggucaggagaucaagaccauccuggcuaacauggugaaaccccgucucuacuaaaaaauacaaaaaauuagccaggcgugguggcacacgccuguagucccagcuacucgggaggcugaagcaggagaauggcaugaacccaggagauagagcuugcagugagcugagaucgugccacuguacuccagccugggcaacagagcgagacuccaccucaaacaacaacaaaaacaaaacuagcuuuagcauuaaagaugcacuaaugcgagauaaaauuugguuuucucuuuugaagaauauuuuuauguaauauugacagagagagacaaugaaagauuuuuauuuggcuuuggaguaaacuauuaaaaaaaauaaaagaaagauucaguuggccucaugcuaucuucacuggguuuuguuguuuagaaagcugagucuucucucuaucagaguaaagguuuuuccuguuacaaaauguuugaguuaucauuguggcuaaaugaauuacuuauggugaccugggauucuacuuugugauaucuaguguuucaaaccuuugauauuuaacaaacuucccaagaucaaauucuaaguuaaaaaaaaaaaguccccuaaaguccaaaagaggcauauuuggcuuauuugguguauuaaaauuauguaggaagcacugucaaauauaaaaaaguguuuaacuuucuuuggguuuauagucguauaacuauguuauuaguauguguuacaaaauuguguaagacuccuauaauucugauacgucucaguauauguuaugaguaauaauuauaacuguucuguuaaacugugugucacagagaugaccagauuuccuuguugacugcaucuuuaacuacggcuguccugagacuuuuguuacccacaggcaguugcugucuugguuuuauccuuuucaaaaggcaguuuauaaucagauauaguacucuaauggguacucuugaaugcaggucucugauaacuuuacaaauugugccauuggaauggaggaaaaaaaacuucuaggauccucauggagagcugauguguuaaacauuguuaauccuuuuguuuuucagaguccagaaaacuauuuuucuuuugagcuauuuacaacuuuaacaauugaguuaaaguauacuucugugagcaaaauuuagagcauauugccuucucucugauuucuccagaauuuggaaacuauuugugaguauucucaacuuauggcaguauaauuauuugugcaagggcaguaacaaucuguuuucuuuuguaauaggauacaauuagagaugccgguuacuuuaccaaggcuuugacugguacgacauacuuucaaauauaaacagacugcuuuaaggaacaaaguugacuaacagagccaauagaagucccuuggaaaagcuggccucauaccuugucuacacagucccuguacgggguuccugaacugugguaaauaaagaccgucacuuuuugacaggcccaggagccccaaauuaucuuaggaccaugagaagaaaaaauuucacccaacucauacagguuuaucuuugcagguauaguagauaaauccauggcugggcucgaggcuuuaaaaaagucuaaccugagauuucuuauggaacaaaguuucagcaaagccaauuuuaaaaacagccuaucuggcaaacaauuauucuugcuuuacuuuauacaaauaaucaggccaagcuuaauaagacuaugacuuauuuugcaaguaaacuuguccuacuacgguuugucuuuaauaaaaauaaggaugggagagggaaaaaaguguuucaaaaaacuaugauacacccugcuguuagauucuagucuuguccuuuguucuugaguuuuuauuauuuccugcaauuuggacuaaauccugaauucucugugggcuacaauucccaaacuaaugcuuucaauuuuuuuuucccacuuuucugacuuggacucaauuaaauugcuacuaccuuuuuccugaggcccugcaagcugaagcuuauucuuuguaauacagaugacaaaaacaugucaaauugccacugccuuccuccucuauaacuaaagaugccuagcccaucuccagugccaucucuugauaauggaaacagcuguuuaacugaacugaucuagucuuaggacuaggaaaacugacuaaaaagauaaggaugaguauauuuaaauuuccucuuuccugucuaccccaaucugucugucuaacaaccucugacccaaaucucucucugcuaguaaccccaugucugauugguucuuggagcuauuuaccugggucccucagagcuuaggaucaauucuacaaaagcuucugaagccaggacuuucacucuuuauccuaggacucauuuguuaaaacuauagaugagaauacuaaugccuuugucaugcaggccuucaaacccuaaccaggaaccccugaguagaagcagacagcugcaaagugguuucacuccuccuaccuuugggucaacaccuacccugacuacgcucccugucagcagaaagaagcuagagcgguuaucacucuuuucccaucuucauaucccacaguaugaaguauuaggaauaagguauuauaaaacccaacaggaggaacugaaacugucuuugcaaaaauuuuaacugagaaaauuaugauggugaccuaaaugacuccaucuugcuucuaacuuccaagauguccuuguucauuccuggaugcagaccaaacuaaccuugggaggaauucaguuuauaguuuaacuuugaaacaaugccgguaacagcccuuucccugaaauaaacccccuucuugccuggggaccagucugccuuuguaggacuaacaaauuagcuacaagagucugaaccuccccaaauugcuccugaaaauaauaucacugucauaaaaccuaagauugugccugagauauuuuguagacccuguguucugaugcaguaucugaugccacacagacagguaaucuggcucaaccagcucuuugaucccaccaggaacagaagauagcaagaaaaacucacuuccacccccuaugauuucaucuccaagccgaccaaucagcaaucuccacuucccaagccccuacccagcaaguuauccuuaaaaacucugauccccaaauucuuggagaggcugauuugaggaauaauaaaacuccagucuccuguacagccagcucugcgugaauuacccuuugucuacugcaacucuccugucuugauaaaucggcucuugucuaggcagugggcaaggagaaccuguugggcaguuacagggccaaugagacaagagccugcucugaaauggcguagagcaguaguggcucucccuggcuagagucccuggggaugccuuaaaaaugcuuguuuggggcauggcccaagcccagggucaugauguuuugaaagugaucaggugauuccaauauauauccagggcugagcaccagugacuuagaaucuaggaaaaaacaccccuuggcuugggggcgaggguggaaccugagcuggccaaggggcuaguggcccuagggcgagugacccuugggucuguugacggcucugagcacagcccucucauuucaccucuccggccuucaagggcagaggagacagcucugugacggaucugggccuggaaugcccacaggagaugccgauucugcggacaucaaggggcucccuggaaggccagccccacuccagggguuugaagccagugucucccugaaugaaagagcuucagcacagacacaggcagggaugcucacucugugggcugguuguuagccacaguccuauuccugggaccaacacccagggccauggacucuguggagucuggcacucaggaggaaggugggcuagcaggaacaucugaagcucguggcucccaugcaugacacccugcuuccuggccucccacacaggagcgggugggacaucuccaccaggcugagaaccucucaucaauuucugccagucaguucuggaagcugacugugggagcggcaauucacucagggucccuccaggagugagggacucacauguuaagaagcuaagucugccaccagccacacaagaagaccugggucucaaaucauguggucccagcaauaaguaguaagacagaucuauccacagaauccauucugugcccuccuuagccuugaguccugaaagagcuacagaugcuaggcaugguuaaguccaggaucgcaaaggccaacugccauccaaagccuaacuuggaaccugaggacaggaggacaugguucacuaauucacgcucuaaugaacuguuggaagguguguaggaaggugcucacucacaaggauggcccuucacugagggacuuggcaggcuccaaucucuuaggaaaaucucaauaacagaugagccuuugaauaacuuucuuagaaagugaaggaagcagacgcugguuguggaccaggccaaagaugcaugucccagcugccuuuccugagucaggcccugcgucacccacuuuccucagaugccuucacuucauucucauaugacuccuucagaagagcaacuguggucgggagugguggcucacgccuguaauuccagcacuuugggaggccaaggugggcggaucacuugagguuaggaguucaagaccagccuggccaagauggugaaaccccgucucuacuaaaaauacaaaaauuagccaggcgugguggugggcaccgguaaucccagcuacucaggaggcugaagugggaggaucacuugagcccaggaguucaagauuacagugaaccaagauugcgccacugcacuccagucugggugacagagugagaccuugucucaggaaaaaaaaaaaaaaaaagaagaacuguguccucacugggcugacgaggucacugucacuguccucacugucacaaggucacuggugaaugguggggccagaucugggucaacaugguccacacugauacaaaccucuuuuaagcuaauuuuguuuuucuuuauuuguuuauugagacagaauuucacucuguugcccagccuggagugcaauggcacaaucucagcucacugcaaccuccgccucccggguucaagcgcuucuccugccucagccuccugaguagcugggauccaggcaugcgccaccacgcccagcuaauuuuuguauuuuuaagcuaauuuuaaaggcagaucuuccuuauuaacauuucuggagaauaaaauguugcacaauuuacuuaaaaggaaggcagguagcauguuagaagcgauguaggagaaugacagaggcgaggcuuucagaucccagcuuagucucugacuagcugagacccuggacuucccacugugcuuccucuguaagagggaggaugcugcugucuccccugggagcauguacaacauaaguguccagcucagggucugacacugaggaagugcuggaagauuuacauuuccucccuuuuuucaauuuuuaaaaauuuuuaauuuuuauuguuuuuuuuuuuuuuaagagacgaggucucgcucuguugccuaggcuggagugcaguggcgcaaucguggcucacuauaaucuugaacuccuaggcucaaguaauccucccacuucagccucccuaguagccaggauuacagggauuacucagauccuuuucucaaguugauuuaaaaauuuuauuuuucaauagauagcacauucauauaguucaaacauauuaagaaagaguuaagaccuagguggcaauucucucuccuguccuccccacccccacaguaaccucuguaaauuucauccauucagacuccuuuuaugcauuuauaagcuaacaaaaagagaaauuccuuugcccucuuuagacaaaaauguagccagcacauuacuuauauuguccugcacuuugcuuugaucaccuaacaaaaagcccuagagauggguccacauggacucuuuuuacagcuacauggcaucccagugcagagacagaccacugucauguggccagccuccugaggagcagcggggcuguccccaacccugaacccucugcgugagucuuucacacaugcuugagugcacugauagccaaauuacccaaaauggaagcgucaagucaaaaaccaaaccagcugcuugauauucaugaaguguuagaauguuuucauguugcaacugccuuaaagccaagaugacuuuuacagaaagcauggguaaguacagguucucuugccugcgaauucagaguggcugagggugauccagccagggugguuucuggaaagccaugcagagccauguguggugugugcucucugcccuugccgucucucucucucugcaacaaaccaagguacuccaugccaggcccagggccuccaugcugaacucagagccagauuuuaagaaacacuggcuuuuguggcugaugggaagaaugacaggguuucugaagauggcaaauauuuugaaaagcaacggccaacgccacacuuccucacucugcucucgaguugcuccaagcagauggcacccuuuauguaacaccagacucugccuccuggaggcugugcugcuggaagaggcugcuaagccucagggccuggcugagaaauggcuuuuuuacugacagccucagcucaggaucacuucccuggacgccggcaaaaacaucaaacuucauuaggaaaggaaaaaaccccagcuuucuaaaugucuaucacugaaaaugcaaaguguaaggcuaguauuuggauugcucugcaccugaaguuucaagaacugauagguuguuugaagguuuacauggcuggacugcuaauuuccauuucuagaaaaccgcugacgaaaaggaucagggaugggggcaaagaaucgugcaagaauguucaccacagcauuaguuaugauagcaaaaccccuuaaaccacccaacgugccucugcaagggaggugaguaacugaugccuaaugagagaauauuauacagccauuaaaaaucuucuuugcgccaggcgcaguggcucacgccuguaaucccagcacuuugggaggccgaggcggacggaucacgaggucaggagaucaugaccauccuggcuaacauggugaaccccaucucuacuaaaaauacaaaaaauuagccgggcgugguggugggcaccuauaguccaagcuacucgggaggaugaggcaggagaauggugugaacccgggagguggagcuuacagugagccgagaucacgccacugcacuccagccugggugacagagcaagacucugucucaaaaaaaaaaaaaaaucuucuuugcaaagaauauucacuaauaugauaaaaauaaaauacguuaagagaaagaaaacuaaaacuaaaacaacauguaaggaucccacuuuugggaucauauacauagaaaggcugggacauuguuggaugauuauaggugacuuucuuuuucuucuucguacuuucucuaauuuucuauaaugaaugcacagguuaauuuacaauugggggaaagcuuccauuaaauaauacucauuuuuuaaaacguagguaagauuuuaaaaauagaauccaggcaugguaaugcaaugguuaaacagaauagaaaacccucuaauucccaaaugaagaauucccaaaauaagucauuuucugauuauccaagaacugcauuccauucugcaaagucccaacugaggcuucuaaauggcuauuuacaugaagcaagaaugucaucauuacagaacaaucugcugucgugugucuuaauagcucuccucucugucuacaagaaauggcaccaagcuagagaaggacugaggaagcuuccgggcaucccuuagauccuaggugucauuucauuagcuuaauuuuuuuaaagacaugaagucagacggugaucuuuuucaaagccugcacugaaagcauuucugcaucaaaagcauuucaacaaaaggaugugguuauaaaaccauauguaacugucauuaagaacaaaccugaaugcuacaccuccuucaaaguacccaguucaucugggauuuagaacaagaucuuucuaccccacugagagagagcuuaucguaguggaaagcacacucauuuaaacagcagguaucaccagcugugguagugcacgccucuaauuccagcuacuugggaggcugaagcgggacaauugcuugaacucaggaguuggaguacagccugggcaacacagcaagacccugucuuuauuuuauuuuauuuuaaacagcagguaucucuuugugauccugauuucaauuauuuuggauauauaucucuaaguggaacugcuggaucauauggcaguucuauuuuuaauuugaggaaccacuauguaguuuuccaucauagcuaugacauuuaacauuucccacaacaguguacaaggguucuaauuucuccacacccucgccaacauuuauuuuaucuuuuugagaccgaguuucgcucuuguugcccaggcuggaguacaauggcacaaucucagcucacugcaaccuccaccucccggguucaagcaauucuccugccucagccucccaaguagcugggaugacaggugugcaccaccaugcccagcuaauuuuguauuuuuaguagagacgggguuucuccauguuggucaggcuggucucggaacuccugaccucaggugauccgcccaccuuggccucccaaagugcugggauuauaggugugagccaccgcacccagccaccaacauuaaaaaaaacaaaauuagccauccuggcccagugugguggcucacgccuauaagccuagcacuuugggaggucaagguggguggaucacuucaggucaugaguucgagaccaggcuggccaacauggugaaaccccauuucuacuaaaaauacaaaauuagcugggcaugguggcgggcgccuguaaucccagcuacucgggaggcugagguauaagaauagcuugaacucaggaggcagugguugcagugagccaagaucgcaucacugcacuccagccugggugacagagcaaaacuccgucucaaaauaaaauaaaauaaaauggccauccuggcaggugugagguuuaucucauuguaguuuugauuugcauuucccugaacacugauguugagccuuuuuuuauauacccacuggccaucugcaugucuucuuuggagaacugucuauucaaguccuuugcucauguuuuaaauuguuuuuuuuuuugccauugaguuguuggaguuucuuauacauuuuggauacuagcccuuuuaucagauauaugguuugcaaauauucucuuccccucuguagguugcuuuuucauucugauuauuucccuugcugugcagacacuuuuuaguuugacguuguccaacuuguuuguuuugcuuuuguugccugugcuuuuggugucacaucuaaaauaucauugcuuuuucccuauguuuuuuuucuaggaguuuuacaguuucagguccuguguuuaagucuuuaauccauggguagauggccaaaaggacgaagucaggaucucagagagguaucuguacccccguguucacugaagcauuauucauaauggccaagauacggaaacaacucaugugucuacugacagaagaauggaucaagaaaauggaguauauucugaccgggcacgcuggcucacgccuguaaucccaucaauuuaggaggccaaggcaggugaaucucuugaggccaggaguucgagaccagccuggccaauguggcaaaacccugucucuacuaaaaauacaaaaauuagccgggcgugguggcaggcuccuguaaucccagccacuaaucgggaggcugaggcacgagaaucacuugaaccagggaaccagggagguggagguugcagugagccaagauggugccacugcacucuagccugggcgacagagcgagauucugccucaagaaaaaaaaaaaaaaaagaaagaaaauauaguguauucauaccaugaaacauuauuccgccuuaaaaaauaaggaaacuugccauuugugccagcaugaguaaacugagaagacauacugagugaauaagccccuuacagaaggaugaauacugcaugauuccccuuguaucagauaucuaaaggugcuaaagucauauaagcagagaaaagaacggugguugccagggacggggcgguggaggagggagauggagaguuguuguucaauggguguaaugucucaguuauguaagauguguaaguucuacagaucuguuggacaaacagaagugccuauaguuaacaauacuguauuguacacuuagaaacuuguuaagagggaauaucucauguuaaguguucuuauaacaauagcaacaaaaaaaucccaaaccgcccccaaaaccaaagaggcacaaugauuaaacucacgaaacugugagcguuaaauauguacagcuuuugcugaucaauuauaccucaauaaagcuauuuaaaacauacaaagaacagguagacuucuucuggugccaccagcucugucauuagccgugugaccuucggcaaaucccuuacccuuuauggguuucaguuuuaucauucugaaaauaaguaacaagccucuacuaccacuguguaccccucaugcuggaagacugugacguggggacccugcugaaaagcaaaucuuucauggguagaucuuagcagugcagcaaggauuuuggaguggaccagagaucagagggaugagaaacucugaauaugcagcauuuaugaugcaccugcuaggugcaggauggcgagaaagccugacacgggccugcugauggcaagguaaccaacacccccagccugcaugugggagggaggcagaggggcccagaggaugggaguaacugaaaaggugauggggcugggcgcggccugucaucccagaacugagaggccgagguggguggaucgcugaggcaggcagauuccuugaggccaggaaucaagaccagccuggccaacaugaugaaacccugucuguacuaaaaaucacaccugucaucccagaacuuugagcggccgaguugauuggaucacuugagcccagggguuugagaccagccugguuaacaugguaaaacccuaucucuacuaaaaacacaaaaaucagccaggugugguggugcaugcccguaauaucagguacucaggaggcugaggcacaaggauugcuugaaccugggaggcagagguugcagugagccaagauugcaccacugcacuccagccugggcaacagagcgagacucugucucagaaaaaaaaaaaaaaaaaaaaaaaaagagaaagaaaaggagcuggcccaaagcuggguggugaugagccuccucuugggccuuugauggcagcaacgccucucugaccuccuggggauccaccuugccccacggagaggacaccugggggcauuucuucuauguauuccuccugcuggcccuggccuuuaacacugggcucugcucucaguucucaguuuagauuuggcccugaacucgagauuucugacaucccuugggggcagcuccaagcacccgccgugugugaugccugggacucacuuggccucuuugcuguugcugguguccucuccuguuucaggcucaugagaucauucccuauccucccaucguucauggccccucguguucaacuuagaaugaaugccucggguggacaaauacaguggaaaaaugagguugaaacagccagagcuuugaaacgcagaggguuugacaguggcaccggggacugguauucuggaaggcacauaggguggccaacguuuaauuccaaagccaaggugaaaagguucaacuaacaugcagugugauccuugccuccacagaggcgucgggggucugagcuuagaggggaagguggcucaaucacccaccucuccaggacagaagccacugcucaguuugagcagggcggguggguaaaguguagguacaggaaaaacagcccaguugucaauuucccccaucaagcgcaaaugcaacaaugaaggugcacaaacacuucucuacuuacuggcauaguuuugucuccaaagaaauaaauggucuuauaaccgucauuuuccacaugucgcagacaguaucucuugucccauccaucaggaaagacaucaaagcugaucuggccuccugccggguggggacggggcacacaaaggcaaaaggugaaaaaggggcuaaugauaugucacugaaaaaaacaauuuacucuuuugucaguuaguggguugccaagguugauuuucaguacucuaguuugcuacuuagacuacuucaugcauagguucuagaaauuaauucuacauuguuuuuuuccagcauuauuucacauaggucuaaaauugaggcacagaaugccaacucagagugagaaaugcauuugcguuuaagcgcccugucaagcgugugguuuaaaggaagcaugcuuaugaaaaaucggauaccagccucauucugcugugcuugucucgggcuuuaacacacccucagggggaaaugcccggaagcagguugcauccggcauauuuugcgggaaaaaugagaaucuucacugaaggugauuuacaggcagugcucacgggcaacaaaaacccuuucaaagcuuugucagaaagauguccaucucacaguucaggaagacaaaaaacccacccacucaucuguuaaauauaaucccuuugccauuccaguuuuccuacaaccucuaccuugaugaaagcuaguaaaaugaggaggcuuugagcaaugacucauuagcacugacaagagaaaucggugugcaaagcauuuggcaggaauauucuaacaaaagacaagccugagauguccgugcugcaggaagaacucugcauuagacaccagaaacguucacacacuggcuguguaaacaacagcuuugugaacuuggacaagucucuucuccuuucugggccucaguuucuugaucuguaaaagccacccaauuggccccuaagguuccuugcuguugaaacauucuaugauuccaaaacaucggucuaguuuaccuaagggguucaauuccaugucucccuuauggaguucacuauagugcuucucuucugcccaaaggugugagaaguuccuacucuuuaguaaucaaagugcuccucuuuugaugagaggaguccagguaggaagaaugcuguuggguaagaauuuagaaccaagcccaacagcguguaagcuguuucuugacuaggcaaguccuauuauggcuaauuaugcagaaaagagagugguugguuuuugucuauagacuggacugcucauuuaaucuuccugcccaccuaaaacugcacauacuucauuaucaauagcucacuggcccacaacaaacucugggaaauggguauccaaguuuggaacacaggcaauauauacaauaccuauggaaaacgugaggccuuuuccagcaaacucuuuccguagaucugcuacaaacuuuugucuuauauuuucuuucugagaaaaacaaaaagauaccaauuguuucuuguauugcaguuuagaaagcacaguuuuaacuacuggccacaaagguaggauuaucuuauugauuuauuuauuuguuuaguuuuugagaugggggucuugcucuguugcccaggcuggagcgcaguggcaugaucauagcucacagcagcuucaaccucccaggcacaagugauccucuuaccucagccaaacaaauagccgggaccacaggugugugccaccaugcccagcuaauuuuuuuuuuuauuauuuguagagaugaggucucacuauguugccuaggcuggucuugaacuccugggcucaagugauccuccugccuuggccucccaaaguguugggauuacaggcaugaaccaccacaccaggccauaucuuauuuccauaaacccagccauucaccaaagauauuucagaaagacguacuuuaucgaguucguagaacucaaugcguucuucuuggcugcagcuucuuccaauaggggacacguuuaacaucccauuucggaauucaaugaaaguaccccugggaaugaaagggugacagaguuucuccaaaaacacguuauucauuugggcaacauagauaaacagccuaaaaucuugggaaauucuaaaaagcagaggcuaguguggucaauguuucucagcucugugcuauguaauaugguagccaugaacuacugugacuauuaagacuugaaauguggcuaauaugaauugagauuagauuugaaagauuuaguaugaaaaaggaauguaauugcaucaaucauguuguauauugacuuuguguuaaaaugcucauauuuugagccuggacaacauggcgaaacucugucucuacaaaaaauacaaaaaauagccuggcaugguuaugcaugccuauaaucccagcuacucaggagguugaggcaggaagauuccaugagccugggagauagggguuauagugagcugagaucacaccacugcacuccagucugggugacagagugagacccugucucaaaaaaaaaaaaaaaaaaagucauauuuuagaaauaucaggcuaaauaaaauauauuauuaaaauucauuucaccucuuccuuuucauucuuucaaaauguggcuacagaaaauuuaaaauuauacauagcucacuuucuauuucuguugcacagugcugcuacugggcagauaauuuugugguuaauaaagagcuaugaaaaugauuuccagcacuggcaacagcagucauuuccuagaagaguuugaaaauacauguaccagacaucuauuuugcuacggagcuucugaacagacugauaguaccaagcaaagcuacacagaaaaaggcucugagaauuguccaacgagccucaguaauaacugaggaaauucaauuuacccaguagcagacagcuccuaaauguuugauuugaucacagaaaaugagaagcuaacauuaguuuagucacuucaaaugacgauguuuaaagauguucuuuuggcugggcgcgguaccucacaccuauuaaccccagcacuuugggaggccaaggugggugaauggcuugagcucaggaguuugagagcagccuaggcaauauggcaaaaccccguuucuacaaaaaauacaaaaauuagccgggcaugguggcacaugccuguauucccagcuacuugggagacugagacaggaggauugcuugggcccgggcaguggaagcugcagugaaccaagaucguaccacugcacuacagccuggguaacagagggagaccccgucucaaaaaacaaacgaacaaacaaaaaauaaaaaacaaaaaacaaagaguuuuuuuccacgguuuccaguuugagucugaaaacaguuucuuuggcucacaccuguaaucccagcacuuugggaugcugcggcgggcggauuccuugaggucaggagucaagaccagccuggccaacaagaugaaacccugucccuacuaaaaauacaaaaauuagcgggacaugguagcgcaugccuguagucccagcuacuugagaggcugaggcaggaggaucgcuugaacccgggaggcggagguugcagugagcugagagcaugccauugcacuccagucugggagacagacucugucucaaaaaaaacaaaacaagcaaacaaacaaaaaccccacaaccaaaaaaagaaaaccacccaguuucuuaaaaguucagauaacuuguaagcuagauaucauucugaccaaugaaauuuaagcauuuucugacaaacuaugcagugaaaagugucuuccaguucuaaacgcugaugccugggaacccuaugaaacauuuucccucaucuuuuucuacuauuuuaaucucacagaccugauguccuggcacuggccauuggaaauaccgagagaccacaugccacgugcagggcugaugaccugauuccaugucaguguggccucuuaggaggcuguguggcucugggcaccucuccaagccuccucuuauucaccuacagaaaggcuaauggcacuugcucugguuaccuccaaagggccuuguuaaaaaucaaacaugccaguuauguaaagguacuuuguaaacugggaagcaaugaauacucauuaaaguaaaaacagcaaaaucucaaucgucuggauccucucuccuauuuugcucaacuugcagagaaagaggcaaaugauguaacaaaauaugcgagccuaaaaaucucucucaauaaucccauguccaggccgucccggaguuggcagaggcccagccuguccucuaccacguguguaugagcacugaggcacuaggggacgggugaccgugccccgggugacccuagggcuaaagguccuaaugaucagaaaaagagcucaauuaaugcccccccacucaaggacauauucuucuucucauuuccaaggcacagagagaaguugaugcaguuuagaaagccuuccccaaaacaaggcugaaggugguuuacuaagcaaucaguuccgcccuaaagaccugggcucucugaagucuuacugcaucugccuggccguuguggggcauguaguuaguguugucaggcaaauguggacaaauguggaucaaggugggucucaguucugccuccuggauucaccaggucucuucuacuguucuggaauuauggcucuccacaucccucucccucgcuaaaugauacgcucuuugaggacaggauuaugccuuuuuuuuuuuuaaauccucccuuagugcucagcccaaaguaaaaauggaacugaccugggauauuuguauauuuuaucuuuucgccauggaaaauuucuaacacacacaaaaguaaacagaauaggauaaguccucaugugcucauuacccagcugcaacaauaaccaaguccauguccagccugucucaugcaggccucccccucggcuaagggacauuccugcacucuggcuggagaugcugagcaggaggcgcucagguuaugaauccuaauagugugaagcagccucugaaguacacccagcccugaaauugaauugccacuuaauuccaacccugaugauuaagguguuacauaguaaguguugaaaacuggggguaaaaaugagaaggauuucaaagaaaucacuugcaaccucaccaucaagaaauagccacuguuaacauuugggucuauuuccugccagucuuuaaauuuacugucggcauuuauguucaucauuauuauuauuacuauuauuuuaaaaauggaacugagauaauuguacccauggcagaagguagguccccaaaccaaacauuuaugaaagccaggggcaguggcuaaugccuguaaucccaacauuuugggagagugaagugggaggaucgcuugaggccaggaguuggagaccagccugggccauacggcaagacccuaucucuacaaaaaauuaaaaaauuagucaggcauggcggcaugugccuguagucccagcuacucaggaggcugagguaggaggaucacuugagccaaggagguugaggcugcagugagcuaugaucaugccacugcacuccagccugggcaacagggcgagauccucucucucaaaaaacaaaacaaaacaaaaaacaaaaagaaagccuagggagacagaaaaugagagaagcagucugugacuggaacaaauguccaugagucagguggcagcugcucagguggcaccugccggcagggaacugggagccggaguagccaggucucagauuugccaacagaagccagaaauccagauguuuaaaacauaaaaucaggcugggcaagguggcucacgccuuugacaccagcaauuugggaggccaagguggguggaucaguugagguugggaguucgauaucagccuggccaacagagugaaaugccaucucuacuaaaaauacaaaaaaaaaaaaaaauuagcugggcaugguggugugcgccuauaaucccagcuacucgagaggcugaggcagaagaauugcuugaaccugggaggcggagguugcagugagcugugagauccugccacugcacuccagccucggccacagagugagacucggucucaaaaauaaauucauaaauaaauaaaacaaacauaaaaucagacuuuuacaugauggcaauuaauccgauuuucuuuaacacugcaggccaaccagauuuggguuuuacguggaucuggcccgaaggcuuccugucucagacuucccgaucuaggguuucuguugcuuuuuguacaugcugcuucacugcuguuuccucucacugacagccuuugaaagcauauggucuucaaugguuguauaaauuuccaucauguggauaagccaucauuuacguaaucauucuuguacuguuggcuuuguggacuguuuccaauuauuccuuacuaagugcugggauucggauuuaaauucgcuggcccaugguggcuacugaacccugcugugaaccagcagcaccagggcagccagagaaaauguggauuuccaagcucggcucucaggcuuucugaaccagaauugccaaggggcgggcuaaauaucagacuuuguuuuuaaaacucuuuaggugauuuuuauaauccuauuuggagaaugcccacauuagcccaccaugugacacuacgcuauguuccugugacgccucuuuguuaaaagcaaacccaccucuucuucgggaguuuaauuuucgcaauguagcucagacaguaguugauuaaaucuuggauuagggccucacccagaugacuuugaauauucuagaugaagaaaauacuugaguuacuugauuuagcaggagcauuuucaaaacagcuucauagcaaacccagggucuucagccacgauugcugaaaaucaguaggcugauguagcagugauggugacaugccccacugucuguuuaauuccuucucuuauuucucuggucaaaagcauuaggcaagccagaaaagcuuuagucaaaagcauuuucugcuucaucacccaagauuuuuguacucauuauuguucaaaugcuuccuguaagguccaaagagcuuacugcugccacuuuuauucaauuaaaauaucuccagauauugacagacaauauauuuguuccacuucggcauucucuuaugucugaauagaaugaucuuacuacuacuaagagcuacacaguaccucuuaaaaaugcuuauagugcccaggcguggcagcucacaccuguaaucccagcauuuugggaagcugaggcagguggaugacuucaagucaugagcucgagaccagccuggcaaacauggugaaacccugccucuacuaaaaauacaaaaaugagccgggcaugcugguggaugccuguaaucccaccuagggaggcugaggcacaagaaucauuugaacccaggaggcagagguuacagugagccaggauugagccacugcacuccagccugggcaagagugagauuccaccacgaaaaaagaaaaaagaaaaaaaaaaaugcuuauagugaagcagucugcucuaguuuuaucaucauagaaauguuauuaauagauuuaaagccaggcuugguggcaugugccuguagucccugcuacgugggaggcugaggcagaggaucaccugugcccaggaguucuaggccacugggauugcaccacugcacuccagccugguuaacacagcaagaccccaucuuuuuaaaacaagaagaaaaggcugggugugguggcucaugccuguaaucccagcacucugggaggcugaggugggcggaucacuugaggucagggguuagagaucagccuggccaacauggugaaacccugucucuaccaaaaauacaaaaauuagcugggugugguggcgugugccuguaaucccagcuaugggggaggcugaggcguaagaauuguuugaaccagggaggcggagguaggcggagguuguagugagcugagaucgugccgcugcacuccagcuccagccugggugacagagcaagacuccgucucaaaaacaaaauaagaaaagagagaaauauuagauuuaaaaaguauaaaaauuuaguuaucaauguagaauauguaauagucacaugguucaaaaugcaaaacaaaaaauacagaguaaagauucauuucuacccguuccucaucuuccuagaggcauucauugugaaaugcccuuuuagaaaacacuuuuaauaguauauaguaauucagauacucaagaaccuaccugucuacacaagaguuucccaucuuuguaugcuaccaagccauuuucuggaaacacauaaucguauuuuucaaccacuacaaucaaaaccaaaaaaacacuuagaaugcaaagaaucaaaaccuguguuuuuacuccuugauuaacaaugaccaccaauaaaaccgcuaaacuccagcaaggacugugaaagacuaucucaucuuacagacuaagagaagaguauggaaaaaaguuccuuguuuuuuuaauggcucuuuuugguuacacauuuaaacgaugaugacugggcaggagauuagggacuuggugacagguuaucuuaugucccugacuucagccugacugucuguagaggaagauacucguccaugaugcugaugguucaccagcagcaaccagggcagugugaaaaugcagauuuccaagcuuugcucucucgcuuccugaaucagaauugcugagggacaggcuaaauauauuuuuaaaaaagcucuuugggucgggugcgguguggcucacaccuguaaucccagcacuuugggaggcugaggcuggcgggguuuuacuaggucaggaguuccagaccagccuggccaacauagugaaacccccgucucuacuaaaaauacaaaaaauuagccaggcaugguggugugcgccuguaaccccagcuacuccggaggcugaggcaggagaauugcuugaacccaggaggcagaggguucagugagccaagauugugccacugcacuccagccucggcaacggugcaagacucugucuaacgucaaaaaaaaaaaaaaaaaaaacaaaaaaaacccaaaaaacaaaaaacaaagcacuaaaagaccuuugguggccaggcacggugacucaugccuguaaucccagcacuuugggaggccaagguggccagaucaccugaggucgcaaguucaagaccagccuggccaacaugguaaaaccccgucucuacuaaaaauacaaaaauuagccgggcgugcuggugggcgccuguagucccagcuacuucggaggcugaggcacacgaaucacuugaacccaggacgcagagguuacagugagccaagauugugccacugcaccagagaauaagacugucucaaaaaaauaaaaauaaauaaauaaauaaaauaaauuuuaaaaaaagcucuucagugauucuuauaaucaguuugguuuggaaacuauccauguugucaaccuuaaugaagggauucucaaacuucagguaccuguuaaaaugcagauccccuauguguuggguggggaccccacacucauauuuuaauaagcuucccaggugauucugauacaggugggccuucaacugucuuuuggccugugaauguuuugauucuauuguugcaugucucugacaggugcagacacuaugcuacacuacacaaaacuucccugagcaagugguuaaauacacaacuagaugcagaaagggcgaucaugagcagguaacaggauuuucagggcuucgugauccccaguaugcgguuuauagcauuucuaaguaggagaucuaccaggaaaaugaaguggaaguggaagagagaguuuuaaagagauugcagagauuacucuucuaguaauggugauccuauaaauacaguccauacagauuuggacuguaacauauuacaucuuugagaacaguaguucucaaacggggguaauuuuacacagaggucauuuggcaaugucuggagacauuucugguagucauagccguaugugugcguguguguaugcugugggcaucuaguggguagaggccugggauguugcuaaagacccuacaaugcacaggacagccuucauaauggagaacuaacugguccaaaauaucaauagugcgaaggugagaaaucuugcucuagaggagcugguuccaagaugugaggacucuggggacaacagggguuaaaagaacaaucaauucauccaccucuccacuuauaauuuuuuuuuuuuuccaagacggaguuucguucuuauugcccaggcuggagugcaauggugugaucucggcucauugcaaccucugccuccuggguucaagcaauucuccugccucggccuccugaguagcugggauuacaggugcccgucaucacgcccagcucauuuuuuguaguuuuaguagaaaugggguuugaucaugucggccaggcuggucucaaacuccugaccucaggugauccauccgccucggccuccccaagugcugggauuauaagcgugagccaccgcgccuggcauccacuuacaauuucuuacaggccaggaggcccuguggcuauggagaugaauaacccauacuccugcucuucaaaaacauauaaucggauaguuuacaauaauuacagaaugcuacauuagcaagguuguacacuagaaucucucagagguacucacugaaauaggauucccaggcuccacagaccuaucaagucagacucuccagugaaggggucaauaagccucucugguuuuucgggguccugugcuggagauucuguuucagugauggggaggugaggggggcugucagagggacaauaugaagaccggucugacuggggcuagaagggcugucaacggguacaagcaagaaguauuccaggcagagagauuaucaugugcagauacagccacugaccuuucuaggugaaucuacucacacaucugaguacccaguucuccaucaguaacuccagaaauguacuggauuaaaagcagaggaaaagcaaaggccaagaaaauguuucccaaaaaaggaagcagaaagcccgccauauggggacaagguuuuagggcagccuaugauacuuggcaacaauauccucauaagaaguuaaucuuuuaccagauguaauuagcaacccaucauuuaccaucauuucccaguugcuccugcacuuucucaaaguccgauccgccuaccacuccgauuuugaucuucugccucaauuuuuguaggaagucauccauuucuuugguaauuuucuaaauuucaagaaagaaaauacaacagucauaagccacacaauaaucaggagaccaaaacucuaaggguaacacaaguacauaagucuuauuuucuuauuuaaaaauuaaagaaaaaauuuuuuuuugagauagggucucacuugucacccaagcuggagugcaguggcauggucauagcucaucgcagccucgaccucccuggacuccggugauccuccuaucucugccuccugaguagcugggaccauaguuaugugccagcacaccuggcuaauuuuuuuauauuuuguagagacuaaguuuugccauguugcccaggccagucuggaacuccuggguucaggagauccaccagccuuggccucccaaagugcugagauuacagguauaagccaggucuauaagccuuauuuucauacaugccaauuaaguuaccagcucuguacauaguucaaauauuuuaguuguaacugggggggcaucuuuaccagaauaaacuuaaguguuauuuuuaccaaauuuuaaacacagguaauauguuaguagcuguugugcacugucccagcuauuuuucuaugcauuuauauacccaucuaugggcacauauacaaauaggucuuauuuuugaaacauaaauggaaucauguccugugcagggacuuugguuuuucagcacuaugcuguggugaucuuuucaugccaacacagaucuagcucaucauuccuuuuaaaugcuacacuauacuccauuuauggauuuaaguuguugauuuuaaaauaaaacaacauaaugaaauuaaagaggaagcuuagggccagacauggaggcucaugccuguaaucccggcacuuuaggaggccgaggcggguggaucaccugaggucagaguucgagaucagccuggccaacguggcgaaacccugucucuauuaaaaauacaaaaauuaggcgggcgcgcuggugggcgccuguagucccagcuacucgggaggcugaggcaggagaaucacuugaacccgggagucagagguugcagugagccaagaucgugccacugcacuccagccugggucacagagcgagacuucgucucaaaacaaaacaaaacaaaacaaaaaaaaaaaaaaaaggagaagcuuagaauugauuuuauugcaaucacccaaaacaaaacaaaaauguaaaagaguaagauaacuagauuuuuuagucucuucuaaaagcaaagcuccuaucuagaaagaguggucuuagugguauaaucuuaugguaaauuccaaacugugugauaauuuuaaaaaaguuauaaacuaagaugaaaaaauagcccuacauuaagacacaucacaauguauuuuuacaagucuuauaacucagcacuuugagcaaucucaguuguacauuuacacugaaugucuuuuuuuuuuuuuuuuugacacgaagucgugcucugucacccaggcuggagugcaaugguguggucucggcucauugcaaccuccacuuccuggguucaagcgauucuccugucucagccucccagguagccaggauuacaggcgcccgccaucaugcucggcuaaucuuuuuguauuuuuaguagagacuggguuucaccauguuggcaaggcuggucucgaacuccugaccucaagugauccacccgccucagccuccccaagugcugggauuauaggcaugaacuaccgugcccggcugaauaucuuuuuacuagaaauuuagaaaauacaaaaaaccauuuaauucaaccucaguauauaaacacuuggaguucaaugauuuuucuuuaaaaaacuuuuuuagaguaauacaugaaugugauuaaaauuguacagaaggguuuguaauagagugcaaucuuuucuacucucacaguggaaucuggaccuauuagacagaaucuagaauuggaggaguggccuuuaaaagucagaacacgguggcucacgccuguaaucccagcacuuugggaggccgaggcggguggaucacgagguccagagauagagaccauccuggccaacacagugaaaccccaucucuacuaaaaauacaaaaauuagccaggcgugguggugccugccuguagcaccagcuacuugguugccugaggcaggagaauugcuugaaccugggagguggagguugcagugaacugagauugggccacuacacuccagucuggugacagagugagacucugucuuaaaaaaaaaaaaagagucagaacugugaaaaucagaaaaucagaagcacuuuccugaauggcauacccagugacuagaacagcuuccaccuuagcacagauaggaaauggcaaacuugacaggaaccaauauccugaggcccagagacuuguaccagguuggcugugugaaacugaggagguuaguucuucacugaguguguuuccuuauguuuaaaacgguaauaacaacuauccuaccugggaagaaagauggaggaagguugagaggguucagugauaugaaaaaggguggcaauguaaacccuagaccacuauggcccacagaccacauugggcagcuguuuguuuuuguaauaaauaaauaaaauuuuauugguacacagccacucuuauuuauauaggguuuauggcugguuuugcacuaaaguugagugguuacuauagaccacauagucagcaaagacagagaaguauuugcuauauggcccuuuacaaaaaaugaauuggggaccggaguuuuagaccacuaugggcuuuuaacaaacccaagugugugaucacugaauuucagaaucagaaaaagccuuugaagaacuugggaguugagcgucaucacuagguaaaucaaaccuguggcugagaagggcaaaaugauacgucuaaggucacacgcauuugaccuggacuucuggagcacaccauuguuaccaccaagcgaaaacuaugaggggugaggguagaagcugaggauagugagaccauugggguccagucucaaguugaaauggccaguguucaguggccaauuucugaaaaggggccaggagagccucaccucaaggcugaucguaacugaaacuuaucugugccuguagcagcaaaaucugaaaguggaaagcaaguuuccaagggcccaaagaggcucucagcgggcagccuguaauaaccuagggcuccuccaucucccuaguccauugcaggggcuggagaugggugugguggagguggcuacuauuuacugaggccuaguguguuguguccaacauacuuucaagaacuuacacaaucucauuugauccucacagacaccauauggaacagguaacauccccauuuaaagcuguagauguugaggcucagagagguuaaugacucgcugaaggucacacagaugucaagaggugaagaugagacuccacuaggucgguuugaccuggaaaccuguuuuuaauaucaugacucacggcacagcccauugguuacaggauuggggccgacacauagcugauaagggggccugaucuuggguugaaauccuggucuaucagucccgagcacuagcggugaguccagauuacauuuuccaaccuagcacaaguuuccugcucuuaagaguucuucagccccgucucaucuuuccaagcaccagagcucuucaagagcugguuagggccucccucucauuccuccagugcacccagaauaggguucagcgccgugaggacguaggcgguccuuagccaccccuuggcgccuacccuggguggucgauagccccaacugggaacagcacgggcuccgcgucggcugccagcagcccgccggccgccacuuaccugccgcggggcggugagggucccauccacgucgaagaggcagagcgcugggccaggcgcugccauguccccaguuucuagccgcaccuuacaagacacguuggcacgaggaacucggcccggaacuuccggguuc

SEQ ID NO: 192599 - RNA, 52261 nt, Homo sapiens
gaggggccccgccgccuagaggguggagggagggcgcgcagucccagcccagagcuucaaaacagcccggcggccucgccucgcacccccagccaguccgucgauccagcugccagcgcagccgccagcgccgggugaguugugggcgcacccagggcgcggggcgacaucgggggggccccgggaucguguacgcccgggcagcagggacgcgaccccuccacuuacuggaccgggagcagcccccggaauuggugacaguaacgggagggccgaggugccacccaugccgccgaccucuggucugcgccacgcucgcuccggccccagaauuccacuucgccaucccgggacagcuucccacgccuuuugagccgaagcaggcgggaaaaguuuggggaggagucagggcgccuccccucgccccgccggacuuacacccggggcucuuggaguccagggagauccccaggucgcgugagggauucccgggcagcguccccagacucgccucgcgggcaggacuggugcgccaggccgggccagcggguccuccugggcugcguaccccucuaggcccccgccgcugcuccgucgcgcccccgagcggcgaggagcgacuucuugggggucaggaacgguggaggagccgggaggcgcugcugggaugacaccucucucccugccaacucuagaagggcuuggggggcuuuaaagaggcgagaccgcacccauguguuccagagguaggagaggcugcagcucguaguguguauucuacgcccuccccaaauccagagaucugagcacgcuccagggaggucuuuuaggugaagauguggggcuggacauggggacuccgaagacaccacagggcaaagcucucccuccaggccagcuucaguuuuggggaagggagcacugccccucccaagcuuugagggugugugugugugugugugugugugugugugcaccuugaucuuauaauucagcugugucuaaguaaggggcuuggagagggacuuaagaagccuccaguucaaauacagugugauuccacuuuuaugagacaccuagaauaggcaaauuuuauagacagaaaguagaaugaugguugccagggccuggggguaccugggaaccgggaguuacuguuuaaugggacagaguuuuucuuggggaggaugaaaaaguuuuggguauacauaguggcaaugguuacacaguaucgugaagguauuuaaugccacugaguuguaugcuuaucaucgguuaaaaugaugauuaugauguuaugcauauuuuaucauaaaaauuuuuuaaaagccgccuuuagccaccucugcacuccagucugaaucagagagaaaucuaagaaccgacacauuauugcugggcaccucuuccuggaauucggccuucaguuaagaaagcuuaaagaggacgaggaagggacgggguccugguuucccaggagucacacaaggggaaggauggcgaccugagcugcuggagguuugcaguuggcuggugcucgcccuccaucuccguuucucccugggagccucaccccugagcuguuuccagcacgcucuccuguugcaaguggggaaacaggcuagagaucuaagucgguuugcucaaggccacugagcugguaaaugcaaagaacuagaccuugaaccuccaucugccucccaagcccuccccuucuuuccaccuggagaugcccugcugguuugcagggaaugaggggagacccuucuggggaaaacagggcguggaugcccacgggggccuuggcaaaugccaagacuacagcccagggagaggcguggagguggcaggaaggugcagaaccuguuuucccacugaggguuuuuggaucucaccaccuccaucccauggggagccagggagucgaguaggaggcagagggcuggccacauagccuggagccuccucugccccucaaguggagagauugaggugcgccugaaauccagagaauguguuuguguuggaaaccacggagucgaccagcugagugggugagggcagggccaggcggaagcgucccugugaggagggugaggcuuggggcugacacugccccaccucgggcuggaggagggggugcacccgcucuggcuggcaccaccccagauuagggucuagcuaaugaggggcuaaaagggcuugguggcguuuuauuguggcuauggagcacauccauuuagcaaaccgcccccgcuucuccacccucaccccaguaauggcacuuaaauccuuucuuccuggaacggaagugaauguuucaccucaguaucuuuucucugccucucacauaauaucuucguaguaggagcuaaaaccacaugcauaugugcacagacuccccaauuucccgcaacagguaauuaacagggaggaucaaccagcccauuuuucacccuaggcauagagugacacucuccugcccucgccucugcuauacagccuuccaggucagugagggcacagcaaaggccacuucuuugucauaguaaacuccgccagacgggaccaggaagggaagucugucgagaugaaaauauauaaauguccuuccaggccagaugggcuggcgcuggacugcuggcugcuuggcgagguuuguuugggaagcagauguccagccucccuccuuuugccgggaggggggggucagauaauugugugugggggggugggggggacaacauguggcugcuucccagcucuguggccaaguggggacucugacgcgggcuacaggggcuaagguggggacagggcagggcucuccagccacgggaguuccagaggggaggcggugacguuacuuacccaaaggugggguggggcccaggcacugggauuaagggagcagaucucucccagaggagagaguuaaaggccagccucgggaugccugugcaggagggguguguguguguguccgggugucucaggagggcaggugauuggcagcagcagcuggaaugaaggaagagggcaguuggcaucauagaagggauggaggccugacucuuggacgauggccucagcaugugcagggaaggaauggggauuggugugguggugacaggcagagcagucuccccuucucaccccaggaguggugaagccuggcucccugcagaaguuagccaaagaaugcaauuucagcagcacuguggcaggaaucagaugcaucuggcucuuguuagggacaggccaggggggagucuaaaaauaucagaggcagagcugccacccagcgagagagugccgggcugguaaccugacaccugagcagaggcuggugguggugaugagggcaccuguccugcacggcuccagagguacucaugcuccuucaggugccugaaagggugagagcucacugcauucgggacagcccugggcuaagauuggagaauuucagggcauaaggaccuuagaagucccaguaugacacugacagcuagggacacucagagagguggagugacuugcccaggucacacagcaauuuggcagccgacccaggacuagaucuaggccacagcugaggggaguucagugggauuccaggcccagguccccagggccugggacccuuauagcacgugucaucuguccaggaggcuggauuuccgugcucccgugcugaugggacaauggugagcaagagcuccgcucaggcaguaggucacuucccacugagcacugggucgcucccgggcaaagcuguugaacccugggaaugcuggcccaucuuggggcgggauauagggaggaaggaggcuggaggagaacuggccaaaugagucccucccuccuucccgugcagagacacuguugguuuuguucaugcaguaucuccggugcuuaaugaguagcugcuaaagugaauaauugaauuccuggggcccucaucuuccuuggcaagcugggcuucuguugaucuaaaagggacugaggaugaagaagagacuucuccgguuccugcucuuuagggacaggcuagaugacaucagcuucuagaagcuuccuggaacucuggguccagagcugagggaggggucaccagggugauauuugacaccaugauuguccugagaaaucuaggaugcaaaaucgccaucaccaugcaggauauacagacagacaagccaagcgucucagugcagaccgcucauagucuuaagaucaagcaaguuuuucccaauagcaaagucgugcacuuugaagauuucucuuuugaugaccugaucacaaacuucucugaacugucuuuccucaaaaugcaaugaauuuaagaaauuugcagugaauaaauaagaaccaaaguuuuuuuguugaucuuaugaauguuuuccaaaauguguuaccacugguggcacacaagauaauucucaaaggcccauggcauaaaaacagaaaagaauaauuaugucuucuucuugauugguauugggggaaaaaauguaaguagcacacaaacccaugguuucacagauacuucugcuuggguugaaacaaaaguugauccuguaaacuuuaaaacauuuuaagauacucaaagaauuuaguuaauaagcacagugguccuugcuuuuggcaaaaaucugaguacuagagugccugcuuuuggggagauggcuuuauaagagggccugggauggacgugucacacuuuuuggaaacaugacucauccugaaauaucugagagcuuccagaccaagcccuucuuuugcaaagaggccccuauguucagcuucagaccgagaccugcaacuuagcuuccaggggagucccuucaucuuuaaugagggucaugauuccacucugaugaccuuugccagcugucuguggaucagaagagaugauauauugaugcacauggaaguggcuugauuuguuugugguuugcuugaaccaaaggaaggcugagggagaggcuggcuuccucacuuuaaucuugauggguuauuauuaagcaacucugugcagugagcugcugcaggcuuuggcaauacaguggggaauuuuccugucuucagaggagguuaucaucuagcgaugggggugacaaguccaagaaugcaagcuccucacgccuguaaucccagaacuuugggaggccgagguagguggaucacgaggucaggagaucgagaccauccuggcuaacacaaugaagcccugucucuacuaaaauuacaaaaaaauuagcccggugugguggcgggcgccuguagucccagcuacuugggaggcugaggcaggaaaauggcgugaacccgggaggcggagcuugcagugagccaagaucacgccacugcacuccagccugggcgacggagcgagacucugucucaaaaaaaaaaaaaaaaaaaaaaaaaaaaaaaaaagaaugcaagcuccaggaccaaggccaccagaugugguuucagggaagcccaccauauguggugugcaaagguuuccuuaagccuguaguguuggagaugggcuugggaggauauuucaaauuccccaagcagugaugguuucagaaaguucaggcaacaaggaacagugagagaguaggcagagguuagcuggaugugguggcacauaccuguauucccagcuacucaggaggcugaggcgggaggauugcuugagcccagggcuucgaggcugccacuucaagucugcugccacuuugaggaugcagugagcuaugauuguuccacguacuccagccugggagacagagugaaacccaucucuuaaauuaagagaaauacauauaugggccgggcacgguggcucacgccuauaaucccagcacuuugggaggcugagguggguggauggugaggucaggagaucgagaccauccuggcuaacauggugaaacccugucucuacuaaaaauacaaaaaauuagccggcaugguggcacacaccuguagucccagcuacuugggaggcugaggcaggagaauggugugaacccagagcuugcagugagccgagauugugccauugcacugcagccugggugacagagcgagacuccaucucaaaaaaaaaaauguauaauuuuuaaaaagaaaaggcagagauugcgagcagggacccugcuggaggagcagugggugcaugguuugucuucagugcugaguguaugaagggagggagauggagcagggagggaugagggggggccacagugugaagugggcuucccuuccacauccccaagaaccuggcuaaggaggcaggcgugaggaugcucacggagcauuauuggaauagaauauccaaugauaggugagaaauagagaaaaggaaaaguggaagcaaccuaaauauccaucagccauuuugcagaguauuuuacugcaguuaaaaagaacaaggggccgggcgcaguagcucacgccucuaaucccagcacuuugggaggccaaggcaggcagaucacuugaguucaggaguucaagaucagccuggccaauauagugaaaccccaucucuaccaaaaauacaaaaauuaguugggcuugguggugugcaccuguaaucccagcuacuugggaggcugaggcacaagaaucgcuugaacccaggagauggggguggcagugagccgagaucaugccacugcacuccagccugggugacagagcaagacucugucucaaaaaaaaaaaaaaaaaaaaaaaaagguuuauccauuguacccauauggaaagagcuuuauggcauuacugaguuuaaaaaaagaacaaccaggagaaguauauguggaaaaguguauuauucauauaaacauaaacagaaauucuuguuguauuuucuguggccucacauguuuauacgaggaacaaugucuggaaggagacaucggaguagguccaugugguugucucugauggggugguagggaaggaacuggauugaaaggauacaaucuuaucucaagccuuaucuguaaccaagagaguaucuucaggaauuacugacuucaauaauaaugcccucauuuucccugagcuugguaagcaauggagguugugcaggugugaggauggggagagaugaugccuuuggcuguggggggucagagacuccauggauggaccaguuagggacuguuuugaaaauccagagacaaggaaaugaugaccagugugagcaggugucauccaguccacauggagcaucccccuuggaacaucacauugcagaugccaaugaacauaauguguuuccagucuggaugcuguucauggggguuaaccguggccaggugugguggcucaggccuguaauuuuagaauuuugggaggguuaggcaggaggauugcuugagcacaggaguuuugagaccagccugggcaacauaaugagacccugucucuacaaaaaaauagcaaaauuagccaggcauggugacacacaccuguagccccagcugcucugaaggcugaggugggaggaucgcuugaguccaggaguuugaggcugcagugagcugagauugugccacugcacccuagccugggugacagagcaagaccccaucucuuaaaauaaaaacaaaaaaagccaaaauaaacccaugcugaccacucccuuucacugugaagugaggguucuguuucucucauagaacugauggaggagaugcuuuggggucccaguugucuuauaguggacauuugucuuuggaauggggaugggagcuucucuaacucaucacaguuuuccagccuugagguccucauccgucccagaaugagugcuuaguaacuguggcaugaauaacauggugucugcugaggggugacaggugcauucugaagacaguaggcagaugccagugggaucagagaauuggauugcggggugcuacaggugggcuguguacagacauguggagggucgaggaggugcuauuuggaaacuaacucccaggcugugacauuuauucuggagauaauccuuaauaccugaacuugggaguucugugacaggucaucuauccugauuuauuccucacguguucauucuaauauuuauuggccgcuuacuaugugccggguagugaacaaagauggacucggccccuguaauggaauuuaucuagcaguggauggaagaucaucugugggagggucaagagaaaccuaaaucuuuuuuuuuuuugagacaggaucucgcugggucacccaggcuggaguguaguggugcagucacagcucacggcagccgcgaacaccugggcucaagugauccucuguccucagccuccugaguagcugggaccacaggugcacccagcuaauuuuuaaauuuuuuguagagacuggggucuugcuuugucacccaggcagcucucgaauuccuggccucaagugauccucccuccucagccucccaaagugcugggauuacaggcaugaaccacugugcccagcugcaaccuaaaucuuuuaagggucuuugcccuugucugucuaggguacagaagaaaaaugaaaaauucccucuuucuccugcucccucauugacuuuuuugaauauauuuagaucaucaggugauaugauguuuugaguaaaauguggccagggagccuugaguccucucucuuauuaauguggaaagugccuugaaauucagauggauggucaugagcccuaaagcccagggccuagagcccaggagaggcugacagcaguggaccaggcugguguuugagccaacagugguggccucucaguauacaccacuaccgcccaucacuggcuuacaguggaagccuggagcaguccucugucucuucaugcaaaccuucaguccuucuggaauccauccccucucuucaucucaguggcuucuaucuugguccagaccgcugccaucuuuugccuugacaauugcacaagcuccaugaccuguaucccugcagccacuauggccuugcaguccguuucccauacguauccagaaggaucugauagagacacaaagcugaccaagucacucuuccccugccccacuuaaaauucuucaguaguuucaacugcuccuaagcaaaaaccaggccuuacaugaucugacucagagguccuuggcugacugaccuuccgaaucuccuggggaaucuggauagaaugcugauuuccuguccccaccugaaaguaaugauaucagaaucucuggaggcaggggccagggcacagggguuuaaggugcccccagugugguugguggugagacguacuggucuaaccccuucucuggacucaucacucuccccuguugcuuucuccucuagcccacucuuuuuucuuaguuccugcaacucuuuuuuuuuuuuuuuuuuuuuuuuuuuugagacggagucuugcucugucaccaggcuggagugcaguggcgcgaucucagcucacugcagccgccgacucccugguucaagcgauucuccugccuaagccuccaaaguagcugggacuacaggugcacaccaccacgcccagcuaauuuuuguauuuuuaguagaggcaggguuucaccguguuggccaggcugguuucuaucucuugaccucaugauccacccgccucagccucccaaagugcugggauuacaggcaugagccaccggccccugccaguuccugcaacucuuaauccucucucaccacugcuucuaccugcucuuucccucgcccuucuucuucuuccacauugccuuccucuuucuguccagcuaauucuuuauccuuuaagaccuuuaagacucauaccaggccaggcaugguggcucaugccuauaaucccagcacuuuggaaggccgaggcaggaggaucgcuucaggccaggaguuugagaccagccugggcaacauagugagaccccaucucuacaaaaaaauaaaauaaaaauuagccagccagaugugguagcucaugccuguaaucccagcacuuugggaggccgagguggguggaucacuugaaguuaggaguucgagaccagccuggccaauguaaagaaacccuguuucuacuaaaaauacaaaaauuagccaggugugguggcacaugccuguagucccagcuacuugggaggcugaggcaggagaauugcuugaauucaagaggcagacgugacggugaguugagaucacgccacugcauucaagcucugggugacggggcaagacucugucucaaaaaauaaaauaaaauaaacauuagcugggugugguggugugcaccugucguccuagguacuccagaggcuaaggugggaggauugcuugaggcuaggaauucaaggcuacagugagcugugauugcaccacugcacuccagccugggugacagagugagacucugucuuuaaaaaaaaaaaaaaaaaagccaccauuuuuucagggacacuuucuagcccuaaguuaagucagguuuucuccucugccauuaguucugaugguauuuguuuaagcccagcaagagcuggcaggcacagggaccaucgcuuccuaucugauaguucaccagggcaccccgguaaccaucgcgauguauccccagugucucagcagacccaggggaggagugggagaagggaggcuugggugagcauugaaggggaggcugcaagggcaggggguuuggaagcccugagaagucacuagggucagggcggcugcucccucucccuccugcaguuggcucugucuggagccacaucaggcccgaguggcaugaucagcauccguuuauaccagugugacauggggucacauucuucccagaccagagccugagagaggcuuaaucaucgacacacccagaguggggucugcaugcacgcaggcauuuggaaaugacuccuguagcauacaggcgauguuaaagacuguauuaugcucguguucauuucaguguauuacuuaaaugucccuuggcaagugaugcugauuuuccauuuacagcguaaugcauguuuaaaaaugaaucgggcugggugugguggcucaugccuguaaacucagcacuuugggagguugaggugagaggaucacuugagcccaggaguucaagacuaguucaaggaacauagggagacccccaucuguacaaaaaauaaaaaaauuacccagguaugguggcaugcaccuguaggaggcugaggcaaaaggaucaccugagcccaggaggucaaggcugcagcaagcugugaucaugccacugcauuccagccugggcagcagagcgagacccuguuuuaaaaacaaaaaacaaaacagaauaaauauuuuaaaaaugaaucaauuuaagcuuaauguguuuuaaggaaaacuguugaauagugaguagaacagguggugcacccacagaaaugaucacaguggugugauugacacugagggccuacccaggucccauuugcuggaucauguacucaucaccuccagcugucaugagugcaggcuucgaaugaauuucuucuugguuucacccaagaguauaccuuagaaaauuccuagcacagcugggcgcgguggcucacgccuguaaucccaacccuuugggaggccaagguggguggaucaccugaggucaggaguucuagaccagccuggccaacauggcgaaaccccaucucuacuaaaaauacaaaaaauuagccuggcgugguggcaggcgcauguaaucccagcuacucaggaggcugaggcagaagaauugcuugaacccgggaggcagagguugcagugagccgacauugcgccacuguacuccagcuugggugacacgagugaaauuccaucucaaaaaaaaaaaaaaaaaaaaaaagaaaauccuagcacaagaauccacaccccucccuuugcuucuagguaacuggaccuaaggcagugaugcucagggaaugcagcuuuaauccgaccguccucuuggucucugucggaggaacugugggcccagugagcaggugccacuugccccagguuacccugugacacccuggcagggccaguuggaggaaacaaaagauaaagauguaccaacgacuuuucuucaaucacugguguguuagugggacaggauuugccacucuagcagcagggucuugguguugggaaaauaagucuguucuuuuucccaggaggcaucgugaaaaaagcauuuaguucucucucuggaaccaagcaaucugagaggcaccugugaauacacauguaaauauauaauaauacauaaauauauacauauauaaaauacauauauugguguauaugcuauacuugaccucaauucaccaggaacgugaggcagcuggugcuuugaauguuuucauuuaaggaccaagggaagugguuugcaaaccuugcuguuuauuggaaucacugggcaucuuuuagcaccuauuggugggggcuguccccagagguucugauuuaauugguuuagaguaaagccccaauggugugcccuucuacuuccugcagccugauuuuucugcagcccugguauugcuguaaauugaucauggcuaagccuuugcuguguuuucugugucugucuuccuuuauucuauagcucugggcuuccugaggcaagacgguggugaaggguaugaguguuccacucccagcucugccacuuacugggggugugaccuuugacaagcuaccuaaccucgcuaccccuccguuuucucaucuauaaaauggggauugcagugaacccaagcagacaauauucugguggagacuaucuccaaugccucaauucuuccauuucccccuugcuuuagugguauuucaugcugcucacagcgggaguccauguacaacccugggaggaugugaaucaaggagagcuuugguuugcuguaugaggguguuacggcccuggcaguccucuuuggggaaacccgagucucuccacuuugccuuuuccucagggggucuuagggcuccuagagaaccagugucccauccugcuaaagccccaccuuggacuugacccuccacaccuggccuuaccuugagcuuccuggcccucccugggcuguggaacgaaugccuggcucacccaccuugguguguuccagagccuggucuaagccccugcucccccugccccaagcauccucauuguguuuuuaccacaguuugcaagcagaucaugagccauggaauuauucaugcucccugcccucagaggagucagagagcuggaggccauggggcugccaaggggaagagaaugcuauauugucaucucaaggcuugaggcuucuuggcgagaccuggaguggggaggaaaacacucuugaaaacagcaucccucacuccacugauaaugacuuaauaucugcuguggaccaggcacugugcugggcacggggacagagcagugaugagaccgacauaaaucccugcccgcugggagcuuccauuccagacagcaagacagaaaaaagaagugcacagcgauacauaagaaaauggcagauaauguuuagugcuucaagagcugaaggcaggcagaucacguagacuagaaaaguuggggaggcuucucugcugacuuaggaguuggggcugaaugaagagaagaagucaauuacaccaagaucuaagaacauuccagaaagagggauacgcacaugcaaagguccacuacucugaggggugggaggugagcuugguuuguuggggacaaagaaggggcacugguuugaggcaugaaaccaaccugacaguuuuuuuuuagcucucugugagggccgccaccuugugguccaugucuuucuguccucccacagugccugcaaagagccucgcaugcucuguguacucagcgaacacacugauggacagguagucaccugugaaaauggugacacacacgccccaccucuuggggcauucagagaaguggagaacugacuucgugguuggagaccacugaagacagaacuggaaucaguggaagagagaucccuguuuaaugcuguuuucugcacagugggauucaugaugcuggggugauuuuagauagcucugucaucacaugacauuaaaucacuggugggaaagcgauucccuuuucaguucucuuucaguucuucugauuucaucaaggggggagucuuagcugaggcuaagguguuuagugccucuuuaacucuaguuuccccucuuuaacuuagagcaggucugcagcuuaguuccuauggcaggcaacagccuugaaccagaauuugugaacuuuaggggcaggggguauuuguuuucacaauuaauuucuauuuauggcaaaugaugcugauuuuccauucccagggauccaaaagauuucuuuuuaaaauacauuuauuuauguuagaaaguggguuaaggacaauuaugaaggaaaaucuuucagcuguacucgagaaggugguagacaaaugacugaaguuugggaacccuuguucugaagcuuaggguccgguaaucagauguggucuuggcaauggugagguccccagucccggggcauguucagauggaaacuggaugcuagaaaaauaauccaggcagaggcugggggugguguguucucauggucacaccagcgccuuucagcugagacugcaugagugcgugauucucuuuguguugagucaguuucccaguugcacagccgcacaaugucauugagcagaugcaauaucaucagaagcacuccagugggacaggcaagggguugggagauugucuuucuuuccagcauggccaccucauagcccccuaggcaugcuaguagggaaauguuacugugggauuccaagugcaucggaauggguucccauggugcuggcucagcaucugcccuagugcuaaauuuuucauggugauaccacuuccuguuggaucccuccccaccucaagucccugguuaaggggcucaaccuuccagcucucagguuggugaguccauaugggcuggguacccugagagagugaugcuauauuaggguucugcagagaaaccaaaggggugcauauauauuuagagagagaguuuguuuuagggaauuugcucaugggauuauggaggcuggcaaguucaaaaucugcagggcgggccagcaggcuuggagacccauggaugagcugaugauguaguucaagucugaaggucauuugcuggcagaauuccuucuuguuccgaggaagucagccuuuuguucuaccaggccuucaacugauuggaugaggcauagcccguuagggagggcaaucugcuugacucagaguccacugauucaaaugugaaucucaucccaaagcaccuucacagaaacauugugacccagacaaguugacgcauuaagugaacuaucugagaugcuuucguuggaccagacacauagcauuaaguaacauagaauccuuuucaaaucacucccuuuuaaauucucuuucaccucuucaaagaggaaaucucaguuuugugcgaauaugacuuuaaaacuucccaaacaugagugacauccuguuuuagcaaagaaauagaaacccagucuuggacuuggagcuuuugagcagcaagagcuuggagcuggaauuuaauaacaauguuuuguuuucauuguguuuauuuuuuccagcaccuucuauuuauggcaggugaugcugacuuuccaucucauuugcgauauaagguugccuuuuauaaaaauauaaguuuaaaaagugaguaagcuaaacaggaauggcagauuuggggaaaugucgacauaagcguugcugggacagugccugaaaugucuccuacuuguccacaugccccgagcugccuguuugcauuuccuucccuccuggaggcugcccuggugguuuauuuccauuugguggcuuccuuucugagaaugguggugguggaugggaggagagaacacuggcuuucuggggaagaaaaaggccuggggguaucuauucuaugacagauuccuugacuacgaugcuggugaugauugauaaugagguaggaggugggacugggagguagggcccacauaucagaccaccaaacuagcuaaaauagggacagggcagaauuaccuuuuuuuuuuuuuuuuuuuuugagacagagucucacucugucgcugaggcuggagugcaguggcgcaaucucagcucacugcaaccuccaccucccagguucaagcaauucuccugccucagccucccaaguagcugggauuacaggugccugccaccacacccagcuaauuuuuauauuuuuagcagagacaggguuucaccauguuggccaggcuggucuugaacuucugaccucaggugauccacccaccucgaccuaccaaaauguugggauuacaggcgugagccacugugccuggccagaauuaccuuuccauaagacauguccacacagaagugacugcaccuuuccauggcaacugccugaugccucacuuuuccuagaaauuuaugcauaacccacucccuaauuugcauauacuuaaaaguggugaacuaccuccaggcauacugccuaugggguagcccugcuccccaaggagcagucccucugcugcuguuguacauugccacuucaagaaaaguugcuaacaccacugguucacccuugaauucuuuccugggugaagccaagaacccuccugggugaagccccaauuugggggcucgccugcccugugucaguaacacuucauagcauuugcuacaugccagaugcuguucuaacuacuuucacuucauuaucucccaacaguccaagggguagggauaccaaugucauccccacuuuagaguggagaaauagggacacugagugguugcuagucuacaguccagucagucuggcucaagucugugcucuuaccucauuucacucaaauuacuuccugcucaucuucuacccugugaccccuuccuauguuaacuuccacguuaaccaggugggguccugguuuccuagucuugagacuccuugggccuggcugaguugucgacagugauguacagucuuuaacucgccagcaaagauccaucuauaaaaaugauaggucuugucacuuaugaaagaggaaaaaguagcugggugcaguggaucaugccuauaaucccagcacuuugggagaccaaggcagguggaucauuugaggucaggaguuugagaacagccuggccaacauggugaaaccccaucucuacugaaaauacaaaaauuagcuggaugugguggugcaugccuguaguuccagcuacuugggagacugaggcaggagaaucacuugaaugcaggagacagagguugcagugagcugagaucgugccacugcacuccagccugggugacagagugagacuccaucucaaaauaauaauaauaauaauaauaaagaggaaaugcuguuaaaccaagagugacugaugggccuggggauuacuugaaagucaccaagacaaggugcucugugaaggaaagaauauuccuaaacuaaugggugugaggcuggggaacacccugcauuugacaccugccucaccccgagcaacguaauccacaucaaccucacucucaugcugacaugcugugugccuguagguauaucauuaacccucucugggcugcagugugguuuuacuggguagcauaauuauaggagcuccuuggaugacagcagccagcagugagcucuuuaauugacagggucaggcagcagucauuggcaggauggcaguuauuagcugcucugugaaagcugcacaaacuagcaaacauuuaacaaguauuugcugagcaaccuugggcacuggggaaggucagugagucauaguuucuguacuugaggaacucuaaaucuaauacagcaguaucuccacuguaucaguuagcucuugcuggguaacaaaccaccccagaauguaauggcuuaaaauagaaaacacugauuuuguucaugauucuauagauggggaauuugggcugagcucagcugggugguuuuucugauuucagcugggcucauucaugugucuguggucagcuagugggucagcugggggcuggcuggucuaggguguccuucacugguaaaccuugucugucuuccaaguggcaucuuaucuuccagcaagccagccugggcuuguucacacaguuacugggcagagagauagagauagagagagagagauagauagagagagagagagagagagagagagagagagagagagagagagaacaugcaugaggcuucuugaggcuuuggcccagaauuggcacaaugucacacuucugccaccuuuuauugauaaaaaaaucacaaggccagcugggcaucagcagguggagaaauagauuggauuguaccucuugaugggaggauuugaucugcuaaaauuuuguuuaauuuuuuuuucacucaugcacaugugggauauuggucugucuuuccuuucuuguguaaugucuuugucugguuuuggaaucaaggcaaugcuggccucacagaaugaggugggguguccccuucucuucaauuuccuggaacaguuuguuuagaauugguauuauucuuccuuaaguguuuggcagaauucacccaugaagccaucugggccuggaguuuccuccaugagaagagacuccaggcccuggauaaacccuuuuuuuucuccuuuuauugccagauuuuaaauaaaagucuagcuucauuuuucacuuguuauuagcccuuuagcuccuugaaaucuggcuucuuuagucauucauucaacacauauucacugagcaccaucuauaaggaagacguguucuaagugcugugaauacuguccugcaaaaacaugccaggcaccugacacuguagcaggcagauauguaauauccaaguaaacaacuacaaggcaacaucaggcccugagagaugcugcaggaagaaaaaugaagggcuuuaguucacuucccuaaaacugugguugccaauucggccaaugagcuaauucucccuccuugucccauuuuucuagucuuuucucuccuggcuucugggucccaucaugugcucuugguugcccucccaccucugugcccacuccuccgucuccuucccuggccuucucucuuccauccuuucuucucccuuaaugcuuucucccugagcaggauuucucaucuaccaguggcuuugucugccaccuguguacccaugacaccaggauuccugguucuagcccguuuucuccugagugacaguccugacuauauuuccaacuaccugaaugcauuucuaccaugucaccaauuucuaaaaccaaaugaacuguuucccucauccuucaaacaugcuacuucugcuuccugucccagugcagaucacggcacuagaaucaugugcccucuuccccagcccaucaucaaguccuguugcuucugcuucuggaagcucucuuggcucccucccuucuguccaccccucuguucccaacucauuugagacccucaucauuucucaacagggcugcuccaauagcuuccccacguuugccuccugcuacuccauccuucugacuguggaaugguuuucuucuagaagcagaucaugccuuuucugcuuacaaagcuuccccagcccccuuggccuccaggauaacauuugcucuccuuuguguggucuccaaggcccuuaagcuucuuggucaguggagaguccugguccaucuuggggcccagcccggaacgugcucuccuaagugugccacucugcacuguggggcgucccgaacuccuugccugugacacccucuccccaccacuccgcccauccuuagagacccagcucaggugucgcuucuuccaugaagcuucugaugcugcucccaccccaacacagggccaaucacaccacaagugucucccaucacgucauauccguccguuuacacacccuugcccuuuagggacccggcagccccagggcacacagagcaugccuuacucaugcccaguacauagcaggugcucaauaaaugcuggcugaauaacugcuucauuuuuaaagaacgggcaaggggacagugaucggaagccugggauuagagcccuggcucugccaccugcaaauuggaugaugugaacaaacuccuuaacuuugauuucucacccacaaaguggaucacaguccuugccuguccuucugacaggacuguccccucacugacagguacuacccugcgugcggcggugggaagagcugugagccuggaggacucggggaugaccuguguucucugcuuccguuguccccagugugcuuugcaaagcauguucccaggaugugggaccuggaggaauaacuuagcaguggccagcaucugaagcuaugugugugagccuaggacuuuugcuagaucccugaucagcucuuaaaguaacaggaccccaaaagggaagggaaauucagauuuaagugggcuagauaaugguuucucuggugccacgcugcuuggguucagaugccagcuccagcuuuuacuagcugugugacauuggggaaguugucuaaccucucugggccuuauuuucuuuaccuguaaaacaaggcugcugggcacgguggcucacgccuguaaucccaggacuuugggaggcugaggcaggcagaucacaugaggucaggaguucaagaccagccuggccaacauggugacacuccgucuuuacuaaaaauacaaaaacuagccaggcaugguggcaggugccuguaaucccagcuacuugggagguugaggcaggagaauugcuugaaccuggaagauggagguuacagugagcugagaucgcaccauggcacucuagccugggcaacacagcgagacucugucucaaaaaaauaaaaauaaagcaaggcuaauuuaaaaaccuucaucagaguuggugaguaaugaauaaauuaauccaggcaaaagggcuuggaacagugccugggacacacuagacaacuaauguuggcuaucauuauuguugaaauugugguuguuauuauuccaagagauuggaagacccagggcugcacagacagaaugauccucaguggcuucugcccuggggcacugccaaauuccagugucccgccuguugccauuuccggagagagccaaaugcugacuuugugcccagagcuccagccacagugagcauggagcugggcggcccaggguaaaugggcuucuuucuuccccauggcaucucagacgccugaauacuccuggcuggcugguguccagauacuagggcaggaggcugggcugaccucugccuuccugaaaacagaggccaaagccaccguccccucggagugcucugggcagugggaggggccuggguucuggccagccugagguugaaccaccagccccggagcaggccugggaguccuugcaggguggccugggugacugcucaccagcccggcccuccccaggguucugggccagagccucccuggccguuggagcgggagcuguggguggaacacuucugaauugggagauugccucggaccuccagacgccgaacaucucaggucuguauugaaagguuccacaccucgggauuguccucuugccuacaguuccgggaaaaggcuccaacucagacugggaaucggcugugguuuaaauaguaggaagaacucccgagggcgggaauggaguugggcggacggagcggucaucuuaacagcacguucucucuccgcgggaagccagcugggcucucugacucuuguucccuggcacguaaaggagcaugugccaaagugacuuccuuuggcaacagcaagcaggggauggggcucacggguggagauucgugguuauuaugaagaagaggacagcaguggacccuuacucuguccgugggcagaucccacagacuuuuauuuauccacgagaaccucauggugacuuuccacgagcaacagcaaaccaaauguugcuucuggaagagggagggccagugagccuccagaagguuguuuguguuucuccacacccagagcuagacgugcgacacacacacacacacacacacacacacuuuaagcaaacauuggacuaaggcauagcuggacggcaccucuacuuaggaaacagcgaggagaugucaauucucuuuguuaucuggggucaggauggacauuucugggagcacuauccuucuuccugucaaacuguagaacuugaaacuccagcugggcacccuggcucaugccugugaucccagcacuuugggaggccaaggugggaggauggcuugaggccaggaguuugagaccagccugggcaacacagcaagacuccauuucuucaaaaaauaaaauuagacgggcaugguggugcacagcuguagucccagcuacuggggaggcugaggcaggaggaucgcuugagcccaaaaguucgagguugccgugagcaauguuugagccacugcacuccagccugggcaacagagagagauccuguuuaaaaaaaaaaaaaaaaacuugaaacucacugagccacaaauguuccacuuugugugcagaauuuccauaacgccacccacaguucccagugucucaccccuuucuccucccucuuguuccuccuccacagccccacucucuccaguucugaugcccggagguuucuuguugcugcuugaaaaacccauuugcuguucuucuacccugguuauggguucuuuuuccuuuaaaaagaaacuuaugucugaaguuguaauuuccuguguucuauauuauuuuaugugauuauuuuuauggguauuucacagaauggggaguauucaggccuugaaucugaagacagcucaccaugguaucuacaaugcaucaaaucaagguuggggcauccaggccauuuaguguacacagugagauccaccucacugaguuucuggauacucagaaaaagugauucauuuagaaguuaauuuugaaaagagaauugaacccauucuaccacaugugcuuaguuccuuuuagauaccaaggaaaaacuuuauccauaauccaaaccagucucaaaguuagaucaaaaaagacagcaagcgcuucagcuuggccagugagcuaacaggaugaaaaaugcagccaacccuaugcagccuaaagcaugggguuuuuuuguuuguuuucuggguuuuuuuuuuuuuuuugagauggagucucacucugucacccaggcuggagugcaguggugggaucucggcucaaugcaaccuccaccuaccggguucaggcgauucucaugccucagccucccaaguagcugggacgauaggcaucugccaccgugccuggauaauauuuguauuuuuaguagagacagcguuuugccauguuggccaggcuagucucgaacuccuggccucaagcgaucugcccgccucagccucccaaagugcugggauuauagccaugagccacugcacccagccuaaagcacgauucuuuuuuaggcccucucuuaauuagcccagucaucccucaaccuuagcgaaugggccagugcagagagagguugccuucacagauucccccugccugguacaaagcucaguggacacaaagaugauuugauacugccuugugcccucucugcugaucuuaauuagguugcugcaugguuuucaccaggcccuaagcaugugagaggaaagagagucguauaaaaaugcccuguauuuggaacuggaaaacuagugaguuccaguccugugaauuuuggcaaaucacccagaaccauuaggacccuugguuucucaucuguaaaauggggauaaagauaccuugcucugccagcaucauaagauugacaugaaaauccugugcagcaugugcuguguaagcugaagcuugaccuuuagucaugaggagucucguuuucauguggcaugaccccugugggcaccccuuccccagggaucugccuuauugccuacuuaucuugggguuauguugaaccccucuguccugcccacaguuagaagugaauuugcugucuucccugaaaagugccacacauggauugcuuguccuacuuguccugugacagcagcaguugcugaggcugcaccuggcaggcagcagggaaaggcagagucaggagagagacuggcuggagaaugugcacugcaaagaaucaggccaaccgcaggcuuguaaccaaaaccauacauuuguugcguuugggguucugcaacagaagacuugaaaugauuuuaaaaaaaauuggaaggaacugaagcaauauggaaaauagauggaaccacagacaagaaggaaggaaagauggagggaagaaaagaaggaaggaaacuggaaaugcuaggggaaaaggaguuuuucaaggaaaagugcaaucauaguacacuauuuggcucuguagaguacaauauuuauauagcaaucauguaaaugacaauuauugaucuaaauguagacuguauugagaugauggaaggaaggagauggggugcaaaugauggugaaaaagagacacuuuucccuaagcaggaaguuaauaauuaaguuaaccaagaaauagaagugcaugaguauuguuuggaaauauggagaagggaagaagaguagaaacagcugaaaagauuaaaagugauugcuuuggcgaggugucauggcucaugccuauaaucccagcacuuugggaggccgaggcaggcagaucacccgagauugggaguucaagaccagccugacuaacauggagaaaccccaucucuacuaaaaauacagaauuagccaggcgugguggcgcaugccuguaaucccagcuacuugggaggcugaggcaugagaauugccuggacucaggaggcagagguuguggugagccgagaucgcuccauuguacuccagccugggaaaaaaaacaaaacuccaucucaaaaaaaaagaaaaaaaaagugacugcuuccagguuguaggacagggguaugacagaagacuguuuuacaccauauaccuuuugguucuguuaucuucuuuuaaaaaucaucauuuuauguagaucaaaacauuuuuaaaagagaaguucugcaaaucauaggacuuugauuucuauacagaaacuugaacacuucaucuagugcagucuccuaccuucagguggguaagcgcccaaacucagguggccuuuuagaauguucugcuuggccccuaaagaaauugaagaaggaaaaaagcaguuugcauuccacagcgaaaguuaugcuucaaaguggcagaggcuuuuggggaacaucacugacuccugaaagauugucgugggcauucugaggaguaucccacugagauagggugauuggaggaguagccaggagacccuggucuaguccugaccuuguuccugcuuugcugugagauggagcaagucuuggcccuccuucguuucuguuaauaccucuggacaauagggcuuugaguuuuccaagggccuuuacagcucuacauuucuagaacuggacaaugauagcaaauagcugucagagggggagagacaauaaacaacugaacgaauaagaugcuuucagaccaugcaauccuccaaagaaaauaaacuagggggaugggcuagauuaugcuggagggggcgugguuacuuuacacgguaugcucaggggugcuuuucuggggagaugauguuugaauuaagaccuagacaaugccagagagccagcugagggugaaacggagagaccgcuccagggaaccguguucaggggaaccgagacaagacuaguuccccuaaagcagcagagcacugaagccugcaggcacaagggcaggcauagggguugggguguggugggggaaggagauggaucuguauuuacuguuacauuuuucgaagggaaaauaacuuuuugugaauggcaaggauuaauucugaugccacccugggcuugguggaccagucuucauccaacacacagccccgggaacuguuuguuuguucuuucguaucaucagagagggcaggaugcaacauggguguauguaguggcaaggagacagcaccacuuggaaaagcccuggggaagcuggucucuagggaccagaauuauauuucuugggggcaacuuaugucaggagccaaagacauaacaucaaggcuucuccacccacucacauaaaugcuuaagaguugauccagugcuuggucgggcacgguggcucacgccuguaauccuagcacucugggaggccaaggcugguggaucaccugagguuaggaggucgagaccagccuggccaacauagugaaacccugucuuuacuaaaaauacaaaaauuagcugggcaugguggcccaugccuguaaucccagcuacucaggaggcugaggcaggagaaucgcuugaacucgggagguggagguugcagugagccgauaucacgucacugcacuccagccugggugacagagcgagacuccgucucaaaaaaaaaaaaaagaaagaaagaaaaaaaagguuuugauacugucugaagacccucugaagaucagggcugacacaguaugaacaguguccaguauacauggcaguaaguuaaauuguuuaaaucacaaaaauaaaugcacauacucuuugcuucaacgccuucacuauuaggaaucuaucuuuaaauauaucaaugcaaugugugcaaagaaauaaguggaagguugcucguuggcagugccguauggagccgcagaaaguccggaagcgaccuaaauggcuaccaauagggaaccaguuaaguaaauugugguguagccgcacaacaaaacaccaggcagcccaaggaaugagguggauucguaggcacagggaaagaauguucucugagggauauuauuagaaaagcuagguuggaggaugcggcuuagacuuguggccaaaggagcuugcuggagcucccagcuccacacucuuguccccuacuagccuucggccccuccagccaaagaaaguugacuggggcucggugggagcagccaugcccaggagaaggugccgggaagggcaaagcacugcaccggggccugaauaaaugcacuccaccaauccagaaagcggacaguggcguuuccuccaaucaggugugaagagaugagugaggggcgggacgaggcagagaguguuacucugguacggcuaccgccacacggaaacguggagugaagaauaaguguucucgcaaucaauaucucuggaaggaggcacaggaaacugagaagcgugguugccucuaagagggcaguggcugacuggcgucgggaauaguggcgcagaagggagacuuauuuugguauagagaugcaggaguaaaggguuauuuuuauucccucuuaaacauucgggggauuuccgcuacuugugaauaacuuccuccaaagccucgggugaagucaccagcaauguccuggguucacaaguccuaaaauugagcuaccgcauuuugguuuuuacuggagaucugaauuccagaugucauaggagaccuuuacuucucuguuguuuuucggagugccuaaugguugaaaccaaccucuaacugccauuuccuuuacauguacuagaaaccuuacuugacuucucuugaaaacguaucccuuucucuguagaagcuuguuccugaugucugaaauguccaucugaaaccauucccagagcuuaaagcaguacuucccagacaucagcauuugacaaccacccugaggauuucuacugacacugaggaccaccuguccuuuuacuuacauaacauuuucccuaaauuguucacuuuuaaagcuucaauaacuugguuuuaaaauacuuuauaucacugcuauacgugguguuucuuccuuauaaaaagaaagaacguuaaaaauaaauacaauaaacucagaaugaugcuauuaaauucuagcuacaaauacauuuuaaccaaagaucuguuuucucuuuuugucaaaaagaaauuagcaaguauuggagacugacuagcaccaaacugggucuuuuccuuggugaacucaguaggauuggaaugggaacuuuuucaccaugugguucaauguugcuuaaugcccuaucaaugcacuguccaaaaucaugccuuauaacauuuuaauuccauccuuugggaaagaauggguuaaaaccuuuuuucuuuuuaauuauuauuuucuagaaaguuuuaguuacauguccauaugcauuugugucaucccagcuggacaacauaugaagcuauuaucacccuggaguuaauggcccuggugaaguuggcauuugggcauuccugcugauguuaaaguaacagggcauucagcgugguacaugagcccuuuuuccccccagggucagaaaugcaucuauuaaaaaaaaaaaaaaaagggaaugcaucauuuuggaggcagcagcauaugguggcagcuaagaaugacgcaggccuaaacaaaggggaauuugucuuuuuugaaagaauuagaagaaucuccaagcugguucauuggguccuucuaauuggugaugcacagaaucacagccaggaccucucagacugaguucugcagccauacagcuccuggcucauuguuaguguguccugggucucaaggaguggacccuguaugagcccaugagccuugauccauuccguggggggauaauggggaugagaaugagcaugguuggagaggagagcuggcagugaaaagguggaggguuugugcagucagugcauguccacuagaggagggggaauaguugguaccagaaaaaggccuuuuaaaaugauccuauuuugcucuggggaugguggcucacgucuguaaucccagcacuucgggagaccaaggcaggcagaucacaugaggucaaggguuugagaccagccuggcaaacacagugaaacucugucucuacuaaaaaugcaaaaauuagccaggcguaguagcacgugccuguagucccagcuacuggggaggcugaggcaggagaaucgcuugaacccgggaggcagagguugcagugagccgagauugugccacugcacuccagccugggcaacggagcaagacucugucucaaaaacaaacaaacgaaaauccuauuucagaaauaucagugaaugcuuaaacucugagugaaaguuucuugagagaggaucuuuacauuaucucaaaauaccuucccacacaugccacaucauggauggaccuuugaaacacugugcuaaaugaaagaagacagacacaaaaggccacacuauuguaugauuccaacgauaugaaauaucuaaaauagacaaauccauagaaacagaaaguauauuauuuguugcuggggguugggggaagggagaauagggaauaacugcuuagugaguacacaauuuacuuugggggugaugaaacguucuagaacuggauaguggugauggauauacaauauugggaauguaaugugucucauuuacacuaauaguaaauguuauguguauuuuaucaaauaucacuucuacaauuuuuuuuuuuuugagauggaaucucucucugucacccaggcuggagugcaguggcgcguucuuggcucagugcaaccucugccuucuggguucaagugauucuccugccucagccuccugaguaccuggaauuacaggugcccaccaccacgcccggcuaauuuuuguguuuuuaguagagacaggguuucacuacguuggccaggcuggucucgaacuccagaccucaggugauccacccaccucggccucccaaagugccgggauuacaagcaugaggcaccaugcccagccuuacaaaguauuuuuuaaugacaaaggggaaauguacagugaaagaaucuggcagaacacaacccagugaucaaaguuagcaucaccaaugaugggacaaacuggcauacugcaccuccuggugggauccauugaggacacauggcucauaugccauuccugcuuaaaaaauauaaucuggaucgaaucaucaggaaacaucgaacacaaauuugagggacauucuacaaaauaaguggucaauauucuuaaauaauaucaauguuaugaaaaacaaagacagaccugaggaaguauuccagauuaaaggggacuaaagagaccugaaacgaaaaugcaguguaucagcuuggauuggauccuggggcaggaaaaagaaagccauguagaacauuauuggguuaauuggggaaauuugacuauggacuguagauaugauaguuauauuguaucacguuaaauuucuccauugugaucaucauagugugguuauguaagaaaaugugcaaccaggugcgguggcucacgccuguaaucccagcacuuugggaggccgaggcaggcggaucaccugaggucaggaguucgagaccagccuggccaacauagugaaacccugucuguacuaaaaauacaaaaauuagcugggcguggugacacgugccuguagucccagcuacucaggaggcugaggcaggagaaucacuugaaccugggaggcagaggaugcagugggcugagaucgcaccacuguacuccagccugggcaacagagugagacucugucucaaaaaaaaaaaaaaaaaaaagaaaaagaaaaaaaaagaaaagaaaagaaaagaaagaaaauguccuugguuuuucagaaauacacacuaaagcacuuaguuguaugguuuaggcaacuuacucucaagugguucagaaaaagagagacaguguaugugugugugugugugugugagugugugugugugcgugcauuaauccauuuaaaacuggggcuacaauuucaucccagugaacagaaggucugauucgcacuguacuucaaaacaugaaacuacaaauuaauuuuuuuccaaaaaaauguaguaacuaucucgucacaaauuauuggaauaaaagaagaaugaaccaaguguugauauuaggaggcugcaucuuccaaccagaucauuugaugugacaucuucccuugacauuugaguuuuguugaccaagaugaugguuauaaaauacucaaagauuuuaucaauuuuucccagugugacuuuuaauuguuugauaguuaaagcauucuuuugaaugcuuuuuccucauuuauugggaacuucuccagcucagacaaguccucauguauucaugcccucaguggcuuuucaucugaucucccaugacauuuuuaucaacuuuggacaacuguaguucuguuguaagacuuccaauuucacuuugcaauugcuuccucuuguaugucacucaaacuguccugccaaaguaaagcauuacccugaaaucucagugguuuaacauccagagguuuauuaauuccccaaucauaauaucuguccaaggugugaggcuucaaccuacuauggcugcaccauccccagcuaccuccuuagggagagggagcauggagaacucauaccugcucucuucugcaucagcccggaaauggccaugucaugcaguucuggcccauugguuugaauuagucacaaguaccugcugcccucuucaucagccuggaaauggccaugucaugaaguucuggccuauuaguaaugaguuccccaucuagcugcaagggaguccaggaaauauagucuuccugugugaucagagaggggaaaaugaaauggcagcugucugccacuuguuguauuuuuuugggguccaguguuguucaaaugggaauauauauuaagaagaauggugucugaguggguauuuauuuuauuuuauuuuauuuuauuuuuauuuuuauuucuuugagauguggucuugcugugucacccaggcuagugugcagugaugagaucaugguuuauugcagccuccaccuccugggcucaagcaauccuucugucuuaguuuaccaaguaggugggaccacaggcaccugccauaacacuaggcuaguuuuccaaauguuuuguagagauggaguuuugcucuguugcccaagcuggucucaaacuccugggcuuaauuaacauccucuugccuuggccucccaaaauggugagauuacaggcgugagccaccaugcccagcuggggauuaauuuuauaaauggucagaucguuaggaaauauuucuguauugugaucacuuuugcuuuguuaugaaguaggggcucugaucaggaaucgucagaaaaugagcuucugagcauggggaaucaggaacagcaucuuagcacacacagagccacuccuuccugcccaagagacgugaugcuuuucucaauuagggauucuaauggguccucacccuccuccuccacaaggaauauuugucgucuggaugcaacagcagacagccccucucaugccagacuuuuguccaguaaagucuccaggcgaguaaagauggggagcacuguuuuugcuuuucuaagaccccaugaaauguugccuuuucuuuuuaacagacagagccuugcuuuguugcccaggcuggagugcaguggcgcaauuauggcucacugcguccucaaccucccagucucaagcaaucuuccugccucagccuccuaaguagcugggacugcagguaugacgaccacgcccagcuaauuuucuuuuauuguuuuuauagacagugucuuacuauguugccugggcuggucucaaucuccugggcucaagugaucuucccaccuucucccaaaguuccaggauuauaggcaugagccaccacgcccagcuaaaagguguuuauuuuuuauuguaauuuuguuuugucauugacagauuuugaauuucucuuucuuacccucuucagcacaucccgcucugggcuuuaaacgugaccccucgccucgacucgcccugcccugugaaaauguuggugcuucuugcuuucaucaucgccuuccacaucaccucugcagccuugcuguucauugccaccgucgacaauguaaguuuccuuuccugccacucacgcagaaaccuggguccugcagucaauagaaguggguuguauuggucuguucucaugcugcugauaaaggcauaccagagacuagguaauuuauaaggaaaaugaggucuaauggacucacaauuccacaugucugggaggccucugcagaaggcaaaggaggagcaaagccacaucuuacaugguggcaggcaagagagcgugugcaggggaacugcccuuuauaaaaccgucagaucucgugagacuuauucacuaccacaagaacaguaugggauaaacuugcucccaugauucaguuaccucccaccgggucccucccacgacaugugggaauuaugggaauacaauacgagauuuggguggggacacagccgaaccauaucacagguugagaacccugccaaaguucucaauguugaaccugccaagguucaaccacgauucgggguuguccucccugcgaaggcacacacaucuucugacccaagggcugaggacucuuggccuaaaugugaagguucaggccgucccauguucagguuuugguggcagguccuggcaggcagggacguuuguccucccaucugugauucuuucauagagccuggcucuaggaagcccuuugaggauguugugugacuucagcuuuccucuagaucagaguucucaaccuugccacuauugucauuuugggcuggauaauccuuuguuguaggggccucccugugcauuguaggaaguucagcaacgugucuggccuuaucugcuagaugcaguagcucccccaccccugguuaugacaauccaaaauaucuucagacauuguuaaaugucccauggagaacaaaaucacccucuguugaggaccgcugcccuagaucuuccaggugacccaucccaggugaccucugcccccaaccccugacaccuccuuaucaaccagggucccuuguugcuagcccacccggccauguccuccccagcagagcucaugcauggaacuuuccagacucuaccuaugccccuaugaaaaauuuaauguuucccuuuaguauccagcuugcagccauauggcaggaauguauuggauaaauaaccucuuggcauagauuaauaucccuccaaacagggagugacaucagggaagcuucuuaacagccuauacacuguuccaaagaccuggcuuccauccugcucauuuuagacugcagagauaauuaaagggcagaaacauugcucagaaagccaaaaaguacaccauacgaguggccaccaacucugccuacauauacggcucccguugauggaucaucaugacaauaguaacauaaacuauaaugccugucacuuagcgaucacuguggcccuuuuaugcaugucaucucaugugauccccaccccagcuguaccagguagggcaccgacaucuccuugcaccggguuacaggugaaggaacugcgccucagggccauucgggcacuuggcagaguuuacagugcaguaagcagcagagccaggauuugagccauuccagaggcuccugguccuagagccugucaggggagaugagcacaauaaucgcauuuggguucuggagcuucuugcugagcugcugugaguggccugggcagggaccacauugcugcuauggauuauagcagugguccccaacguuuuuggcaccaggaaccgguuucauggaagacaauuuuucuacagacuggggagggggcauugcagggggaugguuucagaaugauucaagugcauuacauuuauugugcacuuuauuauuauuacauuuuaauauauaaugaaauaauuauauaacucgucauaauguggaaucagugggagcccugagcuuguuguucuggacuagacggucccaucugggggugaugggagacagugacagaucaucaggcauuagagucucauaaggagcgugcagccuagaucccuggcaugcacaguucacaagguugacacuccuauaagaaucuaaugccccuggugaccugacaggaggcagagcucaggcaguaaugugagugauggggagcagcuguaaauacagaugaagcugccuucacuggcugcucaccuccugcugcguggccugguuccuaacaggcuacagacagguaccaguccauggcccauggguuggggaguccuagauuauaguauuuggacccaccauuccaggagcucacugugaaauaaaugggaccgaauguucuuuuagaaucuccuuuuucuauuucuucccaucuaguccuuugggauccugaaaaggucccagacuuagugaaaaggauagacagacauuaggggcaggaaaaccaucagccuuagugaaucguauccagcacccccaggguauauuaucauggcacauacuaagaagaugcagauggacuuuuuguccaucggugagucugaggguauucauuauguauuuggaauugugcuuggcaacuggaaaguagaaggaaggccaucuugggcagugggggaagggcagcagccaccaaagcacacagggaaaugaaugcuuuuggcugaagacaggagaaucuugucuggucaucccauccauugcaauguuuguuuguuuguuugugacagggucucucucugucacccaggcuggaguguaguguugcgaucauggcucacugcagccucuacugcccaggcucaagcgauccucccaccucagacuccugaguagcugggacuacagucacacaccaccaugccugacuaauuuuuuguauuuuuuuguagagauggguugccccggcuggucucaaacuccugggcucaagcaauccucccaccucggccucccaaagugcugaaauuauaggcaugagccacugugcccaccccugacugcuauuacuuccagcaacucagccucaucuuuucucccauacucucugagggccuggaccaccucuuauccuuugggagaaaguagcagggcaucaccuggagccgguuagaaaugcagaauccuggccaggcgugguggcucacgccuguaaucccagcacuuugggaggccaaggcagguggaucaccugaggucagaaguuugagacuagucugaccaacauggcgaaacccugucucuacuaaaaauacaaaaaugagccaggugugcuggugcaugccucuaaaucccagcuacucgugagacugaggcaggagaauugcuugaacccaguaugggaggguugcagugagccaagaucaugcaucgcacuccagccugggcaacaagagugaaacucugucucaaaaaaaacaaaaaaaggaaaaaaaaaaagaaauguagaaucccggcugagcgcaguggcucaugcuuguaaucccagcacugugggaggcugaggugggcggaucaccugaggucaggaguucaagacuagccugacaacauaguaaacacugacucuacaaaaaauacaaaaaguaggcguggugaugugcaccuguagucccagauacucaggaggcugaggugggaggauugcucgagcccaagagauggaggcugcagugagccaagacugugccacugcccuccagccuggaugacagagcaagacccugucucaaaaaaauaaauaaauagaaaagaaagaaaugcagaaucccaguccccaccccagaccuccugagucagucugcauuagaauaagcuccucaggcaauucucacauguguugcaguuugagaauccuggaagcccaccaugccucgugccuaauuagcagucaguguuugcaucaugaacggacggccuuucucucuauuuccauuuuguguuacaggccugguggguaggagaugaguuuuuugcagaugucuggagaauauguaccaacaacacgaauugcacagucaucaaugacagcuuucaagguaagugugaaugaaggaagcugacugagaagcacugagggaggaaggaacggucaggagugaggcuucggguuccccgacuccguacccucuccuccacucacugcauacuccggugggccuggccgcguuugcucagugugugcuggagcggaggacagcacaagcuggagaugccagggguguggagaagccggaggcuggagggagaccaacuccagcuaaguuggaccucaugccuucucuucucugccucuuggcacagccgaguuucccguucucauccuuucuccagcuucagcucucaucuagaauuuucucuucccuucuuuuuuuauccaagccuugccucuaaaugggcucagagaccauaauuuacucuccagucacuuuucccuguccagcaguaagaaauccgagaucuggcggggcucaguggcucaugccuguaaucccagcacuuugggaagcagaggcggauggaucacuugaggucaggaguuugagaccagccuggucaauauggcgaaaccccaucucuacuaaaaauacaaaaauuagcugggcgugguggugcacgccuguaaucccagccacugaggaggcugaagcaagagaauugcuugaauccaggaggcggagguugcggugagccgagaucacgccacugcgcuccacccugggugacagagugagacccugucucaaaaacaaacaaaaauccaagaucuggcuuccguuccuagacaagcuguguagccuugcauugggcaugucaauuucaacauccucagcuguagaacagaaguaauaaugaugccuuugcugugcccaccucuucaaugagcuaaaauacaugaaaaggcuuuaaaauacagaaaaucccauucaaaaacaugcuaaccacuguuuuucauuaugaagugaaugguucuguuuuuccucauagaacugaugaaauagauacuuugggaucccaguugccugauaaaauacaguauacccgguuaaauuagagauuucagauaaacaauaaguacuguuuuuuaguaugacuauggcccaaauauuaauauaacaugggacauacuuaugcuaaaaaauauuugguuuuguugguggggggggaggguuuaguuuuuugguuuuuguuuguuuguuuguuuguuuuugagacagggucucacucugucacccaggcuggagugcaguggugcagucacgacucacugcagccuugaccucccgggcucaagugauccucccaucucagccucucaaguagcugggacuacaggcacucaccaccaugcccagcuaauuuucguaauuuuuguagagauggaguuucaccauguugcccaggcuggucucgaacuccugggcuccagagaucugcccaccucagccuaaaggaggaggaggagccaccaugccucuccuaaaauuuauuuguuguccaucggauauucauguacugggcauccugucuuuguguuuguuuugguuuguuugccaaaucugacaauccuauuagggagcaaaggagccuacucccugggucccagauucucaccacacucaguaacaauauccauauucaucauaaaagcagcaaaaauaccaguagaaggcaccauuuacuuaaaguuuacugugaggcaugggucuaaguccuuuacauaggugaucucauagccccaucaggcagggaccauaggccccauuuuaagauggggaaacugaggcagagagcaguuaaguuacccaaggccgcauagccaggagcgaaugauggcggcaggauuccagucuaggugugaccagcucuaaagccaguacccuuaaccacggaacaccaucggugcucccuuccaucucgucuguuauucugucaugcuaaccucuggcccugggaacagcccuccuucccugagcucugcaagccccagcugucgccagugugcaaggccagcugggagggcuugcugugcucuguggcuguuuuucugaauccuccacaugggauuauucacuuauuuuucuuuaaaacagggguuggcgaaccgcuggccaaauucaguccaaggccuguuuuuguuuggccggggagcuaagaacaguuuuuacauuuuuaaaaguuguuuacacacacacacacaccccuaaaaacaaaacaaaaagaacauucaacaagagaccauaugguucacaaaaccuaaaauauucacugucugucccucuacugaaaaaguuugccaacuuuuuuuacuuuaaaaaguuuacuuuuaaaauagcccacuuuucuguacauaaaucuacuguauuuaguggagacagggucuugcuguguugcccaggcugguuuuucacgccuggcuucaagugauccucccaccuuggccucccaaagugcugggguuuuuaggcaugagccucugcacucacccauaaaucuauuuucuuuuuuuuuuuuccguuugaaucagggucucgcuuugucacucuggcuggagugcaguggugcaaucacagcucacuguaaccucugccccccagguucgagugauccucccaccucagccuccccaguagcugggauuaugggugugugccaccacaccuggcuaauuuuuguauuuucuguagagacaggguuuuaccauguugcccaugcuggucuugaacuccugagcucaagcgauucucccacuucacccacuguggccucccaaaccauaagucuauguuaaagagaaugucacaucccucccaugaguguuaucacucguauaaacuaguaucacuugccauaaaagaagggaagcuuucugaaaauacuagauggaaagcccaaugauguuaucaaagucugggcagacacacuucccuccugaagccucuaagccuguuucugguccuuuucauguuaaaaaacaaacaaccccaaacacccagauauuaguggguguuuuuaaagcacaaaagcagcugguggagaacuccuccuugagguccuuagagaaaucuauuuauuuauuuguuuauuuauuuauuuauuuuugagacagagucucgcucugucacccaggcuggagugcaguggcgcaaucucugcucgcugcaguccccgccuucuggguucaagccauccuccugccucaaacucccaaguagcugggauuacaggugugugccaccacacccagcuaauuuuuguauuuuuaguagagacaggguuuugccauauuggccaggcuggucucaaacuccugaccucaggugauccaccugccucugccucccauagugcugggauuacaggcgugagucaccaugcccagcccuuagaggaauuuaaacugagcaaagugagcaucccucucauuccgugaauuuguguaguuucccguccucacuggguuccacauacacccaucucaggggcugccuggcaggcacauccugcacccccucccagcuuugagaaacccuguucuaggaacaucuauucauccuuucccccaaagccauguuuuccccauuugccccaucaugggucacuuguugcugaaaauacagauuccuggugcccacuccaggacaaugguagcagaaucuccagggggagaggccuaagaaucuguauuuuuaauaagcaaucccaggugaucccugggauugggcagauuugggaaguacugcuguaagccagagggucaccacuugggcuccauauuggaauucccucgguggcuuuacgaagcccucgugcccgcucucaaugcccgacguucugauuuauuucaucucaguagagccugcuggguuuucuuuuucuuuuucuuuuuuuaauggaguuauaauuuacaaacaaggaaacgcaggcuucuuaagggcucaguuugguggguuuugacaauuguauaaacacccacguaaccaccauccaaaagaagacagagaacauugccaacucuccagaaaguuccucgggcccccuuccacacaguugcuaccgcuuucugccccgagggcaaccacuucugacuucugucacuauaacucacuuccaccuguuccugggccucaugggaauggggucauguggugugugucauagugggggagccggucugacuccuuucgcuccccauaaggaauugggggaaaggcuagaugcucuccaagcaaccguaaucuguagccagaauggauuaaauccacagcucuagacguuucauuaaguacuuaccaauuauguucacuccagugaguuuucaggcaaaacugcaaaauugaaggaaaaaaaagacagaaagaaaaagaaaaggaagguguguccuuagauuuucugugcagcguggacgcuguccccucacguuaucuuuuggccucauccuggugguaacauucagcauucagcucuuacacaggacucccaccuugccugcacccuccaaacccccuuauguagaugaguuuacucuaccuuccuagcccgaugaggaaggagcuauuaguauccccauuuuagaguucaagaccaccgugagcaacauagcgagacuccaucccuacaaaaauuuuuuaaaaauuagccagacaugccuguagucccagcuacacaggaggcugaggcaggaggaucacuugggcccaagaguucaaggcugcagugagcuacgguugugccacuacacuccagccugguugucagagugagacccugucucaaaaaauauaucuauauccccauuuuacaggugaggaaacugaggcccacgaagguaacccaugugcaggaugccuucccuauggccacauagcuuucuacacauuagccucacugugaccugcccccaugugacacccuccacccuaggccucccuucuccacugaaacuucucuguacugagccccaaaccuucauaccccagucucuguuaaggcugaccugaaaagaaaggagcuuuccuccucuuuguaaguagugaccgugaagaucagccuccgauaccuacaggcuaguguggaguccacagagcaccucacaaggucacagucccaugagcccugaguccaugggaaucccucucuaaaauggagacccccaaggccccauccugauuucuugagucacaaucuaccacguuggaaccugagguuuguccuucaaaagauuccccuguccaugagccaagcauguggggucugugacccagaccaggaagaaugcagagcaggugguucuugccucgucuuccagauaaggggucgaggauuguccagucaaauggacacuggaggugaggggcagggggucuggaagacgccuuggcugcccuugugcucagaccauguagacgaccgccugaaccccuuccuguuugccuccugucacaccuacucuggagcugcugcggucgcuguguaccccacagugccggcuggccaagguccucaguccugcgccccugcccuuuucccgcagaguacuccacgcugcaggcgguccaggccaccaugauccucuccaccauucucugcugcaucgccuucuucaucuucgugcuccagcucuuccgccugaagcagggagagagguuuguccuaaccuccaucauccagcuaaugucauguaaguacaucaacgggcuucccuaacaaggggcuuucuggaauaagcacucccuucccagccgccaggagggaagccaggaggagggagaauuuggaaaggagaaauuggcagccgcgcggugcugugugccgguguguguuugcgugugugugugugugugugugggcgcaugcaugcuguaccacagugggacguuuauauuugggaguuuggauugaguugggaguccagggaaggcauccuggagacaugaagccagaggaucuggagggugaguaggagucgcugucgacaguguugugucucaauagagagaggagggaacaguguccuggguagagggaacagcaugacggaagcccugugacaggagggacggagagcugcccaguggggcuggagugcagugggaagugaaccagcagggcaggcagggccacgccccauggagucuugcaggccauagaaaggauuuggggucuuuguucuaagcugaugggaagccaucaacagguuucaagcuggugggugacagaggugcccacguugcaccaggccugugcuggcugcaggggcucaagagaugaacaaggcacagccucaguccuggaggaacuuggaggaagcagaggucucagagcauuuuuuucuacuuaggaauuuuagcaaggcuuaagucagaucagaagucagaagccacaccaugaucauuuguuguuucucagugacgauuuaaagcuuucugaugacaaaauacagaagucccuucuagggugcuuuccaaucaggaguugacgaguggcuugaugaaggcaagaaaucugggugugggagccaacuuaggcugcuuggcccuaaccacucuaacuaccaccuccuuccagcccuccaccucccgggccagggucaaguccaaaccugccaugcccucaggaugacccugagaugugucaucagugcagugcagugacaacuuguucuaguuugccugggaccauccucugguuuaaaacugaaagucccggucaggugcaggagcacuuugggaggcccaugcaggaggacugcuugagcccaggaguucaagaccagccugggcaacauagugagaccuccucuauacaaaaagaaaaaaaauuagccaagcauggcagagcacaccuguagucccagcuacuugggaggcuggaguggaagaucauuugagccugagagguaaaggcugcagugagcuguggggugcuguaccacuuguauuaguccauucucaagcugcuaauaaagacauacccgagacuggguaauuuguaaaggaaagaggcuuaauggacuuacaguuccacauggcuggggaggccucacagucauggcggaagacaaaggaagaacaaaagggcuuacauggcagcgggaaagagagcgugugcaggggaacucccauuuauaaaaccaucauaucuugugagacuuacucacuaccacaagaacaguaugggggaaccgcccccaugauucaaugaucuccaccuagccccguccuugacauguggggauuauuacaauucaaggugagauugggguggggacacagccaaaccauagcaccacuguacuccagcccgagggauacagugagacucuuccuugaaaaaauaauaagauaaauagaguagaauaaaauacaauauaaaauaaaaacacugaaagucccgcauccuaggaaaccccaguccagggcaaaguggggugguuggucacacucagcguccccuccccuuggggcacuuuuacuggacagccagguaccaccccuucuagguacagguggagaaugagaguguuuucaagugcaaaagacuccggagggucacuugaucuugagaaccccccaaguccaccacaguccuuccggggaccuuucuaaagugcagacucccaaggccccagccugcccucuugaaucagcaucugcuggguuagagccuggggauuuguacuccugucccugagccaagcguuggagagcaacaagccagaacaaaugaggccuaaagggagaaugcguucuucccaaggacccugggcgagguagucaggaggugucugaucccccuccuuuacugucucuguaucugccaguuagaggcguggaccccccacccucaccgaccccauuaaaggcaauugaauccugucauuuaacuugggguggggggacuugggugguuacucuguugcccgggcugaaguacaguggcgugaucauggcucacugcagccucggccuccagggcucaagcaaugcucccaccucagccucccaaggaacugggacuacagacaugugccauuaugccuggcuaauuuuuguagagaugggguuucacuauguugugcaggcuggucucgcaaucugccagcgucagccucucaaaguguugggauuccgagcaugagccaccgcacccagcuucugaaguuuauuuucuguuauugucuauguuugucuguugaucuguaagccugcuuagucaaaauugauuacccuaauauauguauuuaggaauuuuauauauauaaauuuucacauauaugaaaauucccccguauuuuaauaugaaagucacgucuucccauuuuccuugcauagcaucccauucuccccaacuccuguggccauuuucugguccaaagaccuggcccucccuguucugcuucaaacugcagaguguuuaaugcuguaucaggcagggaucuuuagacgcaagcagcagauacucuaacucaugugagagaugggauucuggggguagccugcaagaaucaaaggaaaagcugaaaaaccaggucuuggaaagaagauccaggcaccagcaacugauaggcagcggcuccagggaggugcugucagaaucaaggaacccugacagggucacuguuuagacucagguuuccaggagugagagucugauuggcggagauugucuacgcgcuuggccccuggccagagaaugucugagcaucuugaaggauagucccaccaaaacugccuggccaggagagagauaggucccccaaggaaaaccacagaaccuaagcucaucuuagcucuaaugucuguaaauauugggacagcaaguauuucuuuuuuuauuuuuugagauaggguuucgcucugucgcccaagcuggagugcaggggugcgaccuuggcucgcugcaaccuccgccuuccggguucaggcgauucuccugccgcagccucccaaguagcugggacuacaggugugcaccaucacacccagcuaauuuuuguguuuuuaguagaggugagguuuugcuauguuggccaggcuggucucgagcuccugggugcaagugaucugcccgcuucaaccucccaaaguggugggauuacaggcaugauccaacgcacccagccaaggaccacaaguacuaaaauuagggugcuuuuggccuuaugugagagaaaaucgaauuaacugugauuucagccacaaagauaguuacuauuuuuacauaacaaguacucuggagguagaaaaguuucuagagcugauuuagcagcgucugcgucaagcacuuccgcucauuccauccuucuauucugucaucuuuaguguugguguugaccucuucguggcuccaaaaaguuugcugcaacuccagauauuucauccugccccgacaauauuuaaagcagucagcaagagaaaggagagcaauuuaaaaaagcuuucuccucccucaucgcucucuuuucaggcagucauauuuuucuuuuuuuuuuugagaggaaguuuuugcuguugugcgggcuggagugcaguggugcgaucucggcucacugcaaccucugccucgugaguuaaagcgauucuccugccucagccucccuaguagcugggauuacaggcaccuaccaccacacccggcuaauuuuuuguauuuuuaguagggacgggguuucaccauguuggccaggcuggucuggaacuacugaccucaggugacccaccuaccuuggccucacaaagugcugggauuacaggcaugagucaccguguccggcccagggagucauauuuuucacugaagguuuucuguggucagaacugggauacauacugacccaucagcuauaacaaguaaacaggaaccagauugccaagaagaagguuggcaaacuauggcccauaggucaaaucuggccugccacauguuuuuguaaauaaaaucuuauuguaacacugccacuauuauucauuuuuguauugucuauagguggugucaugcuacuguggcagacuugugugaccauggcccacagaaaaccuaaacugcuuacugucuggcccuuuacaggguacgucuguggaccucuggcuuagaccaauuauguucacccucuggguuggugauguggcugcccaaacaaaacuggguuuaguuagcaagaaugggaagcaaaauagcuacaggguaggugacaauauccuuccacaaaauaucaguuguaauuuuuccaauagacuaaaauaaauaccuauuaauaauaagagcuuaaggcugcacgcgguggcucacgucuguaaucccagcacuuugggaggccgaggcaggaggauugcuugagcucaggaguucaagaccagccugggugacauggcaaaaucuugucucuacaacaaaauaauaauaaacaaagaauaaaagcugaaguuugucuucaacucuggccguaugccccugggcuacccagggugcacugugguccaugauuuauugaaaauucaccuuucuuccugacaggucugugugucaugauugcggccuccauuuauacagacaggcgugaagacauucacgacaaaaacgcgaaauucuaucccgugaccagagaaggcagcuacggcuacuccuacauccuggcguggguggccuucgccugcaccuucaucagcggcaugauguaccugauacugaggaagcgcaaauagaguuccggagcuggguugcuucugcugcaguacagaauccacauucagauaaccauuuuguauauaaucauuauuuuuugagguuuuucuagcaaacguauuguuuccuuuaaaagccaaaaaaaaaaaaaaaaaaaaaaaaaaaagaaaaaagaaaaaaaaaauccaaaagagagaagaguuuuugcauucuugagaucagagaauagacuaugaaggcugguauucagaacugcugcccacucaaaagucucaacaagacacaagcaaaaauccagcaaugcucaaauccaaaagcacucggcaggacauuucuuaaccauggggcugugaugggaggagaggagaggcugggaaagccgggucucuggggacgugcuuccuauggguuucagcuggcccaagccccucccgaaucucucugcuagugguggguggaagagggugaggugggguauaggagaagaaugacagcuuccugagagguuucacccaaguuccaagugagaagcagguguagucccuggcauucugucuguauccaaaccagagcccagccaucccuccgguaucggggugggucagaaaaagucucaccucaauuugccgacagugucaccugcuugccuuaggaauggucauccuuaaccugcgugccagauuuagacucgucuuuaggcaaaaccuacagcgcccccccccucaccccagaccuacagaaucagagucuucaagggauggggccagggaaucugcauuucuaacgcgcucccugggcaacgcuucagaugcguugaaguuggggaccacggugccugggccaggucagcagagcugccucguaaaugcugggguaucgucauguggagauggggaggugaaugcaacccccacagcaggccaaaaccuuggccuccaucgccacagcugucuacaucuagggccccaaaacuccauuccugagccaugugaacucauagacaccuucagggugugggguacagccuccuucccaucuuaucccagaaggccucucccuucuuguccagcccuucaugcuacaccuggcuggccucucaccccuauuucuagagccucagaggacccauccaccauucauucauucauucauucauucauucauucauucauucaucaacauaaaucauaacuugcaugcaugugccaggcacaggggauacccucuagagacaaucuccuccuagggcucauggccuaguggaggagacagauuaaaacuuaauuagaaaaacuggcuggguacaguggcucaugcuuguaaucccagcacuuugggaggcugaggcggguggaucaccugaggucaggaguucaagaccagccuggccaaaaugguaaaaccugucucuacuaaaaauacaaaaaugagcugggcgugguggugcaugccuguaaucccagcuaucagguggcugaggcaggagaaucacuugaaaugggagguggagguugcagugagccgagaccgugccacugcacuccagccugggugacagagugagacuccaucucaaaaaaagaaaaaaaagaaaagaaacuaauuacacacugugauggaggcugcaaagaacaccacuaagaauucaaaaucagcugggugcgguggcucacaccuguaaucccagcacuuugggaggcugaggcagguggaucacaaggucaggaguucaagaccagccuggccaacauggugaaaccccgucucuaccgaaaauacaacaaaauuagcccggugugguggcaggugccuguaaucccagcuacuuaggaggcugaggcaggagaaucgcuugaaacugggaggcggaggucgcagugagccgagauucaccacugcacuccagcccaggcgacagucugagacuccgucucaaaaauaaaacgauucaaaaucgaggccuguggcaugguagggaggcugcuuuacgcgugccuauuauuaaaugcuccuggaggcauuuagguauuuagaucagucuaaauauagcuccauucaguucgugcagaugacaguuauugggcaguaccugucuguguaacacccagaaaacaugucuguggaggggcccauggucccgacaguaaaugcggugagagggucccauagagcuggaguuuucaagcuuuagggguucccgugcugcuugggacaggcugauucagagggucugggugaaugauuuccaggugauuuuaagacugugcugagaaauagggcuuuuggggccuuguccuucaggaucaaagcaugaugcuguguggcaaugcagaccacccaggaaccaucccaggagauaagcucuuugcaccucauugucuuuuucugcuuauguuggagcaggaugcugggggcuguccugggauggggugugggaccucgugcuauuuaaauacuuuugcacuugaccuucugcugaguggaguggugguuugccaucagcucaguuccaguggagcugaagagacaucugguuugaguaguuuuagggccaccauggauaucucuucaaugcaggauuggcucuuuccaucugcucuuucauucauuuguuuuugacagauaguauuaaauguuuaccauguuccaggcacugugugaggcucugaaaauacaggggugagcaaauccagauauccucccugccaucaugaaguuuggagucuaugagauaggacccccucccuauggagaagccaccaaugcaguacagggugaccuggggccagagacaggacaaaugucaccuccugccuccaugagauacucucacuagucauauugugggcaagaauguggcuuacaccccuaggguuaacaggaugcuacccaagcucauggaggaaguugaaucuuaaguucccuugaaacuuucuaccuugguggcuuuucuauaauuuucuuuuuucuuuuucuuuuuuuuuuuuuuuuuugagacugaguuuugcucuuguugcccaggcuggagugcaguggcaccaucuuggcucaccgcaaccucugccuccuggguucaagugauucuccugccucagccucccgaguagcugggauuacaggcaugucccaccaugcccagcuaauuuuuguauuuuuaguagagaugggguuucuccauguuggucaggcugguuucgaacucccaaccucaggugauccgcccaccucagccuuccaaagugcugggauuacaggcaugagccacugcgucuggccuucuauaauuuucugguagucacgauggaaacaaacaaaacaccuuagaaccagagaucgacccccucaagcaauacaucaauucccuucacaagaaacgucggggcuacaugaguaucuguguugaaugcggucugaaaugauccuauggauuuucccggcugguugccacugcuguacaacauucagugcccacauccaccugugccauuaagcuuuuuugagacaugagagaugccucuucccugcuguaugacaugcauuugggaaguuggaaagaaaugacaaaaucagggagaaaacauccaagcuucuuaccuguagauagaaucagcccucacuuggugcuuauuaccaguuauucaagaacaauaacaacaacaaaauuaguagacauccaagaagcacauauuaggaccaaagauagcaucaacuguauuugaaggaacuguaguuugcgcauuuuaugacauuuuuauaaaguacuguaauucuuucauugaggggcuaugugauggagacagacuaacucauuuuguuauuugcauuaaaauuauuuugggucucuguucaaaugaguuuggagaaugcuugacuuguuggucugugugaauguguauauauauauaccugaauacaggaacaucggagaccuauucacucccacacacucugcuauaguuugcgugcuuuuguggacaccccucaugaacaggcuggcgcucuaggacgcucuguguucacugaugaugaagaaaccuagaacuccaagccuguuuguaaacacacuaaacacaguggccuagauagaaacuguaucguaguuuaaaaucugccucgcgggauguuacuaaacucgcuaauaguuuaaagguuacuuacaauagagcaaguuggacaauuuugugguguuggggaaauguuagggcaaggccuagagguucauuuugaaucuugguuugugacuuuaggguaguuagaaacuuucuacuuaauguaccuuuaaaauaguccauuuucuauguuuuguauaaucugaaacuguacauggaaaauaaaguuuaaaaccagauugcccagagcaagacucuaauguucccaacggugaugacaucuagggcagaaugcugccauuuugaggggcagggggucagcugauuucucaucaagauaauaauguaugguuuuuacacuaagcaacugauaaauggacaauuuaucacugga

SEQ ID NO: 192600 - RNA, 63706 nt, Homo sapiens
gggccgggccuucgggcccgaggcggcggcggcgguauaaagccggcgacugggagcauguaaugucggaaugcggaggccgcggcggcggcagcagcagcagcgaggacgccgaggacgagggagggggcggcggcggccccgcgggcucagacugccucagcucgagcccgacccuggccacagcguccucggcgggccggcuccgucgcgggcugcguggcgccuuccucauggcgcgccagcggccggagcugcucugcggggccguggcgcucggcugcgcgcugcuccucgcccucaaguucaccugcaggugaggcggcccggacccuggggccccgcuagggcgcuccccuugcucugccgccuggagccugcagggccgggucgcagcggccucagccggggaagucgggccugaccuugcccaggacggcugaccccucccggaaccugcggccacggcuucccaccuucuccucgccccggcccgcccgcggacauuauggcgaggcuuccggguggagcccugcgcccuaucgucccgcuuuagugccgagggaggcgggucgggggugcuccucaccuguuggagucacuagggguggaccugucacuucggcccgggcuguaggacccucauuucucaccgauuucauuccccuuaagcuucagguguagugauccacaaccuugcgagaguuccagaccccuuuuagaauucccgcacucauugaucuaacgauuauuuuuauuuugagacggagucacgcauugugucccaggcaggagugcaguggcgcgaucucggcucacugaaaccuccgccucccggguucaagggguucuucugccucagcuccugaguagcucggauuacaggcgcgcgccaccacgccuggcuaauuuuuguauuuuuaguagagacagaguuucaccacguuggccaggcuggucucgaacuccugaccucacgugauccacccgucucggccucccaaagugcugggauuacaggcgagagccccgcacccggccugaucuaacgauuauuuaucugcaccuacuaugugccggacgcucguccgggugaacuuuuugcucccuugaguggaugggacagugaacaaguaaauauaauuuuuuaaagcuucagugcuaugcagggcauagaaacgauggcgguggggaaagacuuccuaaggaagugacauuugaagcuuauacaaaaaggagaagggaccagcgcugggaagaucccgggggagcguguccacgguagagcgaacagcaaaugcagaguuucugaggcugggcaagcuugguguuucccuggaauugauaaaaaggccugacaguaggcugggguguaggggguaggaacaugaaaguucaugugugucuuuucaggaauguacacacauacaaaauuugcuguauauuucagguguacuucuggucucccaaauccacagugggucuuuugggauuccaguuuauaagaucuguauugcuacuaugauaucugugauuucaccucggaacauuuuugaguuuauuuagcacgauauguggccaguugucaaagaggugucaaaagaucggggauuuuaguggaaagauaaauuauaauaacucucagugagcauuuuccauaggccagguacugucagcaggguuucuccgucuuggcacuguugauauuuugggucagauaauucuguguugugggggcugcccugacuacuguaggaugucuagcagcauccccggccucuacccacuagauaccaguagcacaccccacaagauguaacaacuacaauggcuucagacauuguuagauguccccugggagcaaaauugccugcuugggaaccacuguuuccaugaagcauuuauucauuuaguacauaauugagagccuaguaugggugucauuuaaaucuuacaauccccauuaaaguuugaauauacuguuaucuuucccagugcacagaugaaggaguccagccuucgugauguuucagaaccugcuccaaaucacaccuacgugauaaggggcugagcuggaauuugaauccuuuauugucaggaccuccuagauucuuaaccuuguacuuuauucuugucucccacaaggacaguauacaaaguauuuuacaagguagaguguugcgaggugacauuuagguucaaauuaggaagagagguuucccccuccaggggugaaguuuauuuacaucgguuuguuaaagucuagaaauaaugguuaauguuuguucugagacagcauggcuuaauugauacagaaguccuuugagauugaaaaggaaggaagagaguaaauccaguuacuagaguaggcagaaugagauccuuucuugcuucaggcaaggagaaugaaccaguaaauggcugcugcuucaucuucuuucugugucacuggcaaauuugacagucuuuuaauagacucggauuaauuuuuuuagggucaucuuugauugaauggugucaugauacuguuuauugcugugcaacuggcuaacauuucuacccccgcuuuuccucuuucaguuuuaagaucuuugcuuuaauaaggagauaggcuuaagggagaauaggauuuuuuuuuuuuuuuuuaucuuggcucacugcaaccucugccuccugggaucaagugauucuccugccucagccuccugaguagcugggauuacaggugcgugccaccaugcccagcugauuuuuguauuuuucguagagacgggguuucaccauguugaccaggcuggucucgaacuccugacuucaggugguccuccuacuucggccucccaaagugcugggauuacagugugagccaccgcgccuggccuaggauuuuuuuuuuuaauuuaauuuuuaugaacagcuccaggcuugaaauaaaugucugcucuuuucaaugucuguggcuuggcugaauucaaaccagcuaauauggaaaagguugauuugagguugagccacagugaauaaucgugcguuucugggcaucuaaucuuuacuuaccugugucucuucauccugcucaccuuucuuuuaccuugauuuagagggaaaaaaaauugucuguguguagauacauauguauguauacauguauuuauuuugcuuuauuccauuuuguaauuucaaagcugccucgaauggucuuugcaaggaagugauguagggugugaauuucauaggaaaauugggguuucaacaggccuuuuuucuauguugccccggcuggagugcaguggcuauucacaggugcaauuauggcaugcugcagccucaaacugcugggcucaaguaauucuccugccuuagccuccugaguauaguagcugggacuauaggcacaugcuacuggcucagcaacaacaggccuucuuauuugcaaccaacucgaguuuuuuguacccgagacauaccccucauagcugcaggaaaucuuugcucuauguauaguuucucuaaagcgugaagcagauugaugaguuaaauagaaacucaccaguguuucugauggaguagaggcgagcguuucuucucccuggccaauauuugauuuuugauuggccuuguacuuuaucuggcucauuuaggaaugcuucugaauaugcagagcaaaauuacugaguugcucuuuauccuuucguugacugucagaccuacauuuuuccucagauugcauuauuugaugcuuacauugcauuuuuuuuuucuuuugagauggaguuuugcucuuuuuucccaggcuggagugcaauggcgugaucuuggcucacugcaaacuccgccucccguguucaagcgauucuccugccucagccucccaaguggcugggauuacaggugugcaccaccaugcccagcuaauuuuguauuuuuaguagaaaugggguuucccgguguuggucaggcuggucuuaaacuccugaccucaugugauccacccgccucugucucccaaagugcugggauuacaggcgugagccacgacucuuggccaugugcaguuugaaugguagaaaaguaauuucuccaaagagcagaauuuuggaucucuugaaaacgugucuuuuuuuuuuuuuuccuguagugcccuccccaccucuuagguggcuaucuucuugucauucaggucucagagcuuaaauuauagcaccucccaagccaccacuccaucagaggagcuaccaugcccuucuguacaucaccuuguuaaauuuuucacauagugagcauuuaguauauuuuuauuguuuacacauuugauguuuuuccugucuuccuccccuagaaaguggucuccucgacaacacgcagugcuagcugccgcagccuuagugcuugugcccaaagcacagucacagcugcucaguaaagaauuuuugaauaauuguguaagugauuuuuucagguuaugaaggcauucugcauagacugaaagcucucugauugaagguuaaaauauuaguuugagugaauaaauaggugacuugcuccguuggauacuucugccuguucuggaauuucauauaaaugcagucauagugcauguacucuuuagcacuuuuuucacucagcauaaucauuuugagacucauccaaguuauaguacauaugaauagguuuugcuuuucguuuuuauuguggaguaacauuuaaguaaauggguaagaauauaccccaguuuaucauuuuaccucaugagucaugccagauuucuuaugcucacuauuuacauaguuuuucuuuucccauccuuaugccuuuauccugugucuuuauauuuaagauauaucucguuuagauagugcauaauugggucuugcuuuauccugucuggcagucugcuccuccuaauuagguugcuuccuuuuuuuuuuuuuuuuuuuuuuugagagacguagucucgcucuguugccgaggcugagugcaauggcaugaucuuggcucacugcaaccuacacaauucuccugccucagccucccgaguagcugagacuacagguaugugccaccacgcccggcuaauuuuuuguauuuuuuucaguagagaugggguuucaccauguuagcuaggauggucuugaucuccugaccucguggucugccugccucggcuucccacagugcuggaauuacaggcaugagccaccgcgcccggccucuccuuuuauauuuaacguaauuguugagguaguuggguuuaagucuaccuucgugcuccuuguuuuccauuuguaccgucuggcuuuuguucuuuucuuguuccuuuacuuacuuucuuucuuuuuuuuuuuuuuagauggaguuuuguucuagucaccuaggcuggagugcaauggugcaaucucggcucacugcaaccuccgccucccggguucaagcgauucuugugucucagcuucccgagaagcugggauuacaggcgcccaucaccacgcccagcuacuuuuucauuuucaguagagacaggguuucaccauguuggccaggcuggucuugaacuccugaccucaggagauuugccugccucggccucccaaagugcuggaauuacaggcugagucaccacgccuggucuccuuuacuuucuuugggguuaaucucaucgcguuuuagguuuccauguuuauguucucuauuuaucucguuuagauagugcauaauugggucucauuuguuucuuagcaaagcugcccuaaugguuugugguaugugaguguagaugcauggacagcucaggguguuuacuagggcccuucuacuuggugggaugcagccugggccuagaucuuuaggucuugauggggaaaguuacuucugaccacuuguuuguucagcguucuuuucuuuuuccuccugaucuguuucuugugggaagcucaaguguucaaaaagcccauuuuccaguuaaauaggcuguugcuuuguuacuuaucuucauuagucuuaggauuaugauauauaucuggaggaauguauauuauuguuuaauuguuacuguuaccugaaugcccuggauaaguacaagccaacuccagcuaauaagcuuaauguuuucucaaaguugaguugauuguaagcaucucccguggaaaucuuguuaaugguaguuuacaugcucccucaccguaauucugagcuugcaugcugguggcucuaaagcccuggagauaaguggcuuuuguggagagccaggcugcagaaaaaggaggaugaagucuuugggauguggggagcaggaauauggauuauucagagacauccuucucugcucuccacugcccuuccagccuacaccuaggggacagaaucucagagaauuguuuccaacguauuauucaugucuugcauuugcucagccagauguugccuuucuagggcagugauuuugggacuccauuuucuuauucaaaagaggauuuuccuuuuaagcuucauucuacuuccacagagcuauuuuuagaagaagauaaacuaagcaaucuuuucuguguuugcucuuuuuuagucgagcaaaagaugugauaauaccagcaaagccaccugucagcuuuuucuccuugaggucuccaguccuugaccucuuccaggggcagcuggauuaugcagaguacguucgacgggauucagaggugguacugcucuucuucuaugccccuugguguggacaguccaucgcugccagggcagaaauugagcaagcagcaagucggcuuucagaucagguaaugcucacauucagcuuaagaaucaaaugacugucaguccuauauguagggcaggauguccccacagagacaccuugcccaacgggcagacuuugccaaggugaacuccaggagucguuucuaaguuacagagcuuucuauaaagcaacagaaaggauuuccaauuguggcgauuguacuccaaggcaagugugggagcagauucugaaucucauaacacaagccaaugcuuauccuggggugccauacuguuugguuucagcauugaaaaagguagagggacugaaaauccuaguucuugcauauccauuugauacuugcuaguuagguauuuuagguaagaaaauguauguaugauaugacugcauuguaacaaggccgaccuuuuuaauauauggaccagaacuauauucagcagauaaggaaugccaccuuugggcuagguaagaaagauauauaggcaaauaagucaccuguuauggcagugguuuucagcccaguggaccccaguugugcuuuagaaaauaaguauuuuaugaugucccuuuuucuuccuaaaaaggaauucauagaugauaaaguuuuccuauacauguaauuucaaaauaaucuaaugcacggauuguaacauagaggugaggggggaagaaaguaauuuguaacuaaaugauauauauuuuaguauguaagugcacagucagaacagguccauauaccuuuauguagaaucacugaaugggauaguuacaaacguagacugauaaaggugauauguuggugacuuaccugccacauggacauugcucuuaguaauugauuauccuaaauggugaacagucuugguaaaauccugaacuaugcaaagcccuuucugcucucaguuuacauagaaguugcauuccugaaaaauucagugaacacaaaaagcaugcuuuagauucacauguaaaauggagcuagguacugggcuuugauaauaacagguuuuccccaacaucaguguuuggcaggcguuuugaacuccucuggaaugcuauggacgacucuuccgugugcaaagcagguuugaguguagcaggacaucuaccaacaccccugcccuacguaugcacuguagcuucccccagucauuguagcaagccaaaagcaucccacagauuucuaagacucuccugcucagaaccacugaugugaaguaacguguguaggcagcugaguuccagaaguucauuuggaacugucauuugguuuuucuuagaaacuguggagccuuccaaauuuagagaacaaaguucacguugcccauguugggcacaagagggauaucuauuguguuuuauuaauaagugugaauuagcuaccuuacugucagccuaagcaguauguccuucugagugauggcauuaguauaauaauaaugauauucuggugugccaggccccaugccaauucucaaccacuuugcaaggcgaugcugucagcccuguuuuucugaagcaggacugcaggcauaaggggugaagcaguuuguuuaccaucacguagugguggggguuguagugcaauccagggacugcugcuuuuuuuaaaaaaaaaauuucagcuccuuccaaauugagagcuuacuauuccauguacucaguagggaaaaaaguggguuuauuuuuggaaacacacagaaaucuuuugaacuguauugcaugguaagauugguaaacacgguccaaguccugccuggacaucauagauaagaguaugucuuucuuuuuuguuuuagugauaaauuaugaccuuugaaaacucaaaacaguuuuuuucauaguuucuguuucagugagagaggaaucauucuauuuuuaaauuucaucuuuuaaaucuugguaacuuuucaguuguuauucauagucauuugaaaaccuuuuuuggcucugcagguguuguuuguggcaauuaacuguugguggaaccaggggaaaugcagaaaacagaaacacuucuuuuauuuuccuguaauauaucuguaucaucggagguaagaacuuuuuaaauagcgucucucauuccaguuuaguuugccaguuuauaaaugaauuuugcauuuuuucuauauuaaaguauuagauauucacuauagaaaauucagauaauacagauaagcaaaaauuaaaaaagaaagaucuggauaauccaccccccuuuuuaaagcuaaacaugggaucaggcaguaauacuauuuccuaaacugcuuuucucacuuuuuugagcaucuuuucaugucauuacacauuuuacagcauuguuuuuaaaaguacgaauuacuccaaugcauuucagauaucguaagaguguuuuguaaaaauacacaaaauuucuuaucguuucaucuggaggcauagcagaguccagaguguaucuuaccaucuauucuauugggaagaaaauuacuacaaguacacagucccauguccacaauucuuuuuuuuuuuugagacggagucucacucuguugcccaggcuggagugcaguggcgcgaucuccgcucacugcaagcucggccucccggauucacgccauucuccugccucagccucccaaguaguugggacuacaggcacccaccucccugcccagcuaauuuuuuuuguauuuuuaguagagacaggguuuuaccgcccauguccacaauucuaaagucacaaagagggcugaaaaacggaaagaguuuuauuuuaucuuauuuuauuuuauuuuauuuugagacagaguuuagcuuuuguugcccaggcuggagugcaguggugcaaucucggcucacugcagccuccgccucaggguucaagccguucuccugccucagccucccgaguagcugggauuacaggugccugccaccacgcccggcuaauuuuuguauucuuaguagagacgggguuuuaccauguugccaggcuggucucgaccuaggcuguacuagaguacagcccagacccugcugugaaugauaaguaaugucuaaaaaucugacucaaagaguuuuggagauaggagauaggacuuuggacuuuguucagggugauuggcuugaaguuuguugaaaguaaaauggguaaaggagauuugaucaguagagagcuuuccuuuuuccuucuaaaguucuugggccauaaucaauggggauuuauagcaaacaugcacaaacagugauuuguggguucucugucacauuccaucccauuuccgugucuguaacauaaacuguugucuggcacauaguauugacucccaggaacuauuagguaguauuugggcaaaaacacacuuuucuaccccaucucuacccccacauuuuccucuggauauuagauguuuguauuuuaauauuuguaguaagaagccaguuuuugcuuagggaccacuaagaccauuuucagauuucuuccccacuuuuuggccaguaacuuggagguucugccuuuacauggaagguucaaguacagguuuuuucggauacaggaauacuuucucagaguuacuguuuuuguuuuaaagguaaguguaaggugguguacuuaacucugugcucuguaacgggauggugagcuugcccugcugagguccuugcauuucuuuuuggcuuugaaaaaaggcauggaagccuaguggggggguguaguccuuucagacugcucagagguggacauaacgugaugugacauuaaaaucagaagaguuccauggaaucaaguacaagugucauuuugggauaugcagguauacaguauugucauauauauacuauuugcuugcuuagcuuuugcagaaagauugaagggaccucaaaggaacuuuagaaauguguccaaccuucuuauuuuacagaugaggaauuugaggugguacgcaccuugaaaugcccgccuccacaccccugucuuugcauuguuagcuuuuacaagucacuagaacccuuguaacaucacaacaggaaaacucaucaaagccucuuggccugagugguugagguuuccagauugguagcuccuuuuucuggaacaaaauaaguuagaugcuuuuuugauuucuuccuuuaaauuaaaaauuauuggugguugaugggguuggugguggugguaauuuuuaaacggaacuaauuuguaguaagucuugauuugguagaauuauuaacugugucccagcuguacauguagagaacgcuguuuuucacuuuuuuucaugcuaauauuccuuuaacaucauucugcagugcacauggaagaauuguguuuaucccaucacgugugugugugugugugugugugugugugaauuucuguaaccauguauuaugguauuauaaucacagccuuuauaaaauucuucacugggcucuuguugcuguuaacaguaagcuuaaugucaauuucuguuuagagaaaagaacgauuaugcaguuguugaauuucaccauaaccccccaacccuugccaccuaccauccaauuauauuugggcagugucuguauugugugagacugaagagaggcacgugagaauucugauuagcuuaggaggauaacugaauaguggugguaucacuuagcggcacugaauccaauucuauguguccccaggcacaacuggaggggaaaggaagaaagauuauuuaaacaggucacugacuucagaccuucacauaauuuguuauuguuguaauaaagcuucaaauagguuuaagguucauucagugauccuuugucugccuguuucuuuuuaguaggccaagggcugacuguucaaccugucccuuaccucacagugacuaguagaaggaaagucugcccgccugcguugaauuguauaguuaaauccuggaaucccuuagcauguggucaauuuccaggguugucucucuguuuuguuuuuaaaagaacuacugugggaauuaauuuuuuuuucagagauaagaguaaauguuccuuguuuggcaauucaguuugcaguugaauucaagaucauagaaggguaggggcugcuugugccucuccucacccaaaaugcuuguucuuaauucucuggucaccuccugagcaaagcaggcuacugaucugugacuugguuggaucccaaagcaagacacuuucauuuugugguggugaugauuuuaguuauacauuacaggcuuaaugcaugguguauuauuuuuauuauuuuuauuuuuauuuuuauuuuuugguacuaguuuuggaccaaucgaauacaaaggccccaugagugcuguuuacauugagaaguuuguccgccgggugaugaaaccacuucucuacaucccaucucaaucagaauuacuagauuuucucucaaacuacgagguacuugucuuucauaucuccuccuccauacucaaggccuuucacgggguuguauuggauuguuuguuuuaaagggguuuaaaaaaauaccuccugaauugcagcaaguaaaaggucaugugauagaucagccccaguuaaaugcuuuuugagauacugauuauaaggaugguuuguccaagagaguuuuaagagaauagaguacuagcaaagucuuuguuuuucguuagggaauuuucaacagauuuucaucuugccuuacaguuaacuuagaguagaugagaauuaacuuacaauuuaugugcaacugcaaauuucuaagaauauuacuugacacuucucauagcauuguacuaugagauaccugguuucucuugucaguuguaguuugguuuuuuugaaaacuggaaauauguucccuuccauauuaugaaguauauaacuauuugaaggucuuaauugcagaaaguuuucuaacuuuccugauguagcuucuuuccugcuuccccacugccaacuucaaccccugguaaauuauuuuuaugguauuuucuuuuuugagacagagucuugcucugacacccaggcuggagugcaaucucagcucacugcaaacuccacuuccuggguucaagugcuucuugugccucagccacccaaguaguugcaauaacaggcagugccaccacgcccagcuaauuuuuguauuuuucacuaaagaggguuucaccauguugaccaggcuggucuugaacucugggccucaagugaucuucccauguuggccuccccucacagugcugggauugcaggugugggacgccacgcccagcccuguaggaucuuuaaugcauguuaagaauggcuuauugugaggccaguauugggauuauugaaagauguagccucaaaaaauuauaaaaguaguucugcaaaaaauucacuggagcaaguguaaaaucauacuugaguacaaguaaaaugauacuuagguacaacaaaaucaagaccauaaauaccugacagagauuaaaaaaccauguauauccagaccuuccugacaguuuagaauuguggcuaguugaauuuuacuguucgcacuauuuauauucuguauagauuggauacacauuuuuucaccagaacaucaguauagcuuuauucagucauguuggaaacuacauauguguuaacuauuagcagagauuccccaagcagcaguauaucuaguuauucugcuuuuaguucuuagcuaugcaucagaguaaauauuccuuaauuacauagauagcagauggaugucugugcaccucagaggccugccucucauuuucccugggcaggcuggugggugagggcuauauuaagaggcaggguacuggggccugaucccuuuggcacacucacuggguuugugauuuggggcggguuacucacuuccugggcaucaggggccugggccaggguauccuugagauuccuucuaacaguaaaguugugguaaguggguuuugacaugguucuucaguggguuacagccagagccacucgggauggcacagcaaaauggugaagaaucaggagucagacagaccugcuuuuagcaguacuccauugauugauugauugauugauugauugauuuagagauggucucacucuguuacccaggcuggagugcaguggcaugaucuuggcucgcugcaaucuccaucucucagguucaagugauucuucugccucagccuccuaaguagcugggauuacaggcaugcaccaucauaccuggcuaauuuuuuguauuuucaguagagaugggguuucaccauguuggccaggcuggauuauuuuauuuuuuugagauaggguuucacucugucacccaggcuggagugugguggcaugaacucggcucaagcgaucguucugccucagccucccaaagugcugggauuacaggugugagccaucaugcccagcccagcaguacuuuaaaagacuauccuccaaguauugguguggaguucauguuagacucacuaaucuacugacgacauuacugcugaugacauuuaaaacauuacauuaaguuuuuuggcagcccacuuagagugauguacaacagugauuaaacuggacugccuuuaaaaugggaaccacaagagugcuaccaagauggggucccuagaucacuucugucagccuuuaaaaugacuuccucccaaaagcuguggcuuuuaucggguuaguaucaucuuuugcugggcuugucacugagaugagauugucucauuggcaagagauagauaguacuuuauuaauugugaaacaacucacuagucaagcccaucgugacacuugugaaaccauuugucuugcaaaauauaccaaauagcacagccuagaaaauguaucaguuucacacacacugccuauaagauagagacagaauucuagauccagaaaugaaaccacugucaugguuuugaugguugaauaauuaggaaaguuaaggaauuuuuggagucccuggaguagaacacaguaagcuuuugaauauucugcuaaguuaggguuucucaaccuuggcgcaguugacguuggaggucagauaauucuguguuuuggggggcuguccugugguuuguaggauauuuagcaauaucccuggccuccacccacuagauguugguagcacccuuuucuccccucauuugugacaaccaaaaauaucugcagaccuugccaaauaccccucagggggcaaaauucccccauuaagaacuacugcucugaagaauugaguuuucccaauuaaggccuuaagaggaagaaaacaugucuuuuaucauggggcucucaaaggcauucauuuaauaguuaaaaguuuaucugcuuauaaugguggcaguagagagaagaugaaaauuaaacagugccuugacuagagaaugguggaagguuauggugggguggggggggcggguggaaauuauagcuaggggugaguuagagugucaucaguagagcugucucugauacucaacuuuuuacucaaacuacucacuuuuuccaaaaaacacaaacaaaaaaacccuauacaguuuaaauaugugaaggaacuugcuaauuuaaagacaucuuacuaugaaagauacuuguuuuggucaagagccuuaucucaguuuauauuuuuuaucaauauggauuucaguaucaaguguguuuaaauuuaaguauaucaaaauugggucaaaauaauuaauguuuucauggcacuucugaaguuugacauaaugaaggauugguuuuuuuuugcuugacuuagugucuguuagauauguuuguaacaucuuguaggaguaugugugauaauuuccuccuuguuuuaaaaaaaaauuucuugcguaggaucuggauuuuaaggaaggaaaaaaaaagaaaaaaaauugauuaauuauaaauuugucucuaaucuagauauuugugagcauuuuggaccauuauaaaauuauauaguuagcauucauuacuugggaagugaugauguccugaaauacauaauauucucuauugacauaaacuuguuuuugagacagagucucgcucugucucccaggcuggagugcaguggcgcaaucucgucucaccgcaaccuccaccuccuggguucaggugauucucgugccucagccuccucaguagcugggauuacaggcaugugccuccacgccuggcuguuuuuguauuuuuaguagagaugggguuucaccauuuggccaggcuggucuugaacuccuagccucaagugaucagcccaccuuagccucccaaaaugcuaggauuacaggugugagccacugugccccgcugacguaaaauuuuauuauauguauauggaacucuauucauguaugcuuauucuauuguuagaaaaagaaauguacuaauuguaucuugguuuuaauuuuuagaaguccuauaguugaauccuuucaaaggccuauucagaugauuugauacugaauugcuuagaguggaaauuuuuuuuuuuuuuuuuuuuuugagguggagucucgcucuguuguccaggcuggagugcagcggcgugaucuuggcucacugcagccuccaccugccagguucaagugauucuccugccucagccuccugaguagcugggacucaggcaugugccaccaugcccgguuaauuuuuguauuuuuaguagagauggaguuucaccuuguuagcuaggauggucucuaucucuugaccucgugaucugccugccucggccucccaaagugcugggauugcaggcgugaggcaccgcacacggccgaagaguggaaguuuuuaaccaauggaaaauauuuuauuuggcuuagauaucucagaccuaccaauaucacauugcgcuaaucauuaaccaugguuuuauguuuguaaacuaugacucuaagaggccuggcgaggugcuucaugccugcaaccccagcacuugggaggccaagguggaggauugcuggaagccaggaauucaagaccagccugggcaacaaaauuagacccugugucuauaacaaaauguuaaaaauuagccaagcaugguggcacaugccuguagucccagcucuacuugggaggcugaggcugaaggauugcuugaguccaggaguuuggcguuacagugagcuaugauggcaccacugcacuccauccugggcaacagagugagacuccaucucaaaacaaaacaaagacaagacucugagaccagaaacaauuucuaggacaacaguuuugccuuuaaguuacuuaaacaucacagaaagccauuaaagggugaguacuaaaaauucuuaacuuuguaaacccugaaauacuucaguuguuauuagcaaagaaguaaugcauaaacuaugcauggugaagugcucuucaguuuucaagugcuuauuucuaaauguuccaaacagcugggugagguagauggaaacuguggauccuuccaacagauuaagaagcuaagguacagggaggcugugauuuaccuacauggagacuggacgacagcccagccuuguggcuccccaaauucuugucuaucauguuccuuccucaaagaaauauuuaagguuccugaauugaaacuucaguaucuacccagggguuacaacuucaaauauuuauuuaaugucauuuuuugaaacuuuuuucuuuuaugguagaacauuuugacgauguuggcuccuuaauuuggcuguuagcuuuuuuuuuuuucuaaaugaauacuuaaaagaauaaauauggaugaaggaugaugccauggcucuuaagcagcagaguuuugccauuuccuguuauuaauugggucauucacauuuauucugcagaacugggauuauuuuguguaugauagucacaauauucaggcaggguauggucuauaauuuucuacccagguaagcacuacaaugauacuucccuuguaaauaaugaauguagcuaaaaacugaaaugaacuugccaggagaucccauaaagggagauuaagagcucuauauaauuuucuugcaaaccauguuaagaaauuugacugggccccguggcucacaccuguaaucccaguacuuugggaggccgaggcgggcagaucaugaggucaggaguuuaagaccagccuggccaacauggugaaaccucgucucuacuaaaaauacaaaaaauuagccggaugugguggcgggcgccuguaaucccagcuacucgggaggcugaggcaggagaauugcuuuaaccugugagucagagguugcagugagcggagaucacgccacugcacgccagccuuggcgacagagaaagacucugucuccaaaaaagagaaaaagaaauucuacuuacuucaguuacuccaguuguggaaucccucuuccuugaauguucuuccugccaauuuaaauagagagaggaaaaugaagucgauuacuguggacaacguauacuaacagaaccagugucauuuuuauuuuuauuuuauagagaugaggucuugccauguugcccaggcuaguuuggaacuccugaggucaggugauccucccaucucagcccccaaaaguccugggauuauagacauaagccaccacaccuggccggugucauuuuuauuucaguggacauuaaguugauuggaaagggaauaggacugagcaauagucauuuaauuuucagugacuaauuuucuggcuccucuaauuucaguauuguuuggacaucauuuguguuagguauugguagcuucuacaucaguagugcuuacuuucuuauuuauuuguuuguuugauuguuuuuuugagacagagucucccucucuugcccaggguggagugcaguggugcgaucucugcucacuguagccuccaccucccagguucaagcaauucuccugccucagccucccaaguagcugcaacuacaggugcccaccaucacgccuggcuaauuuuuguguuuuuaguagagaugggauuucaccaggcuggccaagggugaucuugaacuccuggccucaagugaucugaggggauuacaggcgugagugcugcuggccucuuuuuuauuuuuuaaagcacuugacagauucauuugacuuguacuuuauaauuuacucaccaaaugcuaacaguauuauuauuucaaacucuucuaucugcaggcaaaauauuuuaagaaucuuuccaugaauuucuguauccauuuaagaacacuuauuuagcauacauucauucauuuauuccuaacagcuugguaacaaaauuguuuuaaauuuagaugggauggggaaaggcucgggaaucuuuuagggggaagaagagaguuaaguaaaauugccagaugacagaaaacaugagcauuuugacagaauuguagaaugcugguacccaacauugucauauuguuuguaaaauucuacucugaauguugugcacauagguacuguuucuguuaguucauaguuuuguggguuuuuuuuuuguuuguuuuuuguuuuaagauggagucuugcccuuuugcccaggcuggaaugcaguggcacgaucuuggcucacugcaaccuccaccucccugguucaagcaauucuugugccucagccuccugaguagcuggaauuacaggcgugcaccaccauggcuggcuaauuuuuuuauuuucaguagagacaggguuccaccauaucggccaggcuggucuugaacucccgaccucaagugauccaccugccucagccucccaaagugcugggauuacaggcgugagccagggcaacagagugagaaucuguuucuuuuuuuuuuucuuuuuuuucuuuuuuuuugagauggacucuugcucucucccccaccugcuggagugcaggggcaugaucucagcucacugcagccuccacccccuggguucaagggauucucuugccucagcuuuccgaguauuugggacuacaggcauguaccaccacaccuggcuaauuuuuguauuuuuuaauagagacagaguuuuaccauguugaccaggcuggucuugaacuccugaccucaaaugauccucccucuuaggucucccaaagugcugcgauuacaagugugagcuacugcacccagccuagauguuaaguuucuaucagaaugaaaaccaauugauucauuuacaguugaaucuuacaacaagcaagugguuuagauuggaaagauaguauauucuacuacagaucaaaaguuuccucuuuuuuauaacauauugauuuuaaacuuuaccaacagaucaaauuuccaccaaauuuuggaugcaauuuuguuucaaugaucaaguucauuuccacaaugacuuacuaauauagaguguagugccaagugcuuuugggcucaaaaggauucuuuucauuugccuagugcuuuacgguucaucaggcuugcucuuugccuaacccugugaagaauuguuccuauuuccacaucaggcaacugagguuucauauugaaggguucucccgaggcuguucauucagccacuagaucucagacuugagcuuaggucuucugacuccaaguccagcacucuuuccucagggaucucaaaauuugacuuuuaagacagauacgauuauuacagaauaaaaccugacugaaugagugccacagggccuuccaagaaggaagaagugauuguaaacaggaaggcagaacauaucugguaggggacaguuaauugguuuggcagaaugaaggggcauucuacgcccagcuuagagaaguggaaugagcagguggaaaugaauguguaggguggaggagccagagggccagaggcggguccucugcagaucugagggaaaggagaguugccacuguggaaugcuggguuuuggcggggguucugugguuuguuuccuguugaaggggcuugauuacaggugaagauuaacccugauuuccagcaaagugugaagguauguuuggagucaaugagagagagagauucaagaagaaacuuaagaaagguuaaaagaaaauuauugccauugcuugucuggaguuguuaaaagcgauugaggacauaacuuacugauaaaguuuugagccugggagaauuguacugucaacaaacaggguguggaaagaccuacucauggggacagaaggaaauuucagcuuugaaugucccugaaugaccacuguacaauccugucaaagcuacugcaacuccaucccuuacccuguuuguuguuuaaauggaggggauguucaaccccaaccugaaauuuuuaucaugugcuuaggcuuuuugaaaaaaugaaaggcaacaagaugcauuaauugucaaauuguaauaugucuugcuuuaaaauauccuccauuacacuguggcugacagugccucaguuaccuaauucugcucuuuuuccugcagccuggaguacucggguacuuugaguucaguggcucaccccagccuccugguuauuugaccuucuucaccucagcauuacauucauuaaagaaagguaaaaaaugauucauauuaagacauuguuacuucaguagaauuguuacuuacaucuuuuccauguguuauuaugaauauauauucuaauuugcuugauuccuuuucucaacguauuuuuauuuauuuuauuuuuuuuuagauggagucucgcccugccgcccaggcuggagugcaguggcgugaucuuggcucacuggaaucugccucccggguucaagcgauucuccugccucagccuccugaguagcuggaguuacauaggugccugccgccaugccuggcuaauuuuuguauuuuuaguagauaugggguuuugccacguuggccaggcuggucucgaacuccugacgucaggugauccaccugccucaguucccaaagugcugggauuacaggcaugagccacugcgcccagccgucaguguauuuuuaauaauuacauuguuuaguguuccaucauuagcaaacaggaaauacuguucuguuucacauauagucucgcaaauguuuugcuuuuuaaaaauauagcuugaggcugggcgcaguggcucaugcccguagucccagcacuuugggaggcuuaggcggguggauugcuugaguccaggaguuugagaccagccuggccaacauggcaaaacuccgucucuacaaggaauacaaaaauuaggcacguguggugguacacaccuguaaucccagcuaguugggaggcugaggugggagacuugcuucaacguaggaggcagagguugcaguaaaccgagaucgcgccacugcaccacugcacuccagccugggggacagagugagauccugucucaaaaaaaaaaaccauauauauauauaugauaugaaugucgggcacgguggcucacgccuguaaucccaacacuuuggaaggucaaggcggguggaucaccugaggucaggaguucgagaacagucuggccaacaugacgaaaccccgucucuacuaaaaauacaaaaauuuagccagacaugguggcacgugcuuguagucccagcuacuugggaggcugaggcaggagaaucgauugaacccgggaggcggagguugcagugagccaagaucacgccauugcacuccagccugggugacagagcgagacucugucucaaaaaaaaaaaaaaaaauuauuacaucauaaucuuuuuuuguguguauaguuaaaaguuuuggucagcauuuuuagugguuauuuuaucugucagauagguuguaauuuagcaauacauuucuucugagaaguauuuuuauagguauaaaacgcaugucacauuacagcauaggcuacugccagcuucucacaucuguauuuuucuuugacuuaguugaauuguauauuguuugguguccugguuuuuaagugaaaggucauauucucccaauuguuuuauguuguuguaugcucucucucaguccugacuccacagcuugucacuugugucagauccauucucaucugcucgcuugucuccauccccuuuguuaccacuccagucugcgccccuucacccacaccuggaccagaccaguggacacauaacugguauccacucgcuucuccuuccucagacuguggccuuugcauaugcuaguccuucuuccuggaaugugccuccaccccuagggcucaguucuccaccugucagggcccagcccaaauaucgcuuccacaauuaaauaacugaaaccacuaccccagucuaacuuggguacccuguuguuuuuuuguagcacuuaacacaguuugcauuuauguaugugguuacaagaugauuuauuuaaugucuuuuucccuagacuguaagauuucugaggguagggaccauguuccucauguuaguguucuuucuguauagccuggcacaaagcagggucucagucagucuuugccaagcaagugaucacauuaaugacccuauuaccuucccccaggagaucaaccaaaaauauguaacuauucuuuuauuauuuuuauuuuuggaauauuaaaacaguauauaugaaacaauuauaugacuggcaauuuuaauauauaccuugaagguuuuauggacagagaaucuacuauauucacauuguuugucugggagacauagggggagaaaagcugucauauaaguaugucugucuaauugaaagacuuugagcugcacaguuucaagugacuaagcagacuuagcaaauggaaguuugaacuuuggaaacaaaauacugccagcuuaaauaagcuuaagaagcauccauucaaagcucuucauggaaaauuaaauaaagcccuucacagaagacagaccuuaaugaagacuauauaaaaggguaaccuagagucauucacuaaagugaugguagcauucaaguuugugagcugaagaggccauuucaaggucguagaagcauguuuuguuauuugauuggcuuauauugugugcugcuaugccguauuagaaauacauuacucaucuuaaauuauuuuuucauucagagguuucuaaaaagguguuccuuuuaggaauacccuucuaauaagaggcagcagccuuuuucuccuuucuuucagcaaaagaaggguaaauagugauaaauaaaauagauauaaaauaagguugaaagggauaaaugguuaaaaauuacucaaagguucaaaaugaaccuccuuggucaaaucacuaauuuugacaaguuuaugugcuaguuguuuucauaauaaauguggucugauuuacuuucucuacaucucuucccuauccugugauucugguuggagcuuguaaaauucuguugcauaugcaaguuugcaggagcugagauuaauuaauuaauuaauucuaauuaauccuuuucaccccauuuuuuuguggcuaaauucacacaauuggaaaugaugauuuucuguaauaugugcacuaugaaggauucccuaaaguaaaucuugccuugggcaucugggguuuuucucccuuucuucuacccugaagucaaaugguguuuuccuuauuauuaacagcagaugugcaguaagagguaggagaaacacaugcacauuuaaaaaaaaaagauacaguuucaaauuaaauucuaggucaaugucauguuuagauuguauguacagaucaaggcuggagaaacauuugacacauauaacauuuaguuauagagaacugaacugaagaaguguuuagacuguuguaguagaaagcagaugccuugguucagcuggcuaccagcauuuauacaauacacaugccuuuccccugccuuaaugauuuuuuuuuaaauugucuuagaaauagccaggccacuucaaaguucuacauuuguuuuuugaagcuagcuggucaucagugcauaaauaauuugcgagaguaccaugucugaagcaucacagggcuguagggugugcugugaggagagcuuauuccuggcccccagcaugcgaggcuuggguuauaagaucggguucugugguccuuuaccccccacuuaacgcaacuugucaaacauuugcuauuuuuacacauuaaaagaaaggaaauucacuuaccaccucagcacucuaauaguaacugccuucucuuguuguuuuaacuguuuccuuuuuucuccagggcucggccucagugcugaucugucaguuuaccuugguccaccuguuaagguguuguggacaggaacucuugugcauauuucuguccauuauuguauuagccuuucuuuuuuuuuuuugagacagagucucucucugucguucaggcuggagugcaguggcgaaaucucugcucacugcaaccucugccuccgagguucaggugauucuccugccucagccucccgaguagcugggauuacaggcgccugccaccacgcccagcuuauuuuuuguauuuuuaguagagacgggguuucaccauguuggccaggcuguucuugaacuccugaccucaugauccgcccgcuucggccucccaaagugcugggauuacaggcgugagccacugcgcccagccuguguuagccuuuuuuacuucuguuauuauuauuuauguagugcuuucguauuuucuuuaaaaaaaaguuaaaucucugguucuuuuuuuuuuuuuuuuuuuuuucauuuggagucucgcucuuuugcccaggcuggagugcaguggcaugaucucagcucacugcaaccuccgcccagguucaagggauucucaugccucagccuccuaaguagcuaggacuacaggcgcccacuacugcgcccacuaccacgcccgccuaauuuuuguaccguuaguacagacagcuuuuugccauguuggccaggcuggucucaaacuccugaccucaagugauccaccugccucggccuccuaaagugcugggauuacaggcauaagccacugcgccuggccuucugguuaguuuuucuugcuuuuuuuuuuuuuuuccugaaaaucugaugacuauauuaguuuauuuucuucuuuuuuaaauuuaaaaauuauuuagcacuuuaugcucccuggcuuuacuuuggcuuaaaauauagagcacaguugauuuuucccucucucauuuauaaaaugauguuuccuuucuuucuaaucuugaugaugccugcuuuaacuacagaacauauuuuuccauggauuugggucuauuucugugauuucuuuuggucuggauaccuauuuuugucugaguaaacauaaucuaaguucuuacuuuguaaauuguuauuacuuggucaagucuggacuucuuguaguucuuguguuuuguggaauauucuuuuauguccauccgugccuuuggcuggaauuuuguugaaauuauguuaaauauauaaauugacuugaagauaauugacauguucauaacauuuagcuuuccuuucuaggugcacagcaugauuauucauuuauucaaaacuuccuuuuaauuuuuuauaguaggucuuacauaucucucauuaauguuuaaucauuucacagugcuagaugauuaauugugggcuggcaaucuuuguauauguuucaaaagccuggaggaaaucagcucucuuguacuuuacuccuccaggacugcaaagccuguuccucuuguaacauuuuuacauuugaucuuggcagagaggcuacuuuauugccaaaagaaaauuugguagaggggucauauucugaaguugcuugcuugauuuuuaaaaaucugaugauuauuucauuauuugcuguaaaaauguguucugguaacauuuugucauacucugcuauaauucaguggcuuuuuuaaaagagaagauuugcagcaaauuuugaccccauuuuucaucugaucuacaaaaggacuugcagugcagucuagggagaaaagcagugggcugggaggcagcaaugccugguccuuacccuuugucugcuccuggugaggucuguaaacuuggaacaaaauauuuaaccuuucuguguuuguguuuguuuaucuuuaaauuuggggaggguagagguaaguauauaaauccuuauuuuauaaggucaaaucaugaaauacuuugugugugaguaaaguaauaaagcgaguaaagaaauacuuugcgugcaaguaaaauaauagucuuuauaccuuaauuagaaacuaagccaucugguugaaagcaccucagauaaguauuuuaccuauucuagugaaaaaauccacacaagaaaugaugucauugacugaccagcaggcccagucuuucucuuccccuuucccgugcaccuccuaccugcuucuauuuguaacgcaugguuuucucccuguccaauggacugaaucucucugccaccagaauaggagcuaauuuuucagauaauauuuacugaggaccuugauggcaggguuuuguuuuguugcuccuacagcuccacaccgugcuuggugaauguaugacugguaaaggacgcgugagaaagauuuuagcuacgggauuuuaaaugucacuuuggauccccucucacuaccuucuccacuucuugugccuggcccuucaggcucaauagaccauaguguaggaauuucccugccugguucauucuuuuuuuuuuuuuuuuugccgugacagggucucacuuuguugcccaggcuggaacgcagugguaaccuugaacucaugggcucaagcaaucagauucugccucagccuucugaguagcuagaacuacaggugugcaccaacacaccagcaaguuacaacaauuuuuuuuuguagagaucaaauugaaauucacaugguaccuaaauaccaucuuggaaauacacuaaacuauuuuuuuguuuuguuuuguuuuguuuuguuuuugagacauccguucucugcucacugcaaccuccgccucccggguucaagcaauucuccugccucagcuucucgaguagcugggacuacaggcacacgccacuaggccuggcugauuuuuguguauuuuaguagagacgggguuucacuguguugcccaggcuggucuggaacuccugagcucaggcaauccucccgcuuuggccucccaaagugcugggauuacaggcgugagccaccacgcccggccacacuaaacuauuaaccaaaauauuguuuccacucccuucuaccaccuuugggaauuccuaaacucaguugaugaggaaaccuuguagcauuaguagcauuaguuuucuaaggaacucccuuugggaaauaguguuuuagaggaaagguauuaaauggaggaagaacuuugauuccagcguagugucccuguacuccaccagguggcgucugaugcugccgagauuugcuuguagaacugagucgguacgcauaaaaagugcccuccuccaagcgaagaaagcuuuucuggaguauuguucugucagauuggaaauuuuuuuuuuuuuugagacggagucuugcuuugucgcccaggcuggagugcagccgcgcgaucucggcucacugcaaccuccgccucccggguucacgccauuuuccugccucagcuucccgaguagcugggacuacaggcgcccgccaccacgcccggcuaauguuuuguauuuuuuaguagagacgggguuucaccguuuucgccagcaucgucuugauccccgaccucgugauccgcccaccucggccucccaaagugcuggaguuacaggcgugagccaacgagcgcggccagauggugagauuuuauacagcaucaaaagaucuuggcggggcacgguggcucacgccuguaauccuagcacuuugcgagacugaggcagguggaucucuugagcucaggaguuugagaccaaccuuucgcaauguggcgaaaccccgucucuacaaaaaauacuaaaaauuagccuguaguugcagcuacuuaggggcugaggugggaggaugguuugaaccuaggaagucagggcugcagugagcugagaucaugccacugcuuucuggccugggugacgaaagugagaccuugucucaaaaaaaaaaaaucugaaggauaggguuuucuugcucaguaugggacauuuuaaaaggcauugaaaaaacaagggacugacaagcaaggauggcuuggagauugcuuuauuuucucagguuuuuggaccuaacucuugggucuuuggaccagacauugaguuuaacaguucucggcaaauggcauggguucuaggaucguuuuuuuuucuuggguaauuucauuuguugucacuauacucacucaugggggagaccuuuuucuaacuaucugccugcauugagacccuucuggguacugacuaauauagauuaaaauaaacauauuaaaaauuccauacuuugggccgggcgcuguggcucauaccuguaaucccagcacuuugggaggccaaggcgcauggaucaccugagguaagggguuuuagaccagucugaccaacacggagaaacccgguguuuacuaaaaauacaaaaauaggcaggcaugguggcacaugacuguaauccuagcugcuugggaggcugagacaggagaaucucuugaaccugggagguggagguugcagugagccaaaaucaugccauugcacuccagccuaggcaacaagagcaaaacucugucucaaaaaaaaggaaaaaaaauuccauacuuuauguccccacaccuaaaacugacuguuuaauucaguugacauuauuuuagcaaaggaauccuuguauauuuugugagagaugcuuuuauuuccauuaugauuucuuuucuuuuuuuuuuuuuuugagacagagucucacucugugcccaggcuggagugcacaaucauggcucacugcagccucaaccuccccaggcucaggugauccuccuaccucagccccccaaggagcugggacuacaggcaugcaccaccacgccuggcaaccuggcaauuuuuuuuuuuuuuuuuuuuccugagacagaguuucacucuuguugcccaggcuggagugcaauggcacgaucuugacucaccgcaaccuccgccuccuggguucaagcgauucuccugccucccaaguagcugggauuuacaggcaugcaccaccaugcccaacugauuucuguguguguguguguguguguguguguguuuuaaguggaaaugggguuucuccauguuggucaggcuggucuugaacucccgaccucaggugauccaaccaccucagccuuccaaagugccgggauuacaggcguccaccacuccuggccaaauuuuucuauuuuuuuuguagagauguaguuucaccacguuacccuggcugaucuugaacuccuggguucaagcaguccagccaccucagccuccagaagugcugugguuaaaggggugagccacugugccccacaaugacuuauuucuuaagucuuauaaauaagaacuaaggccaaaaaagauccucucagcacgugagguuagaaucagaaguacgauuucuuauuaaauaauucaacaaccauuugaggaucugguaugugauauagcuauaaugaugaauguaucucauuuccugccaucagcaggagccaccagccaguguggccaagaaguaggguugcucacaaugagaauuuagugaugggucugugacagccuuccuuagguggagacgggaagauggcucaguggagaugggugcuggggggugggaggcuuagccugcagcuaaguauggaagaaaccgcaugcagaguggaagguugauggggcuggggaaagcaacagguguguccacuugugccuuggcuucaggaagcucagagccaaauuuaguguucauuuagagagauuuugaucccucgaucccagguauuugaaaaauugcaccuucacuuucuaauuauguagugauauuuucuacccuuuuaaauugacucuuuuagaguauugguguggguguugauccuguuucuccaaguuuguuuuuuucauguuuggaaguugauaagacuccuagauaaagaacuagaagcauuacaaucuuagaaaauaaucuuagggacauaauaaagucacaaacuuacagucaaacagcuccgugcagacaagcccaguucuggucuguccuuggccaccuuuuauauacaguugaaccagauaagcugauacuugacugagcacuuccaugagccaggcacuuuaccugaaugacacagucuucacugucacccuuugaaguaggaaguguuuauuccaguuucacagauggagaaaccgaagcucugagggguugcuaacuggcucaggguuagugugguaggcagggcucauaagggcuccuuaaaaagcuccgcuucuuacucaguagaaccugcgaauagguuauauacauggcaagggggaauuaagguagcaaauagaauuagauugcuaaucagcugacacugagguuauccuguguuacuggggugggcucaguguaaucagaaggauucuuaagaaucaaaauuggaggcaaaauagcagaguguaaugugagauggacagucuaguugucacuggcuuugaaggaggaaagggccacaaaccaagggauguggguaaccuuuggagcuggaaaagucaaggauucucccccagagccucccaaaggaacaugacuugcuaacaggccaggguugauuuuagccuagugagacucauuuuggacuuuugacauccagaacuuuaaaauacaucugugugucugccauuauuuguuacagcaacaacacgaagccaguaccgucacaugccaguaaauacaggagcugagaugagaacccuggugcagagcucacucacuccacccuuacucuguuuucucugcagcuccucugcucuacugaggugcagcaggugauaugauauggugauucccucuuggcuuugccugugauacugcuuuaaauguaauguuuuucccugccuaaugucugccuuccuaauuuuucaaggccuaggggaaguucuauggauuaauaacucuugacuaucuagcaugacguccggcacacuggacguccugugauuuucaucaccccagcuucuuucuuggagcugcuguugcacuaauagacaauaggccaugucuuccgcuuagcagccugucuugguuucuaguuuucccugggcuuuagugguaucuuccuaacaauaagcauagauagacaggggccaaugaguccugaagucauuuuauuuuauuuaauguuuauuuauuuauuugacagggucucacucuguugcccaagcuagagugcaguggcacagucacggcucauugcagcuucaaacucccgaggcucaggugaucuuccugcaggcucacgccaucacacccaguuaauuuuuguagagaugagguuuugccauguugccuaggcugcucuugaauuccugggcucaagcaguccacccaccuuggccucccaaagugcugggauuacaggcaugagccacugcgccuggcucuagucauuuuaauagcaaguauccugguauaaucauggcccagcggccuuuucucacuggccuucagguuucagguuccccaucuguuaaauaagggagcuuugcccuaguuaucuguaagggacacuucaucuugaaaaugcaauggcccuuggccuauuuuuguaggccugggagcuaaggauguuuuuuacauuuuuaaagcauuguuuggaggggaaaaagagaacgugacagagaccucaucuagcugacuccuguguuagaccuuaagaacagccugaaaugggguggaggagguuucucaguggauauauuuaguuugcagaguccuuccuuccccugagggcuaccaaaaaaaaaaaaaauuaauugaagugcauacaagggaaguuuuucaauugaucauuuuauuuuuucuuuugagauggagucuugcucugucacugagucuagagugcaguggugugaucuuggcucgcugcagucucugccuccuggguucaagcgguucuccugccucagccucccgaguagcugggauuacaggcaugugccaccacgucugucuaauguuuguacuucuaguagagacgggguuucaccgugguggugugagccacugugccuggccugaauugaucauuuuaauauggugcuuuagacuuacuaaaugagaacaauuggugugaggguguuuauuuuacugucagguuaaguauauguaacaaugcguauuuaguacuacaguuuauuuucuccuaaaaucauguacuuggaacuacauuucucuuuccuuccuaccuagcucacauacagaaagaaucacagcugccaggcgcgguggcucacgccuguaaucccagcacuuugggaggccgaggcgggcggaucacgaggucaggagaucgagaccauccuggcuaacauggugaaaccccgucucuacuaaaaauacaaaaaaauuagccgggcaugguagcgggcgccuguagucccagcuacucgggaggcugaggcaggagaauggcgugaacccgggaggcggagcuugcagugagccgagaucgcgccacugcacuccagccugggcaacagagcgagacuccgucucaaaaaaaaaaaaaaaaaaaaaaaaaaaaauacaaaaaauuagcuacgcaugguggugguguaaucucagcuacucgggaggcugaggcaggagaauuacuugaaccugggaggcagagguugcagugagcugagaucacgccauugcgcuccaggccugggcgacagugcgagacucugucucaaaaaaaaaagaaucacagcuuauaaguuacauguuaguuuaguaauaucuuggcaaacaccacaauguaucugugauguccaaaugccagauuuuuuuucuaaauaauugcuuugugcuuuauauuaagaaguuugaaacuaugcacauuucacugucucauuucuagggggaaaaugcaaguaaugauaguuuauacauugaaaacaagcauuucuguaauguuacauuucuucgaagguuuuuucauuuuaauggacacuuuauuggaaauauauaacaucaccaggaaaugguuaugaagaacuugaaaagugaaucacuauguaaauauuaaaauuagagggguuguuuuaaucccuuuuuaaaauaauccuauuuuucuccuuuuucugacuuuggaaagaagagugggaaaguagaaguuaaaauuaacagacuaaaaugagaauuguuucccaacagauggaagguacuaugauacagguuugccuuuugguauaccacuauuuucaguuuaaagaaaugagaagaauuuccccauggaguaaaugacuucuuauccaugaugauuaaaugccaugugacuuaauccagugguauuuuguuuugaagcauauguugguuuguuagcaguuaccuuuauaagcauuuuucuugacccgauauuccauuuuguuccaugaugccuuagagaugagcucaugcagaagucuccaugauagcagaugaccuucccuaauguaaggaauuccacauuguucagaccuggaguuucucucuguucuuucaguguauccuuggguacuuuguaguacaccaagugcuauuuacuauaggccucugagagagaauuaauuucagaagcucaggcuagagucauaggucuagagccccacuuuuuccuuuuugaagaaaaggggacacguucuuaaagauaauuauucuuugcuguuggauggauuuucaugaaaaaaauucaagaaacauugucucaugugaucuuaccagauaagugccaauuauuaagacuugcuggcugcuggauuuaucaucucaggcuaauugucuuccugagauaaaugaaucuugcuuuuucaucauuaccacucuggcauaaucuaauggaaauacaauaugaaccacauagcuaauuuaaaauuuucuuuuuuuaaguuuguuuuuugagacaggaucucauauuguuguccaggcuggagugcaguggugcaauuauagcucacugcggccuugaccuccugggcucaagcauuccuccugcaucagccucccaaguagcuaggacuauaggcuuacaucaucacgcucagcgaauuuuuaaaaauuuuuuuagagcuagggucucacucucuugcccaggcuggucuugaccuccuggccucaagugauccuccugccucagccucucaaaacuguugagauuauagaugugagcuaccauacccagccuaauuuaaacuuuucuaguagcuacacuaaaaauuaaaaagaagcaggugaggcugggugcgguggcucaggucuguaaucccaacacuuugggaggcugaggcaggcagaucacuugaggucaggaguucgagaccagccuggccaacauggugaaacucugucuguacuaaaaauauaaaaauuagcugggcaugguggugcacgccugcaauccuagcuacucaggaggcugaggcaggagaaucgcuugaaccugggagguggcgguugcagugagccaagauugggccacuuuacugcaggcugggugacaaagugagacucugucuuuaaaaaaaaaaauugggaaaaauaaaagaaacaggugaaauuaauauuuaacccaguguauccaaauuauuucaacauauaaucaguauaaaaaucauggaguuuuuuuuuuuuucaccucccacauuuaagugauucuccugccucagccucccaaauagcugggacuacaggcgccugccacuaagccuggcuaauuuuuaguagagaugggguuucaccagguuggccaggcuggucucgaacuccugaccucaggugauccacccaccuuggccucccaaagugcugggguuacaggugugagccaccgcauccagcccuaaacugacauuuuaauauuuaaaauuaaauuuaagucauaugauacuaaacuaaaauacaguuuucccuugguauagauuggggauuaguucuaggauccccaaauauaccagaauuugcauacucaagucccacaguuggcccuucagagccugccuguaugaaaauuggcucuccauauagguggguuuuaaauucugcaaauacuguauuuuggaucuguguuucguuaaaaaaaauaugcauguaaguggacccacgcaguucaaacccauguuguucaagggucagcuguagucauauauuaaaacguuguccaaaaccaaaaagcuuuuauccaaacuagaggauagugagccagaugaaugugaguggaaaccagauggaguuucaggucuuucaggaacccuugguagcugucaugaggugaauggugacagcggugcacgggaggcacaagaagggcagccaaagcuauacuuggggagggugugggaagcaagagaagaacauucuguuaggggcagagaagaaucccacacucacaagagaugaccaggaguaaaccugccugccugccaaaaguaggcaagauuucaugagucaaagcacaagaccauuucugcucaaagcacagcaaacaauauuagcaucagcauaauagugcugguuccccagcccaugcccaugggagaugugcugugaugggucuagauggugccugugugcacagccuuguagccgacgaucacagggcccagggcucagcacccucuguagcaagcagccaaggagcacccucccucccugaggggugaguggcgccaagagacaugcuggcuguggucaccuugaccuucuuagccaccugcaugagcagcuguggaaacugguuaguaacuaauucuuuacccagauguuccuucaagauuucauuacaucuugcagugaucauugacaccaguugucacuguaugguuaacagagaucuugaacuggccaauuaccaggcuaauggagaauuuuuuuuuuaaucgaaugggauacugcaguuuuuagaccuuuuugaguagaggaggggagaguaugagucuuaguuuauuuuuaauuguccaacaaauuccaaguucuuaauuaaaauauugaaaauucauuacuuuuaggacaaaauaauucauuuuauaaaugacuaagacuucugucguagaaagcccuggagcucugcuuaucagaaaacacucuggauaaggagaugugacaugcugguuuuuugugucaucuuuacgcuauaaacuuccucugcuaaucuaaguauucuuuguucacgugagacugcaaauuuaagcugcugcuucuagcaagauuuccaccauaugcuagaacuuaaauagaagcguguuuuuuguacauuucuguuaugugugaaaaauaaaguuuugaaauuauaauauguuugagcauguuagaauuuguucuguaugggcagacuguccauucuuauuaaggcaguuaaacagguuuuugaauggccccuuuuaacuuuugggucaggcugucacuucuuauuucucugcucuaauaaaucacgauggugacuuuggcaggcuaucaaaugaauuuccuuacuggcugcuuuuccuucucuucuuuuaacugugacuguccuccaagaucagcugcuucuggagagugguguuuugguccuacuaaaucacguccucucuuuggucuguuucuucugacagcuuugggaucuggacuuauaugccaugcccuuuaaacaaaguuuuuaaaaaucuucaacuaauucuauacuuagagaaaaguugcaaaaauaaaacagagaguuccauaauugccugucuuuagccaguuucccccauuguuaacaucuuacauaaccaauuguuaggugguuuuguacaaacuaagaagucaauguuagaguugggugugguggcucacaccuguaaucucagcacuuugggaggcugaggccagguggaucacuugagguuaggaguucgagaucauccuggccaacauggugaaaccuugucucuacuaaaaauacagaaaaauuagcuggacaugggggugcaugccuauaaucccagcuacucgggaggcugaggcaggagaaucacuuaagguugcagugagccgagaugcaccacuguacuccagccugggcgacagaacaagaaucugucucaaaaaaaaaaaagaaagaaaaagaaguuaacauugguucgguccuauucacuaaacugcagaccucauuugaauugucuccauguuuccacuagugucuguuuuuguuucaggauccagucugggaucccauaucgcaauguguugguuuuuuucucaguuuccuucaaccuaugacaaauccucugucuuuccuuguccuuuauaaccuugacacuucugaagaauauuucucagguauuuuguagaaaauugcucaauuuugucuguuuucuugugacuggaauaggucaugucuuuugacagcaauaccauagaaauagguacuucucagcacuucuuaucaggggguucauaugaugucagugugucuccuacuggugacauuaacuuugaucaguugguuaaaguagugucugcuguguuucuccacugaaaaguuacuaucucuuccuuuguaauuaauaaauaaauaccuugggggaagaucauuugacacuauguaaauauauccucaaacuucugcucaugaauuuuagccuccaucaguggaucuugccugcaacaauuacucugguguucaaaugguuauuuucuguuucuuucauucuuuuuucauuauuaguggaauucucccuuaaagaagagcugacuguucucauuaauauuauuauggagucauggguauuuaucuuauucuguguacugucauuguuuauuuuguugcucaaauuguuccaacuuuggcuacuaggagggcuucagcuuggcuccuggguccuuuggacaaacccccauccuuuuaugagcacuucuuuacuucauuuauuuuuuuugagacggaguuucacucuugucacccaggcuggagugcaauggcaaaaucucggcucacugcaaccugcaccucccggguucaagcaauucugcugccucagccucccagauagcuggaauuacaggugcgugccaccacauccggcuaauucuuguauuuuuaguagagaugggguuucacuauguuggccaggcuggucucaaacucaugaccucaggugauccacccgccuuggccucccaaagugcugggauuacaggcgugagccaccaugcccagcccacuucuuuacuucugauacaagauauuucaggcuuaucuuguacuuucuucaccccagcucuggaaucaaccucuucuccaagggcccugguuucuuuuacuggagaauggcauuuagaaaccaagaucuacgugcuagguaugcucuuugguauuaggaugucauuacuucuaggucuucucaguagauagaacuaggaaguguauuauacccacacaugugcauauaucuguauuucucuauccauccccucucucucccucuguguguguguguguguguguguguguguguguguaucaaaagccuuaaguuuauacucauucucucugauuucaauuuaacaucacaggguuuauuuuagccuucucuuauuaauauauaacuucuuacugcaacagugagaguccuggcuguaauuauguauaauguacuuaccacaaagaaguaaauaaguucauaguuucagaauugcuaacuuauaccucuuuaagaaacacauuuacuaccuagauuuacagcauuuauguacaguucuuuuugccuuuaguuuuacagcauccagucaagauacuguuuuccaguuacuuagguucuuucuuccugucccauucaccaugguguuacccguuugcaauaguuaggguuauuuguacgugcuguauuccacguuggguuugccacaucucgcuugguuuuaacuaauuguuuaauuuuggagugugugaagggugugugauacaucacuguggcccuaggagucagauacaaaaaggccuacucagugccaggccuccucagcccugccuucccguuuccaguccccuuuccccagccuggcuuauuuguccuguauuucuuuuguuuugugccauuuuacacucaucagauuuguaugaaaaauuauugacucuggcaguagggacauacucacuccgaccucauccuugucggccacuccuuaccugagggagagaggaccacaccacugaaagauggggucaugggauaaaacuggaaacuuuauggguuuaacaccucaauauuuuuauaucuuagcuacuuguguauaauuugguaauauuugauguuuaacuguuuuuuaaaaaaaaauuuauuuauuuacuuuggaggcagagucucacucuguugcccaggcuagagugcaguggcacgaucuugggaucucagcucgcggcaaccucugccuccuggguucaagugauucucaugccucagccucccaaguagcugggauuacaggugcccaccacaacacacccggauaauuuuuauauuuuuaguagagacaggguuucaccauguuggccaggcuggucuugaacuucugagcucaggcaauccacccaccucggccucccaaagugcuaggauuaagagcaugagccccugcgccuggccuguaguuuaacugauguuuuauuuagcaugugcuaauaaagcaaaaaggggauaggaaagaauguaccuuuuucugcaguaucuuauucacccuccuuuaacacuaaauacuuuauaaucacacaaauauuauacuccaugaaaaaaaaugaaagcuucacacauaaggauaaggucccuguugauguucguucuccaacaucaaaccacuuucauuauccuuuuagauucuuuauacauuucuaaacauaugugccuguaggggaaaaaacauauauauauauauauauauacacauacauacauacacacacacacauacacacacauaacuuuuauaagugugaguucuuuuuuuuuuuuuguuaacaucaaaagucuacucuuucagccucuguuugugguguauaguccugccucauuguuuuuaacauuugcagaauguuucuuggugaauauccuugcaugugacuccuaacaaacauguggaugcuuagcaguggaaaucccagcuguguccauucuuguagucgguacagcagcugcuuuccugaguggcugugccguuuugccuuuuuccaccagcaucacaucaaauacucauuucuuuacuuucaucaauacuugauguuuccuuugucuuaaauucuuggcaauuugagggucaaaaguagucuuuuguuuuaauuugcuuccuuuugggauagugagguugaguuuauuuccaguaauuauuagccauguauacauauuuccuuuucugugguuuguccauguuaacaauuuuccuuguugauuuguauaagucuuuauauaugcuagauuuguucauuuaauaaauauuuuuugaccucuuaacuauacaccccggcacuucuguaggugcugggauacuagcaugaaacaaagucucuaauuucacagaaauuacagucagaagaggaaauugggccgagugugguggcucacaccuguaauucuggcacuuugggaggcagaggcaggcacaucacuugaggucaggaguucgagacugcccuggccaacauggugaaaccccgucucuacuaaaaauacaaaaauuagcugggugugguggcacacgccuguaauugcagcuacuugggaggcugaagcaggagaauugcuugagcccaugagacggagguuguagugagccgauaucgcaccacugcacuccaaccugggccacagagcgagacuccaucucaaaaaaaaaaaaaaaaaaaaaaaaaagaggacauugggccaaaggaaaucuaaauaaaugaaugagauuaugcaaauguuaauaagugcuauaaaaaauaggguaauugguaaagggaguaccugaaugggucaggagcccaguuucccuuuguaaacucucuccccuaaauauuagcuguuaggugggguggucaaggaaggcuucucacagaaaguaggagcugagaugaguaaugacaaggaaccagccacaagaaguguccagacaaagagaacagcaugugccucagccugucaucaauggggacaggucagaccaucauagguggacacaggggacuccucagcacaagugauugucagagacguuagucagagacauccucucagaagcaggcuugacaucugaggggccgaggucgguuucaggaggagagguuccucagcgccucuuccuucccucucuaggcuagguuaccagaaggagcuuagcugcagggguuugugcuucaagacuugaucacuggguuuugugguuguuuuaaggcacaggccuuuucuuuaauaaaggaaaauuuucuguuucagauuaccuaggaacaguacgauuugggguuaucacaaauaaacaucuugcgaaacugguauccuuaguacacucuggaaguguguauuuacauagacauuucaacacaucacuuguaaguauuuugaaaucacguuuauguuagcgcagugguucuuaaccuuguuuaggucacagacuccuuugagaauugguuaaaaucuauggacacucucuagaaaagcgcauaugauuuuauauauggauggagaguucuuacagccccacccuagagcccaggcuccagguuaagaacccaugcauuagagggcucuugaaauuaauguauagaaauucuuuauuuguauucuuagauuuugguacagacuuuaaaguuuuucuucuuggauaaaauugcagaguuacucucuugaagaauuguuacucugagcccguguuuucagaagcuaggcuuccacugagugauguucuguguuuaucuguuucuuuuaugaugaguaguaaugugacaugcuuuucuccuuagcugauguaauggauuuuugaaguucuugucaagucacagugagaaguugauggcuucucaucccagagagcgucaguuuuccauugucgccuuuguuccccgauuucauuugcuuucuguggagcagccugaacucagcugcuucugagcauugaccuguguccugcucaguccuaugcgucuacucuguugcugcuuccuaagucacaucacugaguugacuuuccugaaguauucugucucucucgcaucacugucaguaacuuacaggucauauacagaucaauuucccugcacccaguguacccagccuuuaaaaccugcgccccccuuggcacaaugucuaagucuugugccuucggaggggcuguugggcccacuccaggggugcccccuugcuugccagucgcccuggcuucugcauaucucucguagcccagaugcugugcuuuacuucuugcaguuuauauuccaaaagucaaauguauuuuuguguuuuccgaauggaaauguuugaguguaguuugaguaugguuuuucaaacucccaucgucccaccuugacaaucacugcugugguuguuucucugcugcccaccuacgcuccuugugccucugccuaagcugcuuugacaucaucugcuuuugcuaucugucauuuuccuacauccuucauuuuuagcauguuacacagccuacauauauuuauuuauaguaaaggguacugagaaagaaauuaaaaguagauggggaaagaaagguaggacuaugagauggaaaaauauaucagguuucugcuucgauuugguagugauuaagguugguugguuuguguagcaguagaauuccuuuuaucaaaugaaauaauacugggauaccauuauuuuuaaaaacacaagcagugguuagucucuguuaugagucaauuuaaaucuucguuuugaggaguuuuaaauaucucauuuuucagaacccucugaagcaccccuuugguaguucuguuugaagccagugauuuaaauuguuagaauuucaaaaauaauuuuauguucacauacauugguuguuuauagcaaaacaaagcaaaaaaucuaggugucucuuucauuuauucguacacguaaaauaugauccguggccuugugcaaguuuaggucauuuuugauugcugaagacauguguugaguuccugcugugugccugguguucgucuaggcccggaggauacaggugagcagaacagacagccugugccgcacggaggcuccaugcugcccuugggggcagcauuugaaggaccaaggucaaaaucuaaaugauccuugacucuguaguuucuguucccuuagauaugucuugguccuuuuaugaauacccagugacguuuaauaccuguccuuggacagggugauagagguuguuaucgccaccagcuggcagggagaauuauuuguugauaggugggucugucucaaggcagaaagaugaaucacacgauauggaagucaccuccugcaaccacuuuuguuuuuucaaccacuugugaggaaaugcugucucuggagaagcggguguuagcugcacaguggggccaggccccgcuccacgccuggguuuucucacccuuaguggugggguuggaacagcacugaugugccuugagcuugccccaccucacgagcucuccuuuauccucugugccuuuguccuucacaggucuuccccagggagguccugaacuacacagcugagaacaucuguaagugggccuuagaaaaccaggagacgcucuuucgguggcugcggccacacggaggcaagagucuccugcugaauaacgagcugaagaaaggaccagcgcuguuucuguucauaccuuuuaauccccuggccgaaagucauccuuuaauagacgagguaagagcugugaugugaaaagcaccucaugaggaguaggaaagccucaucuaccuggcuccucucaucccacacucagucauuuacucuggcagcuaauggcugccacgaggggcagcuguggcucugagcauugcucuuugccccuccauaugggcaggagagagcccgugucuaggacagggacugccgcagccucucuggccauauuuauugacagcuguuggugucuggagugagugggaagaggcagggaagccacaccgugcccuucuagagaaggaccaaaugcccucuucugauguggcugcuguugagcuuccuguuuagggggugaaacagggaguggcaggaacacaggccgaguuuaguguggccuaggagaugccauugucuuggggguuuggccagacugccagcccuggccauccucaggacagcagaggagagcgagcagcagcagcgauguugggacaccuuguuucucugaaccuucccugucgugcagaagccagagugguuuucagaggcagcgccaucggagccugcuguuccugccugucuucggcuucaucuggugcgccugcucugggcgugaguuuauuuuccacacggagcauuuggaggcgcucagagacagcaggcacauuuugcagagcgagccuggagagacagcaggcacaguaugcagagcgagccugggguggcaaaauugcauuuacugagguuuuuauuuuuucacucccucaaggaucccuuaauuggccaaaaccaauuucagacagccaguguaccacuggccagcuaagcagaccugagccccucagcgcuggccuggccuccugccuggagggacagggaggcaggacuucucgcccagguggaucccucccuuugcugugcuggagucuuuuugcucaaguuaugauucccucuggggaguauucugaaugaaugcugcucuuugguuuagaggaagaaagaggagagaaaugaaauagcuuuguuucuuccccucuaauuagggaggacucaaaguaauaaaacuauuucuuuagaaaauuuucacuacauggauauuuugugaacugaggcaccauuucaaaugacuaggccuuuacuguaucuaauauuaagagccuuaaagcucauuguaggaaaggaagguuuucggucaaggugguguggcugugguuguggauuuggagaguucucuccugucugguuugggugugucaggguccuggcuggguuguauuuuguggcaggagcccacagccucugcccagaggguugugguuggauuuaggcaccuggugggaagacucuuucucgccuguuguuucugaaugaguguccccuccagcagucugcaaauccuccaccuaccaacaggccuccuuuuuaucaugguuuugccugugacuccuuucuuuggggcucccauugucucugugaggugagugcguucccuuaacuucagcaugugggugagaugaccgaacacgagguggcaucucaccguauuaugaauuacucagacaagcaaagugccuguccagcacauuucccuuuuuguuucaggucaguuuggcaaauguuuacugagcacugugcugggaagcuccaggggagaaaggauagaugcgacaccaucuuguccuguggucuuagaggcuuguccaguacagggagugaaagccugccuauaauucaaaguagaggacgaucaggcccagggucaggaggaaccagaggagggagggugccaucucagaaagcgggguuccgggcaggggaggaguuagcagaggcuuuggaugggugaaguauucgagacggacuuguaggggcagccaggaucuugauggguugagaaaaacuuacgggaaggaggacccugagcagagacaugagggacgggaguugcugcagguuuagguguuaggaaggaggccggguuuuguggucugcaggaagggcuaacuggggagagaucuugaaaaagccuuuggaggagagggccuuguggacuucucugaggauuucaagauuaaccauagucauccaagucuuugucuucucuuuuuuuuuuuuuugaguuagggucuuccuuuguugcccagguuggaguacaguggcaugaucucggcucacugccuccugagcucgggugauccucccaccucagccucccaaguagcugggacuacaggugcacgccucuacgccuggcuaauuuuuguauuuuucuguagagaugggguuucgccauguuacccaggcagguuucaaaagcccugggcucaagcgaucggucuuccuuggccuccuaaaguguugggauuacaggcaugagccacugcaccuggcccauacaagucuuacugacagugaagagaugcagccagggcugugcguuaucauuacgaacguuuuucuggcaggaggguuccagaaaacugcgaaguaguaagaaccugaacuugggugguagagguggaggguggaaaguagggucuaugaucggggaaacugugacacagugacuagagaugaagaagccuuuggguaaggugggaaggaugaacgcuguacuuacgcaagaugagcuguaaauucauuagcuuguugaccacgaaagaguuagguggcuuuacuuuuucauuaccaccuuaggccuaauauugggcagaacuuugaggaugcuugcauuguugagaagagagaggucaucuuagagugaguggaauagaguugggggcauaccaagcaccaacauucuggacaguugugcuguggugcauguaggaugccagucaggagugaccauaugguggccgcaccaagcccauaguggguagcugcuucuacacacaugcauaccugcauguguacccacacacacaugcaaaaguacagauccugacacuggcgugaggccacugacacccuggugucucuagagaguucuagagagguuauaagacaucacaguguguauuacacaacuuguuaaucaaaggaaaugcuuaccucagccagcaaagagucuucgugacuuguuuccuauuuuaaagguguuuauuugaggcauucacaucgucugaaucugguaagcaaaggcgugguuagcauguucaggcucacagauuucccugauuaaagaaaauagaaggaaacaucuacugugcgaacaguuauuugccaagauuuccuuaauuauucacaugaaauaaaugacaucaagugauacacagaaugugacaugaguuguguuuucaaaacugccuguuagguaaaaggaauagaaacauaaauuccccuucauaggagaaaaaugauaaugccuaacucuuuaagagcauugcuggcugggcgcaguggcucacgccuguaaucccagcacuuugggaggcugaggaggguggaucacaucaccugagaucaggaauucaagaccagccuggccaacauagugaaaccucgucucuacuaaaaauauaaaaauuagccaggcaugguggugugcgccuguagucucagcuacuugggaggcugaggcaggagaaacgcuugaaccugggaggcagagguugcagugagucaagauggugccacugcccucuagccugugcaacuggagcaaaacuccgucucaaaaaaaagcauugcuggucgggcgcgguggcucaugcuuacaaucccagugggauuacagcccugggaggccgaggcagguggaucaccugaggucaggaguucgagaccagccuggccaacauggugaaaucucgucucuccuaaaaaugcaaaaaauuaaccaggcgaaauaaaaauagaaaaaauuggcugggugucgugaugcaugccuguaaucccagcuaccugggaggcuaaggcaggagaauugcuugaaccuggaagugggagguugcagugagcugagaucaugccauuguacuccggccugggcaacaagagugaaacucugucucaaaaaaaaaaaaaaaaaaaaaaaaaaaaagcauugcuguagacagaauacuuucuucaauuaaaaauauucuuuacguggcugcuuuguuuaugagauacugaagcuaaaagagaugaagaaagauuuuucaaggaauuuucuucucuauaauauaauuaaugaucuccuacuuggacuucuguaaaagauuacaguaaaucgugaagucuuauggagguuuuugcgggagugggugggaguaguugucuauuacugcgucuuugaaucuaaaacaguaccaggauggggccagagggcaucugggcucuucacggauuauauaggcuugaccuuguuaguacugcaugcugucagagccucauccaaaaaccacugagauguuuuugugcaggggaaauaaaauuucaagcacuggccuaucaucuaaagugacuucuuuucuugacccaguaguuuucugguggguuauaaagugacuuuuuuuaugccgagaacuauugaaacaauuuauuuuuguguacaaauauguauguuuugaauuaacuauaaauauuacguuauaaaacuuuuuuauuuuuauuuuuauaaaacuuguguuuuuaaauuggaaauuacacucauugaauuguuuuacacaugcagacacacagacacacacacacacacagcgaaacaaaauccugagugacagcacccuguaacuaacuguggugagauuugauucaaguugacagacucuucuguuuuagagaguaaaugccuuuggauuauaacuuacaugucuuucucaggaaaccagaaugggagguggguaacgaaauauucuuuuuggaaauggaagaaucuuagaauaaaauauaaauucaaauugccaauacuggcuugacgguaaaguggcaaaucucaccaagacagaggauugugugcauuacccugagcugccacucauucaucagggguuuacugagcauuuguuaugugccuggcccugugcuaggccccggggauggcaggauaaauccaauguggcuucugccugugagguucuguaaguuuguggggaagagggaugucucagcagaagcuugugagacuguagaaggggucucagggacacuggaggugcaaaaacuagcucuuccuggagugggaguaggacuagcuucccugaagcagcugcccuggugcugggccuugggaacagauggaggagccgguguccccagccaggacuccguaaagguguggcauugcaggagggccuggucuguucugaagaggguagggugagacuggaaagccaaacgggccagauuguguggagguuuuaucucaugggcagcguaccauuuggcccaggagugccaugccugggguuguauuuuuaaaaauauaguaaccaucucccccugcacucucaucuacccugcugcguauucuuggugauacguuccaagacccccaaugaaugccugaaaccacagaugguacugaacccuguauauacuacacacgaauuucacuuuucuucacaauuucauggguagaagauucguucuuaccgaagaucuuaacauccuuaccucuuuuuuuuuccuuauugagacuuuugccguuucacuuaaaggaagcauuuuuggcuucucuuuggcauaucugaauugccagcaucacuauccuuacacuuugggggcccuucuaauaaauaaaggguuacuugaagacaagcacugugauacugagacaguugaucugauaacugcguuggcuacuaaguaacaggcuggcagcauccacagcauggacacgcuggacaaagggauggcucgcaguuuuuguaauggcaaaaauuucaucacacuacucagagcgacauguaguuuaaaacuuacgacuuguuuauuucuggaauuuuccauuuaguauuuuugaaccggaguugaccauggauaacugaaauuacagaaagugaaacguggcuaacggggugcuagucccucagucauccccaagcccuucaccaacucugcccuguauuucagaucaccgaaguggccuuggaguacaacaacugucauggggaccaggugguggagcgucuccuucagcaccugcggcggguggaugcuccagugcuggagucccuggcccuggaagugccggcacagcugccagacccgccaacgaucacagcgucccccugcugcaacacuguggugcugccccaguggcacuccuucuccaggacccacaacgucugugaacucugugucaaccagaccuccgggggcaugaagccgagcucggucagcgugccacagugcagcuuuuuugaaauggcagcagcucuggauucuuucuaccucaaggagcagaccuuuuaucauguggcaucagacagcauagaaugcagcaauuuuuuaacuuccuauagccccuucagcuacuacacugcauguugcaggaccauaagcaggggugugucaggcuucaucgacucugaacaaggugucuuugaagccccuacuguugcauuuucuucccuugagaagaaaugugagguugaugccccaagcuccguuccucacauugaggagaacagguaucucuuuccagaaguggacaugacuagcacaaacuucacaggccugagcugcagaaccaacaagacucucaacaucuaccuuuuggauucaaauuuguuuugguuauaugcagagagacugggugcuccgagcuccacucaggugaaagaauuugcggcaauuguugacgugaaagaagaaucucauuacaucuuggauccaaagcaagcacugaugaagcucacccuagguacugcaggcaguuuauuuccccaagcauuguacauuuugcuugacuucauauggguaaauuuuauugauggcucucauuacauuuaguuguggggugaugucaccuucguagcucauuuuaagucuuuagaccaccaucagucauaauuuucaaagaagcuaauuuugucuauuaaauggaacagaaacuuccucacucugaauuuuggauaaguuugucauuuagcccaugguggggguaagagucccacuuucuaaauuggcgauuucugucacaugucuaagguagaaccagcugcaggcaguggggacuuggggacuagaacaggcagggagguggagagcuauucuggugggauguccuaggggcugaugaaagugagccuugacagcagcuuuguucuaaaggagcuuaaagagaaagcaguggccgggcgcaguggcucacgccuguaaucccagcacuuugggaggccgaggcggguggaucacgaggucaggagaucgagacuauccuggcuaauguggugaaaccccgucucuacuaaaaauacaaaaaaaaaaaaaauuagccgggcgcguuggcgggcgccuguagucccagcuacucgggaggcugaggcaggagaaugucgugaaccugggaggcagagcuugcagugagcagagaucgcgccccugcacuccagccugggcgacagagcaagacuccgucuccaaaaaaagagagcagugaagaaggaaguagagccgccuugccucccuuuuugucucauaggcuuaaaugucuaaggaucaaggccaccagaccuaauuuguucugcugcuguuucauaauguacugaguaauauugcugggaccugggguaccuacacuguaacaaguguaaagugcaaauaaauaagugucagucgcaaaccagcaaaacccacuuuuugaggaguaaggcuccaugaugagaaagcacccagagcuugccccugggacuuggcagcaacauugggcugacccacccuggccuguucccaggaauuugcugaugcccuugacuacacacaaugaagugagaauucaaaagccacguuaguucagccucauuggaaacgggagggagggucaguguaugccgaauggagaaaggaggaauuugguagggaaggaaaccuuucauuucaaguuuuaaaguaugaacucaacaguagacucagagcuucuacauaugagucuuuuuagccauccucuuucaaaucuaggugaagcuuguuucuuacauuagacacauuugugaaaaggcuuuauguaaauauugauuuuucuauaucaaguuacauauuauaaauccaagaguuccucacuguguaaaagaacccugugaccagucacuuuuugaagggcauaaaucugucgauauuauagauuacucccaauucauguuaucuaaagucauuuugauguguugagcuuucuuaaaaugaaacaagcauuuuuuuuuuaaaugggaaagagacuccagagaaauggggucaguguuccuacaagcauguauuuuugagguagucuguauuagauuuuccugaauuccauucaguaaugcucaaguguuuaaugaccucauaauguguucacuuugaauuuaaggguaauugaaagaagccuucuuuagauuucuuuccaucuucuguaucuucucugaaauguuuagccuagcuguucuuuguccugcaguuagugacagaauucuuagggagcuuguaaaaaacaccuacugugugucauuguugguuuagagacuuaacucauaaaucagcugucucuaggcuaguuucagaauuuaggcuuuauucagauuaggaaauaauucuugguuucauguuucaaaaacauagccaacuaaguguuucucagaugcugaucaugaauucucuuuaguauucacaugacauucuucacuuccucuuccauucugcacgcugcauugcccauugcaccucaaaauggagggaguuagaagaaagaaaaagaacugaaacuuuagcugagugcaaugguggacgccuguagucccagcuacucuggaggcugagguaggaggaucgcuugagcccaggaguuuaaggcuacagugagcuaugauugcagcacuguacuccagccugggcaacagagugagacccugucucuuuaaaaaaaaaaaaaaaagugaaauucaaauuaguauuguuucagaugaagcaaaggacucugaagauggcagaauuugugguaaaacuguugguucaaaucagguuuuugauuauuauggguuuuauguauuuuuccacuacauauaauuuuuucuuaaccuuuaaaaaaagaaacuuaaagaaccuuaauaaaggaaacaaaaaacuguagcuccuuguccucaaauuaaugagcauuuaaacacauuccacacuacuguagcuugugcaguugucacauuugugguuaagcuuaaaggucuuaguauuauagggugaaauuucuugaaaagaugguggcuuguugaugauuuauacagucucacuuggugucuauuuguggaccaguccuuuuaaaaaaagaauagucuaugaauauuagagcaucuaacauugcauaguguuuuguuauccacauuacugucugcugaguuaauacuaccagagcuaaaccugaugccacccgggcagcuuuguuugggguuuugcugauaggugaaauguuaaaaaugugagccuaugaagucauuugaguuuuuaaaauguggaguuuaaaaguaggccagcuauucucuuuguaucuagaggagaguugaucucauuuucucuuuauuuuuagagucuuuuauucaaaacuucagcguucucuauagucccuugaaaaggcaucucauuggaaguggcucugcccaguucccgucucagcauuuaaucacugaagugacaacugauaccuuuugggaaguaguccuucaaaaacagguauggagucaugagaggcaaaaguuaagccaucugucccucuuaaaauaauuuccaaacuacaguuguuggggugagcagcuguuuuugauguauagaagaguaaccacgugauggcccaauuauggaccgugaaugaauuacaugugguuuuuaaauuucagaaaagugcuccagaaagcacaguauuggaaagaccuaaagaugaaaauuuucacuguaauauuugcauagguagcauuuuucgggugcuugcuggauucuaagcaaugaggaaagaaaugaagaagagcccauuucccggugcaaguaacaucugucuucccuuucccacaggacguucuccugcucuauuacgcuccguggugcggcuucuguccaucccucaaucacaucuucauccagcuagcucggaaccugcccauggacacauucacuguggcaagguaagcaggccucuucugcagcgcuuugggcuguaugcccauuuucacucuuauuugcagcuuagccauauggugugugagggucugcccauuuuccauuaaccuuugguaggacuuggcugaauuuaauugucagguugaagccaugagcaaagccucuuugaaacugaacuuuuccucaugaauucugaguguuccuuccaugauguugauguuuagcccugacuagauucguagguggcugagugcaguucuguggggagagcacugaccugguugccaggauggccccguggaauaccaugggacaguugccccaggcaaugccaguggguccugggaucccaagcagaucucuccaccagcccugguuuaucucauuugugaaauuaaaaggaaagaccaauagauauccacauucugguauugugauuccauggguacuguaugugcgcuuuugaguaaacaaaauuuuuaaaaauauuuuuugggaaaagaaggcucaaauacagagucuuuagaugggguaguaagcaguuuugggugaggaaaacuguucacauuuaaccccccaccucccccaaaacccuacagauagauaagaguuaaauauaaaaaaaucaaaacaaaaaauaggauuugcugauuccucugggagauggaaacuuuccaaaguggaagcaguuggaaaaauaaagagagaaaaauggacagauuccacuagaaauacgugcagugaaaacagggaaagcagacaaaaagggggaccauuaauauauuuuccagugucucugugucaccuguuauaugcacuguaaguaauaauuagaaucaaaucugaggaguuacuauguugggagaguuuuugauauacauauuaccugacugaguccuugcgacgcuuagugaaggcacucuaguuaaaaaaagaaagugcuauuuguguugaggaggaaacugagacauagaaagauucgacaaguugcccagaguuucaagcugcaaaugaggggccaggauuaaaucaggcauucauacuccagccuccccggaaauuaaaaugguuuagaagauggcugagaccgauuccauucugaacaaaggaugugagcagguuuuucuuuuaagaggagagaguaaauaaacaaguggggaaauuauaaccuaauaaauguaaauuaaaacaguaacaaaguaucauuuaacauauuaaaguaaucagugguuuuaagugacagaaucuuguguugauaaaauaaaauggaaacugcagucagauguaucuaauggaaugaguacauugccauaacucuuuuggaaagcauuuuggcaacauuuacaagaaaucaacaaaaacaguuaacacauuuuugacccaguuaauuuuacuuuggagaaguaauggaauaggaauuccgaagaagcaugagcucaucauuauagcauuguuuacauccaccaggagaugaauguuuaaguaaauuauggcugggcauuuaauggaauuuuuauccuucaacagugcuuuucauacaguuaauggaaaagaacagaguaugaaauauaugacaacucuucuuaaaaauauguaaggauauaggcgaggugcaguggcucaugccuguaaucccagcauguugggaggccgaggugggcggaucaccugaggccaggaguucgagaccagccuggccaacauagugaaaaccugucucuacuaaaaauaaaaaauuagccaaguguggcggcacgugccuguagucccaacuacucaggaggcugaggcaggagaaucacuugaauccagcagccggagguuacagggagcugagauugcaccacugcauuccagccugggcgacagagcaagacugugucucagaaaaaaaaaaguaagcauauagaccaagccugcagccugcauaagaaaggggggccuuauuuagcccaauggaauucugaguggauuuuuacaauguuuuaauuuuauaguuugcuuucuuugaaguaagaaucaagugagaaaaagcauuuaauuauggaauauaguguucacucccacuuguuuagaaaggaacacuaauguuuuagguaggcuggcacaggugaggcaggagugcuguuuuguuaguaaacuuuugguaaaugguuuucauuugguuaugccuuuuguugcuguuguuguuuuuuguuuuuguuuuuuuuuuugagauggagucuugcucuguugcccaggcuggagugcagaggugcaaucucagcucacuauaagcuccgccucccggguucacgccauucuccugccucagccucccgaguagcugggacuacaggcgcccgccauuaugcccagcuaauuuuuuguauuuuuaguagagacggguggcguuucaccgcguuagccaggauggucucgaucaccugaccucgugaucugccugccucggccuccuaaagugcugggauuacagacgugagccaccacgcccggcguuguuguuuuuuugagacagggucucacucuguugcccaggcuggaaugcaguggugcaaucacagcucacugcagccccaaccucccagguucaggugauucucccaccuucccaaguagcugggacuacaggcaugugccagaauacccggccaauuuuuuguagagacaggguuuccccauguugcccaggcuagucucgaacuccugggcucaaacaguccacccaccucggccucccaaaguguuggauuuacaggcgugagccccugugcucagccugguugugccauuuuuugaaaagcaaauuucauccuuuuggacacauacaugacacuuaccgcacccucacuccccccaguuaugcuuucuaaaaacuucugucaagguaaagauugaaaacauguucaucuuuugugugcacuguuuaugaauaguagcugaauagccccuccgcaaggaggaugcagccccuuccauaaaggaugcuguuguggcuccaugucugcuuagcccgagugugggcgcccagcugugugcccagcucugugccagcugcccggggcaggccucuagagcaguugcgguuagcucccacagugauugagcacaggcugggugaguuaguacagaugucauuuucuguauuagaaaauuaaugucaaaucugcuaagaaaauaggcuguuuuuggucucuauccagauuuacaacauaaagaggguauaauuuuccaucuucagaggggcuugauguauuuugcucaaugauuuccuuucuuuucccagagcuauucagggauuaaaauacuuggcuagauccugucaggugaggagugaaugacuccucaggugucagugcggcauuuucugcaaguucauuuuuacuuucaggacaucacauugccacucaguggaaagcguccacguaguagaauguuguaugucuuggaaguaucagcgcccagcucacaccugguaguacauucaucgagaagggacuagcccaaugugggguguaaaaaaugcaccagguucuugaaguuaucugagaagguucuuucaaguugguguuucuugggcugaucaucugccauuucuguucuuucccuuuaccaggauugacgugucucagaaugaccuuccuugggaauuuauggucgaucgucuuccuacugucuuguuuuuucccugcaacagguaaugccaaauuuuugucacuggugggcaguugggauucuuuuguggaggucugaaaaugaaauggguuuaagauguaaaucauucauuauguucaaaaaauguucccuuaggaaccaggcgugguggcucaugccuguaaucccagcacuuugggaggcugaggcaggcagauugcuugagcucaagagguugagaccagccuggccgacauggugaaaccccaucaguacaaaaaauacaaaaauuagccaggcauggugacauaugcuuguaaucccagcuacucugaggcugaggcacgagaaucucuugaaccugggaugcggagguugcagugagccaagaucacaccacugcacuccaaccugggugacagagcgaggcucugccucaaaaaaaaaaaaaaaaaaaaaguguccuuagggacauaaaaggguuguagugucaggauguuaugugugguauggaucuuuuaaagguuguuuuucccagucuaucucuuacccgagcuugaauguggccgugagaauucuuagcuuucauggccuguaugaacauauggaggacgcagagacugacaggauucuucuguugcccuggcuggagugcaguggugcaauguuuguguggggcaaaacagcagagaaucuguggagcccugccugccccaagccuuccacuugcuugucucucaguuggccucccagcagcuccucaucccucucguacagaggacaggguggcuuucuuacccauggcacguccuuuucucggauuccaggaggccuacaaagggguuuucucccaugcgugcagacugcugugaacguccgccaugggauggucgcuugauuuuuucacacuugccuaaucaguauuccaggugcaguucuuaacggcaacuaccccggaagccccugcaagcaggacauuaacaagggggagcggacuuccaguuaguaaacguagaugcagauguuuuaguggaaaaagaaauuaacucuugguccuuuagagccuaauacacuggauguuugcucccuuuuuauagauucccuuugguuuuuagaaaguugaguccuuuuggggacccacucacaugacuuugacaguaucuucucuccaggggaaagugucugcagcaucauuuagggaguucccuggcucgcauguaugacguuugcuguuuuaauuuccugccucccuuuugcgauucagcuugucauguuucucuaggagaguguuuccuucauaucuauugaaucauucccuugguuuuugcuuuguaucucaaagaauuuuugcgggaguacuucugugguaguagggucuugucacaucaugcacuaaaaacagaaugugacucacccuuuucuacugcugacugaguugugaugaggcuuuuucuuucuaagaaguguuuaaauuaccacauaguccaggaaucacggacaguaacacuaacacuuucaucugugugggccaggaguugggcauguaguuuaaugacguauaauuuuugaauuccaagcauaguuugaaaaaauaugaaaaucuuagcacccagcacaugccuuuuaaugaagaaguucucagcagcuggcagaaaugcaucuguguagagagacacaggcggaacagguggcaggguggggcgucaucuggaggccugcgucugggcugagugaccuucguucuuaggcugccuggugugggaaacgugaagaugugcgcauuucuccggccccaugcugggcacuugcugcaggcccuuacccuugucguuucuaaauaucgaacauaagaagacuguccacuucucuuuuaauguaaggauguugguaaaccaaagcuuuauggcuuuggaauggaauuuuucucauuuccuaaaaauaaaugguagaaguaaaguaugcucaucaugagcuggucccaagcgaguguuugguuuagccagaagguaaaugggcaagcagcgugagcugacagcuugcaaaagaggaaaugaaaaaggcuguuggauaacauguaguaagaccuuuuucauuguccaccugcuuaugcuauuuuuagugaaaagaauaugaaauuguauauuuacugugauaaaauauaaacuugugcaugugcuagguggagauguucacagaggggaaaauguugagguguuaacauugaugacuucagaggagugagauugcaagugauuugaaggugcugcuuguauguuuuuacaucccuugcaaauugucuacaaagagcaugucuugauuuauaaaaaucaugaaggaaaaaaaugcaagagccuguccuugggaggaagaggaagggguggggccuugagggagacauagccuuccugugcagaggcaucuuggagccacuugcuccaccgagcaggugcuccuccagccagcacuugcgucagacucugugugacauugcaaaauauaggugcucuggccuggcccugggccagggugaugagggggagaugggugcuccuguccaccaagagacucugaugugucccaggggaagaaucacaguuuuuuagaggugugcccugccacucccucaggguuagaggagaguugcauagacauggggaccucuucccaccauaguuucacaugacugcuuuccuggaaguagacuguugacauucucugucccugcuacuuucacaaaguguggcaguauuuuagugugcccauuagggacauugauggagagugcaccaagaccucuuaguuagcagauagcaugcucacggaugucacuguccuguaaaugucuggagguagacauccugagggaucuuggcagcuuuuucugggaaguaauucacguuuacucugccuuacaagaccaggcuugugccgcagaacgugggggcagguccagcgucugguauucuuccaugggcccacuugacagggccacgauguguuuucaguuguugugggguuuuuugguuuucuguuuuugagacaaggucugacucuguugcccaggcuggagugcaguggugcaauuacggcucacugcagucuugaacuccuggacucaagugauccucccaccucaggcuccuaaguagcuggaucuacaggugugugccaccuugccuggcuaauuuuuuuaucuuacuuuuuauacagaugaggccuuacuauauuguccaggcuggucucaaacuccuggccucaagcgauccucccaccucagccucccaaagcacugggauuacaggcacacagcaccacacccagcuuugucauuugaauggcugggccccacuugaagaaagcuuauauguuaagaaaacuaagcuuuaaaggaggggaugguugaauguuuaccccaaaauuauaaaacaauuuacggccggguccaguggcccugggcagccaggcucuggagucccugcuguugacuuccauucuguuaacaccugagggagacaaacucggcugccggcccaccucauaccuaagugcauaaagcugguaguuuugaucaauugcagccaggcuguacaggcacagguaaauagauaugugagagaaacaucaucagacgauuaaaugacaaguucugaagaggaauuuucuagaucucuagaucaggaccuggaacaaagcuguagggaaaaccccuuucuaugucaccuuccuuccuuauucugugcucucagggcugggcagccugaauucauaguccuuugguugggcuguuugccaguuaucagguugccaggugugagccagauguaccuggggaauggggguacagucacccccaguugagaaccccugccuuagagaauguguaauaaaugcuugcugaagaaacagacuggguaucuuucaaguucuuccuuuuucuccgggcacugucagugggcacaagagggacauaggugggacacuccugccuccccuggacgcucuuccugacacagccgcugggcaucuccgagcacacagaggccccaugccuacacacuccuggggcccugcaucacuggcuuuaggccugggccuaggagcucuugucuuucuuggagggugugggugaagcugagcucuggcuucaggaacagauaagccaucuuaauuacagaacgagcauaugggacagccucagcuuuguagagaauuucuugcccaggcaacauuuuccuuacuuucaguaaguaaaauccacggaacgucuuuucuuggugagaaguagauggccuggccucagguacagccugcuuuuggacucauuguguuggugugacuccugucuuugcuuccuuucccucucucuccagaaaggaccuaagugugaaauaccccgaagacguccccaucacccuuccaaaccuguugagguucauuuugcaucacucagacccugcuuccagcccccagaauguggcuaacucuccuaccaaggagugucuucagagcgaggcagucuuacagcgggggcacaucucccacuuggagagagagauccagaaacugagagcagaaauaagcagccuccagcgagcacaagugcagguggagucccagcucuccagugcccgcagagaugagcaccggcugcggcagcagcagcgggcccuggaagagcagcacagccugcuccacgcacacagugagcagcugcaggcccucuaugagcagaagacacgugagcugcaggagcuggcccgcaagcugcaggagcuggccgaugccucagaaaaccuccuuaccgagaacacguggcucaagauccugguggcgaccauggagaggaaacuggagggcagggauggagcugaaagccuggcggcccagagagagguccaccccaagcagccugagcccucagccaccccccagcucccuggcagcuccccuccaccugccaaugucagcgccacacuggugucugaaaggaauaaggagaacaggacagacuaacuuuuuaaaugauaugaagaaaucagaggugaaaauuguacauugggaauauauuuaugcaaauuuuauugaaauuuauuguaaauaaagauuuucucaguggucuag

SEQ ID NO: 192601 - RNA, 46673 nt, Homo sapiens
ugaaaggcaucuauauauaaaaucuuuauuacaggcaguauugguccauacacuaacacaauaccaacaguacagguuuaaucuuucaaaaucaucauuuaaacagcaaaagaccaagaaauaaaauuugagucaauuauuuuucaaaauauucucaaugcacauuauccuuaauucccuuauuauagugaaacauacaaauacagaaaaauaccccauuuaacaaauacuaguguuaaaugguuauuuggcuuaaaaucugaguuaagaaaauccuuuuuagcaaccuacauacagauaaguagcaaacuuuauuauauuaaacaaauucauucugcuaaaacauguaaagaauuucauccaucauguauucugaucccaguacaaguguuuauucucuuaccgucacgauucuuauaugaaggaccaacucaaagaguuguccuagauauaaccuuauccucuuccccaacacacuucauccaaaagucuguucaacagauggcaaccggguagcagucacuucaccaucugaugccagugguuccgugagagcguggccaggccugugaaacagcccauuuuccuaccuacuguggguugcugcucaggaggaacgauauacgccaauacaagcaggaaaucugcagcuccucugcuaugugccucagaacacuuucaauuuuucuggucaaugcucugauuagguaucauacauaaaagccagcauauuaguuuaaaucuuuaaacaaaaaacuauauuuuccaaagucauuaucauuugggccaauuaagugaucuuuucgugcuuuguugagcuucaucuuuagggcaucucuucuuucuucccauucaugaaguucggcauuuccaugugcaaauuuacagcuguuuccuucugggcaggugccauucauauaccuguaaggagaagucagcugcucaguguccauauaaguuguuucuaaaaaucgugucaugauucuugaaacuguauauuucacuagcuuuaugauuugcauacaacuuuuaguuaggaaucucaagccuagaaugguaaauauuuuauagccaugacaucuacaauagaaaaaucaguacuuuauuuaaauauacucuaugaaaaguacugacugauaggagaaaaaagacuauaguuguuccugaauguaguagaaagaaaucagaggcggcaucaaggaaaaaaaugucuucaauaguuuuaaggaucacauggaucuaaauuagggaauuaaauauuaacagugauuuaauaaaauaagcaauucagaauuacuuaguuuuucacugaaaaaccuuuuuuuuuuuuuuuuuugagacagagucucacuguuuguugcccaggcugaagugcaguaacgcaaccucggcucacuacaaccuccaccuccuggguucaagugauuguccugccucagccuccugaguagcugggauuacaggcaccugccaccacgcccggcuaauuuuuguaguuuuaguagagacaggguuucaccauguuguccaggcuggucucgaacuccuggccucaagugacccaaccgccucagccucccaaagugcugggauuacaggcguagccaccaugcccggcugcguugaaaaauuuucuaagaaaacuuaaacaaaggagugauacauauuaacaucuuccuuugaucuaaguucuagauuuuaaauauaauguaaaagccauuucaaaucugaugaacauuuacugugagcaaagguuguggcaaaggguuugagaaucacagcugugaacacaaaggucauuugggcaaauuggaaugaacaugcuucucuauucaauuauccuaagacauuucaaauuaguauuggaagacuauuaaaucuuuucauauaaccuaagaagagugaaaggaaugguuugaugagcagcgaaacacuuugagccaaaacccaagaauccuucagggucugucagagcacagcaacauuagaacuuuaacacccagguauuccgugucagcugacauguccaugaaaauuugaggucagcaauucugacauggaaaaauuguagaaaccuacauaccuaucacaaauacugaaauagccuguugggaagcggugcugccagcaguacuggucguccucgguguggaaaaccuucucuuugugcuucucggaggagauguggcccugccacugcuucucacuguugcaguuuuucccacacauccagcagugaaaguccaccuaaugugcagcaaagacacaugucccauuagucaccugaugugagauccagacucaauuccagggagcccaggcuggugggagagccaggcaagacauaaaacucagguuagaaauagggacaaggaaaggaccacagcauggggaagcaagccagcacucaggacacagagaagaagggugacaaaugcugccagcuguccaggaaaucuccgguaaagaggcaauaggagcugguaugcaaacaaggauguuugcugggagaacaagaggcagguacaaacaaggauucagggaagaacuaacaccaugaggaaaagcagaaaggaugagaaagaccaggacaugccaacuccaaaaggacgagcagcagcucccuucaguguacgugaacugagccacugcuguggcaucaggaauuuaaagacacugccccuguggggaacagaccuauacaaaaggaaguguuaugaggggauuuaagugcuacaacagaugcaaacuauaaguguuggauaguauuucccaaauguccugggcaauaauuaucugcaacacuggguaaaaacagauuugaacucauucauugugggguauaaaugaagacuuuuuauuacuuuauuuuuuuagagacauggucucgcugucauccaggcuagaguaugguggugcgaucauagcucacugcagccuugaacuccugggcucaagugguccucccacuucagccuccugaguggcuaggauuacaggugcaagccaccacgcccagcucuaagacuccuuauuaugaaacaccccagguaggccuuauuuauuuauuuguuuauuuuugagacagagucucacucuguugcuuaggcuggaguggagugaugcgaucuuggcucacugcaaccuccaucucccagguuuaagcaauucuccugccucagccuccuaaguagcugggauuacaggcaccugccaccaugcccagcuaauuguuugcauuuuuaguggagaagggguuucaccaaguuggccaagcuggucuugaacuccuaaccuuaggugauccaccugccucggccucccaaauugcugggauuacaggcaugaaccaccaugcccggccccagguaagccuuaugauccaacaagucgaggugaccugcucuagaaacaccaaggagcaguugggcgcaguggcucaugccuauaaucacagcacuuugggaggccgaggcaggaggagugcuugagcacaggaguuucagacuagcgugggcaacauggcaaaauccccaucucuacaaaaaauacaaaaauuagccaggcaugguggagagcaccugcaguccuagcuacugaggaggcugaggucggaggaucaccugagcccaggagguaguggcugcagugagccauaacugugccucuguacuccggccuggaugacagagugagacccugucucaaaaaaaaaaaaaaaaaggaagaaaaaaaaauauauauauauauauaauaaaauaaacaccaaggagcacuuaaguaaagguagcaagggaaucaaugugacaaagguaaacauucacagggcaugucacaagcagagagacgcugggcaaggccaggccacacacaaggccugcaaugggcaaugaaacuggaucugacugaaucaacagagagacggaggugccaaaaaacaagaaauaagggcaguaacacauaugcuuauguaaacuuuuaaaaccacaucaaguggaacuauagauuauuuaagaauaaauguagcugggcacgguggcucacgccuguaaucccagcacuuugggaggcugaggcgggcagaucacgcaaggucaggaguuugagaccagccugaccaacauggugaaacuccgucucuacuaaaaauacaaaaauuagccgugcgugguggccggcaccuguagucccagcuacacgggaggcugaggcaggagaauugcuugaaccugagaggcagagguugcagugagccaagaucacaucauugcacucgugccugggcgacagagcgagacuccgucucacaaaaaaaaaaaaaaaaaaaaagaauacauguguuggccgggcacaguggcucaugccuguaaucccacgguuuuggaaggcugaggcggguggaucacaagcucaggaguuugagaccagccuggccaacauggugaaaccccgucucuaccaaaaacacaaaaaauuagccgggcgugguggcaggcgccuauaaucccuugcuauuuagaaggcugaggcaggagaaucgcuugaacccgagaggcggagguugcagugagccaagacuaccgcauugcacuccagccugggcaacagaguaagacuccaucucaaaaaaaaaaaaaaaaauagaauaaaugugucauccuuagguaaacauggccuggaaaaauacacacuggaucuguuccccuggggaggggaacauaugggguucuaacuuuaucuguggcauuuauuuauuuuauaauaggaacuacaacaaauuguuaacaucaguuaacuugcgauggugggcucaagauauuuguuauaguauccucuucacuuuuuugaaauuuuuaaaagaaaaccaaaacaguuaacagaccacugguaacuuaauguccccaagaaccauagagggagaggccagacugcaggcguaagcggggaauguaagguccagcgggguagacagcccacauuccugagccaccugcuggggccucccacuagggaagagucacagacuccucauacuucacuaauccaucaggacaaccccacucggagacauaaauaaucuacccagggugccaggcaaguaaggagagaaaccaggacuuggacuuaugauucucuggcuccaaagucagaaggauugaagaaaggauuuuuucacaugaggagacuuaagcuaguggcaggaaaccacuagagagagaagaugaagacacagaacagagaagggcaggcagugagugacggagccggguuuuggagaagaugggaaagaaaagaaaggccgggcaugguggcucacgcuuguaaucccagcacuuugggaggccgaggcaggcaaaucacgaggucaggaguucgagaccauccuggccaacauggugaaacuccaucucuacuaaaaauacaaaaauuagcugggcgugguggcgcgagccuauaaucccagcuacuugggaggcugaggcaagagaauugcuugaaccagggaggcggagguugcagugagcugaaaucacaccacugcacuccagccuggugacacaacgagacuccaucucaaaaaaaagaaaagggaaaagaaaggcuccaucaauggcucggcaaagagaggguaaaugacgcacgguacucacuguaacuucagcauaaucuguuggcaugugaauuuguuuuccauuuuccuuguuugacugacuggcuaugucuucacuuuuuucauuuuuuugacucuugagccauaguucguaaaauugcuccauaucuuguacuaaagaaaaaugaauuacuuucagcagcagcaacuaaacuccauuuaaauacaugcaacuaugugcauauuuuguagcagucagcauacaguucaaaagaaacucaagggggcugaaggagacuauuauauuagacauggagagaucacccaguucaagcagcagguaaacucucacgcauaagaacuacuuucaggacuguuagauggcaaauauuaguucucaggauuaauuaaccccucccugcauuugcacgacacuuuggggauguuuaaaacucagaaaccauuauaaacaguauugucacaaaagccucaccacugccucugucgcccuacguuccacacucagugucagagcuagaaccacacaaggcuacuuacguggcuugggggacuuggagcugauacacuccucacugcuuacugagaaagaugagaaacauacuacuacuggaccaagauucugacccugaugggaguccaucagucaagccacagucccagagggcggauaugcugggcugcaacugacaagacaaccaugaccaaguccugggcaguggcugccaguugcuuccuaugguaagaacagguguauucugcauuauugccaagugcuaaagcugagguuucucagccuccaugugguugacauucuggcuagagaauucuuugcuggggguaugcccugugcauuacaggauggugaguagcaucccuggccucugcccacuagaugccugagcaacuucugccagucaugacaaugaaaauaucuccagacauugccaaauguccacagggaaggggaguggcaaaauuuguucccagccgggcacgguggcucacgccuguaaucccagcacuuugggaggcugaggcggguggaucacaaggucaggagaucgagaccauccuggcuaacacggugaaaccccggcucuacuaaaaauacaaaaaauuagccgggugugguggcaggcgccuguagucccagcuacucgggaagcugaggcaggagaauggugugaacccgggaggcggagcuugcagugacccgagaucacgccacugcacuccagccugggugacaaagcgagacucugucucaaaaaaaaaaaaaaaaaaaaaaaaaaaaauuuguucccaguugagaaccacugugcuaaaaacucugguaaugaggaccugguuaaaacuuggcuuuguugucugccuaaugguuucuaacaauguaucaucaggcaaagauuagagauaaacuagaaaugcuucuuccuuaagaccagugguggcaggagucauugcaaaagccuggugcgcaagggcaucuucagucaggccggacuacauagccucacucccagcaagacagcuagagggaaucccguccacacaccacugacgaucuaugugguugaaacauggcaggcaacagucaaaucugguugguucuuauaauccagagacugcagucaguauaccuuucaucaguuuacuuaagauuaaagaauaaugauccuuguaguaaaacauuuuauggucaaaagugaaaggcugucugcggcuccucucaaaggcucccacaauaaacuuggaauuugaccaaaauaaacauucuuuccuuggaccucugauucugagccuguuugauuaguaaugccucccugaagaaacugccaauucuaaccugguuaauucagagggcaaacuauuuccaauacgagcagaugaucugauuuaaacagucaagggaguacugaacuuccccaggccauuuuuuaggaauacaucuauuacauguaaggaugcaugcagaccuauauauuuauauccaaaucugaccuaaccaaacacagaucagacgccacauucuaccccacugaggcugugcccacauuuuccaggcaucaucgccaacagagcuacugaugaaacggggcaaccguuuagaaugcaaacugcuuucuguguucacaggaagcuggcauauuuauagagaggaaaagaacuuucaggcaagcuagcucaaggacacagcuaaaagauuaacuuacucccauucuccuucauguaaguccaaacuucucuuuccucaggacuaugagcaaaggaacaguuuccaacauauugacauuuuuucccagaagcaauaugguugcacagcuguauaaaaaaauaggaauaugauuaagacaaaguacaccuaguaaaacggccuaauuuuuacauuuaagcaaaagaagcauuauuauccaugcuaauacuuaguaaucaaauucuaaaguaagauuaauuugacucuacucaaauuaacuauaugcucuaaauauaugaaaugauauuaagguuucuaucucaaaauuuuucaaaagaaaauguccaaaacagaguaaagcauggaacauuuucuuacaagaaaaugucuacaaacucacuuacucagaacauuuaaucuccacaaugaacaucccuggcccucucagucugacagcuccuguuucccugcccaacacuaaugauuccuccacaucagcacuugaaagcaguaaagaaacugcaggcuacuccaaaggguacugaacagugcccaaaacauuucagaaauuuaacuuacuuauaaccaguacuggaaacuaaccucggccauaauucacuacauaugcauuaucagaagacaauuaucacacuagccauaccauggaguuacacagcuuucaaauaauaccucuucagguuauuuguauuuuuauuuaacaaaguaaauacagugauacugguaggaaaauaaagugaucgugaucagcagaacgcagacuucccuaagaauuaugagccaggaaccaagaaaaccuccaucacggagaaugcauucuugaauaccaucaaccuacuugucuguaugagguauaaauccuaguacaacuaauuauuagcuuaucuuaguuugugcuucaacggcagcuggcccuacauuauuuagcuuacguggcauuaaaugcuuagcaucugucacguuuuucagaguuuuggcuaaaacucgcucagcccccuuaacacuguacauuuccucccuuggaccaaugucagugaccccacccuuaaaaucuucugcauaaagucaguacuggauaaaauagucauauucuuucccccgucaaaccccaguaaguacuuagucauauuacuagggaaacauuuaccauagucuuucaaagcucaaugauaaggagcaggaagaaaagcagguaaaggagaaggccaggcacugugccagguguuuacauaacaccaucacacauaauuauucccaauuacaggugagcaaacugaggcugaauaacuugacuggggcccuucuggcagacuuugaagcccauugucuuuaagccucaccacacucucuacacacauacacacauacaguauaauuucuucuuuaagaaaaaaggucccgggccgggcacgguggcucacgccuguaaucccaacacuuugggaggccaaggcgggugggucacuugaggucaagaguccgagaccagccuggccaacauggugaagcuucgucucuacuaaaaaaaaaauuacaaaaauuagcugagcgugguggcacacgccuguaaucccagcuacucgggaggcugaggcagaagaauugcuugaacccaggagguggagguggaggcugcggugagcggagaucgcaacauugcacuccagccugggugacagagcaagaaaaaaugaaaaaaaaaaaaaaaaaaaaaaagaaaaaaagucccuuagcaauaccuaguauggcaggggaaaaaaaagaggaaauaagcuacuguaauguugcacaguaguacaccauguucaaaauuaaagaauaaccaauacucuaagcagcugccucaggaaccaggguuguucucaguuguacucauuuuaucaaaguacuugauauacauauuaucuccaucauccuuuaaaccacaggaaaucaagguuccaaauaaaccccuuucccccuccuacauaacccauuaauaaaaucugagucuaaaaccacuuuggauaaaacacaaaccuaccaacgccuugaaaaggcuggcuguguuacuuguguaaguuuuacaaaacugcaagguacuguagguggugaaaaauacaucuaccucuucuucaacuccuucuugcaguucagagagaggccucauuuacacggggacucuacaguccaucugcccugcuucucugggcaaaagguucccuccacauuuccuccauccagguagagagcuuacuaccuguagaugcuccaagugucccugucugcuaacgcacgugugaagugccucuagaugcucuccagacccucucucucaugaagaggaaaguccaggacaacucaagugguuugcucagacaaucaucuucaagaucagguaaggugcuacaguguaccaagaugaaauguggcacugugugaaugaaauacuguccuaacuuuaaguuagccuaguauuuucuaguuuuugaagaacauguuccucuaacauugaacauuuuucuuuggguuacuuuuagaaagucuuauaaaguuaggugucuuguagcuacguaucccuugcugcagugaaagagacaaggcaugauaaaaacaaacucaucaauagcauucauaauacugaaaaccugagguuugguaucaaaccaaagaaaucacaauuaaauaaaauuugcucucauucccucuccaaaguaauucaucuaaaaaauaaguuaaauuguccccauaacuuuuccucagauccacuaucuauuuacuuuuuccaaguaacucauaaaauuccaaucaauaugaaaacugcuauggaaccauacauauacuaaagggaaggaaaaccaaagaggaaccauuuaaauagcauuauuacugacgaauauuauuuaaagggcuugaguuucaaucugaauuacuacuauuuucuaaugauuugaaaugccuaauuuaaaaaaaguggcuuaaaaauuacguauguacaucaaacuguaaaggcauuuguuucuuuguggggagaggacggauguucauccacuucuuacguucaauagacaucacucucaucgcacgccggucuuugguccaccuaagaaaaauggaguucagaaaaaaacaaagacacacgagcaaaagacauaacacaaagggagaggcacaaaguuuguaccugaggaaccagagaauuuuuuucucaaugcuucuaaaagaaauaccuuaugauucuguauuuucacuuccuauugucauuuacaaacacucccuacaaacucuaaacaaauugauaaaauacaggaaaaaaacacuacuugugaauucuuaucuacuagguccuaaaaaucucuucccuugugucuguaauuauccuaaauuaucuauuuuucucuccucucuucaaagccuuaaacuuuuugcuuauguguauaauuuuauaccuacgaaacagaaaauuacaaaauaggaauuguuuccacacacaauacuuacgaaugccuugcuuuugcacuacaauauuuucuguuuuugucugguucaaugacuugaccguuucucagacacugggcgcacacaaacuuuaucuucauauuaagaaauccaggcauuauuugauuaccaaguaccuuaaacaauuaaaagauucguuuuaauuuuuuuaacagaaaaccaguuuucugaugacaaaauacuaaaucaagaugcauuuuuuucacaauaguauacaauuucccauuuuuaucugacuugauuugaccauuauaucugauaacuaaaucuccaauucuccccccaaauguaagagaauaucauaaaaguagaugauagaugccaaacuuuaauuuaugaaacucaucuuugaaauugaugacuagaauuguuucauuugggucagggguguugaggggagagcaauggaaaaacgagacaugccagguggaaagcuaaacuauaaaaauaaucuaacccccuuacuccgagaacccguaaagcccagaacuccaguuguuuugucaauuaaacuaaauaagaaaacaguguccuacacucuuggcaagcauugugggcugcauaauuuuuuuaugaugaucaacuaaaaugcaaauuguuuuuucacauaagaaugacucaccugaaugaauauuaagaaaguaacuggacuguaaguguuaacugcauccaccaacaaccaacaucuauuacgcaauuccagaaaggacaccaaaugcagaaaguacacaagagaaaaauaccugcgcuccagguacauuugcuuccaaauucugccaauaucguuuagacucuugagcaauagcaucaugugagauaccuggggaauguacaagccuuccuuuaaauuauaucuauaagaacaacagcccaccaaucugggugcagucagacguggagaaccuucagcuuccaaucuauucucauaccuccuaauccaucagcaaggaugaauaccacguuucucuuuuuugaaauggaauauacacaaauacagcucuuugugccuucugaggaaucuuuccucccaacaauugcauguaucaacuuguaucaguaauuaaugacaugagaacacacucaaaauaggcaacucuaaaaaucaaaaguuugaagcucaggacaaaaucaauagcgucaccacaucugguugauggagaaggggaggucuccaaauuccuuuuuguuuuuuuuuuuuuugagacagucucauguuaucacccagacuggagcguaguguugugauccuggcccacugcaaccucugccucccagguuuaagcaauucucaugccucagccucccaaguagcugguauuacaggcgcccaccaccacgcccgauuaauuuuuguauuuuuuguagagauggggauuuugccguacuggccagacuggucuugaacuccugaccucaagugauccaucugccucagccucccaaaguagugggauuacaggcaugagccaccacgccaggcccaaauuacuguuucauuaaacccugucugcucuugaggagacauacuucucagucgcacucaaaccuaccuguuucauuuugcauuauccagacuuucaguuccacaagacuaugggcauaaaagcacucaucuucccuuaaacagccauaccgaacuucaugucgacauaaaucaagcugacacugaccaugaaaagaacguauuuuggaguauuuuacuguugucucucgcaaaauguggacaaggcaccuaagaugaaaacagugacauuuuaauauuguucugccauagauuuuucaaauauauauauauauauauauauauauauauauauauauauauauauauauauauauauaaaguucuacacugacaauacauuuaaaauuuuuuuuucucuuuuuuuuuuuugagauggagucucacucuaucgcccaggcuggagugcaguggcgcgaucucggcucacugcaagcuccgccuuccggguucacaccauucuccugccucagccuccuaaguaguugggacuacaggcgcccaccaccacgcccagcuaauuuuuaauagagacgggguuucaccguguuagccaggauggucucaaucuccugaccucgugauccgccugccucggccucccaaagugcuaggauuauaggcgugagccauggagcccagcccuacauuuuaaauuuuuaucggaaaaaaaaucaugggggcugggcacaguggcucacaccuguaaucucagcacuuugcgaggccaagacggguggaucaccugaggucaagaguucgaaaccagccuggccaacauguugaaacccuguugcuacuaaaaauacaaaaaauuguccaggcgugauggcucacuccuauaaucccagcacuuugggaggccaaggcggguggaucacuugaggucaggaguucaagaccagcccagccaacaugguaaaacccugucucuacuaaaaaugcaaaaauuagacgggugugguggcacgugccuguaauccuagcuacuggagaggcugaggcaggagaaucgcuugaacucgggaggcggagguugcagugagcugagaucgcgccacugcacuccagccugggaaacagaaaaagacuucgucucaaaaaaauuaaaaaauacaaaaaauuagccaggccuaguggugggugucuguaaucccagcuacucgagaggcugaggcaggagauucacuugaaucugggaggcagaacuugcagugagccaagaucaugccacugcacuucagccugggugacagagcgagacucugucucaaaaaaaacaaacaaaaaaaccaaaucacuacaugcaauuguugaauuaauugggggggguacuuauauuuuaagccauaaaauaccuaaauccaugucaugagaaacuauacaucaauaaugcuuuucuguuuuacauaauauauuuaguuaauuauucacuuuccagccaaaucuacuaaaagacauuuuaaaauuuugucauuguucuucaaaauaacaacauaacgaugaaagggcaaugccuggacagacauuacuacuaguuuuuauucagaucuagaaaaagaaucuauuuugucauuacagaaauuagaaacuaucaacauacuuauugucuucaaacucaugcuuuguaaccgggugagaacaagcaguagaauuaucuuuauuucuuuuacuuaucauucuaggcuuaugaucaaaacauuucuggaauagagagagaaagauuaucaaaaaaaauacaaaauauaaauuuuguacccagaauauuguccuaguuucaauaucauuacaaaauuaauauucaauaugaaguuuuaauauucuuuuugguaacaguaauagccaacauuuacugaaugaauguuuuaucacaugggaggaccagaggaauauuuuauucauaaauaugauauuauuuaucauauaaauaaaugaauauuuauucauuuaccaagugaauguuuuaucacauggcaggacaauaccacugggcuugcaaauucaacuuuacaguggaaaauaaguuuuggagaacacaccucacaaaggaauauaaauuccccaagaugcuccuggagaaguuugaacacaguaagguuaaucuuuccauugccgccaaagaaagccucccggcugaaugcuccuuuccgcuccaguguccacacaucuaucuccucuuggcaauaagcaaacgugcaguggccugaauaucuacauuccuccucagcagcaacaucuagaaagacagggaauggacagacauugaaaacauggcaauuggccuguacucccagcuacuugggaggcugaggugggaggaucccuugagcccaggaguucaaggcugcggugagcaaugaucuugccacugcacuccagccugggcaacagagcaagucccagugucaaaauaaacaaacaaacaaaaaaagaugguaauuguuuccuuaaagccaaugaauauaaauaacauuuagggcaucauuugaacuugucuaacaauucauggacagccucaaacaaugauaugcauauuaucuggggauggaucguaucaacucuaaaaaagagaaguaccacaagccuuaauuauuuuuaucacagacugugagaagagccuugauucucucauggaccacaccucagcugaaaaaaaaaaaaaucauuuagggacauucuaagcucauucacacaaacuuguuugacaaacaugaaaauaccaaguucucucaaaagcaucuuaaacacuuuucaaagccuuagcucaguguuuugauucuguuuagagagaacuuaagguuugagacagucuucuguuuaaaaucuggucauaggccaagcgugguggcucacaccuguaaucccaacauuuugggaggccgaggcaggcagaucauuugaggccaggacuucaaaacgagccuaaccaacaugaagaaacccaucucuacuaaaaaauacaaaaaucagugaggcagggcggcacacgccuguaauuccagcuauucgguagcugagucaugagaaaauugcuugaaccugggaagcagagguugcagugagccgagauugugccugugcaccccagccugggagacagagcgagacucugucacaaaaaauugagaaauaaauaaauaaaauaaaaccuuggccaguacaguggcucaugccuguaauccuuacacucugggaagcccaggcaggcagauaacuugaggccaggaauuugaaaccagccuaggcaacauagugaaacccugucucuacuaaaaauacaaaaauuagccagguguacuggcgcaugccuguaaucccagcuacucgggaggcugaggcaagagaaucacuugaacccagaaggcagagguugcagugagccgagauugcgccacuacacuccagccuggaugacagaaugagacucugucucaaaaaagaaaaaguuaaauacaacaguaaaaauaauauaaaaaauauuaacaucucaauccaaggaacuugcuauuagcucuaaacauuuuuuauaacagucaauacuguuauaauaacauaauguaauaaauuacauauuaauagauguuauaauaaauguagcaagcacaguccuacaccacauacugacauuucagucaacuacagacugcauauauaaugguggucccauaagauuaauacuguguuuuuccuguaccuuuccuauguuuagauacacagauaccauuguguuacaguagccucaguauucaguacaguaacaaacuguacaagucuguaguuuaggagccacugacuaugucauggauaggcuaggugcgucgucggcuacaccaucgagguuuguguaaguacucugugauguuccccuaaugaugcauuucucacaauguauccugucauuaagcuaagcaugacuguaguucaucacuuauguaauguauacuaauuaaguaauuacaguacauaccuuuacauauauaauaugguccuucauaauuuguuuuuguuggucuuggacguauuuuuuuccaugauuuaucuucaacauucuuuauccuaccgauuaaaauaucuuucuuacacuuaugaucuauguuagcaugguaagugaaauccauuaacuuagggccugaaaaagauguaaagaggauugcuuauaugcacaaaaaauaucauuucauuuuacagguaaauuuacaagcagacaugaacagaugaacaucaauuauuaaauucccacagaaaucccacuuccacaacccuaaaauguaaguaggcuacuaagguagauuugugccuuuuauaauguaucagacaacacaauguucuauucaacuccacuccugccaaaaaaaaauacccuuacuuaacuuuagggaaauaaucuggagaggaauuuugauggcuuauaaaucagaauaaacuguguuuaugucacuugauuuaacgguaaacauaugaaacaagcuaacagaaaguauuuaauuuucauauacauuguauuguauacuggucuuauaaugcuguuuucuaguucuugcucuacuugaaaauaaucaacuucuuaagcauacacugagaacauaaggaguuucauuaaaauuucaauaagcuuccaaaaauagguaaauauucuauucuacaugauucuauaaauaaaaugacaucaaauaagagcagagccuuauccuauuauacuccaaaggcacuaaaucaguaacugcuacuuguuuaggaagaauucaaaauagggauugaagaaccauaauaacugauguuguuaacauguauuuacaaauuccuaagaacuuucaagguuaugagcaaguaguuuaauacucucugcguguuuguuugguccugaccugauuuuacaaaacagaucuggcaagcuugucucaauucauggguuccuucgaggggaugucuuggagucacugaugaagaugguuugguaacugcacuuccaaaaaaguuuccaaagucauuucuaggcugacuugaaauucccaggaaauucucugaagcaaacaaacuaccugguccauucaucugcaagaaaaauaagaagaaaaaaaaaaaaaacagccaacaaauauugcauuaucacugaagaaaggaacugaauucaucugaaaaauaagauaaucuucauaaacugaggucaguacuacuccauccuuaaugcucuucuaucuuaaaaacugucucuuucuacauuuuucucucuuuugguuucuagucaccccccgacuuuuuugauccuccauauuauaaguaauaaguucuacugcaaaaguacacacgcuuuacaugccccgaucuuauauuuccuugauuuguuuaugcugugcuaaagccucuuacauugucugcaauaccgauuaauuugcuaugacagaucaagucuuaaacacagagccguuauuacuagauguuccagaagucuuacuuuaacacaauuuccugcagcacacacaaaauuuaagggagacugucauguucauucaaauaacucgguuacuuaaguaacuauuuucaauucaagcgauguauuuacaaaagaggaaguggcacuuacaaguaaaagggaagaauuacuguuguuaagcgguguucccucucuagaaguugagguggacagaucuaaaauaauaaaaaaacuucaacagaccuuuucauucugaucacguaauaagaacaucagggcuuaguagcuuacuggcuauggccucccacgcuauucucccgucccaguuucuagaaauuuucuugcucaagguugacacccaaagagggcucuagagucucugcuuuccucuagaaaccaagggcauagucaaacaaauuuaaauaaaaaccuacuuccagaaaaauaagcuaaggcagggcccaccaacugcaacuacuaaaaacaccaagaaaauucuuuauauucaaaaaugggaaaagagccuuuccuuuugaaaauauggggccaggugcgguggcucacaccuggcaaucccaguacuuuaggaggccaaaguggguagaucacuugaggucaggaguuugagaccagccuggccaacauggugaaacccugucucuacugaaaauacaaaaaaaauuugccaggugugauggcaggcgccuguaaucccagcuacucaggaggcugaggcaggagaaucgcuugaacccaagaggcagagguugcagugagccaagauuucgccacugcuuuccagccugggcaacagagugagacucugucucaaaaaaaaaaaaaaaaaaagcaggaacugaccauaacauuuaaaaaaaaaucaguaaaguuuucaauugcuuucuuuuuuuuuuuuuuuuuuuuuuugagaaagggucucauucugucacccaugcuggagugcaggggugugaucuuggcucacugcagccucaaccuccugggcucaaggaauccucccaccuccaccucccaaguaacugggaucacaggcacacaccauacccagcuaauuuuuauauuuuuuguagagaaaggguuucaccauguugcccaggcuggucucaaacuccugagcucaagugauccuccugacucggccucccaaagugcugggauuacaggcaugagccaccacacccagccuacuuucuuuuucuuagucuagcacucaauuauuuucucucugcccuucugucucccauauauuuuaauuucuuuaagucaaucuuuaagucaauuauguaagauuuuugcccuuuuagccacguaacaaugccuucaaaaaaauauuuuucuagugauuguuugaaguauauauguuaaaccuaggaugacagaaacaggagucagacuccaaacucagcaaucuccuguaaaguuaaagcagcagccacgguuugcugagcuccacagaugaaaccuaaaauagacacaucugauugcuagcauucuaaauacugaucuuaaauuaguguuugccuagaucagaauuuaauagcauagccugucucucagacccuuuaagaugagauacaccuuuacgggagaauacauugucauuucacccccaaaacaauaaacucccagcuuaacaaacuauccuacagaaacaccagugccacacacauuucucuucucaugccuuugcuccugggucuccagaauggcacagcuaagucaagguaaauucaaaacugaaggcuuagucuuuauauuuuuagcuacaaagaaaauaauucacaugucuacuaccuagagucaguuaaauaauugccaaacaaacauuuucauuuugagaaaaucaacugcaauuguuuacaauuuagauuugguucuuaccucguuuggauucacucauugaaaaugaauuuaaagaagaacaaaaaucuucuaaggaugaagucaaagguggauaaaauucugagaaggaggguggaggagcauaccucgcaccaauggguaagguuccuaacagcgaugccgaaaagggcaugcuaggagagacacuggcugucugaagggguccucugacuaaagcugacggcugcggaagaaaaaaagaugugauuaaaauucaugaagcugucauggguuuggcugaacuacuuucaacaccagcaaauaaaagcauuauuacacugggagaucacguuacauaacaaaguuuaggccaggcaugguggccuguaauccuaacacuuugggaggcuacggcaggcggacugccugagcucaggaguucaagaccagccugggcaacacggugaaacuccaucuccacuaaaauacaaaacauuggcugugcaugguggcaugcgccuguagucccagcuacucaggaggcugaggcaggagaauugcuugaacccaggaggcggagcuugcagugagccaagaucacgcaauugcacuacagccugggcgacagagcaagacuccaucuccaaaaaaauaaaaaaaaaaacaaaguuuaaaucagaaucaagauucguuuaaaacaauuuuagcuacagaacuucuuuucaagaauaauuuuuaaaaacaauugaggugggaugucuaacuuuuuuuuuuugagacggagucucacucugucacccaggcuggaguacaguggcacaaucucggcucacugcaaccuccgccuucugaguucaaaugauucuccugccucagccuccuguguagcugggauuacaggcaugcgccaccucgcccagcuaauuuuuguauuuuuaguagagaugggguuuugccauguuggccaggcuggucucaaacuccugaccugaagugauccaaccgccuagaacucccaaagugcugggauuacaggugugagccacugcacccagcuagaugucuaacauuauaauccaaauguuacauucauguuucaucugcaaaacuuccuuaugcuucccugcccuuaccugacuacagggcucauaagaauuugcaucauaugaggcugggcaugguggcucacaccuguaauccuagcacugugggaggaugagguggguggaucacgaggucagguguucaagaccaaccuggccaagauggugaaaccccgucucuacuaaaaauacacaaaaaauuagccgggcgugguagcgggcaccuguaaucucagcuacucgggagguugaggcagauaauugcuugaaccugggagguggagguugcagugagccaagaucgcaccacugcacaccagccugggcgacagagugagacucugucucaaaaaaaaaaaaagaauuugcaccauuaaagaggaauugugggauauaugugguguagcaggaggauaggugauccagagacgggagcuggagaagcccaugaagauugagacaaccucucuggaggugugaacuuacaacuggacaagaacauacaacucuaacuuccccaggccccaucaaagcugcaacucacugagagcuuccacgcaccuuacguuaugguaucauaugcuaucuauuugguucuuaaaacagcucucucagauacauccuacugugaucaccaucauacagaugaggaaaaugaugcacuaugaugaaguaacuugcccaguaucacagagcugguaagaaucaaagccagcucugucagucuuuugcacacugacaccaucuauuacaccaccccuggaaaacagcucggaauuucucccuaucaucaccaucauccuaccacugcugcuacugauuuauuuuacuuuaugggaggggucagagaagucuuuuuuuuuuuuuugagacagaguauugaucugucacccaggguggagugcaguggcaugaucuugguucacugcaaucuccaccucccgggcucaagugauucucuugccucagccacccaaguagcugcgauuacagauaugcaccaccaugcccagcuaauuuuugugauuuuugguagaggcaggguuuugccauacuggcuaggcuggucucgaacuccuggugaucugccugccucagccucccaaagugcugugauuacaggugugcgccacugcacccagcagaaaaggcuuucuauacagggauggacacuaaguauuuuaggcucuguaggccacacggucccuguugcaaggacucaacuaugcuguugcagugcaaaagcagccacagacagcacauaaaaugaauagucacugauguguuccaguaaaacuuuacuuacggacccagaaauuggaaugucauauaauuuuauugauugacugauugagacagggucucgcuguguugcccaggcuagagugcauggcacaaucagugcucacugcagccucaaccuccugggcgcaagugauccucuacccucagccuuccaagcagugggaccacaggcacgcaccacuaugccaggcuguuuuuaauuuuuuguagagaugugcccuugcuaugguuacccaggcuaguuucauauaaucuccauaugucacaaaauauuauucucuuuuuuguucuucucucaaccauuuaagaauuguaaaaaauauucuuaguuugcaagccauacaaaaacagguaauaggccagauuuagccugugggcuacaguuggcugaaccccgcuuuaaaguaugugguugcuagaggauuaucuuuaagaauaagaaguccugaggccgggcaugguagcucacgcuuguaaucccagcacuuugggaggccgaggcggguggaucacgaggucaggagaucaagaccauucuggcuaaggcagugaaaccccaucuuuacuaaaaauacaaaaaaauuagccaggcgugguggcgggcgccuguagucccagcuacucaggaagcugaggcaggagaauggugugaacccgggaggcggagcuuacagugagccaagacugcgccacugcacuccagccugggcaacagagcaagacuccgucucaaaaaaaaauaaauaaauaaaaagaauaagaagucuuuaaucuauauaauucauuuuuucuuaaauaucaaacgccuauuuuuuaucagaauguuaucuuugcccuuuccauaauaugagaucccaauaugaauuggaaaaaaauuggcuaauuacuagauagcauucuuuuuuuauuucaaaaugaucaaauuaaccaguuucaguagagaagaaaaaaaguaacuuucaagguuaaaaaaacccccaaauucagccuauaugcaauacugaaaaagucuaucaaguuauauuacaauuuuuaaaaaguuaacucugucuucagaagaaacuugaguaacacugaaacuuaccauaacaguuucauuaguuucaggugcagaaucaagcaggucaucuaguucaucuccaaggaccauaucuccaucaucuagaaaagcuucuggcauagugaagggcaucuuuccuccauuugccagcacugcagauggcagagcgcucucuuccacuuguaguggcaaaauagaaguuaagggcauaacaggaacugaggccagcucacuuccaacuucaugagaaaaacugggugccgguaaagagacaacaggaacugcuucuugccuuggaguuaauaaaucuguaacacagauggaaauguacucagucacuuucaucguacuuacauaauaauaccauuaauccccaauaauagagauacaaagaugaaaauaugaaggcaauuauaaaaauaauaaaauugacaguauaguaaagcaauuccaaacagauacagucacgugugaaaacuuauccuucuuucacaaaaugccuguaucucucuuugggcacagcuaucagacaguggcaaggccacagugggugucagugauugcuuacuaacauccaacacuuuucagucacucacuggcacauccaaaggcacaaagggagcauuggaaaucauuuucacuuucauauuaauacauuaauaugaauauaaccacacagcgauauuauuugacaauacaucacauacaaagacaucagguacaaagcuggcacuauucaaauuguuaagaugauaugugaaaacauaccuggcucaauaucuuccacagaaugguucaaagccuagaaauuaaaccaaacaauggguuauaauauuuucaggacucuaagccauaaaacaaucaguaaaacucacccuaggccgggcacaguggcucacgccuguaaucccagcaccuggggaggccgagacaggcagaucacgaggucaggaguuugagaccagccuggccaacauggugaaacccugucucuacuaaaaauacaaaaauuagccaggcaugguggcaggcaucuguaaucccagcuacucaggaggcugaggcaagagaacugcuugaacccgggagguggaggcugcagugagcugagauagcgccacugcacuccagccuaggugacagagcgagacucugucuuggaaaaaaaaaaaaaagaaaaaaagaaaaaacucacccuaagagaacaaugcagguuuccacagaaauucaacucccaauuaagauccaagaaaugaauggaacacgcaaaccuguauacaugugguguuaggugaggugcuggucuagcagugcugccacuuauuucucguggaccagcauuucucaaaggcuauucagcagaauaacagggaugaauuuggccaccaaucauugcccaacucacaauagccauuagcauccuauuagccccaagaaaauuuuaauuuuaaaauuaaaaacaaaaacaaaaaaaaacccuuuguuaauuuuaucacaaaugacucccaaaacuaguauuuggcccugaaccacucuuauugcacugaaaccuaacaucuauuaacauccuauaaaaugccccacuggagcauucaggaaaugcugguuacagcuaaaauauauuacuugaguuguagauguucuuuuguaaagugacuagaagaggccagaagagauggcucacgccugugaucccagcauuuggugggaggccaaggcaggaggaacacuugagcucaggaguuugaggccagccugggcaacauggugaaaccccaucgcuacaaaaaauacaaaaauuuaacaggccaugguggugugugccuguggucccagcuacucgggaggcugaggugggaggaucacuugagcccaggagguggagguugcagugagccaagaucaggacacugcacuccagccugggcaacagaacaagacucugucucaaaaaaauaaauaaagugacaggaggguauugccaauuacguguuugaggaauuaaaaagguuccaaaaauaaacacacaccaaaaauacuaaaaguagaauugcucccauccuucccuuuaaaaaaaaauauaauuuugacagaaaaaauaacuuuaccuugguagccccauccccaggaacugauuuuaaugagagcugaaauaaaauaaagacacuaauuuaaaaacagaacugacuccaaguucuaaaacaaaaugaaaacaccuuaugcagagaacuccagcuuaccucagcucugacauacgcuuuucuuauuuuaaaucccaauuucugagcuaguucuugaguuaguuuuauuacaugcucauccugaaaaaaauaaguauguauaauuaacaggguuauauuuacuaauggugaagaagaauagacaaaacagggaaguuucccaucaagacaccugcuucauuagcauuuauacccaacugaagcagguugauggaugacuggaaaauuuaacucuuuaaaugccauuuauuaugauguaaaugguuacgauguaaacaaauaaacuauaaauuccauaccugaggcacugcuaaggagcacuuugcuacagcaucguaagccuuuuuguaucuuccuaaaucacuuaaagccuuagauuuccgauacagagcuuugcaguuacuggcauuuaaacugaggacuauauugcaguccuccaaaacuuuaucauggaaacccugguguguaagaccaaagaauaaagucagcaaucaaacaauucauuucuugcacugaggccuuccuguaauaaaaacaaauuaauaccccauccuauuacccucccucuaaacuccaaguuagcaguauuacuuuuauuuuuuaaauuauuuuaugaaauuucaaauacaaaaaaguagaaagaauaucaugaauacccauguacacaccauccaggucagacaaaugcuaauauuuggucagaaaguccccagaucuucaagaaauaaagcuuuccagaccuaacugauguccccaugugucccucuccuauucgcuccucuguaguuacccuuugcuggagcacauuaagaugucaaacagaaacguaacuccaaacagcuaacugauaaggaauauauuacccaaaacaaaauaaauaaacaaugaaugcucuuuaacaaagagcuaggugacaacacggauauuuuucuuaaauucaugguuauauuuuaccgaguauccacagugaaaauuaaaagcacuucagguugggcacagugccucacagcuguagucccagcacuuugggaggccgagguggguggaucaccugaggucaggaguucgagaccagccuggccaacaugguaaaaaccccaucucuacuaaaaauacaaaaauuagccaggcgugguggcgggugccuauaaucccagcacucgggaggcugaagcaggaaaaucacuugaacccaggagacagaggauacaguaagccgagauugugccacugcauuacagccugggcaacagagugacacuccaucucaaaaauuuaaaaaagguggccaggcgugguggcucaugccuguaaucccagcacuuugggaggcugaggcgggcagaucaccugaggucaggaguucgagaccagccugaccgacauggagacaccccgucucuacuaaaaauacaaaauuagccagguguggugguacaugccuguaaucucagcuacucgggaagcugaggcaggagaaucucuugaacccgggagacggagguuacggugagccaagauugugccauugcacuccagccugggcaacaagagugaaacucuugucucaaaaaaaaaaaaaaaaguuuuaaaaggaaaaaaagaaaaaaaagcacuucaaaagcuuuuaagcuuaaaaaugugaaaaucuagugugaauuccuuugaagacuaauuacuauuucuugauuuaaaaaaacacucgccaggcacgguggcucacgccuguaauccuagcacuuugggaggcugaggcgggcagauugccugaauucaggagaucgagaacagccugggcaacacagugaaaccccaucucuaacaaaauacaaaaaauuugcugggcacggcggcaugcgccuguagucccagcuacucgggaggccgaggcaggaaaauugcuugaacccaggaggcggagguugcagugagccgagaucgugccacugcacuccagccugggugacagagcgagacacugucucaaaaaaaaaaaaaaaaaaaaaaacacucguaagaguguuuuuuaccaagaguguuuuacaagaucaacuggaucuugacuaagauguuaacugugaacagggauaccugaaagacacacugaccugugaagaccuguaucuucccuggaugacuuuuuuauaagcagacacaccuucaaaagccauacucaaaugggaaucaucaaggaccaauaacuaagaaacaaauuauuucuuaaaucccuaaccuucuguccaaagcuaauuuuuauuuuuuuauuuuauuuuauuuuuugagacggagucuugcucugucgcccaggcuggagugcaguggcacaaucucggcucacugcaagcuucgccuccuggguucaagcgauucuccugccucagccucccgggcagcugggacuacaugcacacgccaccaugcccaguuaauuuuuuuauuuuuaguagagacgggguuucaccauauuggccaggcuggucucaaacuccuaaccucaugauccacccaccuuggccucccaaagugcugggauuacaggcgugagccaccgugcccggccaauccaaagcuaauuuuuaaaagccucaagccacuccaaaagcagguaauaugacuuucuuaaaaacuuaagaaauugacuuuuuauuaauguacuaagucauugaaaaaauucuuuucacucuagaaacaucauuuuaaaaauuacaacucaccauauuagaauagcaggcaauacgauuuauauauaguuuuucaauuauuucuuuggggauuaaaauuucuucagauuuugcauaaucagcuauauucaaggcuuccguguacuggcuuaucgaguuguuccaaucauguucccgauaaacgucauuuccuucauuaaaaagauuucucacgagagcacgcaaauauaccuaaaaaaaagaaaguuaccacuugaagccuuuuaucaaacaagauaugguauaaguaaauuuuaauuuuuauaccuaaaacuucacaggaaacaaugugacagaacagcagcauugcucuaagaaauugugagaugcagcccaagucacugcuaucucagcuagggauugaaucuugcuugcuuuuucaaggggaaauucaauuucucacuauuaagaaaaaugcagcaaaguaccuuauaaauauuuguucacaucuccaauucugugcccgcuagagaaaccaaguggaagccccaagucaaagagaaugaauaguuuaaggcuuuugagcaguauuuccaaauugccuuccaaaaaggccaugaugaaaaauguuucuagugguuuacuuuauagcacccauacacacuagguaguguguguguguguacacguguguggguacccgugcacauauauguaaaaucuaccaauuucuagguggaaaaugguaucguuuuguguuuauuuauuuuuuuuaaugguauccucuuuguaugugcaugucuuuaccagugaaguugaacuauuccacauuuuuacggaccccuuguauuucuuuuucuguaaauugcucaggucauuuacugauuuggggggagggggauguuaaacuuuuuucuuaucaaguaaguauacacauucuuuuagcauguauaaaaguuugucauuuuccuucauuauuucuaucacgcuuuaguuuaguucuuuuuuuucuuuucuuuuuuuuuuuugagacagagucuuacucuggcacccaggcuggagugcaguggcacgaucucggcucucugcgacuucaccuccugaguucaagugauucucgugucuuagccucccgaguagcugggauuacaggcaccugccaccacacucggcuaauuuuuguauuuuuaguagagacaggguuucgccauguugcccaggcuggucucaaacuccuggucucaagugauccgccugcuucagccuccgaaaaugcugggauuacaggugugagccaccacgccuggccauaauuuaguauuuuaaaagcucuuuuucaucacaagaucagaaaaauauucaacuuguuuugucucauuuuaugaauuccugucuaagcugauuaaauuauuuuagcugauuaaauuauuuuagaagacuggacggaucaacuauuaacaaaacucgugacaugccacuuaacaucuuuagaccccagguccacgugcaaaaugaaacaacuguuacaguuuauuucuggcucuaauacuuuuuuauuccaaaucuguuuguagagagcuaaggaacaagagagaagaaaaggggaggagggagagaggcagcaagaaagugacauuuagaagccucaaaacccucagaggaaaaaaaacacaggugaaccaauaguuaguagagacaagagucugcagucaaagucccaauaaacugggcuuucucccuguuccuaaacagcagaucacuaguucuucccucuugguauccagucccccuuagcugcugucagaacaucuccuaacagaaaaaaauguuccacacacucuuucucaauaaauucugucccacuuauuuucaaugacaugagaaguaauuuucaaguggcucaaaagauaaauuaauucaaaaccacccuaauagaggaaagaaaauacagggcaacugugcaaguaugcaaaaaaagaaaaagaaaaagaaaaaaaaaguccuauauagaagggguuggcaaacuuuuucugcaaaugcccagacaguacauguuuuaggcuccaugggccauauggucucugucaaaacuaccauauguugcaaaagcagccacagauaauacauaaacaaaugaguguggcuguguuccaauaaagcuuuauuugcaaaaaaauaaaauaaaauaaaauaaaauaaaaggacagcaggccagauugggcccacaaggccaucauuugccaaccccugcuacaaauuacaguucacaagccacuugcagagcuuucaagcagaccuucccggagucauuaccgcauauugcuccuguguuccuggauaugacagcggugaccuaagaagaagaaacaaauuaacuguaauuaucaagcuccuuaucgggaccuguucagccagaagucaucuuaaaucugugguuccauuagcuugccacugguucaaggcauauuucaaagacuuccuccuccuuuacuaccauuauucacagaugacuacaguuaugggaaaaaaaauacauauacauauauauauauauauauauauacuauuccuuaguauuuuuuaaguacaacacuuuacuuucaaaccuacuucuauuuuuuaaaaacccuaauucuucaacugccaaaaaagagguuaaaaauaguacagagccacuaacaauauuugauccaauuuacugcaguauagagagaaugucuccuucccaggaaggaacaaagaggcccuucugcccggacauguccauccaaaccacagcugucucaucauugacaugcuucaagaaguccaauuaaacacugagcuucugaacagacacgucugaucacagaagcccucugugccgccagauguucauuuucagucacuuuccacucagcagcacuguucauagaacaaauucaaauuucucagucuaacguuuugggggagacuaacaauuguagcccuaaaagccagcaaaaguaacacuugcuuccgaaugcaagaauguucaaauggacaaaagaaaaaaauauugcuagaauauggaguuucuaacccaaauuaacuggaccuauuaaacaugacuaaagaguucuuccucuccacaaaacauacauccacaccaaagaauuaggacgcggcaagaacacaagaacucugaagcucuuacuguauaaacugcaguccuuccuuaauguucugcugccuuuuucuucucuccucggacacauuggacauguuaucccacacauccacuuucuaaaugagcaaucuggaaagaaacaaggcaaaaaagcacauaagguaccagggucccuggacuccaaugaaaacacccacaaauccagaccuugucacacaaucagcuguggacacauccauuucugacuugacuccaggguccuggacggcagggaccguacaggagucaucuuuguggcuccccugugguccggcacaccauaagcacaccguuuucauauucuuuuuuuuuuuuuuuuuuuuuuuugagacggagucucgcuccauugcccaggcuggagugcaguggcgcgaucucgcgaucucggcucacugcaaacuucaccuccaggguucaagcaauucuccugucucagccuccugaguggcugggacucagaugccugcgaccacgccuggcuaauuuuuguauuuuuaggagagacaggguuucaccuuacuggucaagcuggucucgaacucgugaccucaagugauccaccuaccucggccucccaaagugugggauuauaggugugagccacagcgccuggccaguuuucacauucuuuaaggcugaauggcuaugcagacuuuguauaccccuccugagcagucuccaggaaaaagucaugucuccccuuccuuuccucuucccuccuuuggcuucagguuuuguuuuucccugucuacacgcacgcauaagcugucccuagaacaguuccagccuuguuuugcuucuggaagcucuccagaaauaaaaagguuucacauccgcuugccuccgagggagucugacuuccuuguaagccaaguuuaaaccuuauacauauuuugucccacaaacuuccaaaaugauuauuguugauacaacagauaaaauaaugauauaaaguuacuuccauuggaauuuucuggauauuaaaauguuauccucaauauaacacuugcaaaugucaacacauaucauucuuuugggccccaccuccacuaaucaacguucaccgagcaguuccccaaguucaaggagagccacagagaagagaucugagauaaaacaucaucucccaguggcccaaacuagaguuccucaggcuuggcauucugggcuagcuaauuccuugucuugugauugcaggacauuggcaguauuucugccucuacccacuaugccuguagccccucaccccaaccccacucacaaccaaaagugucuccagauaucguuaaaugucaggguggggaaagcacaaucagccccaguugagaacaacugagaccuaaaguuaagacaacaucuuacacauaaaccacguauuuggacccaggugacaggaagggaaauuccacucauguuugaaguacauugcugaaauuuuuuaguuucauuauugcuuggcauuuacaguuuuauuuuuaaaucucauuuuuuucaaaguauaagggugagauggggguuggaaugucccaaaugcugauaacuggugcuaaacccuuucuucuuugaaacaccgucaguucucaauauuuuuguccuauaaaguugguacuuuacugaaguguuuacaugggaaaggauaugacauaggggacuugcuuuaaaauacuccaguaacaacaaaaaaggggggggcugugagguggggaggaaacagcagaaugcugauaaccaggggagggugagaagugcaggggauucuucaguacuauucucuggacuuuguauguguuugaaacauuacaaaauaagaaguuuaagaaguccaugacacuagaguaaaauggcacuauuucuggaaugugcuuuuaaaacaguuuagccaaaagggggguagcuggguggaaauaaaacaagaaugccaaaaauauggauaaugguuccagcuggaugaggggcauggaagcucauuccacccuucuagcuacuuggacauguuggcccauguccuuaauagaaaugcuuuuuuaaaaaaauuuauauauuuuuuuaauuuauaaauguuuucuaaaaauuuauauguacaaaauaauuuaaggaagcacuauuuguaaaagaaaaagauuuuuuaaauuaacucaggccacucaugguagcucacaccuguaaucccagcacuuugggaggcaaaggcaggaagaucacuugagccuaggaguucaagaccaaccugggcaacacagggagacccccuaucucuacaaaaaauuuuaaaagaggccgggcgcaguggcucgcgccuguaauccagcacuuugagaggccgaggcgaguggaucacccaaggucaggaguuccagagcagccugaccaauauggagaaaccccaccucuacugaaaauacaaaauuagcugggcaugguggugcaugccuguaaucccagcuauuugggaggcugaggcaggagaaucacuugaaccugggaggcggagguugcagugagccaagaucacgucauugcacuccagccugggcaacaagagugacacuccaucucaaaaaaaaaaaaaaaaaaaauuggcagggcaugguggcucaugccuguaaucccagcacuuugggaggcugaggugggcagaucaccugaggucaggaguuccagaccagccuggccaacauggggaaaccccaucucuacuaaaaauacagaauuagccgggcgugguggcacaugccuauaaucccagcuacuacggaggcuggggcaggagaaucgcuucaacccgggaggcggagguugcagugagccgagauggugccacugcacuccagccugagcaacaagagugaaauuccaucucaaaauaaauaaauaaacaaaaauaacaaagauuagccaggcaugguggcaugcaccuguagucccagcuacucaggaggcugaguugggaggacugauagagccugugaggucgagguugcagugagcuacaaucaugccagugcacuccagccugggugacagagugagaccuugccucgaaaaaauaaaaaaaaaagcaaccgggugugguggugcguaccaguagucccagcuacucagaugauggaggcaggaggauggcuugaacccaugaggucagggcuguagugagcuacgauugugccacugcacucccgccugggcaagagagugagacccugucucaaaaauaauauuuuuuuaaaaaaacuaacccagugucuaucaaaaaggaaaugccugaagaaauuauaggaaaaaaaaaaaagaugaggcauuuaaguauccauaugacccauuuuguuuuguuuuguuuuuugagacagagucucacuugucacgcaggcuggagugcaguggcacgaucucugcucacugcaaccuccgccucccggcaucacaccauucuccugccucagccucccgaguagcugggacuacaggcgcccgccaccacgcccggcuacuuuuuuguauuuuuaguagagauaggguuucaccgcguuagccaggauggucucgaucuccugaccucaugaucugcucaccuaggccucccaaagugcugggauuacaggcgugagccaccgcgccuggccguuuuguguuuuuuuaaagugacggguagguauauauauugacauaugcuuguguaaacauaaaauagucccagauggaaucaugggagacuacagcaguaguagaagacugaggcuggaaaagggguaggacgaggucuuuucaaucuauguguucaaaacuuuuguuuuauuuggagccacguaaaugaauuaccucuguacaaaaauuaaacaaauuuuuaaaguuuauguauccucugagcccuuccuuggaaagaugacuuaagggaccaccgggcuuuuguuuguuuuagcuaaaacagggcaauuuacuuagaguucgaacuuuagaguucagaggaacccagaguaguaugcaggaugccagagcagucaggccagagggagggaacaaaagaaaaggaugucugaaaccaggacgauggccacacaguucagugaaugauguaccuuucucucagccucuaucuagccaagguagggaauugguuugagguugacucaaaaaguuaaucugcuggcuaagaauggacuccuggguagugauaucugccaaguuuauagccuuaaagcuauuuuccccagaaaguguuagagaaccuugaaccucaaccuuauacacaaaaggcguguggcaaagagcugacaccacaaguaagugauugaaaggaaacggaaaauggauacagacguuuuuaaugcacaaaauacaccccuuuagcuguuuauagaucuaggaucacaauaucaggcaauauuugaauauaauaugacagaguauuucauguucaguaguuuuuuaaguuuccccaaaaacuuuuauuuugaaaguucucaaacacacaguaaaguuaaaaacaauuauaauacuguaugcccaaacccacaauuaauauuuugugagaucacaucugcccaucuuuaucuaucugcucauccuucuguucauucaucaguccgucuuacuguuuuaauaaauuucaaagucagcugcagauaccuaaacaucucagcacacacacaauuaaguagagaucaauauuuguuuacaguuuuguuuuuuaagguaaaacacgcaaaucuuaaugugaguuuugacaaacucaugugacccagagcccuaucaggauauagaucagcaccuugggaggccaaggcaggaggaucauuugagcccaggaguaugaaaccagccugggcaagauggagagaccccaucucuacaaaaaauuaagccagguguggugguacgugccuguaguccuagcuacucaggaggcuaaggcaagaggacugauuaagcccaggaguuggaggcugcagugagcugcugaccgcgccacuacaacccaaccugggcaacagaacaagaucuugucucuuaaauaaagaaaagauauagaccauuaacugucacucuacaaaguuccuucaugccccuuccccaaaccacuacuguaauuucuuuuuuccucaccauugauuaguuuuaccugugaaauaaucuccccccaacacacaccccuuuguguguguguuuuuguuuuguuuuguuuuugacacaaggucuuacccugucauccaggcuagaguacaguggugugaucacagcucauugcaaccuuaaacuuccggucucaagcgauccucccucaucagccuccugaguagcugagacuacaagugugccaccaugcucagcuaauuuuuuuaauuucacagggauuaaaagcacagggacuggccaggcacaguggcucacgucuguaaucccagcacuuugggaggccgaggcgggcagaucaccugaggucaggaguucgagaccagccuggccaacguggugaaaccccgucucuacuaaaaauacaaacauuagccgggcaugguggcaggugccuguaaucccagcuacucggaaggcugaggcaggagaaucguuugaacccaggaggcagagguugcacugagccaagaucgcgucauugcacuccagccugggggacaagagcaagacuucguuuccaaagaaaaaaaaaaaagcacagggauuacaggugugagcccccucguccagccccauacuccuuuuuuuaaagaaagaaaaagacguuuaaaaauauacuaucuuauuuuuggauacuguuaaaaucuagccucaauuuuaaagaaagaaagaauuuuacaaaguuaacccaacagucucuuuucuuacucagucucagcagcacucccucccaggggccccucccuucaacuuccaccucacagccugggcuaggucuguccccaccucacaggccacucugucuccugcaagcugaggcuccaucuccacagaccucucaccuugagagcccugaggacccacucuugagaucuccccgagccauacucucccauagagguccucccuccaucagaugucaaaugcccucaucuagggccccaugacaacucucacguccauccccaggcagacccucuggccuguuugacaguuccauuugaauuucucacagacauccuaaacuguucauuuuaacaugacagugaaaaggaaugucuccuucccauccuaucacuuagccacccauuugcccuuccgcccguuugcccuccuggagggccaccaaccacuguuaccagucucagaaaaguccagacaaauauauugcuuucuuuuuuuucuuucuuuuuuuuuuuuuuugagacgcagucucccucuguugcccaggcuggaguguaguggcgugaucucggcucaauacaaccuccgccuccuggguucaagcgauuauccugccucagccgccccaguaucugggguuacagguacgcaccagcacacccagcuaauuuuuguauuuuuaguagagaugggguuucaccauguuggucaggcuggucucgaacuccugaccucgugaucugccugccucagccucccaaagugcugggauuacaggcgugagccaccacgcucggccucacaaagauauucuauagaacgauucuguaucuugauugugggagugguuacaugaauuuaugcaugggauaaaacugcauaauacuacacacacacacauacacacacaggcacgcacaaccacacacacacaagugcugcuuaaaacccagugaggcccauaguuugguuaacaguauuauacuaaugucaauuuccugguugugacagugugcuacaguuauaugucaccauugaaggaagagggggugaaggguucaugggacuccauguacuacuuuugaaacuuccugugagucuauaauuauuucaaaauaaaaagguaaaaguauucuguguauauguuuguuuguuuuuauuuuuuuuuugagacaaacucucgcucugucacccaggcuggagugcaauggcacaaucuccagccuccgcuuccuggguucaagcaauucuacugccucagccucccaaguagcugggauuacaggcgcacgucaccaggccuggcuaauuuuuguauuuuuguagagaugggguuucaccauguuggccaggcuggucuugaacuccugaccucaggugaucggccugccuuggccucccaaagugcuggaauaacaggcaugagccacugcgcccggccgugcauauguucuuuuuuauucaaacuggagcuaccagugaguucuguaccccacugucuuuauguaguaucuaaucaguguguucguuuucaaaacacacagcguuccaugauaugguuguaccauaauuuuaccaggccucuggugauggaccuucugguuguuuccaaucuuuaaaggucaccauguacacagggcauuucauacacaucuaaguaucccuuuaaagaacuuuuauaggauaggccagccaugguggcucacaccuguaaucccagcacuuugggaggccgaggcaggcagaucacuugaagucaggaguuccagaccagcccagccaacauggugaaaccccaucucuacuaaaaauacaaaaauuaaccggguguggaggcauacaccuguaaucccagcuacucgagacgcuaaggcaggagaauagcuagaacccgggaggugcaggcugcagcgagcaaagaucaugccacugcauuccaccugaaccacagagugagacuccaucucaaaaaaaaaaaaaaaaaaaaaaagaauuucuaaaggauaaagggcauauguauuuguuuauuuugccagcuauugacacaauacaccaaaugauucucccaccaacaaugcagaggauuccugguuccccacuucacccaggcaucaaaugugugcauccuugugaaccaaaaaagugagaaacaguguggcaaugugaugaggccauguuuguuuuaaucuaucauuagcaaggcucagcguccuuucaaauuuaagaaucaucuguacuuccuugucugugaauuguuugcucauacccucugcucauuuuucuuccaggcugagcuuuacuuauuuauggaagcucuuuauauguugaggaaaauaguccuuucugauguuauugguauuuuuuccaauuugaugucaaucuuuugacuuugguuauuuuugacagcaaagguguuguugucgucgucguuauuauuguuguuugagacggaguuucacucuuauugcccaggcuggagugcaauggcacgaucucggcucauugcaaccuccgccucccagguucaagcgauucuucugccucagccucccgaguagcugugauuacaggcacacgccaaaacgcccggcuaauuuuguauuuuuaguagagaugagguuucuucauguugguccagcuggucuugaacucccgaccucaggugaucugcccaccucggucucucccaggaggcagagguugcagugagccaagauugcgccacugcacuccagccugggccacagagcaacauucugccucaaaaauaaauagauaaauaaaacaaguaaaaaauaaaaauaaaaaucagcccagacugguggcaccugcuuguauguagucucagcuacucagaggcuaagggaggaagaucgcuuaagcccaggucuucaaggcucagcaagcuauaaucacaccacugcacuccagccugggguacagagcaagacccugucucuaaaauaaauuuuuaaaacacacacacacacacacacacacacacacacacacacacacaucccaaugcuugcacucugcuuaagacccuucagcaguugcuugggacgcuggaugaagccuugccuccguacggugaccuagcagacccccauccccaagccacgcagcuccugccucccccagcuucacacaugaggcucccgucacacugaccuuuuaagagcucccagaacaagucaggcacuccaugcuucuaagucacuguguuuguuguucccucugcccaaaauacacuucccagcucuucacagagcugccucccuuucauccauccacaagugggcuuaaauaacacuguuagguaccuucccuugccacccuaaauugcugccucaccccagucucaccccucuuauucacuucagcagguaccugcuacuucucaugcuucauuguaagaacaagaucuggguccagcucaacaaauacuugaacaaagaaugaaguaagcagcccaguguaaagagaaugccucauacaaaguucagaggcccaggagauagaagcugguaaaaccauucacaagaagcaagcgugaagaaggagggugcccagcaggaaaugacugcaugcaaacagagcugguuauaguggggcuuggcccccaacccuuuggggaaacaaggugggaagugaaucaauauagugggaacugccuggagacagcgacggaaaaaaaccugaaaccauaagggauuccucaagauauacaaugacaaguuucacugauccccucuucuccuaaauaaaaaagaauuccagggaagaaggcacuuuguuuuuuuguuuugucuuugagacagugucucccuguguugcccaggcugcaguacaguggcacaaccauagcucacugcagccucaaccuccagagcucaaucuucccaucucagccucccaaguagcuggaacuacaagcacaugccacuauaccugaauaauuuuuguauuuuuuguagagacagagucccacuauauugcccaggcuguucucaaacuuccaggcucaagcaauccacccaccuuagccucccaaaguauugggauuacaggcgugaccugugucuggcccaaggagagauacuuugaacaguucauuuuaaagcaagaaacucaauuaaauaagaauuucauuaaauuaacugaacucuuacaaacuggaauaucaucucucugggaucagcugauuuaaaauuuguuacuaaucuugaaguuauguaagaucucaagguauccuggaucuucagaacucccuuacuauuuacucagugccugguagguuaaacucauuaucccaaagucuaguacaauguugguaacuagacaaauaaauccacauccaugagcuuuugaccuuacaugguaacuuuagaaacuagcucacauuaacagaagacaucaagguaagggaaaugugacugcaacauacugagacagaaauaguagcucuuacuggacuccaggcacuguucuacaugcuuuauacguauuaagucauuuaauccuccugcuaaccuuaagugacagguacuauaaagaaacugaaauacagauaagugacgcagcuggcccaggauuacaccuaggaaguagcagagcucaauuucaaaggcagacagccuggcuccaagccugagagccuauccaccuggcucuucugcacauuacgugccaaagacgccuggaggggagugagcaucugucuaggguggcccugggcugggcucugaaagacaaauauggcucugaugaacaggugggcacuuuaaagccauucaggagaaaugaaagaaacacacgcaugcgugugcacuuguguacacaaaaagauaugcucaacagacgucauuuaaugcaacucagacaaagcagagggcuuucacaggaaugcaguaggccaggagucuggacaucacuccagggaaaaucuuucaaggggaucugcuccacccagaacauaauguauuuaaauacaaauaauauuaaaacagccuuacuuacaagauguacuaacacaggaccaaagucucccagugaaggcagugcagaggucaccuagcacagcauuuguacuuuugccuaaaaagguaucccuacauuucaagugaaaaauuacaggcugggugcaguggcucaugccuguaaucccaacauuuuaggaggcugaggugggaggaucgcuucaggccaggaguuugagaccagccuaggcaacauaggagaccccaucucuauaaaaauguuuaaaaaauuaaaugggcauggugguguacacuguagugccagcuacucgggagacugaggcagaaggauugcuugaggccaggaguuugaggucacagcaaacuaugacuaugccacuauacuccaaccugggugucagagcaagauccugucucaaaaaaaagggggugggggggaggaaaaaugauacauuccacuccauauucaauucuauccccagacugaagccuguguaauauuaauagcuuuaaaacaacaacuacaaaguaguuaaaguaucauuauugucauccuuaauuggcaacaguauauuaacuggcucuugcaacacuuacaaaagcaccuggggcacaaggcaagccucagaaggcugcaaacccagaugauaagacauuaaaguuguugaagcuccuauuggauacuuuaugaaacaguuucucccuuuuacugaaaaggaaaauuucaugagagacaguaugccaaacaacagcaggaagguaauguuacauuuuggcuggaguucuuccccccacaggaacuauucacuuugaaauugcugucagauuucagauucaguaagauacaaagucugugaagagccugaagagccucccucugcgaagaggcuccgccugccaagagccucccucggcacccacgcccugcuaaguggugguucccaggaacaucucaucuuaucuaugaccucuguauggaagaacucaacaggaauauuucauguaaaagcuucaugacaaaugauuugccuggggacacugauaccaccacgauguacccaagaccgccagccgaugaagucuucccaaccaaguaaccccaacacacucucaccuucuuaccaaaugugccagauuaauguccugcuccaaauucaggccuuuucagaaaacauaaagcuucccgcuuucuauuugugaaaaaguaaccucguugcuuuacauaaacgaaaaucaccucauuuaauaugccuuuuguguacauguaaauuaaaacguuaucacuagcaguaauuuuuaaacuucuggauuaauacuuuaauacuucucuccuccuuaaaaauuaucuaaaauuucuucuugauuugccaacaccucacacuuuaaguaauuuucauaaggauucuggagaaaaauauuuucacuagaaaaaaaacaaaacaaaacagaacacuuccagacguuauccagaagacaaaaguuugcucacaucauacugucucuagaaagcccuuucuaggguaucuguggcaacaggauacagacgucuuuuguuucuuucuuccuuuacugaaaugcucaaaacuuuccaacagucacucucaccaucccuggaguugagaguuucuauaauugauucucuuccacuuacaaugacaauuuaacccaccccaacuggcagguuuuaaaaucagucaaaacuaagaauuguggaacaauguggcugacaagccaccauucuuauuugcaaaaacugacagaaucuggggaaugggaaggaaagaggguguaggucuguguaaaacccccaacgaaaagucacaguaacaugaagaaaggcaggaauucuccacuucguuuggauggcagaaaaucaacgggcucuuuguagaauaaacacacacacacaaacacacacgcacaaauauugauaauauugagccucaacaacucaugaucucauccugagacaaaccucauacaacuauuuguagccuccagcauacagcagauagggaaaauuuuucaacagggaaaauacuguccauuaacuugaauuauucugcaaauuaggacaagacccauugugcaauucaguucaacaguuuggcucaguaugagaaggaagaggcaguggauucuuugagagcuuaagggaaggaggccacaugccaucagagaagcaggaaagauaagcagauagacaugucuucucagggccaccacccauucagaugccccagcugcgcgcuguccagucgaaauauuguacaaaauauauuacacaaaauaagccauacgugucauuguauguauguauguauguacgcauguauguggagagggagucucgcucuguugcccagggaggagugcaguggcacaaucucggcucacugcaaccucugccucccgguucaaacgauucuccugccucagccuccccaguagcugggauuacaggcgccugccaccacgccuggcugauuuuuguauuuuuacuagagacgggguuucuccauguuggccaggcuggucucggaauuccugaccucaggugauccacacaccucggccucccaaagugcugggauuacagacguugagccaccccgcccggcccguauaugucauuuuaaauuuccaaauagccacacuaaaaaaagagaaaaagaaaagcagugagauuaacuuuuguuuuuuuauuuguuuguuuugagacagugucccaggcuggagcacaaaggcacaaucucagcucaccgaagccucaaucuccugggcucaagggauucucccaccccagccuuccgaguagcagauucucccaccucagcuucccgaguagcugacuaccggcgugcgccaccacgcccaguuaauuuuuuguauuuuuuguagagacaggggucucacuauguugcugaggcuggucuugaacuccugcacucaaacgauccuccugccucagccucccaaaguuuugggaugacaggcaugagccacugcauccugccaagauuaauuuuaaugaucuauuuucguuaauccaauuugucccaaacaugaccaucucaacaugcauuuaaguauaaaagauuaccaaugacaucuuuuacuuucuuucucauccgaaguuuuuaaaaucagauguacguuucacagcugggaccgcaacugaaacuggccccauuucgugggcuccaucgucccaaacggcggggggucaguggccaccguacugggcauggcaagguccuucgugguucaauaccgaacacgggcaacuccuuuucaucccuagacagguggggacaggaaaauacccaacuccuggcaaauccacccagucccgacucaggcucgaccucggaggccccggccgggccucaggcggccccaccccuuugcugcccaggccugaccggaagccccgcuaaugggaacugacaggucccggucccgguccucccgggcggcgcccccgccuccgcggaccccaaggccucuccccgcccggcccagggcugcaccccgcgcgaaaaaauaaaaaaaucagaaagggggguaaaaaagacggaugagccccaaauuaaugcgccaagcucuccgccggcauccuucccgcccccaagcccaagacgcugaaucgggauccccgcgaucaccagagcagacagaaauaaccaaaaaaaaaauuuuuuuuuagugaaaucaccaaaaaggagacauuuugccgagggaauggcaggcagaagugggucacguuauucucggugggggaaggggacggcgcgcccacccgucccuccgcgcgcacaggccccggcccggcuccucucaggguccucucggguccgcgggccccggaccccgccgccccucccccgccccgcccgccguccguuaacggccgcgcgcgagcacgaggcggcggcgcgcgcggggggggcgggggcgcgggcgcgcgcguuuccuucaugcccggcggcgucccccuaccccuaccuguggggacgacgcgccggccggcggcagaaggcaggcggaggcgggcggcggcaggcgggcagcgguggcggcggcggcggcggggccugggugcucgcucgcagcucucccucgguuagcggcggcggcagc

SEQ ID NO: 192602 - RNA, 22122 nt, Homo sapiens
ggccuuccaaagugcugggauuacaggcgugagucaccgcgcccggccaaauaaaauaaaauguuaaagcaaauucaggacuaccccuccuccaagucuucuguucccuuugggcgcccaggugagcgggggaggggcugggggaguaauaacaucaaaagagcgccuuuuccucccuuauuccgaggagacuucccugggccugacucccgguccuguccccagcgccccgcggccucuggagccccuucagugaccaagauacagagaucaggacgccuuugcgccgccccaggugcccgccccuagcuggcucugcuugggccgcgagggaaggugaggucgggggcggagccggggcgugacagccgggguguguguccgccgggcuuggugccuccgguggcccugcagcaccgucccaccucugccacccuccgauggggccgcuaccugugugccugccaaucaugcugcuccugcuacugccgucgcugcugcugcugcugcuucuaccuggccccggguccggcgagggugagugaggaaggggcuuucccggaacucaggcguuccgguauuccuccagcccuuccuagggacccagcagcccugccucccaucccucuccaaguuccuaguugcccuagagcccccagcucgcucuucuaaugcucacccacacgaugcgccccagccuucugcagggccccccacucacuccucccagggacccagaacuagcccaguccuuccccaggggcgcagaguccucuccuggcucccuccccuaaccggcugugacccucuccggcagcccggaagccucccgguuguccugaucugggguccgcgaacuuacccuucauuccaccugucccugagaugugagacaccagagggugggaggagcaggggcagaaagggccggcuugggggugggagaagaauauauugugccccuguacaacaaaccccggugaccaaaaacaaaacaaaacaaaacaaaacaaacaaacaaaaaaacaaaaaauagaacauacugucccuaucucacuauccauccuuuggggucacuguagagaggucccgugggugacugcccauuucuggggugcacagauacauguacccgcagaguacuaugcagacaccgccagcacacagaugcgcaggcacaggaccagccccagacucaccuggcccucaggugugcggcucccacagggaaaaauacugacauaccgcuagggggacacacgcacacacagcucaaggauacccgagacagcacucaggacaauucagaugcaccguguacacacacacacacacacacacacacacacacacacacacagagcagcacagacacacauaugugcgcauagacccuggggucacaggauggacagacagcccuggcccucccccgaggaggcugcagcgggcagacagggcaaacagaccccagcgugaccugccacaccuauguuggcacagagggaguguuuugcuugguuauaagcacagugcucaugccugccccacgccuagaacccucccucuauaaggcuguugcuagggcucugagauaccagagaguggucagggacgguggcaggggaaccuuuggggacagcuucaggguacgguguugggacugggacauugucagggugcucagacagggcguguucccugggucuuggugcauuuagaggucaagggaccauuucuggaagcucacugugugccagggcagcuuauaucagagcucagcucuuuuuuuuuuuuuuuuuugagacagagucucacuguugcccaggcuggagugcagugguacgagcucggcucacugcaaccuccaccucccggguucaagcgauucuccugccucagccucccaaguagcugggauuacaggcgugcaccaccaugcccagcuaauuauguauuuuucguagaaacagcuuucuccauguuggucaggcuggucuggaacugcucacuucaggugaucugcccgccucggacucccaaagugcugggauuacaggcgugagccaccgcgcccggccccaaaugcguuuuacauuuucuuccucuuugauucaucuuuguccuccaacauaaauaugcuacuuuuuccacugauaaaaagacaaaauggaauuucaaucuggccuggacuucucaaaaaagucagugugaugaaaacuguucuagauaaaacagaaaugagacugggcaugguggcucaugccuggaaucccagcgccuucggaggccaaggcaggagaaucacuugaggccaggaguuugugaacagccugggcaacauagugagaccccauaucuacuaaaaauuuaaaaauuagcugggcaugguggugcaugcccguaugucuggagacugaggcaggaggauugcuugagcccaggauuuggaggcugcagugaacugauugugccacugcacuccagugugggugacaaagugagacacugucucuaaaaaaaaaaaaaagagagacaagaugaucaggaugagcgcaguggcucaugccuauaaucccagcacuuugggaggccaaaccagguggaucauaugaggucaggaguucgagaccagccuggccaagauggugaaaccccuuucuacuaaaaauacaaaaauuagcuggguguggugucgcacgccugugaucccagcuacucgggaggcuaaggcaggagaauugcuugaaccugggaggcagagguugcugugagcaagauuaaaccacugugcuccagccugggcaacaagaaugagacugugucucaaaaaaaaaaaaaaaagaugaucaaacacaaugcgucaaccucccagagcuguauaaacccuaacccuaacccaggaagcaggcaagccugugugugaguuuccacucuauugcugguacuacucggcucuggcaaccccgaaggccaccuuccccuguugucacuguguaaggaggaaggagcacugguuugcaagucagaagccuggguugaagccucugcucggguuccugcuggcugugggaaugugggguuaccuuucccggcuggccucguuuccuacauguccaaugcagggguuccagucacaugcauugggcaccauuacauguccaagcugugccaggaucuagaaaaauggcugggcucaggccaaggggccuuccugucuggcagugaaaauaagaggagauaccaagggcccugagucugagucuggaggggaagucaugagcacagggcagugccagggcccgggagcugccacagaggagcccaccuuggugacagacaccuguaggcgcguccgugaugcccaguucccaacacagggaacuggacaaacguuucaugcacgacucuuuuuucccuucuuggcuaccuugaggaccuugauuauaauaguuagccuuuuuuuuuucuuuuuuugagacucuugcucugucacccagguuggaaugcaguggcaaaaucuuggcucacugcaaccuucaucucucagguucaagugacucuccuuccucagccucccuaguagcugggauuacaggcaugaaccacuaugcucggcuaauuuuuguauuuuuacuacagaugggguuucaccauguuggccaggcugaucuugaacugcugaccucaggugaucugcccgccugggccucccaaaauguugggauuacaggugugagccacugagcccagccggauuauaauagccuuuucaugcaccaggggcuuuauacucauuaucucauuucauucauaugaguugaagucaguuuaucccccauuucacagaugaggaaaccaaggcccagagagguuaagaauuuguccaaggucacacagccaggaaguaggauucaaacccagacagccaggcuguaacaccugggcucuucucaggcucaugcccuucccaggggucugggaagcccugaccugcagccugucaccuuuguuuaccccccagccuccaggauauuacgugugcaccggcgugggauccuggaacuggcaggaacuguggguuguguugguccccgaacccccaucgccuauaugaaauaugguugcuuuuguggcuugggaggccauggccagccccgcgaugccauugacuggugagugcaugccugggaccaggccacaaaaucccucacacucugggguagucaaggcuuaugaggaaguacccaaaacugaagcugggguuugguccagggagaucccagugugcaguacuacuuugcaggcaggcagaggccucuuggauaacauggccagugaagccagaucuugguaccagcugccccuuacccuggccuugagcugaugacguugccuuaaaaacuuggcuaggagcuguggcucacuccuguaaucccagcacuuuggaaggccgaggugggcagaucacuugaggucaggaguucaagaccagccuggccaauauggugaaaccccaucuguacuaaaaaugcaaaaauuagcugugugugguggcaggcgucuguaaucccagcuacucaggagaccgaggcaggagaauugcuucaacccaggagguggaguuugcagugaguugagauugcaccacugcauuccaaccugggugacagugcgagacccugucucaaaagaaaaaaauaauaaaaauauaaagugaccagguguggugauucacaccuguaaucccaccacuuugggucgaagcaguaauaucacuggagaccaggaguuugaaaccagccuaggcaacauagugagacccugucucuauauuaaacacacacacacacacacacacacacacacacacacacacacacacacacacacaaaggaagccagacuaugcacuaggaacugcccugggaaucccuuugcguucucacaacaaucccauuucacagaugaagaaaccaaggcacagaaauauucaguaacguguccaggugcgguggcucacgccuguaaucccaguauuuugggaggccaaggcagguggaucacgaggucaggaguuccagaccagccuggccaacacggcgaaacccugucucuacuaaaacuacaaaauuagccaggcaugguggcgcaugccuguaaucccagcuacucgggaggcugaggcaggagaaucaccugaacccaggagguggagguugcagugagccaagaucgugccauugcacuccagccugagugggauuacaggcaugagccacugagccuggccuggugagcuaauuuuuaaauuuguuauagagacaagagagacaagaguuuucuuauguugcccaggcuggucucgacccccugaucucaagugauccucccaccuuagccucccaaagugcugggauuacagaugggugucaccgcaccuggccucuaaggaggguuucauuauaaaccuacccugaagggagggaauccgauuuuaugagaggguguagccuggugaggccuggaugaccuccagaggcaggggcuugugccugggcugaggccuaagggucaaugggcagacaugaaguugccccaggcagaggguacagugugggcaaagucaggaaguggcagggcuuggaucacuccaggaagagagaggagucaugugucacaggagcucgagacccagagagggaggcaggcaggcaggcagggaccaagcuugggcacagccaggaaggcaggacagggcaugguggggccaauggaaucauuacccaagacggggauuuucagggaaacagcuuagauaaggccagguguacaguagcucccaccuguaaucccagcauuuguggaggcugagguaggaggacugcuugagccugggagcucgagaccagccuaggcaacauagugagaccccauauccacaaaaaauuuaaaaaaggaguuugucuuccuguaguagcagacuugagagguugagguggcaguaucacuugagccugggaguucaaggcuaaagugagcugauugagccauugcacuccagccugagcaacagagagauacgcugucucaaaggaaauacaaauuaaaaaaccagccgggcaugcuggcgugugccuguagucucagcuacuugggacacugaagugggaggaucgcuugagcccaggaguucaaggcugcagugagcuaugauugugccacugcaguccagccugggcgacagagaaagacccugucucuuaaaaaaaaaaaaaucuuagauaagaggaugcugugccucccugggggucuucagucacccauaguccuggcaagagaggagggccaggagagagcuucacccaccugcuguccugcccaugugacauccgcaggugcugccauggccacgacuguuguuacacucgagcugaggaggccggcugcagccccaagacagagcgcuacuccuggcagugcgucaaucagagcguccugugcggugaguccccagcagcaccaugccacccaccccgaguauccccugggcauccuggcauagccagaugacuuccgugccccuguugcaauaaccacugcuuccaagucucuauagaccaccccuuggguauaucuaauguaagugauauuuauuuuauuuauuuuuugagucagagucucgcucugucacccaggcuagagugugcugaugugaucuuggcucacuacaaccucugccuccuggguucaagcgauucucgugccucagccucccaaguggcugggacuacaggcaugcaccaucacgcccagcuaauuuuuguauuuuuucaguagaggugggguuucaccaaguuggccaggcuggucucaaacuccccaccucaagugcucugcccgccucggccucccaaagugcugagauuacaggcgugaggcauggugucuggcccuaaugugagugaucuuuaacaaugaggacuugaaaaagaaaaccaugaagaaaccuaauuauuugaugucuggacgacaaggaagaagauagaaauggcaucagauaauaaacaguguaaauguuuaucagaaagaggcuggggguggggaccagaaggaggaucgcuugaggccaggagugcaucucuacaaaaaaguuaaaggauuuuuuuaacauuggccaggcgugguggcacacaucugugaucccagcuacuugggaggcugaggugggaggaucgcuugaagcccaggagguugaggcugcagugagcugugaucgagucacagcacuccagccuguguaacagggcaaaacccagucucaaaaaaaaaaaaaaaaaauuuuaccuaaccaaccacuucuaaagauauauaaaaaaaacccugcaauuaaaaaucucaggucccucaggcaauccuacaagauuuugaaacaaagcaauaacauaaggacuguaguauuuauuuuauuuuuauauuauuuauuuauuguuuguuuguuuguuuuuggaguguggguuuuuuuguuuguuuguuuuuugauuuuuuuuuguuuuuuuuugagacagaguuuuacuccuguugcccaggcuggagugcaauggcauguucuuggcuuacugcaaccuccaccucuuggguucaagugauucuccugccucagccuccugaguagcugagauuacaggugccugccacuacaccuggcuaauauuuuuguauuuuuaguagagaugagguuuugccauguuggucaggcuggucuuguacuccugaccucaagugauccacccgccucagccucucaaagugcuggaauuacaggugugagccacugcaucuggccgugguauuuauuuuuaagauuccauuuugggccgggugcuguggcucacgccuauaguuccagcacuuugggaggccaaggcagguggaucacuugaggccaggaguuugagagcagccucaauggugaaacccugucucuacuaaaaauacaaaauuacccugguauguuggugcaugcuuguaaucccagcuacucgagagucugacgcaggagaaucacuugaauccaggaggcacagguugcagugagccgagaucguacuccagccugggcaacagagugaaacucuaucucaaacaaaaacaaaaagaaauagauuccauucugauguauggcauuuuccauuuauaguuucccuucaaauaaauaagaaagcuaaaacaaugaaaacaacuaggaagugaguaaugguacagggagaaugcagauaaggcuugaguuucggcagcgagacucaaaguuaucugaagagcuagucaugauccagaccacuaguuccaucccuuuuuuucuauuuucuguuacuugaaaauagacauaacaggcucggcgcuguggcucacuccuguaaucucaagacgggcagauggcuugagccuaggaauucaagaccagccugggcaacauggugaaacccuaucucuacaaauaauaugaaaacuagcacggugugguggugugcaccugcagucucagcuacuugggaggcugaggaaggaggaucaccuaagcccagggaggcugaggcuguagugagccaagauugcaccacugcacuucagccugggcaacagagugagagccugucucaaaaaaaaaaaaaaaaaaaaagaguaaagaaaaaaagaggcugggcgugguggcucacaccaguaaucccaacacuuugggaggcugaggugggcggaucacgaggucaggaguuccagaccagccuggccaacauggugaaaccacgucucuacuaaaauacaggugggugcuuuuaauuccagcuacuaagaaggcugaggcaggagaauugcuugaauccaggagguggagguugcagugagccgagacugcaccauugcacuccagccugggcgacagcgugggacucugucucaaaaacaacaacaacaacaaaaagaaaauagacauaacacaaaauuaacuauguuaaaguguauaauucagugauacuuaguauauucacaaugucauccaaccaccaccuaaacuuuuucaucacucugccucgaaaaaucccuuuccccuuaagcaauccguucccauuccucccuaccaccaacaccugguaaacuuaccagguuaccaguuuucuaucucuggauuuacccugucuagauauuucauauaaauagaaucauacacuauguuccuggcuucuucacuuaguauaauguuuuugagauuugcucauuuucuuucuuuuuuuuuuuuuuuugacacgaaaucucaccugucacccaggcuggagugcaguggugccaucucggcuuacugcaaccuccgccucccggguucaagcgauucuccugccucagcuuccugaguagcugggauuacaaacgugcaccaccaugccuggguaauuuugguauuuuuagcagagauggaguuuuaccauguuggccaggcuggucuugaacuccugaccucaagugaucugccugccucagccucccaaagugcugugauuacaggcgugagccaccacacccauccuguucauguuguauuaauagcaugugucaguacgucauucauuuuauggcugaauaauauccacugcauggauagaucacauuucguuuauccauucauucaaugaugggcauuuggguuguuuccaccuuuuggcuuaugugaauagugcugcuaugaacauucaugaacaaauacuuauuugaguaccugguuucaauauuuuggaguauauaccuaggaguggaauugcugggucauacgguaauccuguuuuacuucuuuuguugagacagggucuugcucugucacccagcuuggaguacaguggcaugaucauggcucacugcagccucaaacuccugggcucaaacuauccucuuggcucagccuccugaguagcugagacuauagguguguggcacgaugcugggcuaauuuuuuugagacaaagucucacuuugucgcccaggcuggagugcaguggcacgaucguggcucacuacaaccucugccucccagguuuuagcgauucuccugccucagccuccugaguagcugggauuucaggugcccgccaccacgcccagcuaauuuuuguauuuuuaguagagacuggguuucacccuguuggucaggcuggucucaaauuccugaccucaagcaauccacccacauuggccuccaaagugcugggauuacaggcaugagccacugugccuggccaagugcccagcuaauuuuuagccuuuuuuuuuuuuuuuuuuuuuuuugagauggagucucacucuuuuuguccaggcuggagugcaauggcgugaucucggcucacuucagccuccgccuccugaacucaagcuauucuccugucucaggcaugcaccaccacgcccggcuaauuuuuauauauuuuuuaguagagacgggguuucaccauguuggccaggcugucucgaacuccugaccucaugauccaucugccuuggccucccaaagugcugggauuacaggcgcgagccaccacgccccgccauuuuuaaacuuuuuguagagauaaguugcccaggcuggucucaaaaucuuggcuucaagcaauccuucugccugucugccucugaaagugcugggauugcaggcaugaaucaccaugcccaguuaagaguucuuuauauacuguggauacugacucuuacccgauaugugauuugcaaauauuuucucccauuauguaaguugucuuuucacuuccuugauagugucuuugcacaaaacuguuuaaguuugaugaaguucaauuaaucuguugucuuuuguugcucguguuuuugguguccuuagaauccacugccaaauccaaaguuauaaauauuuaccguuaaguuuucuucuaauagguuuaucauauuuaacucuaauauuuaggucauugauccauuuugaguuaauuuuugucuacggagugagguaagggguugaacuuuauucuuuugcauguuguuauccaguuaucucagcccucuugguugaagagacucuuccccauugaaucauccugcuaccuuugcugaaaaucaccgccaggagugguggcucacaccuguaauccuagcacuuugggaggcugaggcggauggauugccugaacucaggaguucgagaccagccagggcagcacggugaaaccccaucucuacuaagauacaaaaaaaaauuaggcggguguggcagcaugcuccuguagucccagcuacucaggaggcugaggcaggagaauugcuugaaccugggagguggagauugcagugagcagagauugcaccacugcacuucagccugggcaacagagcaagacuccaucucaaaaaaaaaaaaaacaaaaaaagaaagaaaaagaaaaucacuuggcucuagauggaggaggauuucaucacuuugagcuaauaauuugacuucucuuaaccccagcuuccuuaccuguaagauagguguugugaagaugagaaaagauuuguaagaugagaaacagauuuuguuuuuguuuugagauggagucuugcucugucgcccaggcugaagugcaguggcacgaucucugcccacugcaaacucugccuccuggguugaagugauuaucuugccucagccucccagguagcugggauuacaggccccugccaccacacccaguugauuuuuguauuuuuaguagagaugggguuucaccauguuggccuggcuggucucaaacuccuaaccucaggugaucugcccaccucggccucccaaagugcugggauuacagguaugagccaccaugcccagcugagaaacagauuggaugggaauuuuucuucuaucuccuccuccuaucuuuaucugaacuucucucugaccccugcuaacuccuggagagaaucaaagaucuguuccaacucuugauuaaaacuccagguucugcugacuuggucugcucugguggcaaagaggcuauuguaagcguuauuagaaguauguuuuuauuuuuauuuauuuuuugagacagagucuuacucuguagcccaggcaggaguacaguggagugaucucaacucacugcaacucacugccucccagguucaagugauucucaugccucagucuucugaguagcugggacuagaggugcacaccaccaugcccagcuaauuuuuuuguauuuuuaguagagacaguguuucaccauguuggcuaggcucgucuugaacuccugauccauccgccucggccucccaaaguuuugggauuacaggcacgagccaccgcgcccggccuacuugaaguauguuuuuagaucuucagcuauauauucuuacuacggauuagaacuuggcauaagagcaaagcugaauuaauaugaugauauaaucaauuuuuaggccugaacaugccccagguaucuaucaucucauccaacccucucauuuagaguuggggaaacuggcugggcaugguagcucauaccuauaaucccagcacuuugagaggccaaggcaggaggauagcuugagcccaggaguucaagaccacccuggcagcauagagagaccccaucucuacaaaagacaaaaauaaaggggaaacugaggcucagggagaguaagugacuuauucccaaaacugcccccuucuggugugggugaugaggaggugaaaugaggcuucagugggaaaucuguugaaaaucuuuccuuucucccuucaacuugccuauucugcuugcuccuacccaggugaaaaugauauuuauaaaauauuggugugucuguugguagagucugugccuguuuacagaacugucuucucugaaccaaaugaaaggaacuaaaauaucuauuaugcauuuuggacuaaaaauauuaucuuauucuguuuggagauauucugaacauaguuguuuauuuaauuacagguuuggcccauuuuccauuuaugggccugacuuaaauauauuaaaaaaaauuuaaaccuauaauaauauuuacuagcaggccuuaauuuuaaacuuaagccucgggagcuauucuuccuuucaaauuuuuauucuucuucaaaaugugaugccaucggguuccugagaucauggagcaguggggccaggucuugcuguuggcggaaucuuuguugcucaaggagaaaaguaagaggacaagcagaggcguuguugggucaggagacccugggcuggaauccugguccacaccuucccaguucugugaccuuggaugaguuaccgaauuccuguaagccucacuuuccucaucuguaaaaugggaauaacagaccagaguugcugggguugugugagcauuggagauuguauauggcuuugcuuuucuuuucccuccucuccccuccucucucucucuccccccucccccuuuucuuuucuuuucucuuuucuuuucuuugagauagagucucacucuguugcccaggcuggagugcaguggugcuaucucagcucacugcaaccuccaccuccccgguucaagccauucuccugccucagccucccaaguagcugggacuacaggcgcaccaccauacccagcuaauuuuuuuuuguauuuuuaguagagacgggguuucaucauguuggccaggcuggucuugaacuccugaccucaagggaucugcccaccucagccucccaaagugcugggauuacaggcaugaggaugaauggcuuuucuaaggcuuuucucuggucugucaacaaauauuacugugagucuacucugccgggcuccaugcuagguuuugggcaaggcagagccacgagguauuguuaaaaaggaggagacagggaaguagugugugcgccaagugcuuuguaacuauuguguugagagauaaagcaggugaauuacuauaccugcuacaacauggaugaacuuugaaaauaugaugggcugaguacgauggcucccaccuguaaucccaacacuuugggaggccaagacagaaguaucacuugagcccagaaauuugagaccagccugggcaacauagcgagacccuggcauaguagcgcaugccuguaguuccagcuacucgggaggcugaggugggaggaucacuugagcucaggagguccaggcugcagugagccgugaucaugccacugcauuccagccugggugacagagugagacccugccucaacaaaaaaggccgggcacagugucucacgccuguaaucccagcacuuugagaggcuuaggcuggugaaucacuugaggucaggaguucgagaucagucucgccaacauggugaaaccccgucucuacuagaaauaugaaauuagccggucgugguggcaggugccuguaaucccagcuauucgggagguugaggcaggagaauugcuugaaccuggaagacagagagguugcaaugaguggagaucaugccacugcccuccagccugggcgacugagugagacucuguuucaaaaaaaaaaaaaaagaaaagcaaaaagaaaggaagaagaaauacagcaucgagugaacagagccagacauaagaggucauguauauaggcuuucuguugcuauguuaggaauacaaaaaagaggucacguauaucauaugacuucauuuauaugaauuguccagaauaggcaaauccacagaaauagaaaguagacuagugguugcugggaaugcagaagagugggaacggggagcgaaugcuuaaagagaguuggguuucuucuguggugaccaucucgaucugucacccaggcugggugcaguggcaugaucacaacucacugcagccucaaaauccugagauuaagggauucuccugccucagccucucaaguagcugggacuacaggcacgugccaccaugcugagcuaauuuuuguauuauuauuauuauuauuauuuuuuuuuuuuuuugagguggagucuugcucuuguugcccaggcuggagugcaauggcaugaucucggcucacugcaaccuccgucucccgaguucaagugauucuccugccucagccucccuaguagcugggauuacaggcaugugccaccacaccuggcuaauuuuuguauuuuuaguagagauggguuuucucuauguuggccaggcuguucuugaacuccugaccuugugaacugcccgccucggccucccaaagugccgagauuacaggcacgagcaccacgcccggccuguauuuuuuguagagauggugucuugcuaugcugccuagguuggucuugaacuccugaccucaagcaauccuucugacucagccucccaaaguguugagauuacagcccuaagccaccaugcucagccuggggugauaacaguguuuuaguacuagauaggugcccagcauugugaagguacuaaaugcuacugacuguacauuuuaauaugguaaauuuuagguugugagaauuuugccccaauaacaaaaagcaggagugcauggugaggauuucucuguuacugagagugguuggggugagagaaagucucccggagacaccaaugaagcagagaccugaggaacagaggagacagccacguggaggugaugcaacagccagugcaagggcccugggguacgcacaagugucuggguggucugaggaucacaaggaguucggugaggcuggagcagagucccccagagugacagaaguaggggaugaugucggagagugauaggggcuagauuccuagggcauuggaggcucuucucugagagagauggggagccaaggaggguuuugagcaggggagggacaugaccugauuugcauuuuuuuuuuuugagacagucuugcucugucacccaggcuggagugcaguggugugaucucggcucacuucaaccucugccuuuugggcucaagcgauccucgcaccucagccuccugaguagcuggaaucacagguaugugccaccaugcccugcuaauuuauguacuuuuaguagagauggaguuucaccauguuggccaggcuggucucaaaauuucugaccucgggugacccaccuaccucggccucccaaaauguugggauuacaggcgugagccaccacacucggccuugauauguauuuuaaccaaacuacucugguugccauaugguacaaacccaggagagggaaaggguggaagcuggauguggcuaucaggcuguugcaguggucuuggagagagguggcuugggcaggggguggcagugaagaugguggaaggggcuggcuucuggacaaaucuggcuggauggaacugcaggaguugccaguggaugggugagggugugaggggaagaggagcuggcugggguauuuguccccgucgcccuguagcugaccacucuucuguccuuggacagccggccuucagccagcccuguaugccacccuggggcuauagccaggaagcuacaguggcuccuuccucaagaguccccuccccacuacaucauauuucucugaggguuucuguugugcagcagcccauggaaagcuuacaggcaggaaggcuuguuccugcacuggcugguucuaugacuaauuuucgcacauauuauguuuauccauucaucugucucgccaucuauucauccauuauccauucaccuaucauccaucuauccauccauccaucauccauccauucauucuuccaucuauccauccauccauccauccauccauccauccauccauccaucuauccauccaucacccauccauccaauuuccauccauccaucauccauccacccaucuuccauccauccacccaccauccaucuauccagccauccauuguccaucauccaucauccauccauccauccauccauccauggggagugccugcuugaggggaaugggguuucuucuggggugauaaaaauguuuuagaacuccgggcgcaauggcucacgccuguaauuuaggaggcuaaggcgggcagaucacgaggucaagagauugagagcauccuggccaacaugguaaaacccggucucuacuaaaaacacaaaaauuaacuaggcgugguggugugcgccuguagucccagcuacucgggaggcugaggcaggagaaucgcuugaacccaggaggcggagguugcagugagcugagaucgugccacugcacuccagccuggcaacagagugaaacuccgucucaaaaaaaaaugaaaaguuuuagaacuagauagaugcccagcauugugaauguacuaaaugucacugacuuguacacuuugaaaugguacauuuuguguugugagaauuuugcccugguaacaagaagcaggagugcaugaugagggauccaucuaucccaccauucauucaaccauucauuugcauacuuuuucugauucaaacccaauacauguuuguuaugaaaaauuaaaacauuccagaaauauucuuuugaaaauuuuuacuuauuauuuauuucaguagccuuagggguacaagugguuuuugguuacauggaugaauuguauaguggugaaaucugagcuuuuagugcacccaucacccaaguagucuacauuguacccaauacauagcuuuuuaucccuccccaccucagucuccaauguguccguuauaccacucuguaugccuuuguguaccccccauagcuuagcucucacuuauaagugagaacauacaguauuugguuuuccauucuuaaguuucaucaguuagaauaagugacguaacuuccuugcaaucccuaucaaaauaccaacaucaauucauccaaguugcuucauccagcuucauccaaguugcugcagaaaacauuuuguucuuuuuuauggcuaaguaguauuccaugguguauauguaaccacauuuucuuuuccuucuuuuuugagaaggagucuuguucugucacccagguuggagugcaguggcgugaucuuggcccccugcaaccuccaccuccuggguucaagcgauucuccugccguagccucccaaguagcugggacuacaggcaugcgccaccacgccuggcuaauuuuuguauuuuuaguagagaugggguuucaccauauuggugaggcuggucuugaacuccugaccucgugauccgcccaccucggccuaccaaagugcuggcauuauaggcgugagccacugcacccagccaccacauuuucuuuaucugcucauugguugaugggcacuuagguugguucuauaucuuugcaauugugacugugcugugauaaacaaaugcgcgcacgucuuuuugauauaaugauuuauuuuccuuuggguagauaccuaguagugggauggcuagaaagaauaguagauuuacuuuucguucuuugagaaaucuccauacuguuuuccauggagguugugcuaacugaucuuagcaccagcagucuaaaagcauucuuuuuucaucacauucaggucaaugucuauuuugacuuuucaauaauggccauucuggcugggguaagguaguaucucauugugguuuuaauuugcaguuccccgaugacgaguuauguuaaacauuuuuucauuugcuggucauuuauauauauuuugagaaaugucuauucaugucaugugcccacuuuuuuuuuuuuuuuuuuuugagucuugcucugucaccuaggcuggagcgcagugacauaaccucagcucccugcaaccucugccucccggguucaaaugauucuccugccucagccucccaaguagcugggauuacaggcaugagccaccacacuaggcuaauuuuuguauuuuuaguagagacgggguuucaccauguuggcuaggcuggucucgaacuccugaccucaugaucugcccaccuuggccucccaaagugcugggauuacagaugugagccaucgugccuggccaugugcccacuuuuugaugagguuuuuucuuuucuucuugcugauuugaguuuuuuguagauucaggauauuaguccuuugucagauauguaguuugcaaauauuuucucccauucuguggguugucuguuuacucugaugauuacuucuuuugcuaugcagaagcuuuuuaguuuaauuaaguccuauuuauuuauuuuuguuuuguugcauuugcuuuuggggucuuagucauaaauuccuugccuaggucaauguccaggggaguuuuuccaagguuuucuucuagaauucuuaugguuucaggucuuagauuuaagucuuuaauccaucuugaguugauguauauggugaguuuuguagauggugagagauagggauccaguuucauucuucuacaugcagcucuucaguuuucccaguacuauuuauugaauagggugucauuuccccaauuuauguuuuugaguguuuuuuuuuuuuuuuugagauggaguuucacucuuguugcccaggcuggagugcaauggugcaaucucagcucacugcaaccuccuccucccggguucaagcgauccuucugccucagcuuaccaaguagcugggauuacaggcauguaccacuacgcccagcuaauuuuguauuuuuaguagagacgagguuucuccauguuggucaggcuggucucaaacacugaaccucaggugauccgcuugccuuggccucccaaagugcugggauuacaggcaugagccacuacgccuggccuugagugcuuuguugaagaucaguuaguuguacguguuuagcuuuauuucuggguuuucuauucuguucuguuggucuauguaucuacuuuuauauuaguaccaugcuguuuugguuacuauagccuuguagcauaauuugaagcuggguagugaugccuacagauuuuuucuucuuuucuuuuuuuuuuuagauggagucucucugucacccaggcuggagugcagggggcaugaucucagcucacugcaaccucugccccccagguuuaagugauucuccugccuuagccucccgaucagcugggcuuauaggcacacaccaucaugccuggcuaauuuuuguauuuuuaguagaaaugggguuuuaccauguuggccaggcuggucucgaacugaccucagguguuccacccaccucggccuugcaaagugcuaggauuacaggcgugagccacugugcccagccuauuuggcucuuuuuuaguuccauguaaauuuuaggauuguuucuucuaauuaugugaaaaaugauguugguauuuugauaggaauugcauugaaucuguagauugcuuuggguaguauggucauuuucauuacauugauucuuccaauccaugagcaugggauguauuuccauuuguuugugucaucuaugauuucuuucggcaguguuuuguaguucuguuuguagagaucuuucaccuuccugcucaaguauauuacuagguuugggguagcuauuuuccuuuuuuuuuuuccagcuauuauaaaagggacugaguucuugauuucauucucagcuuaguccuuauugauguauagcagugcuacugguuuguaaccugagacuuuauugaauucauuggucaaaucuaggagucuuuuggaggagucucuaggauuuucuagguauaugauuguaucauuggcagagguaguuugauuuccucuuuucccauuuggaugcccuuuauuucuuucucuuuccugacugcucuggcuaggacuuccaauacuuugcugaauagaaguggugagagugggcauccuugucuuguuccagcucuugggggaaugaaugcuuucaacucauccccauucaguaugaugugggcuauggguuugucaucuaucacuuuuauuauuuugagguauguuccuucuaugccuaguauauugaggagaaguauguuucuuuaaaaaaaauauuauuaugggcugagagugguggcucgugccuguaaucccaguacuuugggaggcugaggcagguggaucacuugagcucaggaguucaagaccagccuggcaauauggcaaaaccccaucucuacuaaaaauacaaaaauuagcugggcaugguggugggccuguagucccagccacaugggaggcugaggugggagaauggcuugaguccaggaggcggaggcugcagugagccacaaccuugccacuacacuccagccugggugacagagacagaccuuaucucaaaaaauaaauaauuacuauuauuauuuuuaaauaaaggaauccccaaaugaagucguguaauaucaggccaggcaugguggcucacgccuguaaucccagcacuuucggaggccgagguagguggaucaccugaggucaggaguucgagaccauccuggccaacacgacgaaacccugucuccacuaaaaauacaaaaaaaauuagcucggugugguggccugugccuuuagucccagcuacuugggaugcugaggcaggagaaucacuugaacccgggaggcggaggcugcagugagcugagaucauaccacugcacuccagccugggcgacagagcaagcccccaucucagaaaaaaaaaaaaaaaaaaagaaaagaaaaaagaaaucguguaauauugaugcagaagagcaguauggcagacuuuggacucuccauuugaaacuuucaauuuccuuuucuguaaaauggggcugacaucaccugcuuccuggggagcccugcagauggagaucacguggugggcugucaagugucucagaaauguaauuuaugacccguccugccucuugcuuuacugguuucccuugagucucuccaggucccugcucuaaucucaguuuccccacuucuuccaggaccggcagagaacaaaugccaagaacuguugugcaagugugaccaggagauugcuaacugcuuagcccaaacugaguacaacuuaaaguaccucuucuacccccaguuccuaugugagccggacucgcccaagugugacugacuaccuugacuugaaaugcucuuuugcacaaggaaauaaagcguccucucaguaaugaa

SEQ ID NO: 192603 - RNA, 193497 nt, Homo sapiens
ccaggcggcguugcggccccggccccggcucccugcgccgccgccgccgccgccgccagcgcuagcgccagcagccgggcccgaucacccgccgcccggugcccgccgccgcccgcgccagcaaccgggcccgaucacccgccgcccggugcccgccgccgcccgcgccaccggcauggcgcuccggggcuucugcagcgccgauggcuccgacccgcucuggguacgugccgggggccgcgugaggccggcgggacggagggaggccggcggggagggaaagcaccgggcccgcagccgcccggggcaccccgcuccccgcucugcugccggccucgggggcccgggacccucacgucgcccgcggcccagccccuuucgggggugcaaggcaugggggaaacuugggugacucaguuccugcggagcagagcguggggggccgcgugcccagcccugggguuuuggagggucgggucgggucagagccgccgugaggaggccuuccuguuuugggguucccgucuguaaaaacaaccuuccagggaaggggacgcuagagauggggggcgggaagaggggugucucucugcuucuguuuucccaucuuuuuugugguuaggguccccccuuuucacgaaaaauacuccgugaccaacggggugagcuggggaggggcuuagauuguagaaagggacuuucauugucuccccaaaguugucguacaagccacauuacucuucugugguuaccuagcuuuguuuuuuuuguucuuucuacuuagauacugcgggggaaguuugggggaaccagggaagaagggggauguccacccuugaugugcccuaccugacccucggcucggggcagacuuggggugcagcugaggacgcccaggacccugguagcugugguccugcccucccuucccugcaacacguggagcuccucucuggggaugccccuuagauuuaaccccggcaaguuuucuucuguaacguggccugcggagccugacugggugucuggaguccacuugcugugguuuaagccccagucuuuugggcuucagcuucuccguaaugcgauuugccucuuuguuccaggaaggcaggcacuucugucucgugcugucuugauuguuggugaacgcaguaggcaaaucuggacacgacuguuucucucuccucuuuuguuuaggaaucaggagaaacagccuugguucuuaggagcuggugaucagcuuccaaaaauacuuucuuguccuguuuugccggccuuuccucgaggguugcauuuggaguguugaaaagucauccuccagggccccauuggaggguuugguuuuguuuguuuguuuuuuuuaguaggguaucauuguguuuaauaaccuaccacacuuugauauaucucccauuuuaagccagugggguuggagaguaaccccagggguggaaauagaacacagacuuugccuugagggucugggggugauuggagccucuuugcagauggacuuucuuuagcaggggaaaaccuguggcuuccuuguugccagguguaguaacagcaagauuauuuuuugcaaagauucacauggugaucuggguuuguguugcugugaauuccagaauauucucuuguuuauuuucuucugaauugaggagggggcaaaacagggugaacauccaugagguuuuguaucaggacguauuuuauugauggcaauugguaguugauggcuaaugaguauguuuggggugcgcuuuguuuaucuuaagaaacucauucacgaaguccaguuguaauauuuuuuaaaauuuuuauuuucuuuuuucuuuuuauuuuuuccuucguuaaggacuuucugccacagaaauugccaggugguuggguuuugcuuggggguaauuguagcugaucucugccucugguagguaccccauccccguguuugaccuugcguauuucugcugucuggauuccaagacuuguuggaggugccuuggaaccagaauuugagaggaggcaacuggggccugagugggaaaauugaaauauaauuaacugaaagcuagaaaguagguaguuguugcuuuuuucuuuucuuuuuuuuuucuuuuucuuuuuugagacagagucuugcucugucacccaggcuggagugcaguggcacgaucucagcuuacugcaaucucugccuccccggcucaagugguccuccuaacucagccucccaaguaccugggacuauaggcgugugccaccacgcccagcuaauuuuuguauuuuuuauagagacagauucgcacuauauugcccaggcuggucuccuacuccugggcucaagcgauccuccugccuuggccuccaaaaguguugagauuacaggcaugggccucugugcccggcuguuuuuguguuuuucaagguagcguguccgaggccaggagcgacuggccucccaggcagucagauaacugugugaccuugagcaagccacuuucccucugugugccucacuuuccucaucucuaaaauuggacaggagccaaaaauguggcagccuucuuggguuguugcgaagggucaaugaguuaaucuuguaaguggcucagcuugugcccugcacggagauaaacaaugguuaguauuaaauauuauuuuuuccaaagaugaaguuguguguuuuaagcuccuuguucuuccuuuggauuccccuuuucuucagcugguggagaugggauugggcugugaaaaggcagugaggcacccgugccuggcuccuguugugaccaaggucaugugcuuagaagucaaggucagugggccucgggugacucugucagagcuuuguuucugggcuacugucugccucugagccgcaggaaauguccagaaaacccagaagauggaaauggcccaugauaaguguucuguugaccuuuacucagacagaugcucugggaagagaaaaggagaacuuugcuaucaaaacggaaaauagggccugaggacaggucacagcagcccuuggcuuucuuuucucaugggggugggacugguaggaggcgcugcuuugugguugauauuggcaugaugguuggaaaaaugggccugggacuuuuugugaguucauuaaaaaaaaaaaaaaaaaaaaaaaaaaaagcaggccgggugcaguggcucacgccuguaaucccagcacuuugggaggcugaggcaggcggauugcuugaggucaggaguucgagaccagccuaggcaacauggauugacccccgucucuacuaauaauaccaaaaaaaaaaaaaaagccuggcauggugguguggcaccuguggucccggcuacuagggaggcugaggcacuagaaucacuugaaggcuguggggguggagguugcaaugagcugagaucacggucacugcacuccagucugggccacagacugagacccugucucaaaaaaaagagggccggguguaguagaucaugccuguaaucccagcacuuugggaggccaaggcaggcggaucaccugaggucagggguucaagaccagccugaccaacauggcaaaaccccaucccuacuaaaaauacaaaaauuagcugggccuggugauucacgccuguaauuccagcuacuugggaggcugaggcaggagaauugcuugaaccugggaagagguugcagugagcugagaucacaucacugcacuccaaccugggcgacagagagacugucucaaaagaaaaaaaaaauugugcuucaggcccuguguagaaaaauuggaaauuauggaaaagcagaggaaacaacuugguauuaagcaguauagugugguggcucagagcaaauucgccucugcugcugaggcagguuacgucaucucuccgugccucaguuucccuaugugggauaacguaguaccuagugaauagcggugacuugaggaauaagugaguuaauccuuagcaaggacuuaaaauguugcugcuuggcacacagcgcucaguaaagaucaguggucguugccaccuggaauucuccaguuaauuuuugcuguugcaccaacugccacuggagaagaccagaaggaagcugcaggugugugucaccgucgauggagugagcuggucccaggguugaugugcaccucugagaugcucuguggcauccaccaacucaguaacccccugaauaucugacuuagccgccaaggaagaauaucuuagaagcuauuaggaauuccucuuggggcuaggucugggccuuggagucagucugaucccugguuuaauucuuccccuuggcucaacagcaguguacgacgagccaauuuuuccccuccuccaaguguggcuuugguuuucaaauccaucccuuagccuucuccuacuuccucuguuuuccccuccccacccuuuuuuuuuuuuuuuuuuugagauggugucuugcugugucgcccaggcuagggugcaguggugugaucucgguucacuacaaccucugccugcugcguucacaugauuccccugccucaggcucccgaguagcugggauuacaggcgcacagccaccaugccuggcuaaguuuuguauuuuuacaaaacuuuacaaaacccccauagagacgggguuucaucauguuggccaggcuggucuugaacuccugaccucaaguggucaaccugccucagccucccaaaguguuggggauugcaagcgugagccaccgcgcucagccuguuuucccccuuuuuggcugccccuccuuccagacccuuccucucucccuuccuuauggaguguuagaguggaaagggaugucagaucuuggggggcccuccucuccacccaccccauuucguggauguggacacugagguccaggauggugacaugacagggugcaagguggcaaggugaauggcuuugggaggagaugagggugacccgggagaggccugggcaggaguggacucagggguuccugguccaaauggguucgugauucaggccaaucaggagcggauucaggguuccuuggccaaauggagccacugcagccacaggggcccugcagaaggcagcugcagccggucccuuuggccaagacucuccugaagggucguguucucuuucuccgaggacaaguuccauuugugauagccuggagggggugccucgccuuugggaccuggugguagaugggggggaagaaaaccuuuucuguuuguggacacaacuuuuaggaacugaucucucuaugugggugucucccacugaccauguuccuaaagaacgugagcuuccucuucccaugucagucuccagcuuugacuucucuuuuucuccucccauuccuaucacaucugucagcaaaucguguugcccguugccucaaacgggcugcuuuucauggcuuccccgacuuccacucuggcucgagucaucguuggccaguuucuggauuugaacagucaccucaguccaggcgccguggcucaugccuguaauccuggcacuucgggaggccaaggcagacggaucauuugaggccaggaguuugagaccagucugggcagaauggugaaaaccugucucaacuaaaaauacaaaaauuagccgagccugguggugggcgccuguaaucccagcuacuugggaggcugaggcaggagaaucgcuugagcccagugggguuggagguugcagugagccgagaguucgccacugcgcuccagccugggugacagugagacucugucucaaaaaaaaagaaaacagccaccuguucgcugcugugccuacucugcccuugaccccuacagucuagucuuggcccagcugucccucuucuacuaaaacccugcaguaguuccuugaggguacaagccaaagggcuuacaguggccucgaaggcugggcagcaucuguccccuuggccucccugaccucuucucuggcugcuuucugucucacucuccuccagccacacuuguggccaggccugucccugccucagggccuuugcacuugcuguuucuccuaccuacuaugucccucaccuucaaacuuuguucaggugucaccucaggcaucccguucuuucccuccacuagcaaaucucugucccccaucuacacccccaguagcacuuacugccuucuaauacacguaauauuuugcuuaaguauugugccuacucuguaaacuccuaccaaaagaucggcuccauaggggcagggauuuuggccuguguuuguuuacggcuguaaucccagcaccuagaacugugccuggggcuuaguaaauaacaguugaccuuggaacaauucagggguuaggagugcugaugccccauguaguugaaaauuuaggaugcagcgcgguggcuuacaccuguaaucucagcacuuugggaggccgaggcagguggauuaccugaggucaggaguuccagacuagucuggccaacauggugaaagcccaucucuacaaaaauuagccaggugugguggcucaugccuguaaucucagcacuuugggaggccaaggcaggcagaucacuugaggucaggaguuugagaccagccuggccaacaugguaaaacccugucucuacaaaaauuagcugggugugguggcgggugccuguaaucccagcuacuugagaagcugaggcaugagcauugcuugaaccugguaggcggacacugcagugagccgagaucgcgccauugcacuccagcuugggugacagaguaagacucugucuaaaaaaaaaaaaacacaauaaaggaaagaaaauucaggucuaacuuucaacucccuaaaaguuuaacuacuaacagcuuacuguugacuggaagccuuaccgagaacauaagcaguugauaacacuaauucuguuguuguugguuguuuuuugauagagauggggagcuugcuguguugccgaggcuggucucaaacuccuggccucaagcuauucaccugccucggccuccuaaagugcugggauuauaggcgugagccacugcacuuggccuaacucauaccuuguauauauauuauauacuguauuuuuacagugaagcaagguagagaaaagaaaauguuaagauuaauucauaagagagauuuuuacuauuuauuaaguggaaguggaucaucauaaaggucuucaucuucauugucuucacguugaggaggcuaaggaggaggaggaaggggagggguuggucuugcuaucucagggauggcagaggcagaagcauaaucugaguauaaguggacccgugcaguuuaaauguguguuguucaagggucagcuguuuguugaauaaaugaaugacaugaaguauuacaguggcuuuugggcggugucgaaacuucuuuguaaggauuuuaaggaugaaauaaucacuuaacugucuggaaugaacacucagauaaacugaguccuccagcuuucucaucagauggcuuguuuuuuuauuuuauuuuuuugagacagggucuugcucugucacccaggcuggagugcaguggcgcgaccucagcucacugcagccucaaccuccugagcucaagcaauucucccacuucagcuccccagguagcugggacuacaggcacacaccaccaugcccagcuaauuuuuuuuuuuuuuuuuuuuguagagauaggguuuugccauguugcucagguugguggugaacuccugaacucaggcgaucugccugccuuggccucccaaagugcugggauuauaggugugagccaccgugcuuggcagaacagcuucuauuucaucuuggaaaggucagaacaggguuuuguccaccccucuuuucccaggacucagugucucacacacagugggggcucaaucaacauuagaauuugaguguuugagguaugaguuccaagcuagggguuagauauagcucaccacugugcugguuuggcuugauuuuaauuauaggaaugacugugauuuccaauuuuauuuauuuauuuauuugagacggagucuugcucuguugccaggcuggagugcaguggcacgaucuuggcucacugcaaccucugccuccuggguucaagcaauucugccucagccuccccaguagcugggacuacaggggcacgccaccacauccagcuaauuuuuguguuuuugauagaaacgggguuuccaguauguuggccagcauggccucgaucucuugaccucgugauccgcccgccucggccuccuaaagugcugggauuacaggcaugagccacuguggcccgcccuacaauguuuauucauuggcagauuucacagaaacaucuggauuucuggcuucccuugaaaaaucagaaguucugcuagccccaggcccacauuuauacaugguagcgguccgcugaggcuguccguuucugaguugcuccaguuugccgcaguccccaccccucccuguuguugcuuuaauuuuaaggccaaauguuuguugccuuuguuuuauuuuauauuauuuuuuugagacgaagucucgcucugucacccaggcuggagugcaguaguggaaucucggcucacugcaaccucugccucccggguuccagugauucugcugccucagcuucccgaguagcugggauuacaggcccgcaccaccacacucggcuuauuuuuguauuuuuaguagagaugggguuucuccauauuggccaggcuggucuugaauuccugaacucaaguggaucacuugaguuccucagccucccaaagugcugggauuacaggcaugagccaccgugccuggccuguugccuuuuuaaaauugugcuuccucacaccuggucugcuucuugcauggauggaacccacuuuggcaccuguugguaucugaguuggcaucuccugcuuugcaggccaaccuugaaguuagcaucugauugguauguuggcuucagauuuucauggcgaaguaaggccuagcuuugaugaucagcucuuaguguggucaguacaacucuagcucgugaaaacuugcccaaacauuuugccaaaauuaauuaauggccagacauccugaggcaagcuuccccccgcuuagcaagaaaacugggauagggcagcaucccuguggguggaguggugcuggggaccugcacuuaccucuuagaggcugaaugguugaacggggccuuugaggaagcuguauuuugcggguggggacauggagcacaguugcucagugucggccccguugacauguaggccacaucauucuuuguggccugguugcuguucugugcagcguagucuuagccccaaaccuggccucuacccccuaguagaugcugguagcaccuccucuuguugugacaaccgaaaaugccucuagauguuuccauauguucccuggggugugaaaucacacagccacugguguggaggaauaugggggagaaacauggagcaagaccuuccuccucauccugcauuucccuaggagguugugggcugucgaaauucuaguguaauuggcuuacugggguugccuuggagaagcuuaaugagacguuaaggagguuaaacuccaauuagcuagagaagaaacuugcggcaguuucuuuuuuacugagggcugugucuuuuuaccuuuuuccauuuucccaguuggaguugugacaguucauucuccccugggaaaacaaaaauggcuuucuuuuucuuuuucuuucuuuuuucuuuugagacagggucucccucugucacccaggcuggagugcaguggcacaaucauagcucacugcagccucgaccuccugggcugaagcuaucuucccaccuuagccucccagguagcugggaccagaggugcacaccaccauacccggcuaauuuuuguauuuuuuguagagucagggucucaccauguugcccaggcuugucucaaacuccugggcucaagcgauccuccugccucggccucccaaagugcugggauuacaggcgugagccaccaugcccagccgaaaauggcuuucuugagagaucagcuuugaagcucuacuccuucauuuuaaagugccccaggagaaguggacgauuacaaaguugagauuccacuuaaguguccccuuaguuuaacugugggauucaucuccuggggagguugccagguucuggaaaguggguguuaaugaccagggagggugccccuaggcuagcauccuguaacccucaggaauugagauuuuuauggagguuuucucuuccucucugugaguuuucucucugagaaaccugucuagggagggaggcucuaggcuagcauccuguaacccucaaguaguaauugagauuuuuauggagcuuuuaucuuccucucugugaguuuucucucugaggaaccucaguguaccuuuuacuggccuccuagguaauacuuguuuggagaauaugugugaugucuaagucuucccaguacaagaaauuugugugguguuugacugauugauggauggagucuuguucugucgcccuagcugauuguaccacugcacugcagucucgaccucccaggccaagugacccucccaacucacccucccaaguagcugggacuacaggcaugcaccagcacacccggcuaauuuuuguauuuuuuuuuguagagaugggguuucacuauguugcccaguuuggucuugaacucuugagcucaagcagucucccagagugcugggauuacaggugugagccaccacgcccagccucguguggucuuugauaccccuggguucauuguauuguucuucccacacugcuuuucauucauucauuuauucagucauuauuaauugagcagcuacuaugugcugcugcugcucuaggcacugaggauacaacagugaacaggacagaccaggcccauguucucaugggguuuacacugagggugacggaaaugauuucagaugcuggcaagugcugcaaagacuugaaccgggaaaaacugggugaggugcaaacuacuacggagggauguccacagaaggccuuucggaggcggugagguuugaccccagagcucaguggcaaagcuggccaugcaaggaugugggggaagggagucccagagugggaagagaaugugcauaggccuugaggaagaucauggugugguuaaaguauugaggaguuuaacucaaaggaacugcagagcccaucucauaaaaaucuagccuggagcauucggcaaaaugcauaaagcacuaacacaauggcuugugguccuggaauuuccagggaaggcgcuuaccagcucagcaaggaaguagaacaaugcauggucccuggcagaagcaagaaccuucugaucuguuuauguuugaaugaaacgcagguuuuuuuuuuuuuuuuuuuuuuuuaaaauagaugggggucuugcuaugcugcucaggcuggucucgaacuccugggcucaagcaauccacccaccuuggcccuuccaugugcugggauuacaggcaugaggcacuacgcccugcugaaucucaggucuuaaaaauucaguuuauuuuguuuuaugagucucuucucuuucucagaaccuuaacugaaacguuugugaucaagaccaacuuggguuuccccacuccccaguugccuuugauucuccgccaaaggcuuguucguaagaugaugagguacuuuuuuccugugguuaagaggacuuucuauagguugcuagaaaacucuuguuuuaaaacaagauguuguugaauugaucuggcugauugcaggaggaagaucuuguacugcaacuuuguugaugaugcuaauacuuuaaggugaauauucuagaagaauauaaagggaaaaauaaaaguuuuaguauguucccacccugcccuuuguucccagaaguagccguuauugaugaugguuguugaugauaguuucuuggguguuuuucgagaaaaguuucaaguauaugcaaauguaugugcaagaacguguucguuuguguguauauguuuacauauucauuuuuucccucccuaguuggguauuuuaaauacuguuuugucucuuguucucuucacuuaaccaguguugauuuucuugccauuuuaagcccaugcaaauugaaaguaaaagccaaucaaaucaacuuuuuuuuuuuuuuuuuuuuaaacaagccacgcauuugccuguuaaauggcugagccauguauucacccauuccccucuuggugucuaucaaggucauucccaguuccugguuucuugcugugauaagcagugcugcacugaaggcacauguaugcaaauauauguaaaugauucagcagaauaaauuuucccacaggaaauugcuagguugacaguaugugcauuuugaaauuugauaguuaauugucagguuacugcagcaguuuauacucccacuaaugggcccaccagcacuuauuaagcaccuguuguuuuccugccauaucagaaaaauugagcaagcugggaagugaucaggcccauguugcuuggcugugugugagagggcuuugcccaguuaaguuaaaccuuacuuuccagaggucaggagaucaaagcagaagugugcuuugguuuuguucaguuuuuuaaaagauguguuuaaauuuuaaacaucuuuggacuuauuuuaaaaauugcuuuuaaaucaauaauuuaacaauguguaaaaacauuacugauagucucaccaugcuaaugucacucugauuuuuacaccuaaacuaauuuaauugcagaguuuucugaucacaagugacauguguuccauaugacagaacaaacaauacaaagauauuuaaauaaagccugaacaugguacugauauuaguuuguucaugcugcuaugaaaaaauaccugagacugcguaguuuauaaaggaaagagguuuaauugacucacaguucugcauggcuggggaggccucaggaaacuuaaaaugaugguggaaaggaaagcaaacauguccuucuucacaugguggcaggagacagaagugcagaguaaagaggagaaaagccgguauaaaaccaucagaucuucugaggacucacuaucaggagaacagcaugggggaaccgcucccaugaucuaaucaccuccagugaggucccuccaccaacacguggggauuacaauuaagauuacaauucaagaugagauuugugcggggacacagagccgugccauaucauucugccccuggccccucccaaaucucaucuuucucauauuucaaaacacaauuaugccuucccaacaguuccccaaagucuuaacucauuucagcauuaacucaaaagucuauguccaaaaucucaucugagacaaaaucuagucucuuucaccuaucagccuguaaaaucaaaagaaguuaguuaguuccuagauacaauggggguacaggcauuggauaaauacacccguuugaaaugggagaaauuggccaaaacaaaggggcugcaggccccaugcaagucugaaauccaauaggccagucauaaaacuuucaaguuccauaguuaucuccuuugacuccgugucucacauccaggucacacuguugcaagaggugggcuuccacggccuugggcagcucugccccuguggcuuugcaggguauagccccgcuccuggcugcuuucacagguuggcguugagugucuccgucuuuuccaggcacacgauguagcugcagguggaucuaccauucuggguucuggaugguggcccuuuucucacagcuccauuaggcaguaccccaguggggacucugugugggggcucugaccccauauuucccuucuuuacugcauugguagagguucuccauaaaggcuccaccccugcagcaaacuucuggcuggacauccaggcauuugcauacauccucugaaaucuagguggagguuuccaaaccucaguucuuuaguucuauguacccacaggcucaauaccacauggaagcugccgaggcuuggggcuugcacccucugaaggcacagccugagcuguguaccuuggcuccucuuagccaugacuggaguggcugggcaccaaguccuaaggcugcacacaucaggggggcccuggacccagcccaggaaaccguuuuucccuccuaggccugugaugggaggggcugcugugaagguuugugauaugcccuggagacauuuuccccauugucuuggaauugggcuccuuguuacuuuugcaaguuucugcagccggcuugaauuucucuucagaaaauggguuuuucuuuuuacauugucagacugcaaauuuccacacuuuuuuuuuuuuugagauggagucucucucuguugcccaggcuagagugcaauggcaugaucucggcucauugcaaccucugccuccuggguucaagcaauucuccugccucagcaucccgaguagcugggauuacaggcacccgccaucaugccuggcuaauguuuguauuuuuguagagacaggauuucaccaugcuggcuagacuggucucgaauuccugaccucaagugaucugcccaccuuggccucccaaagugcugggauuacaggcgugagccacugcgcccggccaauuuccacccuuuuaugcucugcuuccucuugaaugcuuugcugcuuaguaauuucuuccccuagaugcccuaaaucuucucucucaaguucaaaguuccacagaucucuagggcagggucaaaaugcugccagucucuuugcuaaagcauagcaaggaucaggagaacagcaugggggaaccguccccaugaucuaaucaccucccaugaugucccuucccuaauauguggggauuccaauucagauuacaauucaagaugggauuuagguggggacacagagccagaccauaucaguaaucucuugggcuaaccaauaaccaauguauucuuguauuuuuucuuugaaauuuuauaaauauuuauaaauuuaaauaacauuuaaaucaaaauggauuauguuguaaucauuacucugccaguuuuuuuuuuuuaauuuuuaaauuuauuuuuuguagagacaggaucucccuauguuacccaggcugguuuugaaccccuggacugaaucgauccuccggcuuuggccucccaaagugcugggaucaaaguuuguuaauuugauagcuaaaauauauuuucaucugcauuucaauuacaauuagaagcuauguauccugcaacauauuuuccagcaauuuguguauuuucagugugucuuucugaguccuuuuuggguaugccuggacuaguuugucuuuuuccuguuaguuuguaagggcucuuguuauugugggaccuuuccucuuuguccaucaccuguauuguauaaauauuuuguuacaggcuauuguuuuccuauuggcauauuaacauuugagucuuguucuuacuaguauguaguuuugcaagguugcauuuguagcuugcauacugucuccuauguuuuuauuuacuguaauaaguauuuucccauguacccacguaaccuuuuuaauuaaaccuauaaauguccaaucgauaguucccuguguuggugggcuauaaucacauaauuauuaucugugguuugacauuuggguugcuguguuuucuuucuccuuuuuuuuuuuuauuauuauuuuugagacggagucuuguucugucgcccaggcugaagugcaguggugcgaccuuggcucacugcaagcuccgccucccagguucacgccauucuccugccucagccucccaaguagcugggacuacaggcaccugccaccacgccuggcuaauuuuuuuguguuuuuaguagagacggaguuucaccguguuagccaggauggucuugaucuccugaccuugugaucugcccacuucggccucccaaagugcugggauuacaggcaugagccacugugcccagccccuuucucccuuuuuaacuuuuuugagacagcaucuuauaccaucacccaggcuggagugcauugcgcaaucuuggcucccugugaccucugccuccuggguucaggugauucuccugccucagccgcuggaguagcugggauuacacauguguaccaugaugccugauuaauuuuuguauuuucaguagagaugggguuucaccauguuggccaggcuggucucgaacuccugaccucaggugaucugccucccaacgugcugggauuacaggcgagagccaccauacccagucauuuuuauuuuucuuuuaaagaaaacacuguccugaauaccacauggguagagugcguauuggcuuauuuccuuagaugauguucucaggaguggaaugaauaacaucugaaaaggcuucacucuagccauugucuuauuuucuaaaagugagcuggcccagcucaccguucuagcagggucuaagguuacuuacugcugugguuauuauucagaguggacgauggugcauguuaaugucaggcacagcagggcgcgguggcucacgacuguaauccuagcacuuugggaggccgaggugggcggaucacgaggucaggaguuggagaccagcaugaccaacauggugaaaccccaucucuacuaaaaauacaaaaauuagcuggcgugguggcaggcaccuguaaucucaguuacucgggaggcugaggcgggagaauugcuugaacccaggaggcggagguugcagugaacugagauugugccacugcacuccagccugggugacagagagacuuuaucuuaaaaaaaaaaaaaaaagucaggcuuuucuaggguuccuccaucagccuuguaaggcuggagacccguggccaggaagaaaauuggagcugucuggcacugggaaggguaacccaguaguuauaauuagguuggcuuaucugcgagcccuuugauaaggcuucacuaauuuacuaacccaggaucgcauguuagaucaggaucucucugagugcugcaauuguaguuugcuuuucucucucucuuuuuuuuuuuuuuuuagagacagagacucacucuguugcccaggcuggagugcagugguaugaucauggcucacugcagccuugaacuccuggccucaagcgaucuuccugccuuacccucccgagugucuuggauuauagaugcuugucaacaugcccagcuaauuuuuaauuuuuuuuagagaugaggucuugcccugucacccaggcuggagugcaguggcaugaacauagcucacugcagccuuaaacuucuggccucaagcaguucuccugccucagccuuccaaagugcugggauuacaggugggcaccacugugccuggccugcagugguuuaauagggcucuuucaucuuuaacuuugguccccugcccccugagauccguggagugagccguuugacgcuugguacuugggacaaagcuggccuauguccaguucucugcauacuugguaggggaguguuuggagaaaaggcucaccucugagucacacccucuauauucuccaaagggccauggggaugggguggaggaggcuggggugaagagauguuguagcuccagagaaagccagggagguguaugcugggugaagaggccaaguucaggagccuagguuugaaaaucaguauagacgauucagguuaauucacccuguuguuauagagcaucugucuguaggguggccaggucugggugagucucuuggacaagauggguaucagguuucagcucugaaauuggacugauauguggggagauucauucugcaguuuuauuuguaguuuagguuuaagaaaacuuggacugggcacuguugcugucgucugaucccagcacuuagugaugcugaagugggaggaucacuugagcccaggaguuugagaccagccugggcaacagaaagaccccaucucuacaaaauaauaauaauaauaauuauuauuauuauuauuagcugggcaugaugggacaugccuguagucccagcuacucaggaggcugaggcgggagguuugcuugguccugggagguugagcugcagugagcuaugauugcaccacugcacuccagccuggacaacagcauggcacugucuccaaaaaaaaaaaaaacaacaaaaaaaaaacuuguuuaacuaccuaaaucauagcauuugugugaagccagacuaucacaacucugagaacugcugacauauacauauuuuggaaguuccagguuuucuguuacuauaaacaugguagagauugaauuacuuaaagggacgucuuuucuccuacucuuugucuugucugauguuauaagggguacaguauagaaugaaaacagugcagaaaugagugaaacaugaaaaucccuucuagagauaauuuucuuuuauuauuuuuuugagacggagucuugcuccauugcccagucuggaguacagugaucucggcucacggcaaccuccaccucccaaguucaagugauucuccugccucagccucccgaguagcugggguuauagguguguaccaugcaccaccaugcccggcuaauuuuuguauuuuuaguagagacaggguuugcuguguuagccaggcuggucucgaauuccugaccucaggugauccgccuaccucggccucccaaaguccugggauuaccggggugagccaccauggccagccucuucuagagacaaucuuauuggcagguugauguuuuuaauuuucagccucucuucuccacagauccuaaagauauaguaauuuuuuuuuuugagacagagucuugcucuauuacccaggcuggagugcagguggcgugaucucugcucacugcagccuucaccugccgaguagcuaggacugcaggcaugcaccacuaugucuagcuaauuuuuguauuuuuaguagagaugggguuuuaccauuuuggccaggcuggucucaaacucaugaccucaagugauccaccugccgcagccucccaaagugcugggauuacaggucuaagccaccgugcccagccauaaauacaugguauuuuuuaagaacaagaacgggauucuacaaaaacauauauauguguauuuugagacaggaucuccucuguugcucaggguggagugcaggggcacgaucauggcccacugcagccaugaccucucaggcucaagcaauccucccaccuuagccucuggaguagcugggaccacaggugcccaccaccaugcccagcuaauauuuuuucuuuuuuuuuuuuguauugaaaacagucagccaggugugguggcucacaccuguaaucucaguacguugagaggccgaggugggcagaucacuugaggucaguaguucaaggccaggcuguccaacauggugaaacuccaucucuacuaaaaauacaaaaauuaacugugguggcgcuugccuauaaucccagcuacugggaagggggaggcauaaggaucacuugaaccugggaggaggagguuguagagagccaagaugauggcacugcacuccagccugggcaacagagcaagacucugucucagaaaaacaaaacaaaacauauagucuuuauuuuuuuguuugcgugggcuggugcaucuugauuaugaugcauuuuuguuaauugauauuuaauugcagaugaaauguaacauggaucugaguaauugcugauaauuguuuccucuuuaggcagcuggucagucuuuuuuuuuuuuuuuuuucuuuuuaagagaguuucugucuuguugcccagacuggagugcaguagcgugaucucggcucacugcaaccuccuuugccaggguucgagugauucuccugccucagccccccgaguagcugggauuacaggcaugugccaccacgcccggcuacuuuuuguauuuuuaguagagacggguuuugccauguuggccaggcuggucucaaacuccugaccucaggugauccccccugccucugccucccaaagugcugagauuacaggcuugagccacugcucccagcccauagucuuuuuuuuuuuuaaaccucuguguacagguagguccuggggaaauucgaggcaagacuugggugaguggguaucuuagacccucucaggagcucuuugcaggagguagaaucuccgagggucagugcccaugaaugggucccauggccugacuggucccauucaggugacagucucugaggguccugcauagcccuuaccugggcuccaugcugggaaucgagcgguauacagagcaugguucccugccuuccuugagccccagucuuguuggggaaauggccaaauaaaugaauaaucaucaggaagugcuaugaaggggagcugcguggugcccggugagugcaauagcgggguuucaucugguuggagagaaaaaaggagacuccuuaaguggggaacccguuugaugauacagguuuggcuaugugugucaaagaccccaaauauaguggguuaagauacaagcucauuucucucucauguaaaaaucccagcugguguggcagcucuguccccaaaauaaucagggucccaggccccucccaucuuguugcucugcuguccucaucugcauggaucaagaugaugcaucuccauguccacauggcagccaguaggaaagcagaguaagggcacaaccuggagguugccuacgucucuccucgucacaucccauuggcuuguaccuagucauguggugccucuagcugcaaaggaggcugggaaauguaguuuccuuucuaagcaggauguacccagcugaagauguuacucagggaugagggagaguugauacuggagcgcagcuagcaguuucugcuguauaggcaaaagcagaagguaagaauguucugggcagugggaaaugcaugugcagaagcacuggcuuaaugaggaaggccacuguggcuggagucaaagaguagggaagagaaaaagaaccagaaggaggcugagaauugggccuguaggacuuggauccugugggaagccuuggcagcuuucuuuccccccuccuugcuuaggcauuagcucuaagacagggauauuuacaacacaauuauuucuuuaaaauuauauauauauuuuaauuuguacagaugaggucucccuguguuguccagguugguuucaaaccccugagcucaagccaucuucuugccucggccuccgaaaguguugggauuacaggugugagccauuauaccuggccuucaacucagucccuaaagacaacuccuucucaaguguuggaaagaaccaaugacuaaucacuucuagucugccuuauccccaucuugcuugugugacuuugguaagaguuuguuuguuuauuuaaaggagcagagaguuuaauaggcaagaaggggcaagaaagaagggagaauaagauccccuguauagagacggaggagggcuccaaagcugagagagggaaccccagcugccacagauagcagcuagguauauguacagaggcuggaagaggcagugucugauuugcauaggccucaggggauugguuugacuaggcaugucuuucacguagcgcaugaaaaagcuggcccucccaccuagccuuuuaauaugcaaaugcaggguaccaugaucugcacacuuggggaggugugguggcggccauguugcuaggaacauguggggaaagggcaagaaggcugugggaaucgccauguuuggguggacccaguuucuaauggcuugcauuugcauaucaaagguugcuggccuggcucuaagagccggggcuuuacaagaaacuuuuccggaguugcuuuaaaaaccaaacauuucccaaggaccccuuuuccucucuauuugccuaaaauaauugcuuaacuccuacauuacccccuguggagaugccacauuaacugcuguuaggggguuuugggcgacgacuucuucuggcuacuuccuggugaaaaggggcguugaauggggaacagcagcuagggcuccuccugggguggaucuaaggguccucggaagaauggcguguccaugugugcuucagguuacagcaccauuuugaguuugauugcuucagucugaugaaauaauuuccuuuccuggccaacacaccaaaaugauacggcuccgaugagugggggaacaccaggguucuugguccucaugccgguuuagauaaaaugacacagacacacguggagugguuuuaaggaguggagaguuuaauaggcaagaaggaagggagaaggaagaagguccccuguacagagacagaggguggggggcuccaaagcugagagacggaaccuccaggaguugauuuuauaaauaaaauaacaugcguugaggucacucuguguugugugguaugcccagcccucucugcacauaacuuguuucaggcccacagucaugcugggugguugcuguaaugacuuuuuauuuuaaauggggaaucugugacacaguuaaacaugcgcaggaucaugucacuagcaaggaguggacacgguauucaaacccagcagguugacucaaagccugcccuuuccccagcuguuuugccccucagucauuugagucuagucuucaggauuuugacaucuaucucuuaccuuguaucuguuaggauugcaucuggcuucaagaaacagcccuacuucagcagccuaagcagaaagguauucauuuguuuauuuuuuacaugucaggaauuccaguaccucuuggaguugcuggcauuggauuagugaugcaggguuguuaggacugacaucucugcuguuuucuugucuuuuccucaaggccccuaaauggcugcuacagcccuaggcaauauaucuggguucaagguaggaagagggagggauugcaccagccucauggguuccuuucuauucaggaaaguccaagccuucuucaaaggcucuucuguccacauugcagacuucuggucaugucuccuuggcugaaacuggauuacaugaccaccucuagcugcaagggaggcaggaaaaaugagcauuugguuuuaugcuucucuaggaggaaacagcaagggagaaacuuuugaguaagccagccaauauuguccaacauguacuuauuuuuuaacuuuuuuuuuuuuuuuuuuuuuuuuugaggcaaggucuggcuggcucuguugccgaggcuagagugugguggcacaaucucagcucgcugcaaccucuaccuccuaggcugaagcuauccucccaccuuagccuccagaguagcugggacuaccacaugcaccaccauaccuggcuaauuuuuauauuuguagagauggggucucaccauguugcccaggcugcucuugaacuugugaguucaagucgucugcccaccucagccucccaaagugcugggaugacaggcaugagccaucacacucagcuaauguuuuucuuucaaucaauucacuuuuuaagccuuaacaaaguuaucgcaaaaggaaguuucauaucacuuuagaaugucuuugaagucacagguugguuauauuuaugugcuuacuuuaauagcuauuaaaguaaauauagcacuacuaagaaaaaaagauauucuuuaaaucgccuauuaucagugguucuuaacucuggaugauuuugucuccaggggacauuuggcaaugucuggaaacauuuuuggcugucacgauggggcagggagcgcacgccuagagucuaguggguagaggccagggggugugcuaaauauccuacaauacaggaugggcuccauaaugaaaaauccucuggucccaaaugucaguaguacugcaguugagaaacccuggcauggacgcaauccaccugcugccaggaguuauauacaagccauguuaggguaaugcugcaauauguccaucgugauuguguuuucuccugggugacuaucagcaaugguguagccugcuuguugguuuucaagguccauucucaagauacuaucagaucuccagcaaucgugugaugcaguuuaaaauguucaugugagcugggcguggugacucaugccuauaaucccagcacuuugggaggccaaggcuggagaauggcuugagcccaggaguuugaaaccagccugggcaacauagcgagacccagucucuacacaaaauuaaaaaaaaaaaaaaauuagcccgguaugauggugcauggccauggucacagcuacucaggaggcagaggugggaugaucaccugggccugggagguugaggcugcggugagccacgauugcaccaccguauuccagcuugggugacagagugagacccugucucaaaaaaaagaaugugcauaugaauucaagauaugucccuuauagagacuggugaggacacagcuuauugacccugaagcugaagugguugaaaugauagcccucuugccaggcaaauccuaugugagugcuucuaaaagaacacuguaccuugcagagaguauuccugggaccuggcaggaaucagggccucuuggugaccacaugcuuuggaaagggcugugcuuuggcaagugggagauuuuauuauuuauuuucuccugucugccucgguuuggcaaaaacaaaccuggccugggcaugggccuuguggagacaagaaggcagcuugagauuaucagagaucaggcugcugguggguuugccugagcuggccuggucagguagcuugacaaugaugcucagacccccauuaaaguuaauugagcgguuacagagugggaguggggagugggggguguggugacugccugucuccuugaguuggcguggcuaagaaguaagggaauuuuuuaacuuuuccuucuuaauucuggaaacuuagaaaaaagccucucaccaucccuuaaucauucaguuagagagaccaggcuguugauauggacaugcugcguuucauggaauccuagaggccaguauuuaugacauacuucccaguuucagagauguuaggauauaaaaauguagccagcaguguuuacaggaugggcuaaucgagagacacagacaaauaucaaagauagcaaaauaggaagaaacagagucuuagaaucaaugcaguauaauaauagcuucuaguuucuuucuguuuuucuuuuuaugauacagagucucacucugucgcccaggcuggacugcgguggcaugaucucggcucacuguagccuccgucuccuggguucaagugauccucccaucucagccuccaagucacugggauuacaaguuguuugccaccaugcccagcuaauuuuuguauuuuuaauagagacaggguuucaccauguuggccagguuggucuugaaugccugaccucaagugaucccccccagccuuggcuucccaaaguacugggaugacaggugugagccaccaugcccagccucccccucacucuuaagcacagcucuucggcagucagagauguugccugcuguauuucucguucugcuuuuacacaugguuuaaaaauccucgcccaagaauguaagccccauggcuagugcuaccugcuaccuuuagggguggccucuccuggggugcaggagguugcacaguucguuuugugacagcagggucauuuuuuaaucggaucaucugccccaguuugcuuggcucuuaggugcuugggaguucuccugguuuuuugcuguugugaaauggcccagcuuguacacguuguuccuuuucuugcuggaguuauuuccuuuagacuccugucccuaaaguaggauuguugggugaaaaugggguaugcgugguuaggcuuuucucugccugcuuucuggauugcucuucagauagauuuaaucaccuuuuauuuauguuuuguggugguuuuuuuuguuuuuuuuguuuuuuuuuguuuugagacugaguuuuggucuuguugcgcaggcuggagugcaaugguggggucucggcucacagcaaccucugccuccuggguucaaacgauucuccuuccucagcuuccugaguagcugggauuacaggcaugcgccaccaucucuggcuaauuuugaauuuuuauuacagacgggguuucuccauguugguaaagcuggucuggaacucccaaccucaggugaucugcccgccucagccucccaaggugcugggauuacaggcgugagccgccacaccuggccaccuuuuauuuguugaaugaguguuuaauaagcauguccuauaugcaucaggagaauuaaauggacauggucuugcuuuggggggaaaugacagguaggagagaaagagacacuuagaacucaacagaggccagacgcgguggcuuacgccuguuaucccagcacuuugggaggcugaggugggcggaucaccugagaucaggaguucgagaccagccuggccaaaauggugaaaucccgucucuacuaaaauauaaaaucaaucaggcguggugauggcacaugccugugaucccagcuacucgggaggcugaggcaggagaauugcuugaaccugggaggcagacauugcagugagccgagauugcacuacugcacuccagccugggcagcaagagcaaaacucugucucaaaaaagaaaaaacucaacagagaaaaggcggaucguuaaggcuucuuuggcacuuccuaagugccagggacuguuguuaaugccuuugaagugcuaauaaugacuuaauggugacaaguucccugugaagcagggacugugauuguuucuaccuuauggguggggaaaggaggcagagagaggugaagucacccagcuaguaaaugacaggacuagacugaaacccaggcagucugucuccagggccuggccgguaccccaugcuccaucuugccccauaaacacccuggggugggccagagaggagucuuuuccaacaggcugugccagaugacuuuggcuaaucuuggaggcuggaggauuagucagucuacuaagggggcuucagcauuuuggcacguggcuuuaugagcuguuuacuccaacagugaugaugacaauagccauaguagugauaauacuaugguagaaguaacugcagcaaacucaaccccuaacgaguauucuaucuucccaacauugugugcaauagccaugagagauggguguuauucuuuuaauuugacacacgggaacugaaagccagagagauuggguggcuucccccaggccacacagccuggaaguaguaggacagggacucgagcccagaucugcugccccagagccugugcccuugaccaccaagucauggucacuccuuucaacccugccugccccugggccaucuguguugugaugccggcuggccaggauggggagugaggauuucaguuugucauagggcagggagaugggugaggcaggacacuccuugagauggaaggcucuggggucgggggagagggagugguggagacuggggugucuccgaaggaguguuugaagaugacggugguuuuuccaguuuccuguucuuagcuauauucaagaaaaggguaagccagaaaauuucccucugaguuucacaacuucugggagcuuuugcaaagucugggugaugcagcauuuuccugguuugaauccuaagugaaguuucauuuuccuucacuuaacucauucuggcucuggccugucuucccagcuguauuggccaucugguccucuucuggcucuuugucccauuuauuauuauuuauuuuuauuuuuaacagagauggggucucacuguguugccgucuguucuggaacuccuggacccaagugauccuccugccucggucucccaaaauacugggauuauaggcaugagccucuguggccagcuuauacccccuaagcuugugacuaucuucuaugugugucccucuuggagugagguucccuccugucuccauguuggcaaaucuuagcaccuuggcccuucgagauggaggucuguguugccuaggcugguccugaacuccuggucucaagugauccucccaucuuggccuuccagagugcugggauuacaggugugagccacuguguccagccaacccuucuuagauuuuacuuacuucaagaagccugcuuugaccucucaaguggaaauaacaacuuccaggaauagagugaucacugggcauccaucuguugucacaugaaugauuuuauccauauuaaggaggcauuacaugcagcagugagcuaaccugccuguguugaaguuuucuucuuuuuacaggcuguacaaccuugggcaaguugcuuuacuucucugugccuuagucucuuccucagcaaaauggaaaaaauacuacccauuucaaauggggugaaaaugaaauaauauauaagucucgucuucacaaugucucugaugaaaagcagguauugguugcacauggugcucaugccuguaaucccagcacuuugggaggccgagcagggaggauugcuugaggccaggagcuugagaccagccuggggaacauggccagaccacaucucuuaaaaaaaauuuagcuagguuugguggcaugcacuugugguucuaacuaguuuggagcaggugaggagggaggaucuccugagcucaggagguugaggcugcagugagcugugauugcacacgacugcuuuccagccugggcaacagagugaaaccccaucucaaacaaacaaacaaacaaacaaacaaauaaacaaaaaacagguauuguccuugcuguaugaaugaggaaagugaguuuuccuuuuugcuuugugaaacucuuuucuggauauuucuugccuuuuauguguaucucuuuggugguacucugugcuuuuaaaaucuuuuguaauggccauuuauggacaaaucguaucuuauauucaagauucuaagcuuucugagggcaggauauaaaugugguuguuucugguucaaguccugauacaagcaaagcucaguaauuuuuuuaaaugaaugggugggccggugguugggucuucagagucacuaaauacugguggcaggagugggaccacauagaaaaaaauauuaaggcaguggaucucaauggggagugaucugccucucagaggacguucauugaugucuagagacauuuuuguugucacaguuugggaugggggugcaguuggugucuguuggguuaggaucaggaaugcuauaaacauccugugauacacgggacagacguauccagccuaaaacgucaguaguguugagggugagaaacccugggcuuauuaaggcaacaagcaacauauuaauagcaacaggagaaaacaugcauuuaaauuuuuuuuggccaggcgugguggcucacacccguagucccagcacuucggggggcccaggugggcggaucaugaggucaagacaucgagaccauccuggugaacauggugaaaccccaucucuacuaaaaauacaaaaauuaguugggugugguggugugugccuguagucccagcuacuugggaggcugaggcaggaaaaucacuuuaaccugggaggcggagguugcagugagcugagauugcacuacugcacuccagccuggagacagagcaagacucugucucaaacaaacaaacaaacaaacaaaaaaaaaacaaaauuuuuuuuccacaaaugugaaguagucuagaugagauacgcucuuccugagaugauaaagugaggucuaaguguauuuauuaauucuuuugaggaggguguuaggugcuaaaggcagcacguguaaggugaaaauugcguauagccaaaaugacccuggggcuuauucucucucucucucucuuuuuuaauaaacagcuuuuuuguugagauauaauucacauaccauaugaugcaccuauaaagugugcaacucaguuuaguacauucagaauugugcaugucuccugucuccagguaggcaaaucuuagcaccucggcccuucuuagauuuuauuuuuuagagaugggggucucacuauguugcccaggcuggucuugaacuucuuggccuuccucccaucuuggccuuccagagugacuauauucaauauucaaagugacuguagucaacauuagauauuuuuaucacccugcuuacuuguuuuuauuuaagaccugguguggugugugccuggccuugugaucacaaaugcuaguuacacugaauugacauuuugcugagacucguucugagguccauucauagaugcccuagguacuuccugauuacuugccacaccccaggaauucugcacagugaguggggagugacauuuugagggacagcaucaguacauucacugcgcuaaagaaacagucuggggagagugagacaucgaaaaaauaacauauaaaauaaacaucugauggagacauaggaagaugccaaccuucaacaauguuugacuuggagcagggguuggcaugcuuuuucugugaaggguuagguaguacauauuuuaggucucucaggcccaggggcaaauagucuuucuuauaauauguauuuaaaaauuggccaggcaugguggcuucugccuguaaucucagcacuuugagaggccaaggugggaagauugcuugagcccaggaguucgagaccagccucagcaacaaagugagacucuguuuguauuagucuguucucacgcugcuauaaagaacugcccaacacuagguaguuuauaagggaaagagguuuaauugacucacaauuccacagggcuggggagaccucaggaaacuuauacucacagcagaaagggaagcaaacauguccuccuucacaugguggcaggaaggagaagugcugagcaaaaggggaaaagccguuuaucaaaccaucagaucuugugagaacucacuauaaugagaacagcauggagguaacugcccccaugauugaauugucucucacuggguuccucccacaacacauggggauuaugagaacuacaauucaagauaagauuuggguggggauacagcugaaccauauaauuccauggccaaaugauaucguucugccccucccaaaucucauguccucacauuucaaaacacaaucaugccuuuccaagugucacccagagucuuagcucauuccagcauuaacccaaaaguccaauuccaaagucucaucugagacaaggcaagucccuucugccuauuagccuguaaaacugaaagcaaguuaguuacuuccuagauacaauaggaguacaagcauuggguaaauacacccauuccaaaugggaaaauuuggccaaaaugaaggggcugcaggccccaugcaagucugaaauccaguggggcagucauuucuuaaagcucugaaaugaucuccuuugacuccaugucucacauccaggucaugcuuaugcgagaggugggcucuagcuauggccuugggcagcucugccccuguggcuuugcaggguacagcccccaucaaggggcuuucacggguuuguguugugagucugcggcuuuuccaggugcacggugcaagcuguccauggaucuaccauucugcagucuggaggaugguggcccucuucucacagcuccacuaggcagugucccaauggggacuguauggggccucuggccccacauuugccuucugcacugcccuagcagagguucuccaugagggcuccacugcugcagcaaacuucugccuggacacccaggcauuuccaugcauccucugaaaucuagguggagguucccaaaccuugauucuugacuuuuguccacaggcucaauaccacauggaaucuccuaaggcuuuugaggcuugcacccucugauggcacagcccgagcagcauuuuggccccuuuuagccacaguugaagcaacuggaacaaaguguaccaacucccuaggcagcacacagcaggggggcccugggcccggccuauggaaucauuuuuuccuccuagaccucuaggccugugaugggaggggcuacugcaaaggucucugacaugcccuggagacauuuuccccauugucuuggugauuaacauuugguuccguuuuacuuaugcaaauuucugcagcaggcuugaauuuuuccccagaaaauggguuuuucuuuuccgucacaucaucacccuuccaauguuucaaacuuuuaugcucugcuuccucuuaaacacuuuguugcuuagaaauuucuucugacaaucaucuaaaucaucucucucaaguucuaaguuccacagcucuuuagggcaaaggcaaaaugcugccacucuuuuugcuuaagcauagcaagagucaccuuggcuccauuucccaagaaguuccucaucuccaucugagaccaccucagccuggacuucauuguccauaucacuaucagcguuuugguccaagucauucaauaagucccuaggaaguuccaaacuuucuuacaucuugcuauacucuucugagcccuccaaacuguuccagccucugccugauacucaguuccaaaguugcuuccacauuuuuggguaucuuuacaguagcaccccacucccaguaccaauuuacuguauuaguuuguucucacgcugcuauaaagaacugcccaagacuggguaguuuauaaagggaagagauuuaguuggcccacaguucugcagggcuggggaggccucaggaagcuuguaaucaugguagaaggggaagcaaacacguccuucuucacauggcggcaggaaggagaagugcugagcaaaagugcuucuuuugcugagaaguguugagcaaaaucagaucuugugagaauucacugucacaagaacagcauggagguaaccacccccaugauucaguuaccucccacuggguuucuuccaugacaugugaggauuaugggaacugcaguucaaaaugagauuuggguggggacacagccaagccauaucacugucucuaccaaaaaaaaaaaaaaagccaggugugguggcucaugccuguaucccagcuacucaugaggcugagaugggaggauugcuuaaguccaggagguugagacugcagucagcuaugaccacaccacugcacuccagucugggcaacagagugagacgcugucaaaaaaaaaaaaaaaaaaaaaggaaauccauucuuagccugugugcuguacaaaagcaggcagcaggcugaauuuggcccacaggcugugguucgccaacuuaugaccuauacaaauggcaauucauaugguucauccuagcgauaacuguacaugguguauuagauacuauauagcauguucauaucaaaugucauauaauguauaagguaacauauacaguauaaaauagugccugagaaauauuugaugaaaaaaucugauaaguacuuagcaggcacaguacaaaguaccaugaaguuguuaaaugggggaucaggguguuugagaaagggguggggagauaggugggccucccucaagaaggaauguuucaacugugagcugaaggaugccccugcauugcaugucagggcagugauggggagaaagacuccagguagagggaacccacucugcaaaggcccugagucaugaaggggucccuggaacagugaguuggggcugaacccacaagcugcaguuguggggauugugauccauccugagagcucugagaaccuggaauaguuuucagcgcagugugaagggacuggggcuguguuuugaagauauccccugucugcgguugggaggggagucaggaaaccuauuuggaggcugggguuuucacccaggucaugcagauaagauuuauuagguguggaaugaacugagcaaaucacaugucuucuaaugguacaccacacuuuuuuuuuuuuuuuuugguuuugagacagucuugcucugucucccaggcuggagagcaauggcaugaucacggcucacuguagccuugacuucccagguucaagcaauccuccuaccucagcuuccggaguagcugggacuacaggugcccacuaccaugccuggcuaauuuugguauuuuuauuggagacgggguuucaucauguuggccaggcuccucucuaacuucugaccucaagugauucgccugccucagccucccaaaguacugggauuacagguacaagccaccgcgccuggccuuuagugauauuuuaaagacuaaauucccuuagagaugccugggucugcauuuauugcuacuguucuguuucucacugugugucuugaggucaucaaaaguaaccugggccuuuucccuuguuuucugccuccucuaggcuuaugagccauuaagcaaagccggauuggugugugggucaggcucuucauguuuucuuuagcuuaauaagcaguuucuaagggaacucauugugucauuguuuagaauagcaaaagaugagcagccucccaaguggcaaucaguaggggcugggugaauacaguggguuccaccccuuccgugguagggugggaugcuugcagaaggacauaagacgaggaagcccuuugugcacagaugugcggcagccuccaagguccaguuuuuaagugaaaacguggagauccacuugguauauuugguauguuaccucuguguaaaaaagcagacaaguaagaauuacguaguuguauuugcuguauuuguaagaaauuccagagggauaaaugagaaacuaaaagaggcaauugcauuugggcagaguaacuuuuuauuguuuaccuugauauauacuuuuuuuuuuuuugagauagagucucgcccugucaacaggcuggagugcaguggcgugaucguggcucacugcauccuccgcuucccaguuucaagcgauucuccugccucagccuucugaguagcugagauuacaggugugugcgccaccaagcucagcuaauuuuugguaucuuuaguagagauuggguuucaccacguuggcugggcuggucucgaaccccugaccucgugaucugcccaccuuggccucccaaagugcugagauuacaggcuugagccaccgcgcccggccuauauauguauuauauaaacauaugcacacgcaugcauacguacacacauauauauuuuuuaaaaauugagucauggccaggugcagugugggucacaccuguaaucccagcacuuuggcaggugaaggugggaggauugccugagcucaggaguuugagaccagccugggcaacauggagaaaccccuucucuacaaaaaucacaaaaauuggcugggcgugguggcauacaccuguggucccagcugccuggaaggcugaggugggaggauugcuugagccugguagguagaggccgcagugagccaugaucacgccacugcacuccagccugggugagagagugagacucugucuuaaagcaaaaacagagucauauauuuccuauuaaggugaaauuuaaaaaauaaauuccuauauuccaucauccccagcuucugccauucuaaagcauuuuccuaagcagcuccacuguggauguagcggguauuucagaaaggcauuagaaaugcccugggagggcagaacccggggcuucacuggaggugcuguugggcucagucugaugucaaggcagggacauggcaaggguauugagaugugaacaagcauuacucagcaaggugacauguguucaugccuugauacacuuguuuccccaccagcucuauuuuuguugccugcucuauugguuucuuuuucuuuuuuuuuucuuuugagacugaguuuugcuuuuguugcccaggcuggagugcaauggcaccaucucggcucacugcaucuuccgccuccuggguucaagugauucuccugccccagccuccugaguagcugggacuacaggugugcaccaccaugcccagcuaauuuuuauauuuuuaguagagacgggguuucuucauguuggucgggcuggucucgaacuccugaccucaggugauccuccugcuuugggcucccaaagugcugggauuacaggugugagccacugugcccagucucuauugguuucuuauugcugguauugccaucaacuuggugacugagaacaacacacaucacucuaguucucgggagucagagguccaaaauguacggcugguguucuuuccggaagcuugcagggagaauccauggccuggcccuguccagcaucaagaggccaccugucuuccucaauucgugguuucaugucccuccaccccugcuuguguugucaaaucuccuuuacuuuuuuuuuauuuuugagacggaaucucagcucacuguagucucugccucccagguucaagugauucuccugccucagcuuccugaguagcugggauuacaggugcaugucaccaugccuggcuaauuuuuguauuuuuaguagagacgggguuucaccauguuggacaggcuggucuugaacuccugaccccgggugaucuaccugccucagccucccaaaguggugggauuauaggcaugagccaccacgcccugccucaaaucuccuuuucugacucagauauucccaccguccucuugucccuuauaauucccugugauuacauugggcccaccuggaucaucuaggacagggguccccaacuccugggccaugaaccaguagcgagcagucuguggccuguuaggaacugagucaugcaacaggagcugaguggcgggcaagccagcauuaccaccugaauuccaccuccugucagaucaguggcugcauuggauucucacaggagcgugaacccuaacgugaaccgugcaugcgagggaccuaggcugugugcuccuuaugagaaucuaaugccugaugaucugagggggaacaguuucauccugaaagccaccccccgccaucccuggcaaaacugucuuccaugaaauccaucccuggugccaaaaagcguggggaccucugaucugggacauucuccccauuccaaaguccuuaaugauaccugcagagucccuuuugccaugaaagguaagagacucagguucuggggacggggauguaggcaucuuuacgggcuauucuguguacugcaccuguucagcuuaguuccaggcacauaguaggggcucaguacaucuuuguugaaugacacaaucaaucauuugguuaggcuagagaauguggaaggaggccgggugcaguggcucacgccuguaauccuaaggcugaggcagguggaucacuugagcucaggaguuugagaccagccuggacaauguggcgaaaccccaucucuccuaaaaauagaaaaauuaccugggugugauagugugugucuguagucccagcuacucaggaggcugaggcgggaggaucacuugagcccagaagguggagguuucagugagcugagaucauggcacugcaguccagucugggcaacaaaacgagacccugugucagaaaaagagagaauguggagggauauuauagcaagaaguggaucuggaaguuuuacuaguagugguauuuauugagcaccuacugugugcucuggcucauguuuaacaaagugcuuauuugcauaauguuaguauucccauuuuacagaugcggaaacugagguuuaguugcuggccuaguauuacagggugaggagcugaagccccaucugccugacgagggguguguuggggauguggacuagaagcuuggucagggagggauucuguucaaacagggcugcuuagcuuuggcacuguugacauuuggggccagauauuucccgucgugggggcuguccuauguauuguggccauuaagcaguaucccuggccucuguccacagagugccaauagcacuacccucuuccuaaguugugaaaacccaggauguuuccaaauguugucacauguccccugagugacaaacuugcccccacuugagaaccaugguguugaaacauagaucacggcacaucaacuccaugcuccucaggucacccugcgugaaagucagaaucccugcgguggccugugcgucccgcacugacugucuccucccugccuucuuccuuccucgcugucuucacugcuuguuauucuucagaccuguuggccucucugcgguuucucagaaaugccaggccuggucugacuucaggaccuuugcacuggcuguuuucucugcuuggugugcccuuccuccagauggccauuugguuuacuccucuguuuccuuccauccuguauuuguuuauuuauuuuuaauugagauggagucucgcucugucacccaggcuggagugcaguggugugaucgcagaucacugcaaccuccaccacccagguucaagggauucucgugccucagccuccugaguagcugggauuacaggcaugcacuaccacgcuauguuggccaggcuggucuugaacuccuggccucaagugacccacuugucuuggccucccaaagugcugggauuauaggugugagccacugugccuggcucaauccuguauuuaaauacccguccucagcaaggcuugcccucuucucugagugcuuuucaucacacaugucuucauauccucuccuuucuaaaccaucugucucuucucuuuaggcugucagcuccaggagggccggcccuuggucccuauuguucacugcugggcccucagcccuaggaaccgugcucuguaaauggaugaaugcugucuguccuguuacugcaguguccccagacauaucccuaugcccagcacaugccugaccccucacaagacccuggaacaugacuaagggauuuauuuggugaaacaugagagucugauaagaggagaggaaguggcuggggagcaaccuugcaaagauagccaggguuggauggagaaaacgagggugagugucagcuucauaggacgggccuuccacgagaggccucauggugcuugggagaguuggggugaaagcagguuggaacaagaugcuugcugcugacauuugggcacugaugggcagccugaccucugcuuucuuuuuagugcuuaacaacacugaagcccuguuaagacaggauucuuaggacugggcacaguggcucauccagcacuuugggagcccugggugggaggaucauuugagccccaggaguuugaggccagacagggcaacauagcaaggccccaucucuggaaagaaauacaaaaauuaaccaggcuugguggugugcaccucuagucccagcuacuugagaggcugaggugggaggaucacuugagccugggaguucaaagcuguaaugagcuauaaucaugacauuacacuccagccgaggagacagagcaagacucugucucaaaaaaaaaaaaaaaaaaaaaaaauuaguuuugcauguaacuguguucaguucugugucuuggacgugaggauuugugguacccgccuggauagagcaaggauggccgugccccugccuuccugggugauggggauaagucuggaaauugccccugugauguuacugggcuuuauucuuagcucugcugaguuagggggcaggguggggugcagcccagccaacagcaugccagggcgcgucacugcccacgcgaugcuggcuucagccgccuuccucucaccucauggcccugccagccgugcuugccuccugcugugucggggcugggagacuuuagccuuucuccagauguuuucaggagugcgguggggaaaugaaggccacaugcugucucucuaaacaggauuaauguucagaagcccagcgggugcccugaccuaaccacgggccucuugcacuccuuuucucagcuucccuuggcuucugagcuaccccucugcagcguuguuucugaguguggcauuuaggagcacccugucgucuugccuuucgucccuccaagccccgucuguuccuugguugguugugcagaagaguugcuaggguuugaauccaggacgguccugccccugugacucgcgggccaucuucucaccuguuugucucuguguuccucucuguaaaagugggaaucauuacaguaccuuccucauagacugcuagggugauaaaauggagcgauguacaugaaaccugaacgcagugccugguaugcaguccgugcuuagacagggcucugguuuuauuuuuauuucuuuuucuuugagacuuggucucacucugucacccaggcuggaguucauuagcauaaucacgucucacugcagcuucccacuccugggcucaagcgaucuuaccaccucagccucccaaguaggugggauuacaggugugagccacugugccuggcaccauucagcaauuuuuuuuuguuuuguuuuugagacagagccuggcucugucacccaggcuggaguacaguggugcgaucucagcucacugcagucucugucuuucagguucaagugauucuccugccucagccucccaagcagcugggauuacaggcgucugccaccacacccagcuaauuuuuaguagagacaggguuucaccauaguggccaggcuggucuugaacuccugacuucaagugauccacccuccucggccucccaaagugcugggauuacaggcaugagccaucacacccggccaucagcaaauuuuuaaguauacaauauaguauugugagcuauagacacuauucuguacaguagaccguaggacugacugacucaucuuguaugaccaaaacuuuauacgcuuugaccaacaccucccuguuucccccaccaccagcuccuugcaacuaccauucuguucucugcuucuaugaguuugucuuuuuuagaugucacaugugagugagaucuugcaguguucgucuuccugugccuggcuuauuucauuuagcauaauguucuccaggcgcauccauguuguugcaaauggcaggauuucuuuccuuuuuuuuuuagacagagucuugcucugucucccaggcuggagugcaguggcacgaucucggcucacugcaagcuccgccuccuggguucacgccauccuccugccucagccucccgaguagcuggaaccacaggugccugccgccacgcccggcuaauuuuuuuuuuuuuuuuuuuugcauuuuuaguagagaugggguuucaccguguuagccagguuggucucgaccuccugaccuugugauccgccugccuugaccucccaaagcggugggauuacaggugugagcgacugcgcccggccaggauuucuuuccuuuuuaaggcugagcgauaguccauggcauguauagaucauguuuucuuuguccacuugaccacggauagacauuuaguugucuccaucuugguugcugugagugacgcuccagugaacacgggagugcagauaucucuucagggcccauguguggcugagauuaggagaucacugcugucgucucuaguucagcagugcuagugccuccuggcguuuagcguccagcucaagggaguggaauuugggugucucagggucuagggccaccugugccucuaaaucgcagggaagcuuugugugugugugugguggggugcggggggcuauggguaugugguggggugaaucuuauuucucuucuuucccuuuucuuaauuuuccguuggcaaaacagagcgccacuccagaccccuuucauucuugcaauauacaugaaaaguacagggcuuguucugcaaaagaagaguagccccagcgagcucaggguugagugaaguuccgcaaggauggcaccucucggcucuucugggggcuucaggacagagcucagugucgccaagcaggacccccacugcgggcggagcugcagggccaucaacauucauuagguggaucagugaauguagacucugcggugucacaaagcagcaccuguacucacugugccugucucgggauggaaucuaagucagacauccuugcauccccacuuaugggcuguuccuucaccuugcugguccucaccuuucuccuagaguuacggggaggaguaaaugugcuaaggccauacacgccgacucugcaguggccuugaaccaugcuucucugucaccccuuucguugccuugacaauggcugcagccuccuuucccaucuccccuaggaucuucuccuagggucucuuaauacagggguccccaauccccagagcacggacuggcaccaguucaugcaugcccuguuaggaaccaggccacaggccacacagcaggaggugaguggcaggcgagcgugugagacuucaucuguauuuacagccgcuccccaucuuuugcaucaccgccugagcucugccuccugucagaucaccuguggcauuagauucucauaggagcgcgaacccugcugugaaccgugugcgcgagggauccaggcugugugcuucuuuugagaaugcaaugccugaugaucuaucacugucucccaucacagcugagaugggaccaucuaguugcaggaaaacaaacucagggcucccaccgauucuacauaauggugaguuguauaauuauuucauuauauaugacaauguaaucauagaaauaaagugcacaauaaauguaaugcacucgaaucauccccuacccugucugugaaaaaucgucuuccacaaaaccuauccuugcugccaaaaaggggauggcugucuuuuuuucuuuugagauggauucuugcucuguugcccaggcuggagugcaguggcacaaucucggcucacugcagccucugccucccagguuccagcgauucuccugccucagccuccuggguagcugggauuauaggcacaauggcaccgugccuggcuaauuuuuguauuuuuaguagagacgggguuuuaccauguuggccaggcugcucucaaacuccuaaccuugggugauccucccgccucggccucccaaagugcugggauuacaggcgugagccacugugccuggccagggaccacugucuuaauaugugaauuaggcgaugccaugacccugcuuaaugcacucccagggccuccugugagaauuagaacaaaaaauccaugcucuguaccaugccuccaagauuggcuaugugguggccuuuggugacuucucccgcccaaucuuggguccuagcucauuggugcagccauauccuccccccaccccaccccacuguggccuuugccugugccaucuuucugccugguaugugcuucccgagaucuuugcacagccagcucuuccugacccuuccagucugcuaggaugucaucugcccagaccgccacucuggugcuuccuguccugacaccccugcucuuuccuucacagcagguacugcucuuugucauuauguucuuaucugugagcuuucaucuuugauggacuaugagucuuaagaggacagagauaucguuucugauuuucccccaugccugugacuagcccaggucuaggcauauaguaggugcucaauaaacagucaucgaaugauagauugaaugaaugaaugcaugacaggaacccugcacuuaucuguguuaauccgucucuuggcugccgggaacaccagcuccugcaaccuggcacuugggucaccugauugaacccuccugauaacucucuaaacucuguaauagguggguucuagaauuagucccauuucacagaugaagaaaucaaggccuggugaggugaacugacuugcuuuagggcagcagggaugauuuuugccucucuggagauauuuggcaaugucuagagacaguuuugauugucauaacuugaggagguggggagugcuacuaucaucuaguggcagaggccagcgacgccacucaguaucuuacaaugcacaggauggcccccgacaaccaagaauuauuugggcucaaauaccagcgguucugagguugaagaagcccugcuugagggcacacaucuguaagugguggagacgggaaccuagaccuggaaccuuguuuuguuaaccacuacccugcacugcucacaugcgggggugggugggugggaagaguuguagaauguuuccaugucugagucaaaaucuugcuucucugcucuagggagaugaauuuggaaucugugaggccugaggccauucacuugaucuccggcccuggagaucuugccuccaagcgaccucaggcuccaucugucugccauguaccuugcaaacaccuuagaauucuggcugggcaugguggcucacaccucuaaucccggcacucugggaggccgaggcgggcagacugaguucaagaccagccugggcaacaugguaaaacccugaaucuacaaaagauacaaaaauuagccaggcauggugaugcgugccagguagucccagcuacuugggaggcugaggcaggaggauugcuggagcccaggagaucgaggcugcagugagcugugauggugccaguguacucaagccugggcaacagagugagacccugucucaaaaaacaaaaccagcugaccaaacaaaccaaaaggccuuagaguucaagcacgugguuuagaggugguggaucucagugucagacucucaguggguucaaauccuggcccuguuucuucuagguugacgagcccaagcaauuuacauaaacucucuggaccucagagcccuugccaggaaaggggagaguuuuaauaguccugacuuuguagggcuguuggaaagcuuaaauggacugugcuugggaagcacuuaaucacugugccuggcgugaucacucuggcuguuauuauuggcacccaauaaauacaugcuuucucuuuguuuccaacucagcauuuagaaauguccuacccuucaauuccugcugcuauuuauuuauuugaagugcgaacuagcuuucuuauuauuauuuuagaaaucaugcagaggagaaaauucaaacaguacgaaagauaauacaacaaaaaauaguaguugccuuccucucccugguuucaggccuacccccugcagauuaauuagcuuuuuuucuuucuuuuuuucuuuucuuuuuuuugcaauaugaagucuugcucuguugcccaggcuggagugcaguggugugauuuugacucacugcaaccuccgccuccuggguucaagcaauucuccugccucagccucccuaguagcugggauuagggcagaucaugaggucagaaaugugacaacagccuggccaacauggugaaacuccaucuguacuaaaaaugcaaaaauuagccaggcgugguagcaggcgucuguaaucccagguacuugcgaggcugaggcaggagaauugcuugaacucgggagguggagguugcagugagccgagaccacaccauugcacuccagccugggcaacaagagcgaaacuccgucucaaaaaacaaacgaaacaucaaauuccugacuguguaugcugcuugcagguuauauaugaccaggccugguucuguaucuguaaaauggguuacguuauaguaccugaguccuagaguugugugugaggaugaaauguaaugugaaacacuuagaguggugcuuggcugaugcaacuaaugaaucuucccucuuacucuuucuauagacagaagaaggcggcacagguuucuucauugcuuuucgcccuuugcugaaaugucaucuuggcccagaggcccuuucugucuaccugauaaagaacuagcaccugcccacccaccauuaugcuucacccacuuucuucuucuucaagccauuugcucccauugggcauacauagaguuguuuuuuuuagcuguugguaguuuuggccgcuuugcauaaagugaaauugugugagaguggagacuuuauuuuacuuccacaugaccuuggcccaugguaguagucgcugauaaauguccacugagcaauaagaacccgacuguugcaaguuacuuauuuauuuauuuuugagacagggucucagucuuucaccuaggcuggaguucgguggugcagucauagcucacugcagccucgaacuccugggcucaagggauccuccuucgucagccucuggaguagcugggacuaaaggcaaacgucaucacaucuggcuacuuuuaaauuuuuuuauuuguagaagguggggagucucacuccauugccaccucuggucucgaacuccugggcucaagugauccuccugccucggucccccaaaguguugggauuacagguguguaccaccacgcccagcuaaguuuuuuuuuuuuuuuuuuuuuuuuugagaugcagucucacucuuuuguccaggcuggagugcaguggccugaucucggcucaccacaaccuccaccuccuggguucaagcgauucuccugucucagucuccugaguagcugggacuacaggcgcacgccaccaugcccggcuaauuuuuguacauuuaguagagagaggguuucacuauguuggccaggcuggucucgaacuccugaccucaugauccgcccgccucagccucccaaagugcugggauuacaggcgugaaccccuccacccggccagcuaaguuuuuaaauuuuuuuguagagauacagucucacuguguugcccaagcugaucugaaauuccuggccucaaacuauccuccugccucugccucuucaagugcugggaaauauaggcaugagccacugcacccagcugguugugaguuauugagaugguugaauugggaguggaugcucaggccucaguggaacuugugguacacaguauguccucauuaccucccaucaguggcaguugagauucauaaucacuuuuucugccuguugucugccccauccucucuguggccuucccuccuguccuggaguuggcuggcugggucccuggcagggcugcaugcguuaucccugcaggccugcuugccuuaucccugcaggcccugguggagcaucugugcagaaccugugccauccagaugggagcaguaaggguguagggcaaaguuagugagcugcccggugcacgaggacuuccaugauaaucagggcugaaccaggaaggcaggucaaggccagggucauguacagaaaggaggucagcaccaggaucuuguaugggaagacuuagaucaaugccuagugccuuagucaucaucauucagcccagaaaacaugacgcuaugcaacaggaauuuuaugaacacacaaaggucaggggccacucggacuuggacgggguccccaacucuuugagugucagggcugagggcauggagacacaacuugaucaagcuggugaaguguccagcaaggagaagccucuguuggagggagccgggagcuggggaggacaugcgcuuucucuuuuuuuuuuuuuuuugagacggagucucgcucuaucgcccaggcuggagugcaguggugcaaucucggcucacugcaaccucugccuccuggguucaagcgauucuccugucucagccucucacguagccgggacucaggccugugccaccacgccuggugaauuuuuuuguauuuuuaguagagacgggguuucaccauguuagccaggauggucuugaucuccugaccucgugauccaccugccuuggccucugaaagugcuaggauuauaggcgugagccaccgcgcccagccgacuugcgcuuucucuguaaagauuucugugggccagguuccccaaagggcaggcccugggccagugcagugaccggugaccguguucaggacucaucucuuguggcugaauugugugucuggagaguuggguccuucugauucugcucagagcguggugggccuggcuggauuucccuagauuaggaagcagccucggguagcugugauucuuugaguugggaacagcaaguggccugcagacugccagggaaucgucccuuccuugagccuuuagguauugcccauuauucaccguuuuucccagaagccuccaguagugagagucgcacuucuuaccuccuggaguuguuaaaguaaagaaggacacauuagggucccugccgguaaggaacauccaggaggccucgauaccuuuuuuuuuuuuuuuuuuuuuucccugagacagagucucgcucugucacccaggcuggaggacaaugaccugaucucugcucacugcaaccuccaccuccuggguuuaagcgauucuugugccucagcugcccgacuagcugggauuacaggcauuugccaccauggcuggcuaauguauuuuuuuuuucuuuuucaguagagaugggguuucacuauguuggccaggcuggucuugaacuccuggccucaagugaucugcccuccucagccucccaaagugcugggauuucaggugugacccacugcgcccagucccgauacuuuguuucuuugagacagucucuuacucugucacccaggcuggagugccugggugggacgaucaaagcucacugcagccucaagccccuaggcucaaaagauccucccacuucagccuucugaguaggugggacuacaggccugcacuaccacgccuggauaauuuuuaaauuuuuuuggugaagacagggucuuacuuuguugcccaggcuuuucuugaacuccugagcucaagcaauccucccgccucagccucccaaagugcuggguuuacaggcgugagccacugugcccgguccucagaugaucuuagcuuugugaccuaugcuguuggccgcuguaggggcugugauggaggugauguggggguggauggcaggggugacccguguuggcugcuuucuguaacagucauaguucauggucagagucagauuuccucucgucaugccuuccuucccuuccuucugcucccucccacagccgcccuuugggucugggcuggccaucuggcucugagcaggaagcuagccugugcucuucaauuugcuuucugcaggggaaacaccuuccuuugcucagcguuuccugaccucuccuucccuggaguuccgguguccuuaaaugcucucugguuucuucuguagcuuacuuucuugcuugaaaggacaacuuuucuuuguccuuuagacuucuuaucucugggcaauacaguggugguggcaguggugauuauuaucaacuauuaguaucugcuacuacgguuuauugucucuagacuguaucagcaccugucacacauugucccauugaauccucuccagaacucuuccaaaugauguguuuuccugacuuuuaaaaaaauuaaaaaaaaauuuuuauauuuuuuugagacggagucucgcucugucucccaggcuggagugcagugcugcgaucucggcucacugcaagcucugccuucuggguucaugccauucuccugccucaaccuccugaguagcugggacuacaggugcccgccaccacaccuggcuaauuuguuuuuuaauauuuuuaguagagacaggguuucaccguguuagccaggauggucuccaucuccuaaccucaugauucucccaccuuggccucccgaagugcuggguuuacaggcgugagccacugugcccagccaaaaaaauuuuuuuaaagaaauggggucucgcugggugcgauggcucacgccuguagucccagcacuuugggaggcugaggugggcggaucaccugagguugggaguuccaggacagccugaccaacauggagaaaccccaucucuacuaaaaauacgagauuagccaggcgugguggcaggcgccuauagucccagcuacucgggaagcugaggcaggagacucguuugaacccgggaggcagagauugcggugagcugaaaucucuccauugcacuccagccugggcaacaagagugaaacuccgucucaaaagaaaaaaaaaauagaaaaagaaaaauaaaagaaauggggucucacuguguugcccaggcuggucuagaauuccugggcuccagcuguccucccauuucggucucccaaauugcugggauuaaaugugugagccucugugcccggccucuuucucucucucucucucucucucucucucucucucucucuccucucucucucucucucucucucugucucuuucuuucuuucuuucuuucuuucuuucuuucuuucagccugagucucgcuuugucgccaggcuggagugcaguggcacgaucugggcucacugcaaccucugcuucccagguucaagugauucuucugccucagccucccgaguagcugggacuacaggugcaugccaccaugccuggcuaauuuuuguauuuuuaguacagacggaguuucaccauauuagccaggauggucuugaacuccugaucucaugaucugcccgccucggucucccaaaguguugggauuacaggcgugagccaccgcuccuggccuuccuuuuuuuugaagcagguucucacucuguugcccagguuggagugcaauggugugauuaugucucacugcagugucuaccuuccaaggcucaggugaucuccugcuucagcccacugaguagcugggauuauaggcgaguucaccaugccuggcuaauuuuuguguuucuaguagagacggguuucaccauguuguccaggcugguuuugaacuccugggcucaagugauccacccgugucggccucccaaagugccgggauuacaggcaugagccaccguguccagcuuuucugacucuuuuuacuuaucaggagacugaagcuuggagaaauuaagugacuugcccaaguucacaugggguuaaggccugaauuugaaucuacaucugcucaauuaggaagugaguggucauagcuagucucuaccuggauggauuguuguuuaauuguuaaauuuuuucaaaauaauuuuaaauuauuuuauuaaaaaagaggguaucauuauguuucccaggcuggucuugaacuccugggcucaagugauccuccugccuuggccucccaaaaugcugagguuacaagugcaaacuacugugccuagccagauuauuacuuaacaaccaaaacaaaggaggaaauugacgguggacaaguaagaagaucauugcaaagguugggggcagguuguuuggggaguguggaggaagcuuuuuaaaugagguaccugaguuggauuuugaaggaugaauaggaguuuguuaggacagaaagacauugcagagagaggaucuagcaagaggugacugaagaaaccauuuauuugaccagcaguuggggaaugccuugaaggcaggaaccacagccuuucagaaucuccagugccugcaacagugucuagaacauuaucugacaacaagcuugguaaauacuucuuuaaguaaaugccugaguaaggcacauuuggggaacagggugggagaaauuguaggagaaguagaugggacuugaauguagaaggaaggccucauggaucacugcaaggguugguuauuuuuuuuuauuuuuuauguuuugagauggagucucgcuuugucgcccaggcuggagugcaguggcgcgaucucggcucacugcaagcucugccucccgggugcacgccauucuccugccucagccucuccaaguagcugggacuacaggcgcccgccaccacgcccggcuaauuuuuuguauuuuuaguagagacgggguuucacuguggucucgaucugcugaccucgugauccacccaccucggccucccaaagugcugggauuacaagcgugagccaccgcgcccagccaggguugguucuuaaaagccaauagggagccaugggaaguuguuucccagcagaagagagaaggccauuagaucugcccuauuuauuaaugcaaauaucuaagucuaugaaucuuccucugagcaggaaaacgugauugcuuuuaaauccauauggaaagacccucaguuuuacucaugauaaagagaaaaggaacuuaaacuacacagagauauuuuucacuucagauuggcagaggucggaaacuuguuaucugcugugcuuugugaaguaauugccuuuguaccuuaucagcuggaguaugaauugauguucccuauuuggagggcagugucugucuaaauguuacuguaggcacccuuugaccuggcagguuccuuuuuugaaaguuuauauauaugugagacagagucucauuauguugcccagggugguuucaaacuccugggcucaugggauccucccaccugggccucccaaaaugcuggaguuacagaugggagccaccacaccuggcagagaaagugaucuuaucaacacucuugcuugagugugaaauucaauuguuuauucaaugcugcauuguuuguaagaggaacaccaaugccaaguccccaggagaccgauggaagucaaguucaucccuacaauagaauacaaagcagccguaacaaagagugaggaaacuguucauguauacugcgggaugaucuuuaaaaucugugguuaagagaaaaaagcaaaguacggaacauuauguaacguaugcuuccuucgauuugauaacagaagauguauauuuacuuuauuuuuguauaaaauauuuucugaaagaagacauaagcaacccaugaucauugccucuagagagaggaacugaggggagggccauagggaauggaaugagaagacuugucccuuguaccucuuuguucaaaagaaauaucaagaauaaaacacaucuauguuacugauaaagauaguuuccaaaggcugugugcggugguucacaccugugaucccagcacuuuggguggccaaggcgaguggaucgcuugagcucaggacuuugagaccagccugagcaacauggcaaaaccccauuucuacuaaaaauacaaaauuagcugggcaugguggugugugccugugguccuagcugcucaggaggcugaggugggaggauugcuggagccugagagguugaggcugcagugagcuaugauugcaccacugcauuccagccugggcaacagagugagaccuugucucaaaaaaaaaaaaaaaaguucaguuuuuaauauuagcuaaguaaaaaaaagcaagguauagaauggaguaucguagugccuuuuguggcaacaaaauaggucguauuuggaauauaucuggaagaauguaagauguuagcaaugguagcuugccuguaggguagcaauggggggcuguuaauuuggggagaaagacauauuuuucacuguauaccuuuuugaguaauuugaaagaguuuuagcacacaaauauauuaccuauuaaaaauaauuacaaagagagggagacauggguggaugcauggauggauaguugguuggguagauggauacauagacagguggauggauugguugguggauggauggaugaacuguuggguggguagauggauugaugggugaaugaauugguagguggguaggguggauggaugaauugguggauggguagguggauggaugaaugaacugguggguugcuggauggguggaugaauugguagguggguggauggauggauugaugggugaaugaauugguagguggguaggguggauggaugaauugguggauggguagguggauggaugaaugaacugguggguugcuggauggguggaugaauugguagguggguggauggauggauggaugggugaaugaauugguagguggguaggguggaugggugaauuaguggauggguaggugcauggaugaaugaauugguggguugguggauggguggaugaauugguagguggguggauggauggauggaugggugaaugaauugguagguggguaggguggaugggugaauugguggauggguagguggauguauaaaugaauugguggguggguggauggauggaugaacugguggguggguggauggauggauggaugggugaaugaauugguagguggguaggguggaugggugaauugguggauggguagguggauguauaaaugaauugguggguggguggauggauggaugaacugguggguggguggauggauggaugggugaaugaauugguagguggguaggguggaugggugaauuggugaauggguagguggauggaugaaugaauugguggguggguggauggguggaugaauugguagguggguagcugaauggaugaauugguugggggggguggauggaugaauuggugaguggguaguuggguggauggaugcauugguggguggguggauggaugaauugguggauggauggauggauggguucaugguugggugauaaauauauccauggguauacauauggauguguacauagauaauucucuggcuaugauagggaggacuggcugugguggggaacacugacugugguggggagcacuggcuguagcggggaggacucaguaggacaaggagaggcuggaggcagugaagacuuaggaagcaguugcauaguccuggcaaggaauaauuuggggcuaggaucaggucaauuaaauguuuaacauuggaacuaugucucuuguauacauaacugcauaugucaagucuugguaucguuuucuuucuagcagggcacauuccuuuggaaugagcuuuuacuggcaacugcucagaagcuguucuguauauaaugaccaccaacaguuuaauccuuuuuucagccaucaccucaggaauuaacaguaguaugaaaucaauuaaaauaaucagucuuugagaugucaugccuucuccacgaucaacuucuucuuuacaaggcuguguuccaaauacgccaggccaaaaagacgugaacuuuguccuuuuuaggguuugugucuugauguuuccuggcuaaaucucuuuguauguguuggccuuguaagguuuacuuuuuuuuuuuuuuuuuuugagauggagacuguguugcccaggcuggagugcaguggugcagucucagcucacugcaaccuuugccucccggguucaggugauucuccugccugagccucccuacuagcugggauuacagacgugcacuacccugcccggcuaauuuuuauguuuuuaguaaaauauaaaaauuauguuuuuaugggggguucuugccauguuggccgggcuugucucagacuccugacugccugccuaggccucccaaagugcugggauuacaggcaugagccaccgcgcccaaccuaauaacuagaucucuuuaauuauuggaacauguauauuuugaucagauugacacuuuuuuuuuuaagugaagugaucuuauuucccucauuucucauuuuuaacuuuuuuuuuuuuuugauauggcuuuaaagcucuguggagcuguaagggucuggguuccuugacacuccaugggggucucaggugaucgugggagggcuguuggaaucagagcuauuuggagggugcauaggccaguaggaugggaaggcugugggagaagugggcuuuuuggggaccgcagccaaauggacaacugggccuaaucuaaagauuggccccucccagcuccuacugauggucauguaacaggaauggggcccagcaccaccagauuuucugauuuuuuuuuuuuuuuuugagacacagucuugcucuguugccaggcuggagugcaguggcaugauauuggcucacugcaaccuccgccuccuggguucaagugauuccccugccucagccucccaaguagcugagacuacaggcaugcgccaccaugccuggcuaguuuuuuguacuuuaguagagaugagguuuuaccauguuggccaggauggucuugaucuccugaccucgugauccuccugccucggccucccaaagugcugggaugacaggcgugagccacugcgcccagaagauuuucugauuuuuaaaguuaugccagagaccgggcgugguggcucacgccugucauuccaacacuuugggagacugagguuggcagaucaccugagguuuaggacuucgagacuagacuggccaauaugguaaaaccuugucuuuacuaaaaauucaaaaaaaauuagccaagcggggugaccgcagucccagcuauuuaggagguugaggcaggagaaucacuugaacccgggaagcagagauugcagugagccgagaucgcuugaacccgagaagcagagauugcagugagcugagaucaugccacugcauuccagucugggugacaaagcaagacucugucaagaaaaaaaaaaauaaaaauaaaaagccggaaaucaaauuuuaaauguugggaucuaaucuaauuuuuuuaaaaacaaaaaguaugccuaaaacaacagcaauaacaacaagccaucuaugggccaaacuguggguggggaaaccuauuuuguacuucuuauuuuauccgauugaauugugguggagauaggaaauugagaccccaaaaaggguaguaaguuuucccaaaguuauuuagucaguugccagauuauggcuugaauuaaauuuaaauucuucagcugggcaugguggugcacaccuguaguauagcugcuugggaggcagaggugggaggacugcuugagcccaaaaguucaaggcacaggaagcugugaucuuaccaccacacuucagccugggcaacagagcaagaccucauuucaaaaaaagaaaaaaaaaagaaaaauuuaaauucuucauuacagaacagcugaugguggagguuuauucuugggcagguacaucugaucuauuuauguauguaucuaugaauuugucuauuuggcauggcucuuuagcaaaauacaggcuuuuuuuuuuuaaguaaaaguaauugaaacaaaauuuguuuccaaggcuggacagcucaguggcaaaaugcagacuugaacaacauugcccgaguuugaauucagcuccagagcuuaccagcugugugauacuggacacaguauuuaacccuucugugccugaguuucacaucugaaaaaggagaugauaaaaauaauuacagaaugaaaggagauaauacacaugagguacuuagaauaaagccuggcauacagaacugcaguuugguuguuauccguggugguggcgguggcgguggcgguggcgguggcggugauggugguggugaugguggcgauggugaugaugaugguggugaugguggugaugguguuggcagugauauuggugguggugauggucauaguggggaaggugaugaugaugaaugaagaugauuagaaaguccucaguucacaaggucagagugaucuagaugacacagggcucuucgguuauaagagaauauccuucaggguuccuuuaaauggcucucuccaucuuucguacuacagugggacuugccacagguucuggggacuguuaaugugagaugagaugcuacauaccuuuuuguuguugguggguuuuuuuguguguaugcacuguugugugugugugugugugugugugugugugagagacagggucucgcucuguugcccaggguguaguacaguggcaugaucucagcucguugcaacuuccgccuuccaggcucaggcacuccucccacuucagccgccugaguggcugggaauacaggcacgcuccaugcucagccacuuuuuguguuuuucauagaggcagcaucucacuaucuugccuaggcuggucucgaacucccagccuaaaguggucugcccacuuggccucccaaagugcugggauuacaggcaugagccacugcaccugaccuguaugcuccuguuaagagagcuuuauuuuuauuuauuuauuuugagacagggucucuguugcucaggugggagugcagaagacaccacauaccuuuaucccuuguuccucauuucuuagucuuucuggcuacugaucuuuuuaguuugcguguucauccugaaagguccuuggauauauaggagccuugucuguuucuucaaaccccguggcagcugguuucaugcuccaggcgagcuccuguccucugggguguguccugcugaccccucgccuguguuuguguucgcaggacuggaaugucacguggaauaccagcaaccccgacuucaccaagugcuuucagaacacgguccucgugugggugccuuguuuuuaccucugggccuguuuccccuucuacuuccucuaucucucccgacaugaccgaggcuacauucagaugacaccucucaacaaaaccaaaacuguaagucacugggggguuucguuguggggggugggaaggugcaccuggacggggaguggugguuggugauaacugacauuucucuucuacuuaguugacccuaaguuccuucuucuagaaggcagaagaauaaugugggaggugaaaacuggagcucuggagacaaacauggguacaaaucuuugcucugccgcuuaguauuuggccucgagcaaauuuuuuaaccuccccaagccucaguuucccuguuuaugcaauaggaaugauaggcuuguucucaaggcauuccugggagauuaucagcucuuccccucuuacugagccgaucuccuuuuuauuuaauuaaauauauuuauauagauuuuuucuggccaauuuuuaauuuauuuuuuguagagaggggggacuugcuguguugcccgggcuggucuugaacaccuggccucaagcaguccuccugccuuggucucccaaaguacugggaugcucagugugaaccaccacgccuggccccuaauuuuuuuuuuaaguuggcuuuuauuuugaaauaauuuaaagcuacaggaaaauugcaauaaugggccaggcgugguggcucacgccuguaaucccagcacuuugggaggccaaggcgggcaggucaggaguuugagaccagccugaccaacauggugaaccugucucuacuaaaaauacaaaaaugagcugggugugguggcaugugccuguaaucuuagcaacuugggaggcugaggugggaggaucccuugaacccaggaggcagagguugcagugaacugagauagugccacugcacucuagccugugcaacagagcgagacuccuucucaaaaaaaaaaaaaaaaaaaaaaaguugcgaugauaccaggaacugcugccugauuuucucuauccaucacucauagucacuguuuccuguuuuuuuuuuuuuuguuguuguuuuuuguuuuuuuuugacacaagguguugcucuuuugcccaggcuggagugcaaugguaugaucacagcauacugcaaccuugaacuccuggcucaagccauccuccugccucagcuuuuugaguagcugguagcugggacugcaggcauacaccaccaugccuggcuaauuuaaaacaauuuuuuguagagacagggucucgccuuguugcccaggcuguugucaaacuccuggcuuccagugauccuccugccucggccucccaaagugcugguauuacaggcaugaaucuggccuguauucacugauuuuuuaaucuuuugcuacauuuguuuuaucaugagcuuuuguucucucucucuguaugcaugcuauaauuuauuuuuucugaaucauuugagaauggaugcaccuugaaacauaucccacccguagagggcucucaguaaauacugguugaaugaaugguugucguggagggcuuucuugugcagugcgccggaguugcagcuagagaugagcugugagcugagcucuugaguguucaggcaccggggagcauggugaccagacaaacaguccuguuggagguaguggggcguagcaggcugauuacagaccaucacgugccggccuggaugccagcucaccauaccgaggacuuguccuuauuccaguggauaugugccauguccuaggacuguggcugaucauuugaaggcuggcugguucuccuaucccuggggcugagcuguucgugcaggcccugggggagguuccagggcggucuguuguaggauauguaugugcuucucuuccaggccuugggauuuuugcuguggaucgucugcugggcagaccucuucuacucuuucugggaaagaagucggggcauauuccuggccccaguguuucuggucagcccaacucucuugggcaucaccaugguaaguaggagcuggcugugaccccugggccaucugcugggcucaguggagaccaaaaguaauaacucguaagacuagaaucauaguuuuuuaaggcaaugaucagcuggagcugggauauaaauuaaauguagccuuuuuuuuuuuuuuuuuuuuuuuaaagacaugagaucucgcuuucauccaggcuggagugcuaugguaccaucauaguucacugcagccucaaacuucuggccucaagcaauccuccuaccucagacuucugaguaguugggacuacaggugugugucaccacgcccagcuuauuuuuggcuaauuuuaaauuuuucuguagaaaugggaucucacuguguugucuaggcuggucuuagacuccuggccucaagugauccuuccagagcacuggcauuauaagcaugagccacuguucccagccccagcugcagucuuuggauggggcauguguuguccaguuugccacaguccccaccaugcccuauugucuucccugccacugauugaguggcagaugcccccuuuuguugcguuugccacacuuugcucuugcauuggcuacuuuggucacuuauauacuaacugccuggggucuaauggccuugaguuuucacuaucuggcauaggggguggguugcuaagcuaaauaggaaacugcucugucccgggggauacacaacuuagugagugacagagacaaggaaacaacuuuauuaauuacagcugguguguauugagcacuuacuauguauguaccuggcaguauucuugguguuucacgugucuugaaauucauugaauuuucacaacaacccugugagauggguccugcuuuguucccaucuuacaggugaggaaaccaggcaagagagguuaaguguccugcucaagaucacaccacuaaugugcagccgagucaggggugggaccccagaugccaugcuuuuagccccugcaaccugcagcuucugagcccugaacagagaguucucggagaguguagcccuugaguauuguaaaaagaggagggaggcugggcaucguggcucaugccuguaaucccagcacuuugggaggcugaggcgggagaaucacuugaggucgggaauuugagaccaguauagccaacauggcaaaaccccgucucuacuaaaaauaaaaaaauuagccggcgugguggcacacgccuguaguccuagcuacucaagaggcugaggcaggagaauugcuugaacccgggaaguggaggcugcaguaagccgagaucgcaccacugugcuccagucugggggacagagcgagaccucaucucaaaaaagaaaaagaaaaaaaaaaggagagaacaaguuuaaggcaggacauucugagcagggugaacaguguguccagggagggguggaagguuaaggggaggaugcaggcagggaggacaagguguucggugaaggaacacggugugaagguuggggggauagaguggaugugacagaggggucaggaaagacaacguggagccagguugccaaggaccaugaaucuuuauuuuucuaaauuaauuuuucauuuuuuaaauuuuagagucagagucauacucuguugcccaggcuggacuucacuggcgugagaucacagcucacugcaggcuugaacuccugggcucaaaugauccuucugccucagccucccaaguagcugggaguguaggcaugcaccaacaugcccaucuacauuuauuuuuuauuuauuuauuuuuuuauuuuuccccccgagauggaguuucgcuuuguugcccaggcugaaauguaauggugugaucuugaguugccgcaaccucugccuccuggauucaagcgauucuccugccucagccucccgagaggcugggauuacaggcaugcgccaccacgcccggcugauuuuguauuuuuaguagagaugggauuucaccauguuggccaggcuggucucgaacuccggaccucaggugauccacccaccuaggccccccaaagugcugggauuacaggcaugagccaccacccccggccaguuuguuauuuuuguagagacagggucucccuauguugcccaggcuggccucaaacuccuugucucaagugauccuccugucugggccuccuaaagugcuaggauuauaggugugagccaccaugcccugcccagaccaugauucuauauagcacacauaugugcuguccacucucugccaagaacuguccuaaucccuuuauuaacccuuuuacguuguaaauaagguaagcaaagugugguacagagaggagaaggacuggcccaaggucaccuggucaguaagugguagagccagcuuccagucuaggccccagcguguagccuggcaccugcuuuacgccuggcucuccugcuggguuugauuccccuuuguguccucagagccuggcccugugccuggcaugcaguaagcguuccauaaaugcauggagggaaugagagaguaaagggcuuugcuuuguccugaauucgggucuugggcucuguguucuggcagugggguauuagaguggauuuuuuuuuuuuuuuuucaauuucacuauaauagagacagggucuuuccauguugcccaggcuagucuuaaacucccgagcccaagugaucccucugccuuggccuccuaaaguggugggauuacaggcaugagccaccauacguggucagcuguuuuugacuugaguaggucauccucccuuaacauuccuuguuccuggucuuuuuuuuuuuuccuuugaggcagaguuucgcucuuuuuucccaggcgcaauggcaugaucuuggcucacugcaaccucugccucccggguucaagugauucuccugccucagcuuccccaauaacugggauuacaggcacgcgccaccacaccuggcuaauuuuuguauuuuuaguagagaugggguuucaccauguuggccaggcuggucucaaacuccuggccucaggugauccacgugccuuggccucccaaagugcugguauuacaggcgugagcaacugugccuggccguuccuggucuuuugaucguucauuuaugccucugucacccugggggaaacaggggugauagucugaggguuggggcuuuugacuccucaggggacucugagcugggcuggccaagaggugaacuggccugugagauccucagccucucuuuaucuaccugagaucucugggauggaauggaggaccaccagcucagcugugaaugugucagaaacauucugacuauaucccagggaaccaggauaugcaggcacugguaauaugggacaggaugcagccagcacauguuuuuuuuuuuuuucuuugagauagcgucucacucugucgcccaggcuggaaugcaguggcaugaucucagcucaguguagccuccgccucccagguucaagugauucuccugccucagcuucccagcuagcugugacuaaaggcguaugccaccacgccuggcuaauuuuuguauuuuuaguagagauaggguuucaccauguuggccaggcuggucucaaacuccugaccugcccgccuuggccucccaaagugcugggauuacaggcaugagccacugcaccuggcugauuuuuuuuuuuuuaucccuacucuguaucaagcguuggagacacaaccauauagucuagcugugcaaacagacauuaaacaaaugauuccucaaaaggcacaaaguguuugaacgucugcagagugcugugugagggugaaggcaggggagcuugguuuggucuggggcauagccaggcuucucugagggagggaugguggaggugaagccugagaaugagcaaguuguuaaaaagcuuaaggggcugagggcagaggaccagcugcggagaaaagcacauguaaaguccugagggucacagggaaaacuugagaguuguguguggcuggagcagagauggccgaggcagagagcaggggcgauggggcagaggcugaccccgggaacguugagcaucagggcaaguggguuuuguuuucuguacuggguucucugccuguucuuuuaaauaaaguuuuauuggcaugaaggcauguccauucauuaacaucuugucuauggccacuuucacacugcaguggcaaagcugaguaguuuugauguagucuauggcccaugaaguccaaaauauuuauuacgugguccauuaagaaauaguguggcugggagcaguggcucacaccuguaaucccagcaccuugggaggccaaggcaaguggaucaccugaggucaggaguuugagaccagccuggccaacguggugaaaccccgucuuuacuaaaaauacaaaaauuagcuaggcaugguggcgggcaccuguagucccagcuacuugggaagcugaggcaggagaaucacuugaaccugggaggcggagguugcaagugagcugagauugcaccacugcgcuccagccugggugacaagagugaaacucugucucaaaaaaaaacccaacaacuccugucuugugcuucucuccucagcugcuugcuaccuuuuuaauucagcuggagaggaggaagggaguucagucuucagggaucaugcucacuuucuggcugguagcccuagugugugcccuagccauccugagauccaaaauuaugacagccuuaaaagagguaaguggcagucuccuuccucaucuuccuucaguggacccggagggagagaugcugggucccucuggcuuguguagaagucaugcguugccaugggaaccaggggcuggguaccacaugcaccuagcuucucccuuggugacuuuccuaccccaccaaauccucacuaaaucagccccagccuuuuuucuagcaccuccuuuccccagggccugauuugucuguguugcuccaaggggcucccaugggaccuccaagggcaggagcugugggccgaugccaggcuggccccaucagcaggaaacagcaagacaggcggcuccaaauuuugccaggcugggauggagccgagccgggaacgguguuugcagagugacuguuccccugggggacccuaggcuuguccucgcguuaccuuugucccaucaguugcugcucuggcuggggaaguuguuuacauuggcugcugugugcugcugcuaggaauuuugaggagugugcacuuuuuuuuuuuuuuuuuugcuguuguugaggcggagucucgcucugucaccaggcuggagugcaguggcacgaucuaggcucacuguaacuucuaccuccuauguucaagcgauucuccugccucagccuccccaguagcugggaccacaggcacgcgccaccaugcccagcuaauuuuuguauuuuuaguagagacgggguuucaccacguuggccaggauggugucgaucacuugacuucgugauccacccgccucggccucccaaaguguugggauuacaggcgugagccaccacgccugaccuggagugugugcuuuuggaauaaccugcuguuccugccaucuuggagcuaauuagagacuggcaugaggcaaaggaaggaaaagaagcugaacauuugacuauugauugccuacauauuauuaugagugauagcagcugaugcugauugaguucauguuuucaaagugccucgcaggggacuguguaugugucacgaauaaucuuccugaccucuugcagugacuuggacagaauuucucagccucagcacuaaucgacauuuuggauuggagacucguugguuguaggggcuguccugugcuuuguagacauuuaggggugucccuggcuuccccugacugggugccauaacacucccaaguuaccacaaagaagauauccccagacacugccagauguuuccugggaggcagaaucaccccugguuaagaaccaccggugguuuauagguggggaaucugaggcacagaaagguuaaauaaguugacaagaucccacagccagugugagagagccaggccuugauacagcucuguuucacucccaagcccugucuuccucccaucaggcagcggugagcagugagacuacccgugauggagccggcuuucugccauuacaucccggggggagcugggagccccuggggagccugcagugucccuguggcugaguggguuucugccaccugcucucagaaugugaucuugguuuuuuuuuuuuuuuuuuuuuugagauggaguuuugcucugucacacaggcuggaaugcaguggcgugaucucggcucacugcagccuccgccuccuggguucaagugauucuccugucucagccucccgaguagcugggauuacaguugcccaccaccacgucuggccaauuuuuguauuuuuaguagagacgggguuucaccauguugaccaggauggucuccaacucuugaccucagguguucugccugucucggccuccaaaagugcuaggauuacaggcgugagccaccacacccagccccagaaugugaucuuuuucuuccuuccuuccccaccauguaggaugcccagguggaccuguuucgugacaucacuuucuacgucuacuuuucccucuuacucauucagcucgucuuguccuguuucucagaucgcucaccccuguucucggaaaccauccacgacccuguaagugugaccacagaugagugugugugcgugugugugugagagagaugcgugacacaguaccagcuaacauuucuuagauccauccaggaucucguuccagccucccucaaccccugauacagggaauaucaucccaccuacuuuacagauggaaaaacugaggcuuagauguggcugggggagcugaaggagagaaucugcuuugucauugaugaacugcugucuugcaggccuguagguuucucacuuggcauggugauuuuggaaaaugugagcagauaauuacaaaucagguauuuuuuaugaauucuagcuguccagauguucuggaaaaguaaaguucugacagauuaggccuauaauccuacagggcagagcugaggaguugcuggaguccccggcacucccuguuguauuauacuggcaugcuuuccucacuuguggcaaaugccuggccccugagggauuugagugugagauccuuggucuauuuugucaguuucagagaaauucuguaaauauggaaacuuaucagugaggaguguagagauggccaccguuucugcuaguagaacaaaagggaacacuuuauuaauuucccuuaauucuuuucuucuuuuuuuugagacaggguuuugcucuguugccuaggcuggagugcaguggugugaucucggcucacuguagucuugaccuccugggcucaagcaaucuuccuaccucagcuuucugaguagcuggaauuacaggcacacaccaccaugccuggcuaauuuuuuuucuuucuucaacuuuuauuuuaaguuccaggguauagguacaggaugugcaaguucguuacauagguagaugugugccauggugauuugcugcacagaucaacccaucaucuaggaaucaagcccaggauccauuagcuauuccuccugauguucucccuacaccugcuccccaacuuggcuuacuuuuaauuaauuaauaauuaaagauggggagauggucucaaaccccugggcucaagcgauccucuugccuuggccucucaaagugcugggauuacaggugugagucaccacgccucgccuauucuuuauuuuuuuaaauagagaugggaucuugcuguguugcccaggcucaugugcagcuuuugauaagagagaucugggaaggccugcccagaaaacugcaugugagcggagaccuagaggggugagguaguggguggagcaaacaccuagaggaagaguguuccaggcagaggggaauaaguacaagggcccugggguggggagguguggagagaacagcaagaaaagccagcacagcaggagaaggcuaagagacagugggugccugagaggugggacagcccccuugugagccagaugagcuguuuggguuuuauugugaguauggggcagggaggccuuggagcaccuauuugaugcugauucauggcuagucagcugguaaugggcggauugcagugggagaacuuuucaccucugugguucuguuggguuuggccuaaaccucugugaggggcagaggcucaccuugugggugacgaaagggcuuggugggcaucaguauggaggaggagguugaugauaacuaagagauuuuagaaaccuaugucucaggccaggugugguggcucacaccuguaaucgcagcacuuugggaagcugaggcaggcagaucaguugaguucaggaguucgagaccagcccagccaacauggugaaaugccaucucugcuaaaaauacaaaaauuagccaggcaugguggugcaugcuuguaaucccagcuagucgggaggcugaggcaggagaaucucuugacccugggaggcggagguugcagugagcagagaucacaccacugcgcuccaaccugggugacagaaugagacucugucucaaaaaaagaaaaaagaaaugcaugucccaguguauguucugaggagucccguguugguauuuccuugcccaaagaggagcuggguuggagaaaugagcaagugcacacaucuguguauguauuccugugcaucuguguguacgugugcaugugccugcuugugugucucgguagucauaggcauguauaugcguguaugugcuuauaugugaaugugugcuugugaguguguuuauguucauguauguguguguuugugugugugugugucuuuguguugugugugcuugcauauguauaaaguucacaaaggcaauggugacucaugccuguaaucccagcacuuugaaaggccaaggcuagaggaucgcuugagcccaggggucaccccauuuuggaucccuggcuggugccugacacagaagagaggggcucaugagucaguggcuguuauauguauuguguaucaguguguguaaguguguggcagccgagugucccuguuugucaaauguugggcuauucuuuuuugucuuuuguuuguuguuuuuuucuguuguuuuguuuuguuuuuagacggauucuugcucuuguugcccaggcuagagugcaguggcaugaucucggcccacugcaaccccgccuccuggguucaagcgauucuucugcuucagccuccugaguagcugggauuacaggcgcccaucaccaugcucgacuaauuuuugcauuuuuaguagagauggggcuucaccaucuuggcccggcuggucucgaacuccugaccucaagugauccacccgccucggccucccaaaauguugggauuacaggugugagccaccgugucuggccgagccauucuuuagaacugggauuuauacaaaacaagucacaccucaacuggguggcugcagaccuuggauugcucaggguaaacagagucugguuggggcugccuggcuggcguggggaucacccaacccaucaagcuuccucugggagccugggaagagcucucuugccauggaugguucuggaagcuuuuugaaggagggacuuucuuaauuucugaucucccuugggaaucuggauaaauucccuuucacuucuccccugggcguguguguaccagggugacucacagaucugacuuggaccuuuuuuugugcuuucugcauuccuggcagccugggccugggauuugcucugccacccugggugacaugaagcucucagcucuggcggcuaaaaggcuacacuguuguggggcugggacacccugacucuucuccccagucauuguuuucuguuucugugucaucucccccagcucggcuccuccugugucacugcuggucuuccaagaugguggaagacacugugguuugucucuuugcagucucgcucugucgccaaggcuguagugcaguggcaugaucuuggcucugcagccucugccucccagguucaagcaauucuccugccucagccuccugaguaacugggacuacaggcgcacaccaccaugccuggcuaguuuuuguauuuuuaguagagaugggguuucaccguguuggccaggauggucucgaucuccugacuucaagugauccgcccacuuuggccucccaaagugcugggauuacaggcuugagccaccgugcccggcuguggucugccucuugugcagugagauccagcagggugucaaaugugggugugcaggcugcugcauuucugacauuugugcaccuguccaggagagaacacuuugauuggcugacacucucuguccaggaagccugaacuucccucuggguuccuguucaggaaccccaugggguugccauuuaccuuuuugcagauuagaguuuagaccaggaguuagccaguagcccaugggccgaaucuggccugcugccuguuuuuguaaauaaaguuuuauuggaacacagccacucgcguucaucacauagugucuacaggugucuggagcugcagcaguggaguuguguaguugcuacagagacuguagcacccacaaagucuaagauaccuaccaucugacccuuuacagaagaaguuuguccaccccuggucuaagcauuucuuuagcucugaugacuuuuuagcuuccuuuuuuguccccuuuccauuugcaggcauucuuucuuccuaugcaaggcaaggacgggaaucgacauuuauuagaugcuugcgguguacuggcuagcacuaugcuaaguucuuuauaugcaugucucacuugacucucacagcaguccuggugaacuugguacuauuuuucucauuuuacagacaaacaaucgcagacauaagugccuugcucgaccugaguaguagagcagagauucgaacucacgacuggcuguugugcacaaucaugucacuucgcuugguuguaacugcugaaugggagggucuuggcuaaauaauggcuuuguguuaggcuagaggcuucacguggcaguauccaccuuguaaccucagugccuaagacacagccaggcacacggugggccuguagugguaauuuauuguuguguuauauggggaggugcucaguacauguggcacguauauuaugucuugcauaagggugaagugugcaugaggccucacaggacaucagauuaagcugcuucucugccuucauccuguucaaguauuaccagcaagaaagaggaaggggacugauguaugcacagauguucugaaggcuuggcauggugucaagagccuuauuuuuuuuuuuaauguugcauuuugggggguuaaauauauguaaccuaagauuugccauuuuaaccauuuuaaguaugcaauucagugaugcuaagugcuuuuaaaaaucuuguucaaggccaggugugguggcuuacaccuauaaacccagcacuuugggaggccgaggcagguagaucaccugagaucaggaguuugagaccagccugaccaacauggugaaaucccaucucuacuaaaaauacaaaaauuagcugggcaugguguugagcaccugugaucccugcuauuuaggaggcagaggcaggagaauugcuugugcccgggaggcggagguugcagugagcugagaucgcuccagucugggcaacagacugagacccugucucaaacaaacaacgaacaaaugaacaaacaaacaaacaaaauaaccacauaacuaccuagcaacguagccuagcaauugagaugggggcaaggaaggguaggaaccagguccugugagaaucagcuagacuuguggcuuugggcucggugcucuuccuuuggggacgucagcagccccuucuugaaaacggguugcaacucgauuuguuguuggcuucaccuccucucucugucccagaccugagcccugugaucuggggaggaggacaacgggacaaccuguuugcuuguuuucccaucacucucagggauugaaucacaguggagccaggaagauggggagaguccaggcuugcugcucucccauccucagagcagcagcaggccauccaucaccugucgccuguccucagagugaucagccaaggccuggggcggcuggggucaggucaggcagggcgugggugggagcuggcagggcuggcuccuccaggccacuucgugcugagucacugagucggccaauccuccccagcuggcccugcucccacuccaugacucagaugucuauuccagcccuggcugcuugguggggcuccucccaucuguccuucuggcucuggggcugccgaggcuuuugggagccugggcagggcugaccaagacugccagagcuccggccgguccccagucuccugccuuuuuucucauuggcacugagucugugguuuagguuugggggaggagggucuuguagauaaggggaucaaggccaaaggagaucauuuauuaggucccagcugaaagcagagguccuuggaccaguuggaaugcucgacaucccccggaagcuugcuagaaaugcugggucucaggccucaucccagaccuaccaagucaaacucauuuuaacaagaucuccaggugguucaggguugcaaaucacugguuuggaacauucagugaaagcuacucagcucguuugcaguaagagguauuuuuaguccugucuguauaauauguaauauuuuccccccagcauuuuacuaugaacauucuuaaaccuacagaaaagucgaaagaauucuacugugagcagucauauaguugguaccuagagccacaguuaacauuuugcuaaacuugcuuugucacauaucugucugucuaaccagauagcuaaucagccagccaaccggcuacuuuuguuuuguuuuuuguuuuugagauagggucucacucugucucgcagacuagagugcaguggugugaucauagcucacugcagccuccaacuccugggcuccaaugaucuucccgcuucugccucccagguagcuugggcccuacaggugcacacuacuguguuuggcuaauuuuuaaauuuuuuguaggcgugagggcuccuuauguugcccagucuggucuugaacuccuggccucaagccauccucccaccucagccucccaaaauacugggauuacaggccugagccacugaaccuaguuuuuuugauaucugaaacuuccuucgaaauauauuaguauucuuucaugcacccacuuccaaguaaaucauuagcuagaguuuaagaucuguuuacacuucugaguuuuuugcuuaaaauuuacauacagugaaauugcugaucucaaguuagcauuugaugaaucuugguaaaggaauacuuuaaaccccugucaagauauagaacacugcaaggacgccaggaaguucccucgugccccuucaugaucagucucuguccccacccaccaaggccugaucuuggaccguugauuaaagcguugaaacuccauuuucuuuccauuucuccgucaugcuuucagucauuuaauaaucagguguugugccaggggcugagcuagaaagaaacagaccuugaccacugcccuggaggagagauggaagguggguggcaggcaguugaaccaacaacugcaggauggacagugggggcucugagggagggaagugcugggaguugugggggcugggagaguggucccugacucagccuggggcuccagggcuagcauccagggaggagaggggaugcucaagucuaaggaaugcgaggcucuggccaggugaauauguuuggaggugguggggugggagggugcuccugguagagcaacuggcaugugcaaagguccaguugagggagcuuguggguguugggaaucacuuggaauucggcuuggcuaggcugggugcaguggcucaugccuguaaucccagcacuuugggaggccgaggcaggcagaucaccugagacuaggagcucaagaccagccuggccaacgugguaaaaccccgucucuacugaucauaaaaaaauuagcugggugugguggugcaugccuguaaucccagcuacucgggaggcucaggcaggagaauugcuugaacccgggaggcggagguugcagugcgccgagaucgcgccacuguacuccagucugggcgacagagcaagacucugucucaaaagaaagaaagaaaaaaagaauucugcuuggcuagauuggaagggcuaggauguaagcgaaaagagaggcaagagucagcaucagagaucaagggugcaauuaugugucacaauaaggacuuggaauuuuuuguuuguuuguuuguuuugagauggaguuucacucugucaccaagguuggagugcgguggugccaucucagcucaccgugcccuccaccuccggggcucaagcgauccucccaccucagccucgcaaguagcugggaccauaguugcgugccaccacgcccaaguaacuuuuucuguuuuugguagagaugggguuucuguauguuacucaggcuggucuugaacuccugagcucaagugaugcccugccuuggccucccaaaaugcuaggauuacagggaugggugaaccaccacauccagccaggacuuggaauuuuaacccuacuguggugggagcugaggaaagguuuuucaccaguggaaugacacacucagguuggacagguuguggaagauccucaggcucaaaggaagaggauacauuggacaugggggugaggucgguggcacuuaaaaagccuuugcaggcacccaggcagguagagagggaggcugagccaggauauuccccugugcccacuacagcaucaaaaaccagaaaaagggccaggugcguggcucacaccuguagucuuggcauuuugggaggcuuaggggggaagauuucuugagaccaaucuggucaacauagugagaccccaucucuugaaacaaaaaaacaaagaaaacagacaaguugaugggcaaagggcaugggcaaagauucuggggugugcuccaguagaggaaacggagguccugggcagggaggcauuuugcacaguugguaagcaacagggcaaacaaaucaccaguguuuacguuauacuggcaaaucucuuacugcuggacauuuaggcuccgucuaauaauaaggauaacagcugggugcacuguauuauuuauuuaguccucacaguagggcaggaugaucagucuccccacuugacagaugaagacacugagggucagaguggugaugugucaggaacccucccacuggguucucacgcuugaaacacagauugcugguccccacccacacaguuucugaugcaguaggucuggguggggcccgagcaucugcgguucccaacaaguucccaggugccaccgaugcuggugacagagcugcguuugaggaucacugcucuaaacauuauugcugcugcacgcauugccuccugcugggugcagggguuguggggggcacuuuggcagugcagagcggagguaaccagcagaaaacccguuagaacuaaaagcugagaguguuucugacaaacaggucaacaugcugaaagacccagacaagguccuuaaacuacccugcgcuccaagaaucagugccuggggcugccguaccuaauugguucaaaccacaggguuucuggccagcucaucugguaccaaacguagaugucaauaugguggaugccaaagaacacaucacucuguuuggaugaaucaggcuuuuccucccucugccuucagccaggacuucucugaauuguuuucauuucaaaugaaagagggaccaguucacaagcugcuuucaugcuaucugggacaggaguuacuguauuucagugucugaggcugggaaacccccuggagguggcucugucuuuuguaccuagugugugaugucaaaagauucuccuugguuuggguuaaaugacaugcucccuggauuacaauccagugccccaugauuuuuuuuccuccuuuuuuauugucaauccuugaccuacuucagaaguuaguugucuuuguugucaaguaaggccuuccacgucagauagaggcuguuuccaggccgggugcaguggcucaugccuguaaucccagcacuuugggaggccgagguggguggaucgcuugaggucaggaguuugagaccagccuggccaacaugauaaaacccccgucuguacuacaaaugcaaaaauuagccaggcaugguggugugcaccauguaauccccgcuauguggcaggaugaggcaggagaacuguuucaauuugggaagcggaggcugcagugagcugagaacgcaccauugcgcugcagccugggcgaugagagugaaaccgucucaaaaaaaaaaaaaaaaaaaaaaaggcuauuuccuuuuuuuuuuuuuuuuuuuuuuugccagugaaggggggacccuguguuggccucccuaucggucacuugagauaaucugaaaaucuguguuuagauccauagaagagaggcggccugaggagaagaauuugacaaagcucuuugagugugcaaauuagaaauggcaauugcugggcgcggugggucaugccuguaaucccagcgcuuugugaggccgagauaggcggaucaguugaggucaggaguucgagaccagccuagccaacauggugaaaccccaucucuaucaaaaaauccaaaaauuagccaggugugguggcagaugccuauaaucccagcuacucaggaggcugaggcaggagaauugcuugaaccugggagguggagguugcagugagccgagaucgggccacugcacuccagccugggcgacagagugagacucagucucaaaacacaaaaaacaaaaaacugugcaguguucugucugucaauguccuuguugcauuugcagggcagguuuucuaccaguggcuggggacuuaguuuuacugggccgagggaagguuaggauuugagggucuuguuaagcuggauaugggcugcauuucaagccuccccuggcugucucuauccugcguguugaugccaaggcugaagaagacuggauuugcaggcaaaagacugucauuugaggccuguuuucaccccuuaaucacugugucuugguauguuguggggguugagguaggcagagguuagccaaccuuuucuggaaagggcuggcugauaaauacuugaggcuuugcaucccauacacugucuguggcaaccccuaacuccgcuguguagcucaaaagcugccauacucauuuauaauacauaaaugaaugggugugacuguuccaaugaaacuuuauuuauaaauagcuggucugugggccauagaugcuucugauauauaaagcaucugguauagugguguauugugaacccacugggguuuuuucccccccaaacacuugagcuuuauugauguauauugacaaauaaaaaugguauauagguugggcacggugguucaugccuauaaucccaggacuuugggaggccgaggcagguggaucacuugagcucaggaguucgagacuagcucaaggaauagagugaaauucugucucuacaaaaaauacaaaaauuagcuggguguuguggugugcgucuguagucccagcuaccuggggggcugaggugggaggaucacuugaaccugggaggucgaggcugcaaagagcuaugauuacacuaccgugcuccagccugggugacagagcgagacccugucucgaaaauauauuuaagguguacaguuuuauguuuccauauaccagaggcuacugucacugcuucuauuauuauuacuacuacuacuacucauguuacccuuucuuuggcuguuacuuugugccagguacuauucuaaguacuuaccauguuugaucucauuuaaucuucaccaccaaggaacugacccaaggucccacagcuaggaaauggcaagcugggauugagccgugccagcuagccccgugcuaugcacugcuucacacagaagcugccccuccaccccugccgccuuccuuuuccuuuguuccuuuguuaucagcuggccguuuccagaaacgguugguuaaccucugccuaccucaacccucagugauuaaggggugauaucgggccucaaaugacugaccuuuuuccuuuguugcagcucucacugauuguaauucugauuguaauuauauauuuguuugcaccgugguuuacuuacuguccaucuuccccagggcaggaggcugaauggggcaggggucucgcugucucguuugcagcuccguccgcggcacuucacccacauccuggccuauaagcaaguccugcccauauauuugaccaauaaauaaaugaaucauugacagccgugccccaccccuuccuccucucucugccagccagcaccuuggucuuucacaguggguagagggcuugggcugcaggugaaauggauuugcaauucccugauaacccacccgccgacugugggagugggcaggaaggugucagcucuuccggaugaaaaaccagccugcaaugcaguguuucuacccagccuacaaagcaaacaccacuaccuccacgccuuagguuggagaaauuccgcuuuacgacacagucccaugggccucaugucauuugucccuccuggcagucccgggggauaggucgagcaagcaguaggacaaacgacucccauuuuccagguguaaaaacugaggcuuggaggugaagggacuugcccaaggucaucagcuagaauauagcagggcugggauuagaacccaggucuguccggguccacggucugaucugaacucggcuucaguuggucuggaaugcaccggcugcaucugaugaucuuauuaaagaucuguggcugucaggguccucccccuggaggugcugauuuaguuggucuggguuggggcccuaggcacuuggcacuuaacaaacuccuuaggugauuccaguggacaggcagggcugggaacuucaucaccccuccgagccccagagcggagccugauccuuagcccuggcuguguauuugaaucacuggaggagcuuuuuauuuagccuuuuaugauggaaacauaaaguagacagccuaggauaaugaacuaccaugagcucuuuuucuuuucuuuuuauuuauuuuugagacagggucucacuauuacccaggcuggagugcgauggcacaaucucagcuugcugcaaccucugccucccggguucaagccauucucgugccucagccucuugaguagcugggacuacaggcacgugccaccauguccggccaauuuuuauauuuuuuguagagacagggucuugccauguugcccagacuggucucgaacuccugaacucaaagcaguucucccgccucagccucccaaaguguugggguuacaagugugagccacugcgcccagcugccaugagcucuuuaccaugcauugcauaggugaacguuuuaauauguaucucugaaggacauggauuuguuuauuuuaaaugacuuuuuauuucgcaauaguuuggcucacaaaaaguugcaaaaauaacagaguuccuguuguucauugcucaacuuucucuaaugauaacaucugaaagauaagaauuuuaaaaacuguaacuguugggcugcaugugauggcucaugccuguaauuccagcacuuugggaagcugaggcaggaggaucacuuaagcccaggaguuugagaccagccugaucaauauagguagaccuugucuugacaaaaaacauguauaugugacuguaauacuaacuuuaauaauaauucauuauuaucaaauauuccaguaauccauuguguuuguacaauggcucauucuucuaugauaucauucuuuauguuuuagcugggauuuuuuuauggaaaagaguuuccccuucauuucuuugaucacugaucacucuguggugaucgaauaaaugacuguuuuccucagggaagccuucuccaacccuggugaaccaaaugaguacauuugggaaagguggagaaaauacuuguuucuuuccgcuuuuucugcguucaaacaaugaccugguucacugacaacaucagauguuucucuuuauuuccagcgucaauaugaaauuuguguacauaaacauguaaggcugggcgcaguggcucaagccuguaaucccaccacuuugggaagccacggugggcagaucacuugagucaggaguucgagaccagccuguucaccaacauggugaaaccccaucucuacuaaagauacaaacauuagcccagugugguggcugaugcuuguaaucccagcuacuuaggaggccgaggcgggaggaucacuugaacccaggaggcggaguuugcagugagccaagaucacgccacuggacuccagccugggcgacagagcaagacuccaucucaaaaaacaaaacaaaacaaaaaccuugcuugguauguuucagccuguuguacuuauucuccuugucaaagcucaaauugucccucuuuuagccugcagcggccacuucugcuuggcucuugagccuuuuaacaauccuguucaugcuuaguuuccuuguuguccggugugacaagauguucuuggcuuaccuugcauauuuccugcccagccacuuuuccaagaaaaaucuggaaguuuaaaacaaaaacaaagcuucagugccccagucgcacccagaaccagcuuaaucagauugccuggugcggguagggcccggauacaguauuuuuuuaaauuuuauuuuuauuuuguuugagacagggucccuaggcuggaguguaguggcacgaucucagcuuacugcaaccuccgccucauggauucaagcaauucugccucagccucccgaguagcugagcuugcaggcacccaccaccacauccagcuaauuuuuuguauuuuugguagagacgagguuucaucauguugccuaggcuggucucgaacuccugaccacaagugaucugcccgccuuggccucccaaaguacugggauuacaggcaugagccaccacacccagccaggauacaguauuuuuuaaaaagcacgcccagccuugaauggaaaaccacuggacgagaguaugccaccuuaucgggcucuguaaaugccuuauaucugcacaaggcuggaacuuugaguggaguccuuggcuaaagcuuucauuacugccuggugaccucucuucccucugcugcuaaagcuuguguuucagaauuuagacccggaugcauccauguugaaagccaggcuuugucugucaucccaggagcucuguaucggucccuuuccuugccugcauguuguugacuuggggcucaucuucauuucucugggaaaugaguucuuugauagcuugcuuagaaucucucaguacuucccauugcccuuagaaugaagaccaaaauauguggccugcaguguagacugugcacagccuccaguguagacuacucaggccccuucuugguuccuggagucuaccaugcuuucuucuaccaccgggccuuugcacacacugcugucuguugggaaugcguugccuuuccuuguuacuuaguucucaucuacucacccuucaggugccagcuugacugucugccucgggggcgccuucucugaccuucguacaccagaucagcccccaugcacuuacuuugucucauugguaauauuucucucccuucaggacacacaucaaggcccagaaguuguaguuuugcauuuguucaugugaucauuugaugcaugucucucucuggagccugacucuuuggggcucacauccucacuccaccgcuuuuagcugugggaccuugaacaaaucuuuucaucucugguccccaguuuuuaaguuaaauuaaauuuuauuuuauuuuuauuuugagacacucuugcucuguugccaggcuguagugcagucguucgaucauggcucacugcaaccuccgccuccuggguucaagcgauucucuugccucagccucccaaguagcuggaacuacaggcgccugccaccacauccagcuaauuuuuguauuuuuaggagagacaggguuucaccauguuggcuaggauggucucgaucucuugaccucaugaucugccugccucggucuccgaaagugcugggauuacaggcccaguuucuuuuaacugcaaaacagggaugauauaauacuuuuauuuaucuugugaggugaggaugaagauuaaauaagguaguuuguguaaagcacuuagaaaagagcuagcuacuaauaguagagaaucuuggcagguauuacugaugauuacugcaguagaccacaagcuccauacaggcaggggucauuucuguuuguuuagauuuguaugcagggugcuuggcacaaggguugugcucaggaaauacuuguuggaugaacgaaugaaugaaguggagauaauaguaauaccauguuuauagaauuccaugaggauauaaaauaaugcaaguauauaagcucuugguagagugucuagcacauaguagauggucaauaaauauucagugacugaaugaguaaaguggggacaauaguaauacccgcucaugagguugucguggggauauaaggcaacccuguaguaccuuguagaaugccuagcacauaguaggugcucagaaaauauuuguugaaugaaugagugaaguagggaugacguuaacaccaacuccuaggguuguuguggggauagaagacaaggcaggucuauagcauguuguauugugguugcacaugguagacacuccguugauugaaacuggaagagcugccaugaauuucuuucuccuggcuauuaggagaggguccuuuuggggugcagaaugguguggagcugacgcuaguccucuggaaggaagagugagcagcugacuacuugcuaagcucugaccuggaugaaaagucaaaucauuccuuucccucuuccucccaaaccugugcuuucuuuccacuagaaucccugcccagaguccagcgcuuccuuccugucgaggaucaccuucugguggaucacaggguaaggccaggccccccagaccucagggaggugguggggagugaaugaaugaaugaaugaacgaaugaacaugcucagcucccccuccccaacuucucccuccuuugcucuucugcagaguugucuugaaucugccugugcuggccauguggucucagagacaccaacucuguccggcaguuccgugaacuugaaugugauaaacacgugagccgugagcagcugacaccucugcagaaggcuuugccugggacagccauaugcuggacugcuuuugcuuuagcuucagauuuggguuuuuaaaauauuagguauaguuauuauugacauugucccccuccugucccccacgccuuagaaaaauaauacugucucaccacaggaaguguggguuaaaaaaccacaugugcagaucagcagugcaggagacaucuagagguaaccagugucaccauuuuaguaugccuucuucuggucgucuuucuuuuuuuuuugagacggagucuuacucugucagucucagcucacuacaagucuccgccucccagguucaagcgauucuccugccucagccucccagguagcugggauuacaggcuugcgccaccaugcccggcuacuuuuuguauuuuuaguagagacagaguuuugccauguuggccaggcuugucuugaaacuccugaccucaggugauccacccgcaucgacuucccaaagugcugggauuacaggugugagccaccaugcccagcuaccuucugguccucuuuuuguauaucuuuuucugcccguuguuaacaucuuaguggggauuguuugaagaaucuuuuuuugccccuaauaagcaucaucuuuuuuuuuuuuuuuuuuuuuugagacaggcuuucgcucugucgcugaggcuggagugcagcggcacacuuguagcucacugcagucccaaucuacugggcuuaggugaugcuccugccucagccuccugaguagcuggggcuacaggcacacucccccaugcccagcagauuuuuguacuuucuguagagaugggguuucaucauguugcccaggcuggucuccagcuucugagcucaagugauucucccgccucagccuccagagugcugggauuacaggcgugaaccaccaugcccggucucauccuugucuuaaugacaaacaucguuuuaaaaaauuagauguuuuaaauaauuucuucaaguuacuauuaaaaagcaucacugggacaguugauguaauuuguucaugacuacaggaccccggaugcaugcuaauaacauucauucuuguuuuggaaaauugugcucuaguuacauaagagcauguccuggauuggaagagaauaccuccaguuuuucuuggguaaaggcauguagaggcuguauguuaacuuuuuuuuuuuuuuuuuuuuuuuuugagauggagucuugcucugucauccagggugcagugcaguggcaggaccucagcucucugcaaccucugcuuccuggguucaagagauucuccugucucagccuccugaguagcugggauuacagggaccugccaccacauccagcuaauuuuuguauuuuuaguagagauggaguuucacuguguuguccaggcuggucucaaacuccugacuucaggugauccacccacgucagccucccaaggugcugagauuacaggugugagccaccaugccagcccuuuaacuguuuaagugguucagaaaaagaugauguguuugcauguguguguguguuugugugugcaugucaauggauacagacagagaaugauacugcaaacguggcaacguguuaacaauggugaguugagugaauucuuaguaugauuugaguaauuuuucuauaaguuugaaauuauuuuagaacaaaacaugaaaguauuuuaccuuuuauuauaaaaguguuuagucugcugggcacgguggcucaugccuguaauguuagcacuuucagaggccaagguggguggaucaccugaggucaggaguucgagaccagccuggccuacauggugaaacccugucuccacuaacaauacaaaaauuagccgggcagcacacgccuguaaucccagcuacuugggagggugaggcaggagaauugcuagaauacaggaggcagagguugcagugcacugagauggcgccauuacacuccagccuggauggagugacauagaaagauuaauauaauaaaacucaauaaucucaucacccagauuucaugcuuacuaaugcuuugucaugucagccuuuuuauuuuuuaauuuuuuccuucagccuauuuuuuuuuuuuucuuuuuauagggucugacucuguugcccaggcuggagugcagugacacaaugacggcucuuugcagccuccaccuccuggccuugagcaauccugccaccucagccucccgaguagcugggacuacaggugcgagccaucaugacuggcuaauuuuuuuauuuuuacuuuucguagagauagucucccuauguuguccaggcuggucuugaacuccagggcucacaaaauccucccaccucggccucccagagcgcuaggauuauagacaugagcuaccgugccuggcccauaucagccuuuuuuaauuuaaaauuuuaaaaaguuggcggggcacgguggcuuaugccuauaauuccaagacuucgggaggccaaggugggaggguugcuugagcccggggguucaagaccagcuugggcaacauagggagacucuugucucuacaaaaauaaaaaauaaaaaaaaaauuagccagucauaauggcuuacacccaaagucccagcuacucgggagguugagaugggagaaccacucuagaccgggagcuggaggcugcagggagcugcgaucgcaccacuguacuccauccugggugacacagcgagacccucucuccaaguaaauaaaugaaugaacgaauaauaaaaaauaaaaaagagcuauccugauacuucgcuccuaaaucaucuuuuuuucccuaagucuuuuguaugcaccacuaaaaaaaaaaaaagccauuuuuccugcaugacccaacagaaugagcuguaauuagcuuguaauauaugcaaauguccaucugcauucugacuucccaagcugcauggcugccuucauuugcagcgggcagcugugcugcagaggggagcagcaucagcaggcguguggagugagugagccccguccucccccuccuccugucauugacucucauugccuaacccccuugugucuuggccccagguugauuguccggggcuaccgccagccccuggagggcagugaccucugguccuuaaacaaggaggacacgucggaacaagucgugccuguuuugguaaagaacuggaagaaggaaugcgccaagacuaggaaguaagugugaguuuccuuguccuccaggaugcccuggucaccuccuuuccacuccuguggccucaauccaggauggggcccuggcagugcugccuguuacuagcuuugugguucugggcaagaugccucacuucuccuccuggccucaguuugcuuuucugccaaaugggguaggaucucacaugucauuaaagcaacugggcagagaaaagaagaaagaagcugggugcgguggcucucgugucuaaucccagcacuuugggaggccaaggcaggcggaucacuuggucgggaguuugagaccagccuggccaacauggugaaacccugucucuacuaaaaauacaaaaauuagcuaggcaugguggcaggcgccuguaaucauagcuacucaggaggcugacaggagaaucacuugaacccaggaggcggagguugcagugagcugagauugugccacugcauacuagccugggagacagagugagacuccgucucaaaaaaaaaaaaagaagaaaaauguuguccaaacaggcaguugaugcugucugccauggcgcgugacuaucccuccuugagucagucucacuuuuuucugucucuuucugagcaucuggcauccugcauguucuugcuguuugaauguucuguccaacaugcccagcugaccacguaagucuguuuagccaaagaagccccauuugagggugauuuuggcuguacuggauuuuaggcucuacccccuauguaaggcgugccccacugcaccaccucugucacucuucgggaaucaggccagugccuccccugcacauaccuuaacucaucaaaucugagacaccauuaguugcgugaugcguuauuauucuauguaacaguaagaaagaaaagcagcugccaauuaaacaaggacauaagacuugucucgagcccggacgaacuggaacaugaaauugugggugacaugggggcaguggauugcggccauggggguaguagaauggcuguuuuuguuccuguugccuguucugggguaaguuuacuacgauaaacugugguggggccaguguggugcauuggauuccccacagacccauuggccuuacagggaaaaaccccagaccgggguucuguuccucauucuauuccggggaugcccaggauacaggccuucagucagacccagauggugggugggaaucuggacauccaugugccagccacuaggacaucagcagaggaccucgugacuccggucggaggcuguuugggugguccaggugaugggagaaauugucucgugggaggcagauagagcuugggccucugugacugagcauuguaaggaaauggcccauguccaugacccaguugaagguuuuuggcaggcaaagguggggucccuguuuauuacaguucuucauggagacagaacuaguaggauggauggauggauggauagaugauagauagauggaugauagauugauagaugauagguagaugauagacggauaguugguggauguauacaugguagguagauggauagaugauagauagauggaugauugauagaugauggauggauggauggauggaggaugagaggggaucuacuagggaaacuggaucaugugauuauggaggcugagaagucccacccuaggucaucugcaaccuggagaacccaggaagcugguagcauggcucaggccuaguccaaaagucucagacccagggaagcugaugguggaauucucaguccauagucaaaggccugagaaccuggagucauuggguaagucccagaggccagaaauccuggaguucugauguucaagggugggagaggaugacauccuggcugcagaagagagagugccugcauuugccauuacucugacuuuuuguuguguccggacccucugcugauugggcggugccacccacauggggcgaggauggaucuuccuuagucaguccacucauucaaaugccagucucgucuggaaacauccucacagacacacccagaaauaacacuuuaacagcaaucuggguaucccuuaacccagucaacuugaccccuaacaucacccaucucaucuggauuccuucagccucaccugcagcaucccccccgcuaagcaggccacauuuguagugugggcuucagcauuccucaucauccacgccucugcugaucaccuggcucggcuuccucucauggaagacggaugcccaccuuuguguccccuggagcuugucaggagagcagguugcuggagacaccaugggagaggccaauaucacagccuugggaggaggacagaguuugaauccagaagcuccuccacuggccuggcucuuaauccacugagcagaugaaacugacugcugcuuuugugcuuagcgacguuuagucccugaggguucagagaguggaacaaaagagacacacucuaguugggugccaucgacauucuauaugggagacaggacguugguugugaaacaugcauugacaagaagcuuuggagaaugaugguguuggggugagauaaaaaugaggaaaugagggugagaguaaccgaggaagcuuuuguguguguguguguguguguguguauguauguguguguguguguguguguguuuucuuuuuuuuuuuuuuuuuuugagauggagucucauucuguuacccaggguggaauacaguagugugaucucggcucacugcaaccucugccucucggguucaagcaauucuucugccccggucucccaaagugcugggauuacaggugcaugccaccacgccugacuaauuuuuuguauuuuuaguagagacgggguuucaccauguuggccaggcuggucuuaaacuucuaaucucaagugauccuccugccuuggccucccaaagugcugggauuacaggcaugagcuacuguguccggcugagagagguguuuuagauacaguggucaaagguucuacccaguguggccaugacccuuggugagcaugugccugucccucccuaagucuaucucuggcuguuuucgagccucuggcauccugaguguuacugcuuuuugaaguguuuuuguucaacaugcccagcugaccauguaugauuguuuugagaaggucacauuugagcagagacuugcauuggagggagugagccuuguguguaucuggggaaggaagggcuuuccagguagagggagcagccagugcaaaggcucugaggacacucguggugcaucagggggcuuguguggcuugaggaaagugagugagggggagaaagggaggagaugaagcaggagaaggauuugcaggggucuccucugagaguuaaggugggauuccaggugcagugagaacacaggcgcagguuuucugcagggcaguggugugacgugaguucuguuguuuguuuguuuguuuguauguauguauguauguauguauguauguauguauguauguauuuuagagacagggucuugcucuguugcucaggcuggauggcaguggcaugauaacagcucauugcagccuggaaauuccgggcucaagcaguccucccaccucauccucccagaguagcugggauuacaggugcacaccaccaugccuggcugaugaauuaauuaauuaauuuuauauuuuauauuuguuuuuuugagauggaauuuugcucuuguugcuuaggcuggagugcaguggugcugucuuggcucacugcaaccuccaccccccggguucaagcgauuuuccugccucagccuccggaguagcugggauuacaggaauguaccaccaugcccggcuaauuguguauuuuuaguagagaugggguuucuccauguuggucagucuagugucaaacuccugacaucaggugaucugccugccucggccucccaaagugcugggauuacaggugugagccacugcgccuggccuuuuuaaauuuauuuuauuuuauuauuauuauacuuuaaguuuuaggguacaugugcacaaugugcagguuaguuacauauguauagagacaggucucacuguguugcccaggcuggucuccaagucuuggcuucaagcaguccuccugccucagccucccaaauagcugggauuacaggugugagccaccacacccagcugaguucugguucauaacaacccaggcuguccuggggaagguggauauuuagggacaagagugaaggcagggagaccagggugggaaccucaagggcuguccaugaagucccuucaugccucaccgggagccgccauuguauuuauuuauuuauuuuuugagacagggugucacucuuuuguccaggcuggagugcaguggcacgaucucggcucacugcaaccuccaucuccuaggcuggagugauccucccaccucagcuucccuaguagcugggacuacaggcacgugccaccacaccuggcuaauuuuuuuuuuuuuuuuuuguagagaugauaucucgccauguugcccaggcuguucucaagcuccugagcucaagcaguccaccuaccuuggucucccaaagugcugguauuacaggcgugagccacugugccugacuggagccuccauuuuucacccagagcauuuucugagaauucagugagauauaugauaugauaagcugugcccuagcccugaguacaugcugggcagguuuuaauuguacaaguuuuauuuauucaucuguacacuuugaucuugccagggaggauguggugagaacugggucuuggggcuugaaagcgggccaccugagaagggucuggcucugugaguaccuugguguuuagagauccucagcguggagccaggggaucauuuacuugggacauugguagacggaucgcuugcuuuauucccagaggcauaagccagaucuggcaccuguaaccccugugaaccuggagagagugagaaggaaaacccuguccuaggcuggaauuuccugguguggccccuuacacucagaucccuuuuguuaaccagagaaaggaaugcagcucgugcagcucugggcugcuggguauccuaggcucggggaucaggugauggacgccagggcugggggcucugcauggcuuccuggauccuuuuaccaccucucuucacccaugagugacuccuucucaaaagucagguguggcugggcaugguggcucaugccuguaauugcaguacguugggaggcugaggcgggaggcucaccugaguucaugaguucgagaccagccuggccaacauggugaaucccugucucugcuaaaaauacaaaaauuagccgggugugguggcgcucaccuguaauccagcuacaggggggcugaagcaugagaauugcuugaauuguuuggauuuaaaaacccagugcuucauugguuuguguguagugguuuuauguucucuuuuguguauggccacucagagcuuagggccauuuuggacugugguuucugcuggcaugaaugugaaaugcuucugugacucuggaagaguuuggcaguuuuuuuuuuuuuuuuuuuuaaguuagacacagugaacauaccaccagucacccccuucccaggcauccagccaacagagcugagaacauauguucauaaaaggcugguacaggaauguucuuagcuacuuugugauaacccaaacuggagguaagccagacaucuauuagcaagugaacagacagaugcaccaguuauguacaucugcacaacugaauacuaagugauguacaagaacgaacuauuggccgggcacaguggcucaugcccauaaucucagcacuuugggggcccaaggcaggcagaucacuugaggucaggaguucaagaccagcuuggcuaacauggugaaacccugucucuacuaaaaacauaaaaauuagcugggugugguagcgcacaccuguaaucccagcuacucgggaggcugaggcaggagaaucgcuugaacgcaggaggcggagguugcagggagucaggaucgcaccauugcacuccagccugugugauagagcaagacuccaucucaaaaaaaaaaaaaaaaaucccuauaagauaaagacuacuuuuuuggugacagcuuuauugagauauucauacaccgcacaauucauguaugcagaacauacaauucacugauuuuuaguguguucacagaguugugcagucaucaucacagucaauuuuauuuauuugcuuuuuaagacagagucuugcuguggcgcugaggcuggagugcaguggcacaaccucggcucauugcaacccccuccuccuccugaguucaagcgauucuccuuucucacccucccaaguagcugggauuacaggcaaccgccaccaugccuggcuaauuuuuuauauuuuuaguagagacaagguuuugccauguuggucaggguguucucaaacuccugaccucaagugauccacccgccucgaccucccgaagugcuggcauuacaggcaugaaccacugcacccagucaaaaaaaaaauuuuuuuuuagaaauagggucuugcuguguugcucuggcuggcuggacuguuuuuuuuuuuuuuuuuuuuuccacugauguauauaugccuaucccuuuaccugucuugaugauuguuguucuuuuuuuuguuuuguuuuuuucuuuuugagacugagucuuuuugcccaggcuggagugcaaugguguggucucagcucaccacaaccuccgccuccuggguuuaagcgauucuccugccucagccucccaaguagcugggauuauagguaugugccaccaugccgggcugauuuuguauuuuuaguagagaugagguuucuccauguuuggucaggcuggucuugaaccugccgaccucaggugaucugcccaccucggccucccauagugcugggauuacaggcgugagccacugcgcccagccuauuguuguucuuucuuuuugagauggaguuuugcucugucacccaggcuggagugcaauggccugaucuccacucacagcaaccuccaccucccagguucaaguaauucuccugccucagccucccaaguagcugggauuacaggcaccugccaucaugcccggcuaauuuuuguauuuuuaguagagaugggguuucacuauguuggucaggcuggucucaaacuccugaccccaagugauccagccaccuuggccucccaaagugcugggauuacaggugugaaccaccacuccuggccaugauuguuauuuuguauuguuuugaaaucaggaagugugaauccuccaacuugauucuuauuuuucaugauuguuuugacuguucuggauccuugaguuuccaugugaauuuuaaaguuagcucauaauuucuaccuggcagccagcugggcuuuugauggggauugccuugacucuagaucaguuuggagccaucaguuuucuaagucuuuaacuuauucaacucguuuaaucuuaccuaccuuggagguagguccuacuuuuauccucauuucacagaggaggaaacugaggcccagagagcuuaaggaccuugucugaagucacgcagcuggccaguggccaagccagaccuugagccgguggcucuggagcccguggcucuggagcccguguuuguaaccacugugcugagcugccucuuucccugggcuuguugucuuugacucugccuucccugaagggugacauucccuggccaugucccugugguagggggcugcaucucuggcagaccccacaacggcuucaccuccuuguguuccaggcagccggugaagguuguguacuccuccaaggauccugcccagccgaaagagaguuccaagguggaugcgaaugaggagguggaggcuuugaucgucaaguccccacagaaggaguggaaccccucucuguuuaagguguuauacaagaccuuugggcccuacuuccucaugagcuucuucuucaaggccauccacgaccugaugauguuuuccgggccgcagaucuuaaaguaagaccccuucccucccaggugggcuccauuuucccuccuuggcuuugaucuuucaguugcaucagucauaacccuggggucaugcuguguccugaagugggcucauagccagaugucuccauuuuuacuuuagcuuuuuugaaaaaaauagagacagggucuugcuuuguuggucaggcuggucucgagcuccugacuucaagcgauccuccugccucggccucccaaagugcugggauugcagaugugagccauggucacugccuagcuuuacuuuaugcuuuacuuaauuaccauauuagugaagaccacaucguuugcaaguaacagaaacccacuaggcuccccuaaaacccaaauggggaggauauggcauugucuugggaaaccaagagcaaggaaaugccagcagaucucaugaaaaaacugcaaccaggguugggcgcaguggcucaugccuauaaucccagcacuuugagaggcugaggugggaagaucaccugaggucaggaggucaagaccagccuggccagcaugguaaaaccaucugcuaaaaauacaaaaauuagccgggcgugguggugcacgccuguaaucccagcuacucaggaggcugaggcauaaaaauugcuugaacccaggaggcagagguuacagcaagcugauugcaucacugaacucaaaccuuggcgacagagcaagacuuugucucaaaaaaaaaaaaaaaaaaaaaaagaauaaaaacaacaacaaaaaacugcaaccaggaacuggggagucagaaaggaaguugccucucuccuaccuggcucucugcugcucugugacucaggggcuacacaucccuucucuuuuccucccuaccucuuuaccucguguucccuaugcaauuccuuugggugacuugcuggugaugagauauagcuagagcaauuagugcacaaccccaaggcagaggccucuuuuaugagcaguuugggucaccugcacagccagaucaccacuguggacuuguuuuuccaucuaugaaauugaagugauagugucuagcucaucuggcucaggagaaaguugcagugccaacacugaagcucucuucccugcccccacgugucacaagucauuccaggcccucucuuugcuccuuugcagguugcucaucaaguucgugaaugacacgaaggccccagacuggcagggcuacuucuacaccgugcugcuguuugucacugccugccugcagacccucgugcugcaccaguacuuccacaucugcuucgucaguggcaugaggaucaagaccgcugucauuggggcugucuaucggaagguaggggacgcugugccauuggcauguggcccgacuuccacauccccuccugcagcccuggguuacucuggggccagcguggggauuuccagcccagcuucuggagcaguaggaugaggguagcuuccgugaccuuagguggcagggacagcacgcaucaggcauuguacguuaggaaagcugauuucaagggugggcguguagaugucuuuguguaucagcugugaguaauugaguuucuuagauggaucaguggcccuuguuguggggaaauccaaguuuggauccucauucugcuguuaacauucuguguuucagcuuguugucacucuuuuuuuuucguuuuuuugagaccaggucucacucucucccccagacuggagugcaguggcaugauauuggcucacugcaacuucugccuccugaguucaagcgauucuucugccucagccuccugaguagcggggacuacaggcgccugccaccacgaccggcuaauuuuuguauuuuuaguagagacaggguuucgccauguuggccaggcugaucuugaacugcugaccucaggugauccgccugccucagccucccaaagugcugggauuacaggcaugagccaccgcgcccagccuguugucacucuuaauuugaacugagcagguggcacauuccuugcaugguaagaguauguagcaggcauuuguguacauccaauuucaaaggaccuaaauuaccuucuugaucccuauaaauuuuuuuuuuuuuuugucucgaggucaaggaaacugcuuggcuccuagguuaggaagagacagucuugcagguacuugaugaacuagaggagugauucucaggccugucugugaauuagacucaccuggggagcuuaaacugaugcaggccaggcacuguagcucaugccuguaaucccagcagcuugggagaccaaggugggggaaucacuggaggcuuggaaguucaauaccagccuggucaauauagcaagacccuggcucugcagaaaauuuaaaaaaauuagccagguaugguggugcguaccuguagucccgucuacucaggagauugaguuaaaagaaucacuucagccccggaguuggaggcugcagugaguccugauagcaucccugcauuccggccugugugacagaaugagacccugucugaaaaaacaaaaaaacuuccugacaccuagguugcaccagaccagugaaauugcgauugcugugguggcacccaggugucauuguuuuuguuuuuuauuuauuuuuauguuuugagacagggucucgcucugucacccaggcuagagugcaguggcaugaucuuggcucacugcagccuccaccuccugggcucaaacgauccugccaccucagcccaccacguagcugggcccagaggcaugcaucaccacgccugcuaaugucuuaguguuuuuaaaacucacgaggugauagugugcaaucauguuugagggcuagggacauuuucccccaccagggcacguuuggcaauaucugggggcauuuucgguugucccaacugggggcgagggcauguagugggucgaggccagguauugcugcuaaaacuccuacagugcgcaggacagccccccaaagaauuaucuggcuccagaugucaagaaugccaaggauuagagacccuggcccacacccucaguccuucagugggaucugggaccaguagcacugacacagccuggaagcguagaaaugcagaaucccaggccacaccccagacuugcagaauccaaaacaacuccccccaccccccaccacuccccccagaaaaacccggccgcaugugugcacauuaaagcaugcgaagcccugguuucgaggacaccuagggucccuugccaacugaugaguucaagguugggaggcacugagcaccgcggauaagaaugugggcuuugagaugacacaggcguccugggcagacagauaggucgggaggggaggaggagagaucugcggcauuucugccccugagagucuccuuccucuccgugggucuggagggagagucaggccucuucagcugccacacucacccaccuucccucuccuuugucccacaggcccuggugaucaccaauucagccagaaaauccuccacggucggggagauugucaaccucaugucuguggacgcucagagguucauggacuuggccacguacauuaacaugaucuggucagccccccugcaagucauccuugcucucuaccuccuguggcugguguguguuuaacgccguuucccuuugcaugcagggagggacuucuacgugugggcagugggccgagggaguggguguugaugguaauggcauguagagcucccuggcaguuccggcugugguucauauuuuauuuuccagccuguuaaccaauuccucaguauuuuguuccuuuccugaauugucagguugauguucuccuugguggcauggcguuuucauuuucucuuuuccuugacagugucaguaauuaacuacccuacaauggacgacacaucauauuucuccccuugaauccucccaaacgcuaaccagacucacuuauucauuagucccuaauuaugguggucaaaauucucucaauugcaagggauauaaaucugucuuaaaguagccuaaguggccgguugcagaggcucacgccuguaaucccagcacuuugggaggccgaggcgggcagaucaccugagaucaggaguucgagaccagccucaacguggagaaaccccgucucuacuaaaaauacaaaaugagcugggcguggugguguaugccuguaaugccagcuaccugggaggcugagacaggagaauugcuugaaccuggaaggcggagguugcggugagccgagauugggccauugcacuccagccugggcaacaagagugaaacuccaauuccaaaaaaaaaaaaaaguagccuaaguaaauagagggaacuuuggggcugcauguaucucagaaaucuggggacuagcuucagguguggauugauccaggagaucaagcaauguugucaguacucaguuucacccacugcccuguuguccucugaguuaacaucauucucagugguacuucccuacauggcuccguagcuuugggcugauaacauccugauagauaaaggugccagagaaaagacaaggcagcauuucucugcacagccagagucagucucagagagcacucugauuagccuggcuugguccuauucacacccgugaaccaaucacuguggcccaggaggcagaguucucucauuggccagccugggucacauguccucucccauggcagaagagaugugauugacagcccuuccauguggagagggagaguucccaaaauaaaaugauaagcaaagaggcucauagcacaacacaugccuugugcuuugcuaccucuggaucuuugccacguaccuuuccuuccuucuuccuaauugaugaaagccugcucaucccccaaggcuguaacaaacacuacuuccauugauuuacccucccuucucaauuagauggacuucuucuuuugaauuuugagucccaauaacuuuaguauaggaacucaucuaauaauacuuucugaaauaguuuuuuuuguuuuguuuuuguuuugacauggagucgcgcucuguugcccaggcuggaguguggugugccaucuuggcucgcugcaaccucugccucccagcuucaagcaauucuccuaccucagucucccgaguagcugggacuacaggcuuacaccaccacgcccauuaaauuuucuuuuuuuuuuguauuuuuaguagagacaguguuugaucauguuggcuaggcugaucuugaacuccuggccucaggugaucuacccucuguggucucccaaaguguuggaauuacaggcgugagccaccgugcccagcccacucccugaaauaguuuuguuuuguuuuuuuugcaugcucaguguacugccuccucuuugaaggguaacauguuagcuacuugcagacauauagcagcugacuuuugugucuucuguggguacaaccccagcagggccugaugcauaaugggcacagcucaaauuauuaucuguuauugaaagagaagggcuggacgaaauggcucaugcuugugaucugaacacuuugggaggccaaggcggguggaucaucugaggccaggagagcagccuggccaacauggcaaaaccccgucucuacuaaaaauauaaacauuagucaggcauggugguguaugccuauaaucucaacuacuuggguggcugaggcaggagaauggccugaauccgggaggcggagguuguauugagcugaguuuguaccacugcauaccagcuugggcaacagagcgagacucugucucaaaaaaaagaaaaaggaagaagaaaaaauuacugguuuauuuggcuguaguuugguuuuuuuuuguacauuuguagagcagaaggugaguaaaguguuucuaauaauaaaacucagaaaaaacaccagaauuuaauugucuaauaggcuggguacagauauagguggcaugcgccuguaaucccugcacuuugggaggcugagguggaaggauugcuugaagccaggaguuugagaccagccugggcaacauagugagacccugucucuacaaaaaaaaaaaaaaaaaaaaaaaauuagcugggcaugguggugccuaccuguggucccagcuaccguggaggcugaggcaggaggauugcuugagccuaggagugcagaggcugcaguaagcuaggaucacaccacugcacuccuaccugggugacaaggcaagacccugucucuagaagaaaaaaaaaaucuaaauaaagugucuuuucaagcaggugucuuggggaguccacuuuuguaaaagugcuacuaugggaaaaauauuuuuggaacauuuguucuagaacugccuucaggauugguuuaugaaccguuaagaaaauugucuaacaucacguuuuguuuuagaugguaguugcuugagcucagcacuguugacacuuggggccagacaguucuuuguugugggggcugucuuuuuuuuuuguucuuguuauuguuuuuuuuguuuuuuuaagggacagagucuugcucuguugcccaggcuggagugcaguggugcgaucauagcucacugcagccuugaauucuuggccucaagcagucuucccacuuugucaucucaucuagcuggggacuacaggugcacgccaccaugccuggcuaaguuauuuauuuuuuuguagaaaugggggucuugcuguguugcccaggcuggucucgaacuucuacccucaagcuaucuuaccacuuuggccucccaaagugaugggauuacaggugucagucacugcaccuggccacaaggcuauaaguuaauacagcaaaauuagcaaggaauuaaggcacacauggggcgguguucaagagaagccaggugcaggcuuccaggaguccccagcagagucacagguucacuaauucucuggcaaccaugaugauuaugugugugaaauguugccaaccagggaagcuugguaggagcucaguuccuggguuuguauuaggggcaggucacauaagcagccuuugcuuggcacauaccaaaagucuagacucccagagggaaagcgguguucagcauaaaccauauuguuuguacaaacaguugaggcacacugagcuacucuacccaauucuguuaaugguggaaacccuguaaguaugcagacacuagccaagggcuaaacuuguaagcagccuucaagcaggaaaagcaaucagguggucguguucacacuuuucugcuuacuaccuuauuaccuuucuaaaaaucuaagcugggugugauggcucgcgccuguaaucccagcuacuugggaggcagaggugggaaagucgcuugagcccaugaguuugagaccagcuuaggcaacauagugagaccuugucucuacaaaaaaucaaaaaaauagcugggcaugguggugugaguguagucacagcuacuugggaggcugaguugggaggaucacuugagcccaggagaucgagagcaguuugaguaacauagugagaccuuguccuuacaaaaaaccaaaaaaauuagcugggcauggugaugugacuagucacagcuacuugggaggcugaauugggaggaucgcuggagcccaggaguuggagaccagccugggcaauguagcaagaccuaaugcuuaccuguagucccagcuacuuuggaggcugaaguaggaggaucacugaugcaaauagccacuguacugcagccugggcaacauagcgagaccucaucuccuaaaaaaaaaaaaauuagaauccugcaguuguaauuugcaaaacucauguggccccaagggcuugggagaaaggagcguggaccugcuuauucuucaagggauugggaggaccuggagagaugcucaggaaugaaaccacaggcucuuaacacccuauugugggguaaaaguaacacaccuugcccugaacuuggucagcagcauccacgugggauggaucaaccggggaagcuguuacgggcccuguuuucuucugucuggugagugaugaagagucuccuuuccuuccuuagaaucugggcccuuccguccuggcuggaguggcggugaugguccucauggugcccgucaaugcugugauggcgaugaagaccaagacguaucagguaaggcaugugucucugcgggcccccaagccgggcccuaggcagaggccucuccaugaggauuuuaguccaguuccuucugcucugucccugggguucucagccuugccugccaguuggacucacuuggggagccuuaacaaaugcugaugccccggcugcauaucugggauucugauucacuuauuguggguggggucuggacaucaagauguuuuaaagcuucccaggucauuauauugggcagccaagauugagagcuccugacacaugguuagaccuuguaggccggugacuggaaucagaaggucugugagccucugagaaaguccuuguuucccacggucuuguuuauuauguguaugugugacucagcuuucaagaguugaguacaaauuacccccuacuuuuuucccccuuauuagcucuuaccuuauaggauacaugcuguuaaucucuuuauuuaaauuaaaauaauuaauuucuaaaauggggccuugcuguguugcccaggcuggucucaaacuccugggcuuaagugauccuguugccucagccucucaaaguguugggauuacaggugugagccaucaugcccggcuuucagcuuuuuauuuuuggagauauuuuguauuuuaaaaaguuugaauacccaaguaauagagugauguuucuuauuauaaaaaaguccaaaucaagccgggcucaccccuguaauuucagcauuuugggaggccaagguggguggaucgccugagcuuaggaguucaagaccagccugggaaacauggugaaaccugucucuaccaaaaauggaaaaguuagcugcauguggugaugcgugccuguagucccagcuacuugggaggcugaagcaugaggaucaccugaacccaggaggucgaagcuguagugagccaugauugugccacugcacaacagagugagacccugucucaaaaaaaaaaaaaaaaaaaaaaaaaaaaaaaaaaaaaaaaguuuaaaucguacaaaaguacauaaauuaaaaggggauacccccuucccuacucucucaaccacugcaaauauauagaagcaaauccuucuacaacuuucuacguauguauauacagaccugauuaaugguauaguuugguuuguuuuuauauauguggguuuuuuuuuuuguuuguggagauggagucucacuuuguugcccaggcuagagugcagucguacgaucuuggcucacugcaaccucugccucccggguucaaguaguucuccugccucagccucccgagcagcugggauuacaggugcccaccaccacacccagcuaaucuuuguauuuuuaguagagaugaggcuuuaccacauuggccaggcuggucuugaacuccugaccucagaugauccacccgccucggccucccaaauugcugggauuacaggcaugagccaccaugccuggccauuauauauguuuugugugugugauauuauuaccauaucuguuuuuaccuaaaugggcccacguggcagcaugauuuuuguccuuuagcgcccugcuuuggggaccucucugugcugugccguauagcuucaauucauucuuccaacccggugccuuuuggucuauaauggagauggugcaguuuauuucuuugcucuucuguugauggauauuuauggugugcuguggaauuucaaaugggagcacuaggcugcacugacgauaccacagggagaugaguuucaggacaugggccuguuggaaggagaggccucacgugguaggguugggugggaugggugaggcaggggcuuuaggauugagucacccuucagucucuugauguguaggaugcccugaguggcccgacucaacccauuucagucccuggccuccagaucauguagcuuauauucuucccaucugugacccggggaugacuguagcacuaaaugauaagaguucuugugauuguuaagugucugaauacauguaaaaugcuuagaaaaguugcugggauacacaaaauccugggugguaguaaaaguauuuaacaacugcacugcacaaguauccacuauuuggaaccagugcuagccaguacagaaacauuucacuauuuuaacaaccaugggccaggcacaggggcucaugucuguaaucccagcucuuugggagccugaggcaggagguuggcuuguggccaggagugcaagaccagccugagcaacauagcaaggugccaucucuacaagaaauacaaaaaugaacugggugugguggcauaugccuguggucccagauacuaaggaggcugaggugggaggaucgcuugagcccaggaauucaaggcugcagugagcuaugaucaugccacugcacuccagccuggaugccagagugagaugauguuuccaaaaaaaaagaaaacugggcugacaagaaauaagaaaacaggcugggugcgguggcucacaccuguaaucccagcacucugguaggccgagguuggaucacuugaagucaggaguucgaaaccagccuggccaacauggugaagccccgucucuacuaaaaauagaaaaauuagccaggcgugguggcaggcguuuauagucccagcuacucaggaggcugagguaggagaaucucuuuaacccgggaggcagagguugcagugagccaagaucgugcuacugcacuccagccugggcaagagagcgagacuccgucacaaaaaaaaaaagaaaaaauacgaaaacagagaagaaaaacaccaccaccaugucuccuguguuugggucagcagaguagggacugaaucccuucuuuucuguacaccugaaggguuuuucuugccucuguuccuggauucuaaauugaguauguuucuccaaugucuaaccuaacgugauuugaagggguuuuuuuuuucuugauagcgggguccuuugguguggucuuggggcucaagaguagggcuaguagggauuacagggucagcucucccacccucaggaggcccauuuuuaauagacggugaaguugaggcccagugcgguggcucacaccuguaaucccagcacaggaguuugagaccagccugggcagcauggugaaaccccaucucuauugaaaagaaaaaaaaaaaucaauauaaaaaacauuuacaugucaaaguauauaauaaaguuuaugagaaaaauagcuggugauguugagugaugggcugaucccagggucgccccagauguguugacugcccgucucuuccaagguggcccacaugaagagcaaagacaaucggaucaagcugaugaacgaaauucucaaugggaucaaagugcuaaagcuuuaugccugggagcuggcauucaaggacaaggugcuggccaucaggcaggaggagcugaaggugcugaagaagucugccuaccugucagccgugggcaccuucaccugggucugcacgcccuuucuggugagugaagccacauuuuuccuggcccucauuguuugauguuuuauuuucucugcguaccugaauauuuuuaaaaggucacuauguugcccaggugcaguggcucaugcuugguaaucccagcacucugggaggccaaagcagguggaucaccugaggucaggaguucaagaccagccuggccaacauggugaaacccagucucuacuaaaaauacaaaaaaauaagccgggugugguggcgcaugccuguagucccagcuacuagggaggcugaggcaagagaauuacuucaaccugggaggcgacgguuggagugggccaagaucacgccagugcacuccagccugggcgacagagcaagaccuugucucaaaaacaaacaaaaaagucacuaugucagcaaggccuucccugaacacuugguuuaaacauuugccaucuucuccauucuccuuuguuuuauucacacuuagcagcuucuagccaaccuguguaggaaccguucguuaucuauuuacugugauauaaggagcuugugccagaauguaaaccagugcccccugcuuccugcauuaagauagccuugcaagacaaaaagugcgagcugagucgaacggcacgcuuggugccauaguugaucuacauuguggugcugcguccuuauuuugucaccaacuggucacaaaguguggauugucagugucucauaggccacaugucaaguggcauggucuaaacacacucuaaaauuuacuuauuuugggcugggugcgguggcuugugccuguaaucccagcccuuugggaguccaagguggguagaucacuugaggccaggagcucgagaccagccuggccaaccuggugaaacccuguuacugcuuaaaaaaaaaaaaaaaaaagaaagaaaaaaaaagcugggcaugguggugcaugccuauauucccagcuacucaggaggccgagacaugagaaucccuugaaccugggaggcugagguugcagugagccgagaucgagccacggcacuccagccugggcaacacagcaagacccugucucaaaaaaguaaaaaaaaaaaaaaauaaguaaaauaaaauguacuuauuuuauugucugcuuuucccccacuaggaugucagcuccagaugggcauuuuugucguuucucuugacugcuguauccucaguauauaaaacagugcauagcaggugcugaacaaauauugucauccauuguaaaaaaaaaaaaauacagaaagauauaaaaugaaaaguauauuguccucucuuccaucaguuccucccuucuaaagugacaguuucguguacgcuuuuagagaaaaauggacaagcauauagguauuuaaaaauacuuugacagauauaaauggaaucauacuguacauaguguucucuuuucuuugguuaacaauauauagucuugguucguucauucuggucuacuucauuuuaguuuuuugggggguuuuguuuugaaauggggucucgcucugucccccaggcuggaguacuguggugcgaucauagcucacugcagccuugaacuccugggcccaagcaauccuccugcuuuaguuuccuaaguagcugggacuccaggugcacugcuaccacucccagcuuguuucauuuguguucaugauggaugcuugucugacgugcagaugcgcccugcuggaauuacccuuucucccauuccuugcaaaaacagguuguucccuguuuuuuuugcuguuaugauccaugcuacacugaaaguucugguaccuguccugggguaugguaaugggucuaucccugccuagcuggcuuugaaaaguuuaaagacaacagugcaacuuacaauuugcaaaguuggccgcaaaucaggagaccauacagagauggacuuuggaaauucccuuuuuaagcacaguuaaaaacaguuaauggugaaggaugacuucagaucaugccccauguuuguuuuuucuuucugucuuuuuauuaacugugucauucuuuuuguaauguugugcucauuacaacuauuccuucuuggucagguuggcaaauuauauguuuuucuggcaaguuucugugaagcagaguuaaacauguuuaugaauaugaacuuuucuguuaaacuaccaucugcuucaucuuuguugaguuucagguggaaugucuaaggaagcuccagcuguuucagcauuugcgaaagcguguucaugcucccacugaauuuucuuagucuugccuuacuucucucagggucuggaacugcaggagagaugguguucaaauucaagccugcaucagaaucaccuggagagcuuguuauuauauuuuauuauuuauucauuuauugagaugaagucccagucugucacccagguuggauugcuauggcacuaucuuggcucacugcaaucucugccucccggguucaagcgauucuuccaccucagccucugaguagcugggauuacaggcaugcagcaaccaugcucagcuaauuuuuaaaauaucuuuaguguagagaugguguuucaccauguuggccaggcuggucucgaacuccugaccucaggagaucuacccgccuuggccuccgaaagugcugggauuacaggcaugagccacagugcuggcuguuagcuuguuacuauaaaacucagcuuucugggccccacccaaauuuucaguuuuaguaggucugguuggggccugaguauuugcuuuccuaacauaucccuaggugcugcugcuucugguucagguugacauguagagacaccggaguggauccucacugccuaaagucugguccguggaccagcagccauggcaucaccuggugcuuguuaacggugcagaauuucaggccucagcccagauccacugaaacggaaucugaguuguaacuaguucucuaggugguguguaugcacauuaaauuucgagagagacuggcagaaaguaggaguaaagaaacuuuuucuguaaauacuuucggaauuccgggccauacagucucugucacaaauaccagucucuuccagcguagugcaaaaacagccuuagauaauauggaaaucgauggguguggcuguguuccuguaaaaaaguauuuagagacaccaaaauuugaauuuuauagaauuugcaugugucauguaauauuguuuugauuuuuuuaacuuuuaaaaaauaugaaaucuggcugggcgcaggggcucaugccuguaaucucagcacuuugggaggccgaggcgggcggguugcuugaggcuagcagauugagaccagccuagccaacguggugaaaccccgucuauacuaaaaauacaaaaauuagcuggaagugguggugcgcaccuguggucauagcuacucgggaggcugaggcaggaggaucgcuucaacccaggaggcagaaguugcagugagccaagaucaugccacacacuccuggcugggcaacagagugagacccuuuccugcugcugcccccccacccccucccagccccccacaaaaaaaaauuagccaggugugguggagcaugcuggucauccaagcuuuuugggaggcugagguacgggaaucguuugaacccgggaggcggagaucgcagcgagcugaggucacgccacugcacucuaagccugggcaacagaacaagacucugucucaaaaaaaauaaaaaaaaugaaaucaaugcugagcucaugggccguauguaaacaggugugggccaaauguggaccugagccauccuuguuggccagccccuggcuuagaggacuggaauguucuucugagaaucaggacaccugccacauucuacugccagcucacagugugaccccaaagcuggucaucucaccucgcuggcucuagauuuugucacauggaaaaugaagggguuagauuccaagcaugucaaauacugggcccuguccuccuuccucaugcccacagcagacacccacagucacucaugggguucuuucccacugaguuauguucaagcagcccuccaggugacuggugccaguggccuagaguugagcaagaaaugacaucuuguugcccuucuguaacuccauguucccuaagaucacuuccagcuccaaugccccugcauucugccuuguacauugcauucuucuuacacuccaauaccuugacuuuaccggggugcguugaugaacucucucuuuuuuuguuuuuuuugggacugagucucacucugucacccaggcugaagugcaguggugccaucucagcucacugcaaccuccaucucccaguucaagcaauucuccugccucagucccccgacuagcugggauuacaaacaugcacuaccaugccuuguuaauuuuaauauuuuuaguagagauggguuuuugucauguucgccaggcuggucucgaacuccugaccucaagugaucuaccugccuugaucucccaacgugcugggauuacaagcgugagccaccgcgccuggacucuccuuuuuuuuugagaaggagucuugcucucucgccaggcuggagugcauuggcacgaucucagcucacugcaaucucugccucuuggguucaagcgauucuccugccucagccuccugaguagcugggauuacaggcgccuacuaccaugcccagcuaaguuuuguauuuuuaguagagacgggguuucaccaggguucaagcaauucuccugccucagcguccgaguagcugggaguacaggcgcacgccaccaugccaagccaauuuuuuguauuuuuaguagagaugggguuuagccguguuggccaggcuggucucaaacuccuggccucuagugguccacccaccucggccuccuaaagugcugggauuacaggugugagccgccaugcccggugggucuuacuuuauaaaguaggaaguaauguauuugcauauggugaaacauaauuaaagcugcaccagaugguauucauacagccggacuucgcacguggccaccucagccugcugacauucgccaacaggucauccuuugucccuguguuguagggccuggacugcacauugcaggauguuucccagcaucuguggccucuaccugccagaugcuaagucguaccucucccucuucuucccaguggugacaauagaaaauggcuccaggcauugcgaaguguccccuugggggacagaauucucccaguugagaaccacagucaauagugaaaggcccaagcccuuccuccuaacaccagucaccuugcuucccucucuccauguuucuuguguguuuuuccagaguccacgucuguaucacuguaaugguggauacaugucauacauguaguuaugguuacuugauucuguuuacuuuacuuuuauacaagugauaguaagagucauacauaaauacauacaaaauggcuuuuuuuuucuuuuuuucuuuuuuuuuuuuuuuuuuugagauggggucucacacugccgcccaagcuggagugcagugacaugaucuuggcucacugcaaccucugccucccaggcucaaguaauccuccaaccucagccucccaggcagcugggacuacaagcaugcaccaccaugcccagcuaauuucuguaauuuugcagagacagggucucacuuuguugcccaggauguuuucaaacuccugagcucgagcaguccgccugccucugucucccaaagugcugggauuguagguaugagccacugcaccuggccuugauggcauuuugaaaggucuugucucagaggaaaagauacaagccagagggcgcuggugaugagguuuggucugugccuugugucccgcuuaggaggggaugggcagcguguucucacagcuuuuugcucugcacauuggauucguuggcaaaacccacaguuuccaggcugucaccaaacuuugcuuaucacuuccugcccuguuccccauuaggaaaccacagcagaagaugcuuaagagcaggacuggcuuuucuucucuuuuuucuuucuuucuuucuuuuuuaaagagacagggucuuguuuugcuguccaggcuggaguacaguggcuugaucacagcucacugcaaccuccaacuccugagcuaaagcgauccuccugcuucagccucuggaguagcugggauuacagaugugaaauacugagcccggcuaccggcuuuacuuaaccuuuucuugagcuuucuugccauuuaguuucccggaguuuccagagacagaguuuguugagcuguuuggcaagaaacagaugggccugggugucagcuggggagaccuuguccuggccgaggcaucgaagccucugacuacauuaggauaaaauauguggccuuuaguuccccuggaaggugccugaguguuuuuuccacuggugugcauuccugugcuucaaagacgaugagguguuuacccagcgguaggugugauggaacacagaggccggggaaggccagggaugccauccagggacugaugggacuguuuuucuggaauggcaaaccuggcauuuaccacguccaccuaaugcacuuuccuaaaauagcaucgccaggcagccgucaauauuuaacauuuucugucuuggaugauuugugagcuucuugccuucuguuuacccugaaucucccuuuguuagaauaauucaucauucucuaugguaaugaucuguccuguaguucucugcugaucauauccuagggcccauggagacacugccacgaccaugucauuuuauuuauuuauauauuuauacauuucuguauuuuugagacggagucucauucugccgcccaggcuggagugcaguggcacaaucacagcucacugcaaccuccaccucccagguucagcugauucuccugccucagccucccgaagagcugggauuacaggugugcgccaccacaccuggcuaauuuuuugucuuuuuaguagagaugggguuucaccauguuggccaggcuggucucaaacuccugaccucaagugauccgcccaccucggccucccaaagugcugggauugcaggugugagcuaccaugcccagucagaccuugucauuuugugcuuguaccagcaaagcauagggaccuuggcaaauaguucaugcucuguaaauguauguagguaaaugaauaaauacaugaaugaaugagagguugaaauaaaucauauuaauuaggaacugucuugcaaauaacagaaaccuagcuuaaaucaacuagaguaagagaagagggggauuuuugagucacaaaacuaaaaagucuagaaaaagacuuuuaagcaugaaugggguuccaggcauggcuggaucuaggaguucccaagauaauguugggaauaacaacgucucugacucucagcucugcuuucuugauggugguuucuuuauuagcugguaguuuccugaucauccugucaccucagcaaccccugugaacagagagucuuacucuuuuccccuaauauuuccugcaaagcuaugggauugagucucauugguuguggucgaucacaugcuucuuccugagccagucacugaggccagggagauaggaugcuugggucagccagggcuaggucaugucuuucagggcuuggggccaagguagggggugagggaggagguucaucuguggcugaagcucauagguugacacugggagaaguucaguucccccagagaaaauugcauguugccauaaacagaguaauagaugccagguaggcaggaagagcagguaacugcacacagggcaucaggauuuuuagggagugggcuggaguguagggguuccauucauugguuuuccacguuucucagaaaaggcaccuaggggacaggugcuccucacuguguaugaagggcuuuugcacccuagacccucgccuauuacaaggcgaacuccagucuccugcugccuggagccccagucauugugcccguccuaccagccucuucggauuuccaaacacugccugcagggaaccuguuaaagccugugcuuccacuagacugugcgucucaggguugccaagcccaccucaguccccagcgcaugaugggugcucaguuaccaccugagggguggauggcuagaugaccuccuccuucuggagaagccaggaccauggaccugaaaggggccgcaugauguuguccuguccccucucugugugugcccugugcugccagcagccggcaucgauugguacuuggcucaccaagggggcugguacguuuugguggugagaugccugaggccugguuugcuucacugcugaagagacaccugugaugugcucuucugcccucaggcaaauucaccuaccccguccccacccauuuauccacucccacccauccauuaucuauccagcagacauucacugagcaccaugaucugggcucuguccuaggcucugacaauacagcagugcauacuacagguaauaaucuccagucauggaacauucauuuuucacggagagaaacagacaaggaaaaauaggcacaauaaauaaauccuagugcuagagaaagccauccuaagugcuauagaaagaaaagagucagaucuuuggaauaagggcggcuugcaguuuuaaguagggugguccaagcucacugagaaggugacacuugaggaaagacuugauggagguaaagaggccaaccagggaguagcaagagcaugugcaaaggcccuggggcauuacugugcccauucauaggugggauaaccauggaggcugaaacagugggagugaggggagagugacagaugacgccaaaugagguacagggaagggacuuuacaaaucagcugggccuugggaucugagucagcacuuugacuucuacacugaaaaauagguugacuuuggagagguacuuuuuuaaaaauuacuuguuuagagaugggggccucacucuguuacccaggcuggugcgggggcacaguaauagcucacugcagccucgaccuccugggcucaaaugauucuccugccucagccucccuaguagcuaggacuacaggugcaugccacuaugcuugacuuauuuauuaauauuauuguuguuuugagacggagucuugcucuguugcacacgcuggggugcaguggugcaaucuuggcucacugcaaccuccaccucccggguuaaagugauucuccuacuucagccucccuaguagcugggacuacaggcacaugccaccacacccggcuaauuuuuguauuuuuaguagagacaggguuuugcccugucagacaggcuggucuugaacuccugacuucaggagauccaccugccuuggccucccaacaugcugggauuacaggcaugagccauugagcccagccaccuggcuuauuuuuuaaaaaauuuuguagagacacagccuugcuuuuuugcccuggcucugcucgaacuucuggccucaagugauccucccuccucggccuugcaaagcauuuggauuacaggcaugggcuaccaugccgaucgaaauguauuuuuuuaacggagguauaauucaccauuuaaaagugugcaauucagugguuuuuuugugugaugugugguggugugaaggucacccaguggguuuuuuguauaaaugauaaugacaaucaccacuaauuccaggacguuuucauuaccccaaaaggaagcccuguaccuguuaccaguugcuccccaaaucuuccauuccauuccaggcaaccaguaaucugcuuucugucugucucuguuuaucuacuguggacuuuucauauaaauggaaucaaacaacagguggccuuuucugacuguuuucuuuuuuuuugagacgaagugucucccuuguugcccaccugaagcgcaauggcaugaccuugccucacuacaacguuugccuccuagguucaagcgauucuccugccucagccuacugaguagcugggauuauaggcaugcaccaccacuccuggcuaauuguguauuuuuaguagagacggaguuucuccauguuggucaggcuggucuggaacucccgaccucaagugauccgcccgccucagccucccgaagugcugggauuucaggugugagccaccccgccuggccaucugacugguuucuuagcaugauguuuucaagguuuauccauguuuuagcauguauaagaauuucacuccuuuuuaugguugagaagucuaucauguagauacauguagacccuuucgaguaaagaauaucucugggcugggcaugguggcucauaccuguaaucccagcauuuugggaggccgaggcagacggaucacuugaggccaggagcucaagaccagccugaccaacauggcgaaaccccaucucuacuaagaaaaauacaaaaagauuagcugggcaugguggugggcgccuauaaucccagcuacuuggagacugaggcaugagaaucguuugaccuugggaggcagagguugcggugaacugcgaucgcaccacugcacuccaucuugugcaaaagaaugagacugugucucaaaaaaaaaaaaaguaucuuuagguaagaugccaguguugcguuaccgcuuagaagaugggagccaggaugggugcaguggcucaugucuguaaucccagcacuuuagguggccgaggcaggcagauggccugagcccagguguucgagaacagccuaggaagcauagggagacccugucucuacaaaaauaaaaaaacuagccgggcauggugguaugcgccuguaguccuagcuacucgggaggcugaggugggaggaaugcuugagcccgggaggucgaggcuguggugagccaugauugcaccacugcacccagggaucaugcgucccugucguuucgagcaccuugccucccucuugacaucggagccuggaaaauuucugugccauggcucagcgucaucugucuuguuaaugucagagccagaacacgaaccagcucuggcuucccgugggaccgggcucucgcuugugugaccacguuaauagauuccuuggaagaaugaucuaaggaauuuggaccaaaucuuccaacaagaaauaaaaacagcugccaucuguugaguuuuacugugcuugggcccugugcaaauaaacacccuacauaagugccaacagcccuuaaaagccuaucaugacuuccauuuuauagaugagaaaauaggggcuugccuggagaggugaaauaacucaaccagggucccacagcggaaauauggcaaaguguaugguuuuuauuuuuaagcuguaugaccuuccaggaaguaacaaugaaauggcagugcugagacccugaaaauacaugggccgauggccagauggcagggcuauuuggguaaagugggagagacagcucccuugaauggugagagggaggagucagguggcccccuggauggaagaugguuucaggcagaggaaacgucaggggcaaaggccuggcuuggggauugugcuuggugcuuuugaggaauacuaagaaugccccucuaggacaucucugagaaaguugaugggagaggccggcucuuugggcucccggucguugauuuauccaguucauucccagaguguuuagugagcaccugccaugugccagauacugccccagguuuuuccacgagcuccagcagcuggucaguuguggccaccuggggagggcccaagcgcgucuccagggccugucacugcuccuaggaugaugacucucacucggggcacagcagucagcacugggcguucugcuugcagguggccuugugcacauuugccgucuacgugaccauugacgagaacaacauccuggaugcccagacagccuucgugucuuuggccuuguucaacauccuccgguuuccccugaacauucuccccauggucaucagcagcaucgugcagguacagggggaagcuggggcgacuuccgagagggggccuugggguucuaggccacgaaagcauggaagugcccccgagcgcagccucuagaucacacucccggucgggcuccaugaggcccggacaaaggcugccaugcuuucgucuggucaugccugaaagaaagaaaacacauuugacuucuugacagagaacucgcacuugaguauaugaaucaaguuuaaugcagcagggcuuucccaugcucuggaagaaucuuuccgaaauacucuguucucuucagccuguuccuccgccauuccuauccuuuuuuuaaaaaacguagcucuugucugacuugauugauuuuacaacccacugauaggucuugaccacccacgcuuugagaaaccccaaccuuacagccgggcgcggcggcucaugccuguauucccaccauuuugggaggcugaggcggguagaucaccugaggucaagaguucgagaccagccuggccaacauagugcaaccucaucucuacuaaaaauacaaaaauuagccaggugugguggcgggucccuguaaucccagcuacucggaaggcugaggcaggagaauugcuugagcccaggaggaagagguugcagugagccaagaucgugccauugcauuccagucugggugacacagcaaaaacuccgucucaaaauuaaaaaaaaaaaaaagaaaaaccccaaccuuacggccgggcaugaugguacaugccuguaaucccagcacuuugggaggccaaggcagguggaucucuuaagcccaggaguuugagacuagccugggcaauaugguaaaacccuguauguaaaaaaaaauaaaauaaaauaaaauaaaaauaaauaaauaaauaaauaaauaaauaaauaaauaaauaaauauguuugaaaauuagccaggcaugguggugugccccuguacucccagcgacucagaaggcuggggugggaggaucagcugagcuugggaaguugaggcugcagugagucauagucucaccacuacacuccagccugggugaagggaguaagacccuguuuuuuuuuguuuuuuguuuuuauuuuuuagaaacaauguagaccauguagaaucucuaaaauuccugccauugacuguguaaggagggguggcuuucuguuuugucacacuugggcacuacuggaagcuccugucacuuuucugcacuguuuucacauucuuuuuccgagcauugcgaacaucccuuuugaaaacuccauuuuaacuacauaggcaaaucaaccguaaaauuugguaguacaaggcugauagcaggcuuugucaaaaacaaaaaaauccauuuuauuaugaaaaaugucaaguguacacagaaguagaauagcuuaaaguuuguaaacuggcauuaaaagaaaaagaaaaagaaaaaaaaagccaagcaugauggcucacaccugcaaucccagcauuuugggagaccaaggcagacagaucagcugaggucaggaguucgagaccagccuggccaacauggggaaaccuugucucuacuaaaaauacaaaaauuagccagauguauugguuggugccuguaaucccagcuaaucuggaggcugagacacgagaaucgcuugaaccugggagguggagguugccgagguugcagugagccgagauugugccacugcacuccagccugggcgacugagugagacucagucuccaagaaaggaaauaauacaacaugaaccccguguacacaucacucagauucaacaucggcauuuuuuggcugggcgcaguggcucacgccuguaaucccagcacugugggaggcugaggugguaggauugcuucagcccaggaguucaaaaucagccugggcaaugagacccuuaaucuacaaaaaauaacaaaauggguguggggugcaugccugcagugacuacaugggaggcugaggcagaaggaucgcuugagccuaggaguuugaggcugcagugaguuauguuugcaccacugcacuccagccugggcaacagagcaagacucugucucaaauaaagaaaccaagguugggcgcaguggcucaugccuguaaucccagcacucugggaggccgaggugggcggaucaugaggucaggagauggagaccauccuggcuaacacggugaaacccugucucugcuaaaaauauaaaaaaauuagccaggugugguggcaggugccuguagucccagcuacucgguuggcugaggcaggagaauguugugaacccgggagguggagcuugcagugagccgagauugcgccacugcacuccagccugggugacagagcgagacuccaucucaaaaacgaacaaaaaaacccaaaacauuuugccacaguugauuuaucucauucuuuuucaguaucccucccuugucccucuuucccuucauuuguuuuuaaugcuaaacucugcuaucuaucccuucauucuuuccuuucuuugccgaauaauuuuaaagcaaaucucagaccccuuacauucuacccacaaauauuucagcaugcauuucuuccuacauaauguaauaccaucaucaugucuaagcaaacuaacaauaaguuuuuacaauaauacucagcccauauccaaguuuucuggaauaucucagaaaugccugucccauugggcuguuugaauuggcucuguugcauuugcuguuacguuuccagagucccuuuuccaccaggccucugcccuuuucuucuuuuauuuuuauuuuuauuuauuuauuuuuugaaauggagccucacucugucacccaggcuggagugcaguggcaugaucuuggcucacugcgaccucugccuucccagguucaagugauucuucugccucagccucccgaguagcugggauugcaggugcgugccaccaugccaggcuaauuuuauguauuuuuuuuuuuuuuuuuagcugaggcgggguuucaccauguuggccaggcuggucucaaacuccugaccucaagugaucugccugccuuggccucccaaagugcugggauuacagguuugagcuaccgugcccagccauucgcccauuuuuucugaaauaccuuuugugggcuuuuaaaacaaagcagaaccaaaccuguuucuuuuuuuguuuuguuuaauucuaaaguauacacugguucuaagaaaugugggaccuucagaaauaagggagggugugugccccuccacaccuggggaaacccuugaaaguuaaccuugguugguuuugcaaaaaugcuuuuuaaaaauaacucuccccugccauugcucucuguacaggcgagugucucccucaaacgccugaggaucuuucucucccaugaggagcuggaaccugacagcaucgagcgacggccugucaaagacgguguguguguguucaguccuggcuucuggaaguggccgccuucccaucucccacuggguccucccuacuugcauuucuuucccuuggcugcccucagguuugacucugcccagccgcuugucugcgagaccccgggggacaaggguucugcagagccugcagaagggaagggaagccuggccuccugggcuucuguccugucucacacuucccaggagggugaacuugcacuugcauuuuuguuuucuugcugagggucagcagcugcuugaggcuuccccgugggagucacuuuccaaggcuuugaccuugauucuauucugggcuaaaugaggacucuggaggcuggccagccuccaucacccacaagcuguguagacuuaggucugagccucaguuuuaucuagauaagggaaacaaaaguaccuuucuuuggcugaguguuacuuggauuuuuuuuuuuuuuugagacagggucucauuccauuucccaggcuggagugcaguggugcagucacagcugucacugcagccuugauuucgugggcucaggugauccucugaccuuagccucccaaguagcuagaacuacaggcacacacagcaccauacuuggauaauauuuugguauguuuuguagagacaggguuucaccauguuguccaggccggucucgaacuccuuagcucaagcaauccaccugccucagccucccaaagugcugggcuuauaggcaugagccaguucuccuggccuuuuuuuuuuuuucaauauuaaauuguuuuauuuggagagacaaggucuugcuuuguuccucaaguuggucuugagcuccugggcucaaggaucccucugccucagccucccaaagugcugggaugacagaugugagccacugcaccuggccaugcauuuuuauuggcagguuuguuuguuuuguagcuuguuaauuuaucguuucccagcccaucccccugagccagggauguuguuuguaaccaucucucuaggcacuuaauaauaaauauuaggccgggcacaguggcucacgccuguaaucccagcacuuuggggagcugaggcagguggaucacuugaggucaggaguucgagaucagccuggccaacaaggugaaaccccgucucuacugaaaauacaaaaauuagcuggacaugguguugggcaccuguaaucccaacuacucgggaggcugaggcaggagaaucacuugaacccaggaggcggagguugcagugagccaagaucgcgccacugcacuccagccagggcaaagagugagacuucaucucaaaaaaaaaaaaaaaaauaauaauaauaaauauuaauggcacuaagugcagugacacguucacuuauaaagccucugucaugcacaugccauuccaaggaugucaaugucccaacuuguccauuacucaccaugguaccccuggaggagggugauggaaacccccauuuuccagaugaagaaacuggucucugaaacuugccugagauugcacagcugaucaaaagaagaaccagcauucacacccacagcccaucgguagaguccaugcucuuccuggccauaggguguugccucacugagauuuacugagcaccuacuaugugccaagcauugugagaagugcucugugugcacugccucauagacaccccaucacagcccucugaaguugauugcaugauugucagccuuauuuuacagaugaaaaagugaggcacaggcugggugcaguggcuccuaccuauaauccuaguacuuugggaggccaaggcuggaggauugcuugaggccaggaguuugagaccaccuuggguaauguagugagaccucgucucuacaaaaauuaaauucaccaggcaugguggugcaccuguaguccuaguuacuugagaggcugaggcaggaggauuggcugagcccgggaguucaaggcuauagugagcuaugaucaugccacuguacuccagccugggugucagagugagacccugucucaaaaaacaaacaaacaaaggcacagagaaguuaacuaacuugccuguggcuacccagguacgaagugguagccccaggauucaaacccauacagucuggcuccagaguccaaugucagaagauugaauguguguaaacgucgguuauaccgcgugagcugugucuggcaccucgcaggcgcucagguaucuuuaguggcaccuaaaacguuugacacguuugacacagcaccuggugcauagaagaugauaaacagauccugggaguugucacuucucuggucugagcgagauggucucagcaucuucagcucagcccccuggugugggguuuuuuauccugggcgcuacugacaucuggagacacauuguucuuugugguuggggacuguccugugcacugugggauguugagcagcaacccuggacucuacccauuagauacaguaguauccaucccaauuuuggcaaccaaaaauggcuccagacauugccagaugugccuugagggacacaguuaccuccaguugagaaccguggcccaaguggaugcuggacucuuccucccaacacuccugggcuguggucaucugguuucugcugucccagugucccacauccccucacaucauaaggcaaugauuccaucuacucuggggucaaauuucucugcuaaccacaggcugaaauuugagguggccggcgguggguggggggugguuucuugguacugaaguuguucacagcucaaugcaagcaucaggaaaccccuaggccccugggugccgcccgcaccccagccccuccuuccugcccuaauaguggccuccuaggugguuggacuuccuggaauguuuagcacgcucuagccagugggggcccccuuggcugcucccagcucccaagcuaaccguucucugcaaccucucugucuccaguggcuuuucuuaaauuccuuaaauagcaacucccaguuuccucauuccacguccacucguagaagagcugagggagaaaguuaaucuagguuaaccagcaccuuccucucucucuagguuuuuuguuuuuuugaugcauggaggaaguuauuucuucauuugacaacuuaaacaaaaaauacuccuguauuaucuccagauggucuuaagguggcucauaauucagagagcugcuuuucuguuuuuucuuuuucuuuuuuuuuuuuuuuuugagacagaguuucacucuguugcccaggcuggagugcaauggcacgaucuuggcucucugcgaccucugccuugguuucaagcgauucucaugucucagacucccgaguagcugggacuacaggcaugcgcuaccacaccuggcuaauguuuguauuuuuaguagagaugggguuucaccacguuggccaggcuggucucgaacuccugacaucaggugaucugcccgccucggucucccgaaguguugggauuacaggcaugagccccugcgacuggccugcuuuuguuuuaagugagagacaugaaguaaaaggaaaauaacaggaagaagaguaaaagaagacagaggugcuaggagcuuuagaaguguggagcuggccgggcauggugucucaugccuguaaucccggcacuuuggaaggccgaggcaagcagaucacuugaggccaagaguucgagaccaggcugagcaacaugucaagaccccaccucuacaaaaaauacaaaaaaaaaauuagcugggugugauggugcacauccuguagucccaguugcucaggaggcugaagugggagaaucgccugcgccugggagauggagguugcaguaggccgagaucgcaccacugcgcuccagccugggugcagaagccagauccugucucaggagaagacagaaacauggaaccaguuaacgugggcuuugucuccgacacucuccccuucccugugcccucguaccacacuuccuguuccguauccucuuuuuuugaguuuaucgugauggauguuuuagaaagauccaccugcugugaugugcuguguguagagugguguggcugggggaggaagacagaggaccuggggagaagggugaacgaccucccuuugcaccucaaggagggcccagcggucugaugcuggccaccccaguggagagagguuugcauguggacgccagcuguuucccacugaccuuggccacugcucggcccucccagcuggagcugccccgaaccugccugagaagggccagggcaucgagagcauugaguaauucucaugcggcccccgccucugcagucaucucccaagaugaucguccagauggcgcaaccccaucuuacaaggacaaagcugcuugcaguuuccuucugcuuucugggucuggggcugccuccagaacugcagguugaguuucuucuuucagaacccguggcugaugucaccagauaauaaugccuagcgccauucgugccaagcgucugggguugaaccauucaagcagagaaagagaguguucugugcauguggagucgcacagcucagccugucccugacaugucucugugcuuuguaggcgggggcacgaacagcaucaccgugaggaaugccacauucaccugggccaggagcgacccucccacacugaauggguaagccgggacguggacacacgugaugguguggagagagccacagggcuuuuguuaaacguggauucgaauucccaccgugcucccucucugugaccuugaacaacucacuuugccuuucuaagacuuagcuuacccaucuggacaaugggugcagauacaccugcuuaggcugucgugagaagcagacacacaugccuagcacagaggguucccugggauuguaaguuacagcagccuuggacagcuagacuuagacaauacaggagauucuuggcuugcguaacugggaaguucuacuuucaggugcggugugauccagggacucugccgucagaacuuucuucauauuuucuguguuucacuuucuccuggucugcuuuauccucacgcauccucuccccuugugaugguaaauggucccaacagcucccacuguguaucccacuguuaggagaacugccugcuucuuauugacccagauuggguccugugcccucugugaggcaaucgcuaugccuucagacacugagugugcugauuggccagucucagucaggggcugugaugcugcugaacuccagugccccucagcugcccagcucacccuuucuugccagcuuucuaucuggcaccccacacccuacaguccuuaccuuuccaaagcacaugaugucuaggaaauugaccuuauccccaggcaacuugucaagcaccucucauuuuguucugaccagaggccuugaucaacagcuuuuuaggcccccuuaaggaauccgcaaaacacaggggugaugggacccuuuuagagguuuagcucaugccuggguagccaaaucacugcuguauuuuaugaugaaggagagaaacucuccagagaaaacaaucuguagaaggccugcauugaaaauucauggggguacugcaugcuuaggaaguucuuccuuaugucuaacuuaaauccugccugcuucaauuguagcuguucugucuuguugagcugcacaacuaaucuguaucugugucccuuuccugacccagugguuuuccuguucaguuaccuuccccccaugagcccccagaaccuuucucuaacccuuuucucucaucagccuguaagaauauuucagucucacguggacaguggcagguacugucucacguggacaguggcagguauugucucacugggcuuccugcccacucaggccccauaauccuuuccccucccagcacaggaacaaaaagccugaugagugucaccaugcagcagugucauaagaaugaaacaaucagugacagcaacgacuaucagcauuuccacuaauacucugaaaucagaaagguggcaguuaaaaagcacagaaucccagcacuuugggaggccaaggugggcacaucaccugaaguccgaagucugagaccagcuuggccaacauggugaaacccugucacuacuaaaaauaaaaaaacuagcugggcaugguggugcaugccuguaaucccagcacuuugggaggcugaggcgggcagaucacuggaggucagcaguucgagaccagccuggccaauguggggaaaccccaucuguacuaaaaauacaaaaauuagcuggaugugguggcgcucgccuguaaucccagcuacuugggaggcugaggcacaagaaucauuugaaccugggaggcacagguuucagugagccaagauugagccacuguacuccagccugggccacagagugagacucuugucucaaaaaaauaaauaaauacuuaaguaacuaaauacagauaaauaaaaaauaaaagcacauuccauauaagugaguccagcaaagguuuggaugugcccucccuucccugggaggauggaaacccugcucuggaggugccgucggcagugggaguggccugggguugaccugccccauugacagccggucuuacugggugaaugcugagcuuauuuuauuuugcuuucugcuguucguuaaaggaugauuucaauagagacaucuuccugaaauucaacucagauuuauucauaugcguuucccuuuucaacccuuugguggcucccggcuggcagaguucaggugucuuagcacagcguccuuccagggcauauuucaaggugcucccaggucuggccacuaccuaccucagugccaucgcaucccugguuacacccugugccuucaccccuuuacaccuuucuccggcucuccacauguuucugugugugggacacuccugcuuuuugucagaguuuuuugguuuauuuauuuucugagacagagucucacgcucuugcccagaucggagugcaguggcacgaucucagcucacuguaaccuccgccucuuggguucaagugauucuugugccucagccuccucaguagcugggaccacaggcccugccaccaccacgccuggcuaauuuuuauauuuuuaguagaaacgggguuucaccauguuggccagacuggucucgagcuccugaccucgugauccgccugcguuggccucccaaagugcugggauuaccagcacuggcaugagcuaccguguccggccccaguuugucuugagguguccucuccuuucagaccuugcgucaugcccccaguaaaguuucugccucuccgaggggcaaaaacuguuccagaagcccacugugacaggaucccucagguuacucccugccucacuucucuaagggacaccugucaccugccucccaccuggaggcccccugagacaggucacugaacugaacucagcaguagaaauggaaggaauguugaggccuucaguguuuaguacagucuugccuucugucuuucucuuucucuacuugggguaaauugaggcucgguggccaugggcauuagcccggcaggccucauucagcguggcugagccagguguguugugucguuucagcaucaccuucuccauccccgaaggugcuuugguggccguggugggccaggugggcugcggaaagucgucccugcucucagcccucuuggcugagauggacaaaguggaggggcacguggcuaucaagguaggaugaggaccagcggggaggggcaguggggaagcugguggucugaggaaaagcucagaaaugaugguguuucuuuugacugucccugugccagaagcgaaagcagcaacgucucuuuuccuccuccuccuguaucuuuccacugucucuuucucucucguucuuucuguucuguuccgugcuguccuagaaggcaggauuuugguaucauuuauuuccaucugucucccagcacuuaaaauagugcccaguauauaguaggcacuuaauaaauauuuauuuuguuaccucuuuauuaagcuguuauuuuauuauuauuauuaucauuauuauuguguuuuuuuuuuuuugagacagggucaggcucugucccgcaggcuggagugaaguggcgugaucucggcucacugcagccucugccuccuggguccaagcgauucucccucagccucccgaguagcuaggauuacaggcaugcgccaccauguccagcuaauuuuuauauuuuuuuaguagagacgguguuuuaccauguuggccaggcuggucucaaacuccugaccucaagugaucugcacaccucugucucccaaagugcugggauugcaggugugagccaccgcauuuggccacuuaagaaauacuuaguagacacacgaagacucccugguacgcagccugugucuccuucccuugcgucucugccugucacugagugucucuuggucuguuugggucuuuuuggauuguucuuuaucuuuauggaucucugaguaucuauucuuauaaauguaacaaaacaaaaauguuuaugugguuggaauauuuucuuagaacauuuuuuaaagggaacaguuuaaauuuuuaguguugaauucuuaauauggagcuaaaagaagacugcaguuuuacugcuuuuaaauacacaguguacuuugaaguaaguugaaauuccccaggagugagcuuaagaggcuccuuuacaaauaauccccacuggaaaucaacagccuuuguuugcauuuaguucacuccccaugaaggccuuuuccuaguguaacgacacgucccuggaaguuuugcuaccagcauuuccaggaguguggucugcagccagcucaucuugcaggacauuugggcgauaaagaaccccaggcucaaagaagcgugggaaauaaugcauacuccagcccccucccucuuggagacuuacaguaaacauuagcaaauuaaaggcucugacaaguccugcaaggagaaaaaaucuauuaacuguuuaaccuuaugugucccagguguacuuguccgcaccucuuuagugucugugcaacugcacauuugucucuuggaaucugccuuugggaaugucaaguuuaugacguuguuuguuguuguggguuuugagacagaguuuuuuuuguugcccaggcuggagugcagucgugugaucuugacucacugcaaccucugccuccuggguucaaccgauucuucugucucagccucuugaguagcugggauuauaggcacccaccauuacugcacccggcuaauuuuuguauuuucaguaaagacgggauuuuaccauguugaccuggguagucuagaacuccuaaccucaggugaucuccccaucucggcuucccaaagugcugggauuacaggcgugagccaccgcuccuggccuaguuaaugacauuguuuuuauuucagagcaaaacccuuucuuugauuauacagugccuuuagaaaguauacauugugguuggguccaaauuaaugaccuuuagcuguuguuuuaagaaauguuuuaucauuacuuucaaguuccugccauaaaauaagaugaaugaaccaugagagcuagauuaauggaagaaaauuccaaaucccgaugggauccacauugcuuucuguuuccuuaaccccagcuuucugcuauccuggcacuauuagcauuucaggccagaugauuauuuauuauugguuguuuggccuagguaaggggagugcuagaaauguauauaaaauauuuaucuuuucccaaauguuuuaguuggugugguuuguguauauuaugucugaaauuucuguggguucuaugguaaggcaccacuguugacauuuuggcuuuuuaaaaguuaggauauucaagucagcagguuaauuauuugagaauuuagaguaagaaugaggguaccugggaccugcugucagcuuugcccucucuagaauucccuuauucaagaaucuucuggcugggcgcgguggcucacaucuguaaucccagcacuuugggaggcugaggcagguugaucaccugaggucaggaguuugagaccagccugaccagcauggcgaaaccccgucucuacugaaaauacaaaaauuagugggccugguggugugugccuuuagucccagcuacucaggaggcugaggaaggagaaucccuugagcccggaggcagagacugcagugagcugagaucuugacacuguauuccagccugagcgacagcaaggcuucguuucaaaaaaaaaucuucaggggcuccccuugccccucugauaaagcccaugcuccccaccaaguauaggcccccuugcugucccugguguguuuucugccagucguucccucacaggauugaucgauguuccugucacgcuggccuuucuguuccuugaaugugccaaguacuuuucacuuccaggccuucgcaugugcuguucccucggacuugaaugcucuucccucuucuccucaugaaacugacucauucuucacuuuuugguucuugucuaaacauauguuugagcugagcaugauggcucaugccuauaaucccagcacuucaggaggccaaggcaggaggauugcuugaggccaggaguuugagaccaggcuuagcaacauggcaagauuuuguuucuacaaacguaauaaauauauagagaauuaacuaccucagcauuuucauuagcaaaauacacaaaacaaauauccuuacucuagccuuuauucucaugcuguuugugauaccugacauauggaaauaaaaauaagccuuugaaauggaugcuugauauaggagucuuugcuucaauuuuuagcaaggauauuuccucaaagauccuucccggaugucccaaacuaggucagucuuuuaauuuuuuugagacaggaucuugcucugugguccaggcuggagugcaguggcacggugcaaucucagcucgugguaccuccauuuccugggcucaggugauccucccaccucagccucccaaguagcugggacuacagaugcacagcgccaugccuggcuaauuuuucuauuuuuuuuagagaugggauuucucuauguuguccaggcuggcuuugaacuccugaccucaagcagucugccugccuuggccucccaaagugcugggauuacaggcaugagccacugcgccuagucaaguuagacucuuaaaaagugucauauaucuuuuuaucuuugcguccaccguaacuguaaucaaguaguuuuccgucaccugagggacuuccacucuuuggaagcagggguuuugaucaccgcuguaggcauugaguuaauagcuagcuacuaaguaaauaacuguaaucuuaucaacgaggauaucaacucuuugacuccugauauuggagucagugauucaccugcuguggguucugaucccagcccuggcaucuguuguccuuugugagucaguuucccucuugccaaagcaauaguugugaugaaaaugacuugugaagugaggcccuccuagcaggcgggugggccagcuguugucucguugaucagaucugucugugugucugucucaccucguucuccauuugcaacuuagggcuccguggccuaugugccacagcaggccuggauucagaaugauucucuccgagaaaacauccuuuuuggaugucagcuggaggaaccauauuacagguccgugauacaggccugugcccuccucccagaccuggaaauccugcccaguggggaucggacagagauuggcgagaaggucaguauagguuggauguuggccccugaaucagucagcuguugccgcguaacaaaugcucucacaaucucagugggcugugagucugcugcuaucagcugacccggcagggcucagcugggcggcucugcugcacgcugcaggccagcugaacuuggguccaggcuguggguguggcucaggucucacuuacagagcuuuugcuggggaccggggugagggguccacagcuuuccaaaggggggcucuucucaugguggcagcagaggcccaagauaggccccccagaaagcaugcaaugucccuuaaaguacacugucccuucuacucacaaagcaagucacuuggccaagcucaaaggcaagggaccaagaaggaaguacauucuaccuuuguggucacaugacugcagagucacaugacagagggcaugcuguugggaggaggggagucgaugauucauauguucacagucccugucaagauagccauaauacugaaaauagcacaauagcuaacacuuacugagcauuuucucuuucuuuucuuucuuucuuuuuauuuauuuauuuauuuuugagauggagucuugcucucuugcccaggcuggagugcaguggcacgaucucagcucacugcaaccucugccucccgcguucaggugauucuccugccucagcuuccugaggggcuggaauuacaggugcauaucaccacacucggcuaauuuuuguauuuuuagucgaggcaggguuucaccauguuggccagguuggugucuaacuccugaccucaagugauccgcuggccucagccucucaaaguucuuuuuuuuuuuugaaauggagucucucucugucgcccaggcuagaguguaguggcucacucuuggcucauugcaaccucugccuccugaguucaagugauucuccucccucagccucuugaauagcugggacuacaggccccugccaccacgcacagcuaauuuuuguauuuuuauucgaggcaggguuucaccauguuggccagguuggugucuaacuccugaccucaagugaucggcuggccucagccucucaaaguucuuuuuuuuuuuuugaaauggagucucucucugucgcccaggcuagaguguaguggcucacucuugguucaaccucugccuccugaguucaagugauucuccucccucagccucuugaauagcugggacuacaggccccugccaccacgcacagcuaauuucuguauuuuuaguagagaugggauuucgcuguguuggccaugcugaucuugaacuccuggccucaggugaucugcccgccucugccucucacaaugcugggauuacagauguuaaccaccucgcccggccuauaacuugaguauuuucuguauguugggaacuaugcuaaacauuuuacacguaauucuuccccacagcaagcccauggguggaauuuguuguuauaccuagguaaucauugaggaaaaaggaggcacagagaggccaagugacuuaccugaggccacacagccacagagcugcagagagcaugguuccuguguccauguuguuaccugcucauuuugucaucucuaaaagggccauucucugccucucaccacugcagacccucccuccugcugugcuccaucucccagguuuuccugcugcuucacagcaacccccagccccugcccaccuccacaccuuggucugagccuucaaggccuggggugccuccccugcugcuugccuggccacuuugcucuggcaccccaugguggucgucugguguguccccucuuggaagaccaagagugcaaagcacuggcccauuucuguuuuuaguuacaagccaggggcucugucggcuuucuuacguggugaaugauguuuaaaaauugagauaagccugcagcuccuuggaaauaaaaaacgaauuauuggcugggcgcgguagcucacgccuauaaucccagcacuuugggagaccaaggugggaggauugucugaggucaggaguucgagaccagccugggcaacauggugaaaacccaccucuacuaaaaauacaaaaaguugccaggcauggugccgugcaccuguggucccagccacuuagggggcugaggugagaggauugcuugaaccugggaagcggagauuacagugagcugagauugugccacugcacuccagccugggcgacagagugagauucugucuccaaaaacaaaaagaaggcacguggcugccaggaccccaccucagugcaugggagucagggcaggcaucucaggagggacugggcaguaaccugugauuuccagccaaauagggaaacgacguuggcuuaucugucauggugggagcuggcgcugcugcugguccaugcauuguccuuccuccuggugacugggaugugggcuggauuucagcauccccaggccggagccuugcuucaccuauauguggcuuugccagacagugacagauccagaguaagcuggcaaacauggcagcugucaccaacagcagcaguaacaauaauaugaccacguccaccagcgccuuccaugagacuaagggaucacggccuucccacuggucaacaugauuuggugccgucagccauccuuugcugagcacuugcugugcaccacgugcccugcucagcaccucacgggagauucagguuuucucuuuugcccaguugacagguggggcuaaacccugugccugugaucccauccuugguggugguggagcuggggccuggcuccagguuugugcaggcgugaccucaugccuucagcaucaaacuuaaagaagaggaggugggugcagcucugcagggccuucacccaggaccugcuguguccugagcaggcucuaugccuuucuuucuuucuuguuuaaagagacagggucucauucugucgcccaggcuggagugcaguggcccagccauagcucguugcagccuggaacuccugggcucaagccaucuucccacucagccuccugaauagcuggaacuacaggcgcacaucagcaggcuuggcuaauuuuuucuuuucuuuucuuuucuuuuuuuguagagacagggucucccuauauugcucaggcuggucucaaaccccuggucucaagcaguccuuccaccuuggccucccaaaguucugggaucacaccacacucggccugcuucuacguauugugagucucaagauuucccaggaaacccacuccugugugugucucuccccagggcgugaaccugucugggggccagaagcagcgcgugagccuggcccgggccguguacuccaacgcugacauuuaccucuucgaugauccccucucagcaguggaugcccaugugggaaaacacaucuuugaaaaugugauuggccccaaggggaugcugaagaacaaggugccugcuggcgggguggggcuugguguugggccgucucgcccuuugguuaagucagaacguguccccuuuaggaguccuuuacuuucucuggcuuucuuuguuuuuaauuggacuuuaaagaacacauuucucaugcuugucuuggaagccuuccuaagacagccgucuuguacuugucuuuauagggguaaguccuccgcgcagaguuaaauucauugccucuccauggccaagggaggccucucuuccugauuaagucacagggcuggcuucuuagcggggaaucccacuccaagacauugccugugaccuagcaggcugcauuuucuuacuugcagaggugucuguggguagaggggucggaaaauugccacaacaccuuaacauaauaggaaauaguuccuguguucuuuuuauagggcaguugugguaauggguacacacuggcucuuuuuuuucucccccugauuuuauuuuuuugagguggaguuucgcuacuguugcccaggcuggagugcaguggcaugaucucagcucacugcaaccuccgcaucucggguucaagcacuucuccugcuuuggccucccaaguagcugggauuacaggugcccaccaccacgccuggcuaauuuuuuuuauuuuuaguagaaucgagguuucaccauguuggucaggcuggucucgaacuccugaccucaagugaucugcccgccugggucuccugcaaugcugggauuacaggcgugagccaccacacccggcuguuucugcugauuuuaaaacuaacacauccccauggggggcauauagauuaagaaaaacaugaaaaagaaaaauggaagcaguuacacacauuccacugguuagagguuuuguauuuuuuucaagucuuuuugcucuguguauaaacuuuuuaaauaggguuaucuuguuccacguauauauacaggaaacaucgugcuacaugaccucuuguaaucguucccauacauaccacuaacauucuguguaaacauauuuuaaaauaguacaaaacauuuuugaaaauuacuaaguaauacaugcccauuguaacaaaauugaaaaguacaagaauauggauaucuucuuauaauauauguguguaugcgugugugugugugugugugugugugugcauguauauaaaguaaauaaagcugggcacggugaguaaucccaacacuuuuggaggccuagaccaguggaucaccugaggucaggaguucgagaccagccuggccaacauggugaaaccccaucucuacuaaaaauacaaaaaucagccgaguguggugaugcauggcuguaaucccagcuacucgggaagcugaggccggagaaugucuugaacccgggacguggagguugcagugagcugagauugcgccacugcacucuagccuggguaacagagcgagacuccgucucagaaaauauaucuaaauaaaguaaauaaaauagucccucuucauccugcaucccuaaucuuuaauucuucucuuagagagcaaggguuagcaaaucuggcccacugccugcuuuuuauauggcucuugagcuaagaaugauguguguauuuuuaaauagaagaaaucuaaacaggaagaauauuuuaugacauuugaaaaucguauuaaauuuagauaucaguguccauaaauaaaacuuuauuggaacauggccaauguauuuuuuuucuuuuuuuuucugcagacaggguuuuccucuguuguccaggcuggagugcagugccacagucauggcaugguagccuccagcuccucggcugaaucaauccuccugccuucugaguagcuccugggaccacaggcaugcagcaccaugccuggcuaauuuauuuuuauuuuuauuuuguggagacaggucucacuauguuucccaggcugguuucaaacucuuggccucaaggaauccucccguuuuggccucccaaagugcugggauuacaggugugagccaccgcacguguccuguucuuuaaagcaucgucuacagcugcuucaacucggcagggcugaguuggugccauggcaacuguaagauccauaaagcugaaaagauugaccguuagcuguuuaaggaaacauaugcugacuucuauuaauaguuugaugaaugucuucccaaacuuucagauuugcagauaaaauguaugcaugugcauauuuuguagugguuuuggggguggcugacagcgggaguuguuuuagaaaaaaauuaagccagagcugggcacgguagcgcaugccuguagucccagcacuuuuguaagccaagggcgaauggaucgcuucaguucaggaguucaagaugagccuggacaacaugaugagaccccugucuugacaaaaaauacaaaaauuaucugggcaugguggcacguaucuguagucccagcuacuugggaggcugaggcaggagaaucgcuugaacccaggaagcauagguuguggugagccgaggucgcaccacugcacuccagccugggcgacagagcgagacccuaucucaaaaagaaaaaaaaaaaagaagaaaaaaauuaagccauugggcugggcgcagcggcucacaccuguaauccuaaaacuuugggaggccaagauaggcagauugccugaggucaggaguuugagaccagccugggcaacauggugaaacgccaucucuacuaaaauacaacaacaaaaaaaucagccaggugugguggcgggcgcauguaaucccagcuacgcgggagggaggcugaggcacgggaauugcuugaacccgggaggcggagguugcagugagccgagacugugccacugcacuccagccuggacaacaaagugaaacucugucucaaaaaaaaaaaaaaaagccauugcauacaaacuguuuugcuguggcaccauccuuuuauuccuuuacacacuuguaugguucccucccuaccucuugucauucagguuuuuguuaaaaaauaaccuuccccauuaccuuuguuaaaauugcaaaacccgcacacuugguacacccguuccccuuuuugcuguguuuuugccauucagcaagcacuauucuacuaguguucguuucuccugcggcccuggaaucuggggcaggggucuuuguuuccuuccccuuccccagcuuuuagcucagcaccugaggcguggcaggcccuuugcacaugcauguuacaggaccgugugcacagguucagcugcuccuggaugcuguuaucgcgggugcaugucccaccuucagaccugaguuuugcccaccagguguucgucggcucauuccuccuuuagucuucacucugccaagcuaggcagucucacacaugugcacucacguggccggguguccccuuugcccacagacgcggaucuuggucacgcacagcaugagcuacuugccgcagguggacgucaucaucgucaugaguggcggcaagaucucugagaugggcuccuaccaggagcugcuggcucgagacggcgccuucgcugaguuccugcguaccuaugccagcacagagcaggagcaggaugcagaggagaacgguaggggcagccccaggguuccacccacucagggugucuggcaccuugaagggccacauuggccucuuugagguugccaccagccacuuggggaaggcggcuccucagggcaugagggugggagcuggauggagcccccuaaagaagcaauguggaaaaccaccuuagucccugcagugcugaacugggagagagucucggugcuuuauggccaggggaugggagcaccaggcuucagcucagcugaccucagggcagggucuagcgccuuccuggaacaugaccuuggaccugaugaguuucaggguccuuauggcaaaaaugggaaugaugguaauuaaaguccuggcucucggggcugagagaaacugaggacauacgugacacaagagaugugaggguugugaggugaagcacggaguuaagcuggcaggcucggguuggugacgucuggguucaauccccggccgcucaucuccccagcuaugugaccugaggccugcccuucagacccaucugagcuucacuuuccucccucauaaagcaguucagcagggccagacguggugguucccagcacuuguaaucccaacacauagagaggcugaggugggaggaucgcuccagcucaggaguuugagaccauccucaguagcauggcgaaaccucaucucuacaaaaaauacaaaaaauuugccaggcacaguggcucacgccuguaaucccagcacuuugggaggccgugguggguggaucccuugaagccaggaggaauucaagaccagccuggccaacauacugaaaccccaacucuacaaaaaaaaaaaaaaaaaaauucagaugcuauuaagugcuuuggaggggaaacaaaaaagacaaugccaugggcugaggagugaugggugucauuguggcaacucaggcaggggauagggaaacccucucuggggagguugcauuggcaugggaaggagccagcagggagaagaucugggaaguguugugggcagagggaacagccaguacaaaggccucaggaccagcaugagcucaauuuguuuacaaaacaaaaagggugguguggccagaccauggugugccaggacguggggggcaggagaagaggucagcacagugauuguccugcagggccuuccagguggguuuuggucuaacugcccugggaagccacugagugucagagaggcaaagugaccagccccaggauacacagcagcugcuggcaggguugguucucaaguuggucucugaguuucucauccuuugccuggggugggagcuccuucucugcagagguccuagugaucucuaauaagugcuuucuugagauguaauucacacacguaggcugggcgcaguggcucacgccuguaaucccagcacugugggaggcugacacagguggaucaccugaggucaggaguuggagaccagccuggccaacaugaugaaacccugucucuacuaaaaauacaaaaauuauccuggcgugguggcgcacgccuauaggcccagcuacuggggaggcugaggcaggagaauaguuugaaccuuggaggcggagguugcagugaaccgagaucgugccacuacacuccagcuugggcaacagagcaagacuucgucucagaaaaacaaaacaaaacaaaacaaaaauucauacaacauacaauuaacccacuuaaaucacaaaauccaaccaucaccacagucagguuuagaacuuuuuuuaaucacccccaaaagaaaccccaauccaucagccaugacucccuauuuuccccagcaccuccgaagcccuaggcaaccacuaaucuuucugucucucuagauuugcuuauucuggacauuucauauaaaugccaucacaauagguggaauguugugacuggcggcuuuuacacuuagcgugguguuuucaagguucgucuauguuguagcuucauuuccuuuuauugcggaauaauaugccauugugcagauagaccauacuguguugaucuguucacugguugauggacauucagguuuuuuccacuuucugacucuugugaauacugcugucaugagcccuggugguuuuaaaggaaaaguugguggccggguguggugguuugugccuguaaucccaccacuuugggaggccaaggcggguggaucacuugagguuaggaguucaagaccagccugggcagcauggugaaaccucgucucuacugaaaguacaaacauuagcugggaugguggugcacaccuguagucccggcuauucgggaggcugaggugggggaaucgcuugagccugggagucaggcugcugugagccaaaaucaugccacugcacuccaucuggccugggugacagagcaagaccaugucucaaaauacaguuggauuuuuguuucuugccagugcaugauagcugacauucccuucagcuuuuaaauuauuugauuagacugaauuucugcauguucauucccuugugguugggaaguucuaccuugagucuagccuguuucuucuugcugcagaaucccccuuugucuaucucucagcccgagcaaugcauuguggcaacuucucggugacuuuuucacugaccugcuuggcaggcuacuuuuaggugacaauacccuuugugcucucuaaaucaaaauguguggguuuagcugaaucuuuugcccagcgugaggucugucucucuacccuuccguccaggugagcaaaaaauguccuuaaacucucuuggccccagauagguuccgcacccccgccuuucuuucccagcugcuagaguauccaagcaguguauacagaacauggaaggcugccagaugcuuugugauuuuuguacacaucagcacuuaauuuggugaugcaaaugccgcccaccacccuggcaccucgugcguucauuuucccaguuugaccucccuaccuccugccuuugagguuacauagaaguccuuggcagugggucuuacaucaaacuggggcaccccccucucucaccacccacccuuuuccauugcucuggaggggcccuggcuauaaagucuugacaucagggucuggucuugcccagccuuagccaacucgaagcgccaaugaccuuggguuuguuuaaaccacauuuuuggcucuuccuaaaggggaacuuuuuuccuuguuggauuaaucagcucuuuuuuuuagaacacccaggcugaaggggugcagguguugguauuugguuugggagaauccuugaggggggaugggcaggaaccaggcuugugaauggggccauaccgaccucucucccgggauauucaguuuacugauuucuaagaaauauaucuuuuuuacuguuugucucccucucuccuuuuuuuuuuuuuuuuuuuuuuaacuuuuaauggcauuccuuuuauuccuaauuuauucccaugccauaagcuuuuguuucuucaauuucuucugggauauauuuuucuucugugcagccuccccuuccgguuuaggaacaguuuguucccuuucaggcaggaucaucuggauguggcagagugagcucacguauggguuaauccgaccgacccugagcucuguagguccggcgacgcaacuuaggugcuuucuucaguuggauaugcucaaggaccagagaaucugcaucugaacccuuaaguucagugugacucucuguauuuuuaagcaugugcagcagaaauucagugcucuuuuugggccgccgaccuuguggccagccccacuucuuggccuggguacaucuaccaacuccaccauuauaaugucagaaugguacauguuguuucuguaaaguggcaucuuucugauacuuuguggccuuuuguacgugcauaccuuugauggccugggcgcuuucaggaguguucuuuuucuuuuucuuuuuuuugagacggagucuugcucugucgcccaggcuggagugcaguggcgcgaucuuggcucccugcaagcucugccgcccagguucacgccauucuccugccucagccucccgaguagcugggacuacaggcgcccgccaccaugcccagcuaauuuuuuuuguauuuuuaguagaaacgggguuucaccguguuagucaggauggucucgaucucuugacgucaugauccgcccgccucggccucccaaagugcugggauuacaggcgugagccacugcgccuggccuuuuuuuuuuuuuuuuuuuuuugauacagagucucacuuguugcccaggcuggaguguaguggcacgaucuuggcucacugcagccuccaccucccggguucaagaaauucuugugccucagccucucgaguagcuggaguuacaggcaugugccaccacgcccagcuaauuuuuguauuuuuaguagagaugggguuucaccaugcugaccaggcuggucucaaacuccuggccucaagggauccuccugccucagccucccaaaguguugggauaacaggcaugagccaccaugcccggccucacaaauguucuuaaggugaacacgaagauuugaaccucuugaucugcaugauucugugguguuuucuggauaaagugaauagugaaccauuuucacagauugccucaagccccuuaggggaacaaauuuuuaagggauuuaaaaaaauggcucauuaaccuucauaccuggaagguaaaacacaucuucaugacucugguuucuuucuuaggaaccuaauaccuagagcagugguuuuccaucaggggcaaauugcccccacccuggggacaguuggcaauguuuggagacauguugggaugucaaaacuggagugggguuugccccuggcaggcaagcaggguagaggccagcgaugucgcuaaacauccuacagcacucaagacgaauucccccuuacccugccccccgugacagggaauccccuugccaggacauccaaagcaccacgagcaagaaacccugugugcuccgacuucacacugcugaauucuucccuuguccucuugggagaaggaucuuuauuccaacaauguggccauuuuucucuuuuaaaaaauuuuauuuauauauuuuuauguuuuuuuauggagaugggauaucagucuguugcccaggcuggucucgaacuccugggcucaagcgauccucccaccuugaccucccaaaaugcaaaugcugggauuauaagcaugagucgcggcaccuggcccguggccauuuuucaaaaccuugcuugaaccaucuguuaaccucauggcaaauauuuuucccucuuaaguauuuaccgaguuuuucuuaaugauuauaaaagcaacaugugcucaucguagacauuugcaaacuacaaaagaguacaaagaaucaggaaaaaagguggcucauauguguaaugccaggacuuugggaggccaagguaggcggaucaccugagggcaggaguucgagaccagccucgccaacauggugaaaccccaucucuacuaaaaauacagaaaugucaggaggcugaggcaggagaauagcgugaauccggggggcagagcuugcagugagccaagauugugccacugcacucuagccuggguaacagagcgagacugucucaaaaaaaaaacaaaaaaacaaaaaaaaacucccgagaaagaacaucuuucugcccucacugcccagaaggggagcuguuguuagcuuuggcaucuuuuucaccuguccuuccuuccuaggccuucucccuugacaagauugagaguauaucuuagaguuuucucaucuccugccaccuuuugauuucuuuucuuaacagugggccauaagcaccuccccaaguuacacaaauuaguugucagcacagagcagcugccgagagaguucaucagacagacccccacauuccuucuggcuguccucagaggccggauuucuuccucuuuugaggaugaagagcuuucucugccgaggcugggggaggaggucagugaggcagccagugaaugccguuuuuggucaaaaaugaggcguugacuauaaagcugugaguugaauucuucccuccggggaggcuggccugcuggaccuugcccaagcagaguuccagaaccuucuugaguaaaggcaguguugguggaauaaacagugagaggacuggcaacggaauacacagacccggggcagcacuuaacguacgugggucaaggguagaaacagcaccuggcuugacagcauccaaaacccaacaccuggugguugcaugaacucagugacagucacugaauuacaaguuucguguguuugcuuuaaaaaaaaaaagaaagaacucuugcuacuuuauagcauucuccacccuggcccccagccuucaugucccucuucuucccugcuuugauuacuuuguggcacuuauugcugccuggaguaaauuauggaucuacuuguucauuuauuguugaucucuuccuuuggaauuuaagaucugaggguuuuguuuguuuguuuuguuuuguuuuguuuguuuugggagucucacgcuguugcccaggcuggagugcaauggugcaaucucggcucacugcaaccuccaccuccuggguccaagugauucuccugccgcaaccucccaaguagcugggauuacggaugccugccaccacgcccggcuaauuuuuguauuuuuaguagagacggcguugugccacauuggucaggcuggucuugaacuccggaccucaagugauccacccgccucagccucccaaagugcugggauuacaggcaugagccaucgugcccggcugcucugagggcuuuuugguugucucuccauccccaggacuaagaaaagagccugacacauaguagacacucaguaaauguguuaaaugaguggaugaaucgcaccuuggcuguucaaggcauguccugcauaagcaguggguaggccggagggcuuuggauguuuacacugcagauaaauaccucagacuaggagaaaauaggaguggauuucacccccucucaggucugcuuuagaaagcagcuuugucaguccugccuaugagaggggccccucuggcauugggaagucagcucugcuucuugacuugacuauacacuugucagucugcccaucugucugucggguguguacagagugccugcugugugccacaaggccaccugguacgugagccucuguguggaauggugccccccacguugaguugugcagugugcaucuuguguaacugcacuuggccaccugcugugccaggugcuggugauacaguaauggauaugacccacuucaugcccuugagagcucacagucugaugggagagacaaacgccaaacaauuaaggguaucauagugcuaaaugcagugauggagggcugcuugagggccugggaaaucacagagaaggagcccccaucccagccugggaggguccagggugauaucugggcuaagucaccuuuucuucuccucuugggcacaugugcaucuggcucuguguggggccagccccucucaggagcagugucuguccucaaaggggcuggagcugaugcccaugccaccucccagugucaugccuggccugccuacuguaauacuuuauuucuuuuccucuccugcguaaaaacaagccugaagacugaagguuggucugcauuauuuguuuagcucuauuuaugguuaaacacaguuaugacuuuggccaggcaugguggcucacgccuguaauccuagcacuuugggaggccaaggcagguguaucagcugaggucaggaguuugagaccagccuggccaacauggcaaaaccccgucucuacuaaaaauacgaaaauuagccaggugugguggcgggcaccuguaaucccagcuauuugggaggcugaggcuggagaauugcuugaaccuggguggcggagguugcggugagcuaagaucacgccacuucccuccagccugggcuaaagagugaaacucugucacaaacaaacaaacaaaaacccaacacaguuaugacuuuggagaaagggguuggucuugugcagugugcuugucccggauccacccagcacgugugggauggggaaacugacgcacaaauggagcagacccuucagccauucuugccucucccccuuuagaaaagacacucccuucacuccuuuauuuagauaggggcuuagggcgggaguuucgcuuugcuucuuaacaauaucuugggucuucugaauucccaggcagcacagugauggacgaggaggaagcaggucaguacugcccggguuggaguuggcuuggcucauagaaugaggccagagacgggccgagacugucgcugcaugucuggggaggugccgucagaugucuguguuuucaccccuccgguuguucauugguucauuuagcacacauuuacuggguaccuacugugugucuggcuuugaggcuggcacugggggauacagccugaguccccagaucccuuuauugucacugaugaccuuggguaagcucuacuguuucaugcaucacguuaccgugaccagcaugccuugaggggaccaugcuuaugaagugccuggcacacaguggauggacaauaaauggcaacaguuugauugugagcugccacgcauagauccuggggcacagucaagacacacaugggcccagacaaugcagggugaucagcgccuguuggggaacugcagcagguggugguggggacccugaagagggaugucgccuaguggaauuccaguggccagacuggacccaucccuccugccuucugcaguguguggcuuagggucccagccaagggcuuuuuuuguaagcagcagaagcugaaucuggccaccuuaaacaaacagaggguguuuccuggaaggauaccagguaacucaugaaucaaaggcagaacugagcaaguaggacucaggaaaugggaacucugggagacuagacucuuuuaggacaggugaacuugaacugucuuugguccuuguagaccacugaugacgguucaaauccugggagaggggcuuuuauggggcgaccucagacagugcccaccuuggcugggggaaucugaggcacccugauugacaggcccaccaaggcuguaggaagagggagagcugaucccuucaaaaagccaacagggggccaggcacaguggcucacaccuguaaucccagcacucugggaggccgagguggguggaucaccugaggucagggguuugagaccagccuggccaacauggugaaaccccgucucuacuagaaauacaaaagaauuagccaggcacgguggugcaugccuguaaucccagcuuccugggaggcugaggugggaggaucgauugaacccaagaggcagagguugcagugagccaagauggcaccagugcaauccagccugggcgacagagaagaccuugucucaagacaaggaaaaaaaaaaaugcugagaggaugguggacuaacugauguucagauuccuccucuuaggcgcuugguccuccuccgugcagaguggaauuuuccagcugcccaguucgaccugugggcuaauugguggguugagaggguaagacagccuuagcgagcacugcaugccugcagaagcucccagcugaccaugguggcugcgcucagugacgaacaggagaagugaaggcugaggcuuauaggaggguggccugaggcugcugguaggagagcgggggggcucucugcggcaugcagccuccagaugggggucccugggaguguucuggaacauucucaucccugcacagagaaagaugguuaagggcauggcugguucccagugucacacaugugugugaggacaggcugcaugggaaguccugcuugguaucauucuuccuuccugggugauguggcuauuuguguuuuguuuguuuuuuaaguuaguguuuaguuaguuuagacaaaacaaaacagaugcugacauuaaagggaauguuuaaagcagaguuucucaguuccuggcugugccuagaauucucuguagaaccuguuuaaaaauguauuuaguaauaagcaacacgggggucgccaucacugaacacuugcugugccaggcacugcgugcagucucguuucacccucucgcaaaugaagguugggucugcuguuccuguuuugcagauguggaagaugaggcucagacagauuuaucauuuccccaaggggcacagccaggaagugagagaacacuucccacauaucacaguuccuggagcucuaaucgagacucauagcagggacugggcuggacacgagggcaccugcucaguuuuuaauuuuaauuuuuugguuuauuuucuuuuauucguguuuuuuagauuuuuuuuuuauuuuuauuuuuuauuuuuauuuuuagacagagucucgcucugucacccaggcuggagugugguagcaugauuucagcucacugcaaccuccgccucccggguucaagcaauucuagagccucagccucccgaguaggugggauuacaggcaugcaccaccacgcccagcuaauuuuuguauuuuuagaauagaguugggguuuuuccauguuggccaggcuggucuugaacuccuggccucaagcgaucugcccgccucggccuugaaagugcuggggauuacaggugugagccaccgugcccggcggccaccugcucauuuauaaagccccccgugacucauuuacaaccaagacugagaauuccuggcauggagugccucccucuguccaggaaugaucugcagcccccucuucccuuccaggugugucugugucucccuguggcuguuucugcaagauuuugcauuuuugagcucugcuuuuauucaugucaucacccgagcauguucccagggucacccugaccaugcugcuggcugcguauuuaucccuuuuguaucuucuguccuggguccucucccaccuucucuggggucagcccuguggugccuuacauugugcugcuuucucuccuggcaccaaagaaugaggcagucagugcggagugggggcaguagucaucaucaucacugaguuauugugaaccgggaaagagauaugaucuguguugacacgacacacggugcccaagugcacuugauaaauguuggcugucauugucauuguugauguuccggugauuauuguugaugcuggguggauucuuccugggaucagggcagauauccagcugcugugucccuugguguccuuaucaguguccuuccuaauucugcaaccaaggcaucugccagggcuggggucucaucugaagacucaaucagggaaggguccacuuugaagcucaccugguuguuggcagaacuugguuccccaguucaaauguugaaauacuuuauuacuguggaaacagccacugccccagguaccuuuuacccugaacucuugggaccucucuguggucuaggaacugaaggguuaacuccuggcacuacaggggucuccgggccucugccuguuggcugauggccuugucaaauugguuaucuauuuugaauaucacuucuucuuucaaugcuugggaaucacggggcuaugcccuuucccucaugcguuuccuugcauccugguccuaggaagugagcuuaacauagcagggcuacuguuuucugggcuggguuuuacccauugcugcuggcacaggaugcuggcucaggcccagugcccucaguggauggagccuucugcacaguugcaaagcacugucccuaccccaagggacugagcuccagauaccaccugccccacaaccagacagccuguucauggccucugcagagcaggucuccuacuuucugaucauccuggcggccaggugcucuguggucuccucacugaaguggccgguuuuuguugcccuugguuuuagcaucugccucauauaaccccacuugcccccuuugucucucuucugccaggggucacgggcgucagcgguccagggaaggaagcaaagcaaauggagaauggcaugcuggugacggacagugcagggaagcaacugcagagguaagggcggggaggaaggccccaaccuaaggacccugcccugccagugggaggacaagaggaggaacaaaaaaaggccucagcccccugagguccuggaaggccugggcuuuuaccuucccucccaaauccuccaaggaccuugcuuuucagaguacagaggcccaaagaaggaauguggcacucuuuuugccagguggcacaacucacacaggccucaugauuuaaccagcuguccacgcuucugacacucgggcucccuacauggugugggucuuugcucaggucucuuggcggggccuggaagguucaggcuuugugaagcagcauuugauuuaaaacugucucaaggccaggugugguggcuccugcuuguaaucucagcacuuugggagguugaggcaggaggaucgcuugaggccaggaguuugagaccacaguggguaacauagcaagaccucaucucuacaaaaaaggaaguaugcucguguuugauuauagagggcuuccuuagaucccuggggauuuauagcguaugcaguauauuaaccauccuagcuuuuaaaaaacuggcuaagucggccaggcaggguggcucaugccuauaaucccagcacuucgggaggcugaggcgggcggaucaccugaggacaggaguugaagaccagccuggccaacaugaugaaacccugucucuacuaaagauacaaaaauuagccaggcaugguggcaggcgccuguagucccagcuacucgggaggcugaggcacgagaaucgcuugaacccaggagguggagguugcagugagccgagauugcgccauggcacuccagccugggugacagagcgagacuccaucucaaaaaacaaaaacaaaacaaaacagcagcagcagcagaaaacaguaaaacaacaacaaaaauugacaaagucggagccuaaacguaucagaccgcggagaucugagaaaggaucccggaccugcaguugcuacaggggucaggagagagcaaagaccaugcggcauagcacggugccuggaacagacaaacacuucguagaugucgcuuuugccaugguuaucauccggacaugguuaugguccggaauuggugggucuuggucucacugacuucaagaaugaagccgcagacccucacggugaguguuacaguucuuaaagguggcacgucugggguuuguuccuucugcuguucggauguguucggaguuucuuccuucugguggguucguggucucgcuggccucaggagugaagcugcagaccuucgcgguaaguguuacagcucuuaagguggcgugucuggagucguucguuccucccgcuggguuugugcucuggcuggcuucaggagugaagcuguagaccuugauggugaguguuacagcucacaaaggcaauguggacccaaacacugagcagcagaaagauuuaucgcaaagagugaaacaauaaagcuuccacaguuuggaaggguaccccaguagguggccacugcuggcucuggcagccagcuuuuauucucuuaucuggcccuacccacauccugcugauugguccauuuuacagagagccgauuggucuguuuuuacagaguguugauugguccguuuugacagggugcugauugguguguuuacaaccccugagcuagauacguaaguuccccacauccccacuagauuagcuagauauagaguguugauuggugcauucacaaacccugagcuagacacagggugcugauugguguguuuacaaaccuugagcuagauacagagugcugauugguguauuuacaaucccuuagcuagacauaaagggccuccaagucagcaccagacucaggagcccagcuggcuucaccagguggaugccacacuggggcugcagguggagcugccugccagucccgugccgugcgcccucacuccucagcccuugggcgguggaagggacugggcgccauggagcaggggcggcacucguccgggaggcucgggccgcgcaggagcccauagcggggagguggggaggcucaggcauggcaggcugcaggucccgagcccugccccgcggggaggcagcuaaagcccggugagaaaucaagugcagcagcugcuggcccaggugcuaagccccucacuacccgggcuggcggggcugcccggcagcucugagugcgggguccaccgagccgacgcccacccagaacuagcgcuggcccgcaagcgcccugugcagcuccgguucccucccguuccucucccuccacaccuccccgcaagcugagggagccggcuccagccuuggccagcccagaaaggggcucccacagugcagcggcgggcugaagggcuccucaagcgcugccagagugggugccaaggccgaggaggcacagagagcgagcgagggcugcgagggcugccagcacgcugucacuucucaaucuuacacagccuaaauucuagugggagacuccagacagugcaugaguguagaaggauguaagauuuucugucgagguguguggaugugugaaguccuaggucaugaagcaggaagccccagcuccccauuugaauucuagauuccauccagaguugguuccaguugcucccucugccacucccugaaaacucacucuugcuuucagauuugagggccacuuccaccucacuaggccuuaacuaaagaccuuugcacagaucucauggguaaggaaaguuuacccaaucccaggcgcuaauucaaagaggggaggugguggagguuuauucggccuucaggaaguguuuucaggggacacaguucugggggugcagggaugacucauauggggcucuugaccucaguuagcuuauaaucuugugcaggagauaaguggguagaggaaaguauagaaauuuccacggcagugagccgcagcuguguuuugcauggucuccauaauuucuuuucuuuucuuuucuuuuuuuuuuuuuuuugacaugagucucccucugucgcccaggcuggagugcagugugcaguggcgcgaugucagccacugaacggaaaacugugggcgacgcaaucugugaucaucucugggggucugcauaaagcucaugaccacugaugugcgaaaagugcuuuuuuuuuuuuuuuugagacagggucuuacucagucgcugaggcuggagugcaguggugcaaucacggcucacugcaauuucugccucugggauucaagcgauucuccugccucaaccucccaaguaguugggacugcaggugcacgguaccacgccuggcuaauuuuuguauuuuuaguagagacgggguuucaccguguuggccaggcuagucuugaacuccuggccucaagugauccgcccaccucggccucccaaagugcugggauuacaggugugagccacugcaccuggccaaauaaugcuuucugaguaacacgcuugcaugaaggagcagucaggcaagaucccaccccagugcccaccacauuuguaaaacaagaaaaucgaacuagcuggguacuuugcccuauguuuuucaucauauguuacauuuugaaucuuuuucauguuugaaaaaugaucuacgaugugcccuuucuguuauaucuuuuauuggcuuuuuuuuuuuugagaugaauucuaauugaucucagaaaaaaaaaaaaaaagcacgcacuuuuuauauaccaguugucaugggcuuuuugcaggcccccagagaucaucacagauugcguuucccaugggucucauuccugccugagacacugccuuucucuggguaccuauaaaccuggagagugacauggugggguguggugcauauauucauauauauguuuacaugugugcauguggaaacacuccgucucuuaugccaugguucagacccacaauagcagucccagcagggagcccuccgacccugcccaaggcaucuguacgguugacacccuugugcuuugcuucuccagacagcucagcagcuccuccuccuauaguggggacaucagcaggcaccacaacagcaccgcagaacugcagaaagcugaggccaagaaggaggagaccuggaagcugauggaggcugacaaggcgcagacagggcaggugagauucgcuccuuaagugaugacaguggcuggaguuuauagagcgcccacugugcacugggcacugugcaaagugccuugucuauguuaacucaccuguccaucacaacacaccugugaagauacuauuugcagcaccagaaacugaggccagagaggcuaagugacuuacucacggucaccccuggucagcggcagaacugggauuugaacccuggccaacuccaggguuaguacuuguagucucugcucuauugacugccugagcagcucaggggggucucauucgcuagaggugagcuggaugcuuuaaaucagggcuuccugcaacgugggguucaguugugcaugagaugguguccgguugugcacagacgcauuaaaugacagaggaauguuuguuucauuucuuuuuuuaauuuuuauuuuuuugagauggagucucacucugucaccaaggcuggagugcaguggugcgaucucggcucacuacaaccucugccuccuggguucaagcaguuuuccugccucagccuccugaguagcugggauuacagaaacuugcuaccuugcccagcuaauuuuuguauuuuuaguagagacaggguuucaccauguuggccaggcuggucuugaacuccugaccucaggugauccacccaccuuggccucccaaaaugcugggauuacaggggugagcaccgcguccugccuguuuuucauuucucauuugguccuaaugauuacgucccugagaaagucccaguuggguccuacccugccuucucaaccuaucaaccacuauccucucuuuguaacaaggagaccggguuuugagcuccuguuuuauuguuuuuaaagaucgucuauuuugggcaaguguuaauaauucuccauuuaugguggugauccaaaguuuauuuuuaaaaauaaaugugguuuuuuuuguuuuuguuuuuaaagggaauggaauuuuuaaaguagguaaaaaauaagcaugcagauaaagaaaaacaaaaaaaaaaacaugaaaggugguagccggggaguggggcuggggcacuuucucuuagaucugcccggauguguccagagcuuccgaggacugucuguuccuggcuucuuccuuaacuugucaucagagucaggaccguaacaaggggcagaggugacucugguguccucucucgccuuacccuuagugacccuccaggaagccagagaaguuaccccaaaucgcaggacaugggaaggaagggccagagaugccaggcccauuuaauccucauuuaacuccaauuuuauauucaaggaacaucaaagccagggggcuuguuacuugucaaaguuggacccagaguggagccaggcacaacacgcuuaucguuucuuugugucuuuuuuuuuuuuuuuuuuuuuuuugagacgaaguccugcuguguugcccaggcuguagugccguggcgcucaccgcaaccuccgccucccggguucaagcaauuuaccugccucagccucccgaguagcugggacuacaggccugcgccaccaugccuagcuaauuuuuguauuuucgguagagauggcguuucacuauguuggccaggcuggucucaaacuccugaccuugugaucugccugccucagccucccaaagagcuggugcugggauuauaggcaugagccacugcgcccggccuuuuuuuuuuuuuuaauuuguuuucuuuuuuuuuuuucugagacaaggucugacucugucacccaggauggagugcaguggcacaaucauggcuaacugcagccuccaccucccggauucaagugauucucccaccucagccuuccaaguagcugugacuacaugugugcacccccacgcuugacuaauuuuuuuaauuuuuuuguggagaugagguuucgcccugucgcccagacuggucuugagcuccugggcucaagugacuggcccgccucccaaaguacugggauuacagaugugagccaccacaccuggccacacacuugucauuucugacccccgagcccaccacauuccacuacucaugagaaagagguuccugaacgcugcaggcuaauuucagggacagcaggcaacuuggccgcaugacaaagccaaguggugaaauaaacacauucuuaauuaugaccugucuccucacccacauuuuucauuuuccagaauggggacuugaaaacucaaaaggaagcagccaguuacacaucagaccuguuaucuuucaccuguuaccuuucagcuagaccguagggucagaugauuuuuguuuuuuuuucuggugaggggcagagccucacugugucgcucaggcuggagugcaguggugugaccaacgcucacugcagccuuaagcuucuggguucaagagcuccuccuagcucagcuuccugaguagcugggacuauagguguggaccaccacaccuagcuaauuuuaaaauuuuuuguagagacagggucuuacuguguuucccaggcuggucucaaacuccugggcucaagucauuguccugccuuggccucccaaagugcuggcauuauaggugugagccaccgcacccaguccagaugauuuucaugacccaaaauucagcaugaaaagcuugaaaugacaaugagcacagacacggguaaagaucccuggaauuucuugaaaccaagucaggugguuuaggugggggcuggccuaaagcagauugcccugucucucaugucaggcggcuagacacauuuguuuagccccaugcugggcuccacagggaauauaggagggaaagaaacuccaaccuucaccuccuggagcgaacugggcacugggaagaugggugagaugguauucugugcucagagugaaaagaguuggaggaggcuggcccaguugugguguugaggugacauuuggccuugguugccaggcaacaugucacacguugcuuaaaacucauugguggcuucugcuuucugucagucuuggcuaaaaguuggaauccugacccgagucucccaugccauguguggucugacugcgaccgguuuuuccagccucuuguuccuugcugccccaugaucuccuggcuccagccaccagugccuucucucaguuccccagaugcacuguguucccuccuaccucagggccuuugcacaugcugguucugccaccuuuuuuccauuuucagcugguuuaacuccuuuuuuuuuuuuucccccuggaggcaaugucucccucugucacccaggcuggugugcaguaaguuuggcuuggugcaaccuccaccuccuggcuucaagcgacccuugugccucagccuacaggcaugugcccccacgccugacuaauuuuuguauuuuuuguagaggugagauuucaucauguuggccaggcuggucucggauuccugaccucaggugauccacuugccgcagccccucaaagugcugggauuacaggugugugagccacgaugcccagcacucuuuauuuuuuuuuauuuuuuagagacagucucacucugucacccacgcuggagugcaguggcgcauucucggcucacuguaaccuccgccuacuggguucaagccauucucuugccucagccucccgaguagcugagaugacaugugccuaccaccaugcccagcuaauuuuuguauuuuaguaggcaagggguuucgccauguuagucaggcuggucucaaacuccugaccucagguaauccacccgccucggccuaccgacgugcugggaucacaggcaugagccacugcacccagccuugguuuaacucuuuaaugucacuuccucgaagaaaaccucccccaauaccucucuagacugcauuaggucagguugucugauuuuauacucacguggaauugugcaccguuuacagcccuucucugugaugacgcauuuaucugggaugauuuuaugggagccuaucucaccacgcgacuggaagcuccaugcaugagggcagagacccugaguuugucucuuuuuuuugagacggagucucacucugucgcccaggcuggagugcaguggggcaaucuuggcucacugcuucuaccucugccuccuggguucgaggaauucugccucggccuuccaauuagcugggauuacagaugccgaccacacacccggcuaacuuuauauuuuuaauagaggcaggauuuugccauauuggccaggcuggucucgaagucucuaccucaguugaucugcccgccucagccucccaaaauguugggauuacaggugugagccacggcgccuggcccucgacuuuguuuacugcugacuuuguugaauagcuaaaggggagggguguucuacguaggagcaaaggcaggcagcuggguggcacagugcuggugaagcccccgaccuuguggggcuggggcuggggcugggugcgugcaugugcuaagcugccuuaucuccugugaucuccaggucaagcuuuccguguacugggacuacaugaaggccaucggacucuucaucuccuuccucagcaucuuccuuuucauguguaaccauguguccgcgcuggcuuccaacuauuggcucagccucuggacugaugaccccaucgucaacgggacucaggagcacacgaaaguccggcugagcgucuauggagcccugggcauuucacaagguuggugccgcugucucccaccccgccugauuugggccccuguuguggcuuugucuaauuauagaaauggauccuuagaguccucagcguuuugugggaccccaaaccaagccaaacccagaaaaaugguagcugucagcuaguagacacucagauauuuguagaguggguguuugagugcuuuguucauaugggccuuggugguagacgggaggagugcuccagugugcccauuuuacagaugaggacaguugagaacagaggccucuggaagcacugaggguugggaggacccccuugagcauguuugcuuugucacagugacagagcuuccaugaggucucauuugcggacuuuugccugcugagugagggcggaaauuggcuuauacuaguaauucccaauuaugggcaguguugucccucagggauguuugacaauaucuggagaugcuuuugguugucaaaagauugagaaacccugcuguuggccaggcaugguggcucacaccuguaaucccacacuuugggaggcugaagucaaaggauugcuugaggccagauauucgagaccagccugggcaacauagugagacccuauuucuagaaaaaauagauaaauaaaauaaacuacaggucacguggugguaugcgcuuguggucucagcuacuugggcagcugaggucacaagauugcuugagcccaggaguuugagccuacaguuagaccuaugauugcaccacugcccuccagccugggugacagagcaagacccugucucaaaaaauaaacaaaaaaaaaaaaacccugcucuauacuguucugugugguccuaugggaguccucaaaugcagcagcguugauauuaacagcuggcauuuacugagcauuuacuuggugcuuggauuuguucuaaacacuuccacguguuuuaacuuauuuuauccuugcagcaguccugugagguaggaguuaauauuucccucauuuuggagauacagaaacugaggcccggagagguugagucaguugccaaaagucacacagcuaauacauggcagcauuggcauugaacaaggcagucuggcucaggagcucacgcuguuauccacugugcuacgcaguaugugagccauguuugcaaauacacauguaugguccauaugauauauacacaguaaauggauagucuugacacauuugaguacuucuguaugccaggcacauugccagguggggacuucacauuccacagugcuccgaggucagcgucauugucccauuuuacagaugaggaaacugagagauucagugaccaguaggaggucccauagcugguaaguggcagagaugggauuuggcagcauuggcuccagagccuguuacuugagccccugccuauugggugucuucccgauuaaagaggccgagauggaagccucucuguuccuaggaaguugcugcucuggaacacacagugcgcuccuguggauuguuugagagaagcaccagugucucaggaucuccaggagguggcuuugggaaaacccagcgguagcagagcacacauggacuccuugagucucucaaucccuccccuccccucuccuugccauuaggggaaaggacuguggccuacaaauuauaauugagggaagguagagaacagagagggugugguauuaccugaacucacacagcaacaacgucuguuccagagcugugcugucuggugcgguagucacaagacacagguggcuauuuuaauuucagcuguuaaaauuaaauaaacguugggcgcaguagcucacgccuguaaccccaacacuuugagaggccaaggcggguggaucgcuuaauccagggguucaagaccagccugggcagcauggcaaaacccuguuucuacaaaaaauacaaaaauucgcugggcgugguggcgcaugucuguaaucccugcuacucaggaggcugaggugggaggauugcuugagcccaggaggucgaggcugcagugagccgugaucacagcccuguacuccauccugggugacaggaugagagagaccccaucucaaaagaaaaauaaaauuaaagauuuauucgauuagacuagacacguuucaagugcucaguagccaucauuucagaaaauuaucucagcacuguucuaaaacagcgaucccuagccuuuuuggcaccagggacugguuucauggaaaugguggguggugauuucgggaugaaacuguuccaccuuagaucaucaggcauuaguuagauuaucagaagaagcgcacagucuaggucccuugcaugcacgguucacaauaggguucgcacugcuaggaggaucuaaugccaccacugagcucacaggaggcagagcucaggcgcugaugcucaggaggugaccaccacucaccuccugcuguggggccugguuccuaaccggucaugagcugcugccaaucuguggccccgggguuggggaccccuggucuagaagaauauggcauggggauuaagagcaggcugucuggauuaaaaucccaguucugcuucugcuaggcacaguauacuaagggcaaaggcguucaccuaucuggacuucaguuuucuuaucuguaaguuggguaguaauagaaguuauucagagucaucauaaaaaucaguuacauguaaaacccagcacagugcuuagcacauaggaaguacccucugaauaauagcugccauuaucaucaucauuauuauuacuauuuuuuuuuuuuugagacggagucucauucugucgcccauguuggaguggaguggacgcagucuuggcucacugcaaccuccaccucccggauucaagcaauucccuugccucagccucccgaguagcugggauuacaggcgccaaccaccacgccuggcuaauuuuuguauuuuuaggagagacggaguuucacuguguuggccaggcuggucucgaucuccugaccucaagugauccacccaccucggccucccaaagugcugggauuacaggugugagccaccaugccugguucaucauuauuauuauuauuagaaguugggaguccaggccugccucguccacauggccacuccucccugcagugccuggucagcucccucucugcauuguggaguuuuaacuccgagugucugcagggaucgccguguuuggcuacuccauggccguguccaucggggggaucuuggcuucccgcugucugcacguggaccugcugcacagcauccugcggucacccaugagcuucuuugagcggacccccagugggaaccuggugaaccgcuucuccaaggagcuggacacaguggacuccaugaucccggaggucaucaagauguucaugggcucccuguucaacgucauuggugccugcaucguuauccugcuggccacgcccaucgccgccaucaucaucccgccccuuggccucaucuacuucuucguccagguaaggggugaggucuuaguguucgggacaagcccuacugugcauuauauaccaguguuaccuaaagccuuguuuuaucuuaccauguccccaguguggugcuuuugaagcauguagauuuguuuuugucaguuucgaauaccuaaauuguuuuuuugcucacaauaacaaaaugcacuuuuuuuguggaaugcaguuuuuuccuaaguuuuacuuuuccaccugucaauucaaaaaggaaacaaaaccuaucacuauaaagacaacuucauuauuaaaauuucuuuuuuuuucuugagacagagucucgcucugucacccaggcuggagugcaguggcacaaucuuggcuuacugcaaccuccaccucccaguucaagugauuccccugccucagccuccugaguuaacaggugcgcaccaccacggccggcuaauuuuuguauuuuuaguagagacaggguuucaccaguguuggccaggcuggucucaaacuccugagcucaggugauccacccaccucgaccuccccaaguguugggauuacagaugugagccacugcguccagccuaaaauuucuucaaguauaaaauucuuuaguucuuaagccuccugcaggaggcaggaacuaaacaaaaaacaugacuaauagcagccuaaauaagauagacguuuucuuuuucucugucauaauagaaauuuagagguaggcuguucagggcugguauggcagcuucaugaguuuaauaucccagauaccugcuuuuauuuaaaaauuuaaaaaaucuuaccauauuuauacaagccuuucauucuuucuuucuuucuuuuuuuuuuuuaauuugacauggagucucgcucugucgcccaggcuggagugcaguggcgcgaucucggcucacugcaagcuccaccucucggguucacaccauucuccugccucagccucccgaguagcugggacuacaggcgcccgccacuacgcccagcuaauuuuuuuuguauuuucaguagagacaagguuucaccauguuagccaggauggucucaaucuccugaccucgugauucgccugccucagccucccaaagugcugggauuacaggcgugagccacugcgcccggccccuuucauucuuaaguuggccucaugguccaagguggcugcuggagcuccagccauuauaucuauauuucagucagugagaucaaggaagggaaguagggcaagggagcauaugggugcugaaucagcacuacucccuuaucugcaggcacacauucuaagacucccccaauggaugccuuaaacugcagauaguauugaauccuacauauccuguuuuuuucuguacauacauaccuaugauaaaguuuaauuuauaaauuuggcauaauagauuaauagcaguaauuuauaauaauaaaauagaacaauuauaacaauaugccaguaucacuacuucuccacauuagaggcguuauuuuuauuacuuuuuuuuuugagacagaguuuagcuguguccuucaggcuggagugcagugauggaaucucggcucacugcaacaucugccucccggguucaagugauucucuugccucagccucccaaguagcugggauuacaggcaugcgccacacccagcuaguuuuuguauuuuuaguagagacgagguuucaccauguuggccaggcuagucucaaacuccugacgucaagugauccgcccgccucagccugccaaagugcugggauuacaggcauugacccacugagcccagccaggggcauuauugaguaaauucggauuacuuacccauaagcacugcaguacaauggccgucagucugauaaccgauauggcuauuaagugacuaaacugacagggagggucugcagcauggaccugcuggacaaagggaugauucacaccgcggaugggacugggggggauuucaucacacuacucagaagggugcacaauuuaaaacuuacacauuauuuuuggaccacaguugaccauggauaaccgaaaccauguguguuaguuuguccucauacugcuaugaagaaauacccaauacuggguaauuuauuaaggaaagagguuuaauugacucacaguuccgcauggcugaggaggccauggcagaaggagaagcaaacauguccuucuucacauggcaguaggaagaagaaugagagcaccacgaagucggggagcccccuuauaaaaccaucagaucuugugagaacuaacucacuaucaugaggguugggggaaacugcccccacgauucaguuaucuccaccuggucccucccaugacacauggggauuaagggaacuacaauucaagaugaaauuuggguggggacacagccaaaccauauaaccacggaaagugcaaccuuggauuagagggacaccuguacaucuaauuguccagaacuuagucaugggaccaccucuauucacaagggacccuggaaagugccguguuuuagcugggcacauugcacuucccagcaaaaacuuucaguugggccuaggcacgguggcucacgccuguaacccuaccccuuugggaggccgaggcgcguguaucaccugaagucaggaguucgagagcagccugaccaauauggugaaaccccaccucuacuaaaaauacaaaaauuagccaggugugguggcaugugccuauagucccagcugcucugaaggcugagacaggagaauugcuugaaccugggagguggagguugcagugagccaagauugcaucacugcaauccagccugggcaacagagugauacucugucuaaaaaaaaacagagaaguuucuguugggaaaggagaaauuguguaggcagucagucgucucugcugcaucccuucugcagaaacgguuauauguucuuuguucuuugaacacaugugguuucuuaggauaucgcaggauagauaauguuuucaauugacagguggagcaucuugcuaagugggagagcugagagugcaaccucaagucuguccaauuccaaaacugcuguuaccgcuaaaggauuaaccgcagcacaauugccaguagggauggguuguuuagaugggagcauuccagcugcaaagcaaaacaagaguaagaaaccaugaggcucaccauaucucaaaccacgcugcacagcuguucagguggcauccagggggccuugguucaaucauguggccccugcgccccaccacacuguggcccaaugauugaugagaacgaacagugauggaaucagagagaguagguccaguuccuggagucucguuauauccucuugaaauuggugccagcuuuuuuuuuuuuuuuuuuuuccccugcauuuaccaaauauguuaucuguguucauacgcaagcuggaaaauuuccugaaagacccaaaaagaacaaaacaggccaaaugcaguguugaaggcaacuuaaaugucugccaauagcaggaccuuggguacaccguggagcaauguggcuuugagcagggauaauuagaagacgcagcuguuggagcaccaaggauuuuuauuuuucaacaacaaaggaaaugauuuuagcaaaggaccaaguucuaggugcacugucguuaucaccgagaugaaaugcauaaugugugugggcaggacuggaagggaggcagauacaugaaaacaucgucuuuuuaaggguugagauuauagaauaguuaauuuuuuaauggcuuuuggcuaaauuuacauuuauccucucacuaggcagucucauuccuaaguguauauuaaaaaaaaaaaaaaaaaaaaaagagcaaaggcagugcuuagaauguucucagcaucuugauucauaaucgcccaaacuggaaacagcucaaauguccauuaacaggaccguggagaaauaaauugugauauaauuauacaauuuaugguugaguaguaaaaaggaaugaaaugcuaauacacaacaauuuggguuuaucucagagauguuauagugaucaaaagaagccagacgaaaaagaguagguacugugagauuucauuuauaugaaguucggucgggugcaguggcucaugccuuuaaucccagcccuuugggaggccuagacaggaggauugcuugggcccaggaguucgagaccagccugagcaacaugggaaaaccuggucucuacagaaaauacaaaaauuagcugggugugguggcgugaaccuguagucccaccugcuugggaggcugagauggaagggucacuugagccucggaggcggagguugcagugagcugacauugugccagugcacuucagccuuggugacagggcgaguugucugaaaaaaacaucagaucggcagggcagguggaucaccugaggucaggaguuugagaccagccuggccaacauggugaaaccccaucucuacuaaaaauagaaaaauuagccaggcacgguggugggcgccugcaauuccagcuacuuaggaggcuaaggcaggagaauugcuugaaccugggaggcagagguugcaaugagccaagauugugccacugcacuccagccagggugacagagcgagacugucuuaaaaaauaaaauaagaucauuccugaacaaauauucaucucagguuagauuuuuccaguaaguaagguucagaggcaguggcaaguggaggaaagugaacagguaacacacuugagagcgauuugcaucuggauuguucagaaagcaagcugguaagagaggaaggagaugugguccaggguaagauggggcagaucaccugggccuucagccaugcagaggggucuggauuucaugggaggcggugggaacagcuggagaagaaauuauaucugauccacauuccaggaauuggcagaacagcuauucugagacugcgugggguugugcgguaccuggguucacuuacauagcuucuggggccccagaagacucuccaucuguggguugcaauuaacgcccgugccgccacccaggaagaagcugccaaccacagaggccuuguaaaagccaccugcugcuauugaugcuuuuuguuggacucugccccaaagcagcccaguacaccuggcccagggcaggaugcagggaggccgaguuccuagcaacccuuuguuaguuuucccagcucuccugucgauaagcaauuguaggcaccuuguggaaucaggaaccccgggcucaccaguuccuuuugcguagaugagaaaaaccuaggcuaggagagcgcaguguccucacauggcuggugcagccucugauccacagcuccacaaagcuugcagaaggugguuggcuuuuguucugaaucuaacaagacuuaucgggaggcucuuggugccuggcacuggcugaaugcccagguugggggaggcagagcagaugaagcaucugcccgcgaggguggguggagcugcuugugaaacguaucaucguagcccgggagcugggacacugaagcccggagaaggugcucauggaggaugggaagggcuucccgaggaagugacaucugugcucccaucugcugggugaugaggaauggccuggacgggaugggcaugguggguggaggcaggcggccugugugcagggaaggaaggggagaguuacaggaugagaugaguugagggaagaagcaugguuggcaacucuaacagcgcugggaggccaucggaggggggugacgagauugacccuauccucaugggcaucucagcugggcugagugugcuggaaccggccauugcauggacacagucacuccugaggggaugugaucaacaggcggaauucugucacuuaaugauaacaauagucaccagcuaacugaaugcuuacuguuaggucaaacuauaugaaacugcuaauacuuauuucuuaucuacagaaacagcuauuuccugugguucaaccuaguauuaccaggcacugugcuuagugacaucaugcauaucuauaugauuuaugaaauaauguguccacgcaaauacacaucacauguaagacuguaacucuuacaugucacccucacaaugaccccgugaagcaagcuuuguuuuguuucguuuguuuucuuaauaauauuuuauuuuuguagagauggcauuuugccaugugccugggcuggucucagacuccuggccucaagugaucucccgccucugccuccugaagugcggguauuacaagcaugagccaccccaccuggccgagcaagccuuguuguucccauuuuacagauaaggaaacugaggcuuagagaaguaaaguguuagucguguuuauauugccagucaguaguugagucaggauuugaacugaggucucguugaccucaaagccuaugcugaaaaccacacugcugguuccagaaaacccuagaggugaaaggcuucagagaggcaguacaggguagagguuagcacuuugcagcccagauggccuggguuugaaucccaguucugccccuugcuagccaugugaccuuggggaggagauuaacuagcuucuuugugccuuagucuacccaucacauauaggaaugagcaccucagguuuuuugugaggauugaaugaacugauguuuguaaaacugcuuagaacgaugccuggggcugugggcuuuguauaagcgugagcuauuauugucacuguccuugucauugguggugcuauuccugugguucaccaggugagugggcaccccugugagggcagcccggcucuaacauuuugccuccuggagguaucgguuacgucuagauguucuccagcacagcccugcccugggaggauggcaggagggaaccuucaucaacuccccgcgucuguucucuaccccagagguucuacguggcuuccucccggcagcugaagcgccucgagucggucagccgcuccccggucuauucccauuucaacgagaccuugcugggggucagcgucauucgagccuucgaggagcaggagcgcuucauccaccagagugaccugaagguggacgagaaccagaaggccuauuaccccagcaucguggccaacaggugggcauggugggccugcaggagcggguggaggaggccgccuuagcaccuugucucuuugccucgaucuuuuccucgcaccuugagcuggguauaaagccaaaccccggccuugcagaaaggauggagaggcuugaugagcgcggaggacagaugaaucauuaagagcagacagcggcacuguagacaugcagugcccgcggcauuuaagugcagggacacagcucuucuggagucagaaagcccugcaagugcuucccguuaacugucauccuagugaugcaagacugccagcgaccgacucugcuauugaguaucuucauaccgcuguucccgucugggggugaucaugcaccccugggugaugugugucagaagcaauuuacuaauacuaagcuaaaccauaugagauugucaucuugugggccagaugucauggcucacgccuguaaucccaguacuuugggaggcugaggcaggaggauccauuagauuccaggccagccugggcaacauagcaagacccccaucucucuuaaaaaaaaaaaaaaaaaaaaaaaguagcccaucaugguggugugugccuguaguccuagcuucucgagaggcugaggcuggaggaucguuucagcccaggaguucaaaguugcauugagcuaugauuacaccacugcacuccagccugggugacagagugagacccugucucuggaaaaacaaaaaaaggagaugggggugggagauugacaucuuguggaucacagauaauagcaucaauccaaaagaggcagaaguuugcuaauuauuugcugaauuuagagaagugucccucucacccauuugcauccuuauagacuuuucugaaaaagugacagcaccccagaggugucccauaaccauuagcccgucuuacacacucuaaucccauagcguaagucugggugggcuaacccugaaugauuacagaccuugacuucccuucagaauuuuuagggaguuugucacaaucuggcugugucugucggaguagugaggaucagucacuugguucauaagggcugcaauggagaaaagaucaacaccccaucuuccuagaaugcuuuauauuuuagaacauuaaaauaauaguucuagugcuauaugauaucauacgaagccuagcuuuaaacaaauaagauggccaggcgcgguggcucacaucuguaaucccagcacuuugggaugccaaaguggguggaucaccugaggucaggaguucaagaccagccuggucaacauggcaaaaucccaucuauauuaaaaauacaaaaaaauuagccgggcaugauggugggugccuguacuugggaggcugaggcaggagaaucacuugaacccaagaggcagagguugcagugagccaagaccgcaccauugcacuccagccugggcaacgagagcgaaacucuaucugaagaaauaauagaagagaagagaagaauaaaauaaaaaguaaaauaaaauaguucugaugguacaugauaccauacuaaaccuagcuuuaaacaaauaagaugaccaggcacauugguugacaccuguaaucucagcacuuuggguggccaaggcaggcgggucacuugagcccagcaguucgagaccagccugggcacucuagggagacccugucucuaaaaacaaaacaaaaaaccaaaaauuugccaggugugguggcaugggccuguagucgcagcuacucaggcugaggcaggaggaucacuggaacuuggaagguugaggcggcagugagcugugaucaugucauccacacuccagccuggauggcagaguaagaccccaucucaaaaaaacaaaaugacagaaaacaugauuucuguuucuauuuuaaaggguaaaauaguauauuuuaacacuuugaaaugaagagucugggcuugggaacguuacaaugauguuuacucguacuaguuacgcacuccccucccagaucugucucguaacaagagacuguuauuuucuacuuguuuuuagccaaaaggccgagaaacgaugguuauuuuaaaucccuagugucucuuacaguugaugucuucuuaguauuuaggaauuuccaggacaucuuuuuguuguuguuaaugcacugugugugugugugugugugugugugugugugugauuauaggagugacccacuacgcccggcuguguguguguguguguguguguguguguguguaugugugugugugugauuauaggagugacccacuacgcccggccuauguguauguauuuuaaaggcuucaaugagaaaaaaguugguucuuaaaaaggcaagcuucagauuccagggaagauugccucuggagagcucuguuuuaauccauggguuugccagauuaaugaggauuuacuggccucgugccuucggcccucccuacccugcgcccauugugcauguuuugaaaaagcagugccaggaaggacucucucuggaauuacugcggaguuacuugaguuagcaaagaauccccuuccucccccaagagcuguaagccaagucucuguagagcugacuccaugccuguuugucugccugugugucuuggcgcagguggcuggccgugcggcuggagugugugggcaacugcaucguucuguuugcugcccuguuugcggugaucuccaggcacagccucagugcuggcuuggugggccucucagugucuuacucauugcagguaagaggggaugcucuuggcuggauuauuaaagucuguuaaugggggagccaguuguccuuggcuuuggauuccagcuccaacaggaaugggggagaggaacuugagagguacggaguuugaggagcagguacagugccacagugccuggugaccaacuagagcaggagacggauuugacauguggccaggauuuuccccaucagucacacagauuccuuaguggcccaagaggauacuuccagguacgaggggaaugcuuuuaaagcuaugaauuucccucuaagaacugcuuuagcugcaucucacaaaugaugauacauuguguuuucauauugucaccuggcuaaaaauauuuuccaguuucuuauuauguggcccaugaguuauuuuggaaaugugugugcuuaggagauggcaauguggcaggccugggugauggcuauaccugggguugcuaauuucgguaccuuucuuaccugaauguuucauaacucauaaccuuuuauuuuuauuuauuuauuuuuuuuggagacggaaucucacucugucacccaggcuggaaugcaguggugggaucucggcucacugcaaccucugccuccuggguucaagugauucuucugccucagccucccaaauagcuggguuuacaggugugcgucaccaugccuggcuaauuuuuauauuuuuaguagugacugaugggguuucgccacaucggccaggcuggucucaaaccccugaccucaggugaucugaccgccucagccucccauaauucauacuuguugaaaauaauuuguuuccuauuaucucaguggaaaaaaagaaaaaggaaagucaaguacgcccgcuuacucuagaaaugccacgugacucuuccacucacaggucaccacguacuugaacuggcugguucggaugucaucugaaauggaaaccaacaucguggccguggagaggcucaaggaguauucagagacugagaaggagguaggcaagggccccuggcuggaccucuuggucuuugguguagcuuuaccccaaggagaucucuggacccuauccugugcaccucugccucugagcuggauaccucaccagguagaagugcaucuuaacgcuuguccagucuuuuugcagcacuuauuuagagcccgguuuuagggugaaaauaguuuaccggcuuuacccaagaucugggguauccauauacgagacugugggaugcugucagggcauucagaagguauucacauugugaagaaguuucccccucuauuucucuuucauaacuucugaugguaucacagagaaagucuuagucuggggcuagcaggucuuuaacaccuuagcaauugagaugaucucccuucaacagacagauaaacagcagcccucacacuuggagucuucaacaggacggauucugucuaucagaaauaaccuucuguuauuuguuaugaauuugguuuuuuugugugugugauggagucucacugucacccaggcuggagugcaguggcacaaucucggcucacugcaaccuccuccucccagguucaaguaauucuccugccucagccucccaaauaguugggauuacaggugccugucaucaugccuggcuaauuuuuguauuuuuaguagagauggggguuucacuaaguuggccagucuggucucaaacucuugaccucaggugauccgccugccucagccucccaaagugcugggauuacaggcgugagccacugcgccuggccuguuauguauuuguauaggggacuccuguuacggaaaauaauacuacuuuuccuuuugugauuguaauaaauuuuccucuuaaguaaguugagaaauuaagucuaagugacuugauuaagcauauuaaaacaacaagagaaugaguacaugcauacuacacgaaugauguagcugggaacugaccaaaguuugggaaacccugccguuauugaaccccaguccccuuuuuauagauggagaaaaagggaaccuggggagggacaacagcugauccaaggucccacguggcuugguagaacagcugggacuaggacccgugccuccagucuuugauguugcguugcccuuaauaacugccuucuuaggcccugaacagcagcacaaguaggaacagcagugauaauagauaaucacaauaaugccuggcgacacccccacccuacauuaaugauaacagggacacacauagugccuuguagaaugucaggcccagacuuaaacguuuaauauagaguaaugcacucagucuuuaccccgcucuaugacugauuuuugagacacggucucacucuugcccggguuggaguguagugcgaucucauucgcugccucccaggcucaagugauucuccuaccucugccuccugagugucugggaccacgggcauaugccaucacaccggacugauuuuuguauuuuuaguagagacgggauuuugcccagacucaucuugaucuccugagcucuagugaucugccugccuuggccucccaaagugcugggauuacaagcgggagccaccaugcccagcccagcccuauaauuuagaugcuacuauuacccccauuuuacaggugaggaaacugagacaaaaagcugaaguuacuugcccaagaucacauggcugguaaauggcagaccuaggcguugagccugugccuccucagagacccuauccagugccaugggagucaugcuacccggccuccugaggagagaugccccuugggagugagaccaaggccucuguaaggucuguccuccugaggaauucacagaggugaccucggcccacuccuuuaacauucugacugggugaaccaggucccaugucacgggugagcauuguaagaauggcgugagugcccccgugaggaaccaaggguguauuacaccggcggcuuccaacuugacacugaauuuaauucacuuacaagguauuucauuagguuuuuuuuuuuuuuuuuuuuagauggaauuuggcuuuuuuuuugcccaggcuggaaugcaguggcacgaucucagcucacugcaaccuccaccuccuggguucaagugauucuccugccucagccucccaauuagcugggauuacaaguacccaccaccccgcccagcuaacuuauuucauuaguuuuuauaauagccucauugacaugugaauuucacaugccauggaauucacccaguuaaagcguucaguuagauugaauucaguuuuuuuuuuguuuguuugagacuuaagucucgcuccagccuggagugcaguggcaugaucucagcucacugcaaccuccuucuccuggguucaagcgauucccagccuccugaguagcugggauuacaggcgauuuuuguauuuuuaguagagaagggauuucaccauguuggcccggcuggucucgaacuccugaccucgugauccacccgccucagccucccaaagugcugggaucacaggugugagccaccacacccggccugaguucaguuuuuaaaagcauuuuacuuuugacugacuuuuauauuuuuagaaggaucguguuugacaaacccaagagaaaguaauuguccucauuaguccuaccacuauucuguauuugcauguauuuuuauauauagauagaaaguuccacauacuucucuccauuccgcucacuguguuguuauagcaucuccccuucaauuauguacauaaauuauaaaauagagauacacuuguuguuuuaaaaaagaaaaaaucaauacagggcuggacacaguggcccacgccugcaaucccagcacuuugagaggccaagguggguggaucacuugaagccaggaguucgagaccagccuggccaacggugaaucccgucucuacuaaaaauacaaaaauuaguuggcaugguggcaggugccuauaauuccagcuacuugggaggcugaggugggaggaucgcuggaacccgggagguggagguugcagugagcugaagaaacaucacugcacuccagccugggugacagagugagacucugucucgaaaaacaaaaaaacaaagaaguuuaugguggagaaagacaguuuguuccuguucgccccguuccucuccucuccagagagaggccccauuagcauucgggugaauuucccccaaaacuuucccguguggauucccacauaccccaacacuuuuguuugcuuguuucuuuuucuuuuaacguaaguggaaucuaccuguuauccugugaaaccuuuucuuuaaccaugaggcaccuuugcaucuguguauaguaacagucacugccucuaagggcugcugugaggcucagaugagaucaugggucucaagugcugagcagagcaacuugccuuaguugcauuguaagcgcucaauaauaacauuuauuuuuuggccaggcgcgguggcucacgccuguaaucccagcacuuugggaggccaaggcagauggaucacuugagcccaggaguuugagacgauccugggcaacauggugagacaucgucucuacaaaauaaaaaauaauacuuuuuguuguuggcggugguggugggguuuuuuuuuguuuuuuuuuuuuugagacagaggagucuugcugugucacccagacuggaguguagugguuuuaucuuggcucacugcaaccucugccucccagauucuagugaucgucgugucucaaccucccaaguagcugagauuacaggcucccaccaucaggcccagcuaauuuuuguauuuuuaguagagccaggguuucaccauguuggucaggcuggucucaaacuccugaccucaaguguucugcccaccucggccucccuaagugcugggauuacaggugugagccacugcgccggcaacgcugugauuuuauagcacguccacaaaagggcugcaugucuugccuaaaaguugcccggcguuuucuuguuaugugccgucugcagugccccugagcuuggccaugugcucugcagccugguucagcaccugugugugcccuggacggggaggugcauuccccgaggcuaaaaccagugaaccuggcccaggccauauccagcugugggccucaggaaaugcugaacugaacuacuuuucaaaaggaggguugugugucccugggcaaguuaccgccccucucugugucucagucuccuuguguguaaacuggggauaaugaaaggacccucccacaugggguugcugugaggauuggaugagacacugcgauacagaugcugcuuuuauccuugccuuccugccggggugggcagccaggguaacucacuuuuauugucgugucuguccagagaagaccacucauuucauugacuccauuuauaaauauuuauuuaaauuuuuuuuuaucaaaaaguaaguuuuauuggcaucuaaaaacaaaauucacccaacacugaaacauacuucaauauuuauguuauuguuuucuuguuucuuuuuuacucacugcagugugaggaacaaaucacauuuacuuuggagaaacagagaccauaguguagauuuuacaaaaucacuuuuuaaacucucuguauugcgcuccucaaauaccuagagccagucugugcauaacauggcacacuguugucuaaaccguaaaauuuugcaucagccuaaagauauggauaagauauaccuccacuugcucuuuugaaauacaucuauuaccuuauccagccuaaugauaguuaccuaaaaaauucuuuguuccguaggaagucucugacaagcuguuauucauuuccuugacguuaaaagaaucugggggcaacauuuauauuuuaucagaaaaacuuuuuaaaaguuuaccuaucauguucauauugagaacaaugucuguggcgggcaugguggcucacgccuguaaucccagcacuuugggagguagagguggguggaucaugaggucaggaguuagagaccagccuggccaacauggugaaaccacaucucuacuaaaaauacaaaaauuagcugggugugguggcgggugucuguaaucccagcuacucaggaggcugaggcaggagagucgcuugaaccugggaggcagggguugcagugagcugagaucaugccauugcacuccagccugggcgacagagugagacuccaucucaaaaaaaaaagaacaaugucuauacaaaucaguuguacaauuauuuuaaaagaauggugagcaugaacgucacguuaauucuggcagacaaaaaugaacaacuaugguccauugagccauuaucuguuacacagagaugacagcuuuacagaagguaucucugaccuacugagggaugaucauguccucucaguuucugugccuucuaccacuaguucacuuucuauaucagcagcugugucacucuucuuguuuauguucauaaauguguguugaacaccuacuaugugcucugagcccugggauacagcagugaacaauuagagccuguccucauugaguggauggugcagugggugugggagacagaauacacucaagcaugcgagccccaagagggcuggggacaggcagugcccugaaggagaaggcagugcgggaggggacagagggacacagggcugagagggugcucuguaucgaccagagauccacaggaugcaagggggucauuuggggaauaacauuccaggaagggcaaccccccagugcugaggccugggaggccaccuugggcagcagagugagugagaggggaggucaggggagucacagcuuuaccagauggacuggaaauuccuuacucucucccuucacugcgaucgaaggcgcccuggcaaauccaggagacagcuccgcccagcagcuggccccaggugggccgaguggaauuccggaacuacugccugcgcuaccgagaggaccuggacuucguucucaggcacaucaaugucacgaucaaugggggagaaaagguggguacacaucgccccauucccucacccauucccagucgggcacagggugccaucgggcaggugaaccuagcugcagcgucuccccagucacucacggcuccacaccuuugcuugaauggcuuuuuggggggcugggaguggacuguggcaguaaaagcuguucagagcgcauacagcuugcagaagugaaggcuuuuaggugaacugacagccugaagaccaaaugagccccacagauuuguuuuggaagauuuuuuguuguuguuguugagagagggucuugcucuguuacccaggcuagagugcaguggugugaucucagcccacugcagcggcagccucccaaguggggggacuacacaugguugggagugcaggugugugccacugcaccuggcuaauuuuuguauuuuuuguagagauggggguccuacuauguuguccaggcugaucuggaacucuugagcucaaccggucugcccgccucagcuucccaaagugcugggauuacaggaaucagccaccauuccuggccccuggaagaaguucuuuuuuuguuuuuugguugguuguuuuuuuuuuuuuuuuuuuuuuuuuuuuugagauggagucuuacucuguugccaaggccagagugcaggggcccgaucucagcucacugcaacuucugccuccuggguucaagugauucuccugccuuagccucccgaguagcugggacuacaggcaugcgccaccaugccuagcuaauuuuuguguuauuaguagagaugggguuuugccauguuggccaggguggucuugaacuccugaccucaacugauccacccgccucagccuccccaagugcugggauuacaggugugagccacugcaccuggccuggaagaaauuugaauaaguugcaaauacugaaaaaucuggaagacuuaauauaaaaauuuauuuucugcuuuuuuuggaagaucagaacaucuggcaacaucaggucaauccucccccgccuggcucuuucuagucaaccugugagccuccugguucaccccagucccucccugucccauucauugccuaguuggccccuccaaaacauuagaauuugugaucucuagaauaaggugucaccaucccuucuagggggauggcucaagggaagugagaaauugucagaauuuuggaaccuucucuugguuccgagcuguucuuggaagagguuccuugaccugagugauacccuuagacuuuccucuggaauuggucugacagucuuccuggccauuugcugggggacaaggcugcuuucaccucugaacauauggacuuauugaacuguuccuacguaccucccacaaagcucagaacauucuguucccagcagauaauuucucucugaguuacagagaagagcagagugggugauguucuugcugucuuuuuuuguuuuuguuuuuguuuuuguuuuuguuuuguuuuguuuuguuuugagacagccucucacucugucacccaggcuggaguccaguggugcuauuucggcucacugcaaccuccguccccuggguucaagugauucuccugccuccgucucccgaguaucugggacuacaggugcaugccaccacgcccagcuaauuuuuguaguuuuaguagagaugggguuuuaccauguuggccaggcuggucucgaacuccugaccuucucugauccaccuuccucggccucccaaagugcugggacuacaggcaugagccaccgugccccagcccuuguugagucuuuauggcuuaucucacgucaugagaauuuuugcacgcaugcugcucugugacaccccuguaggagggaagaaggagcccacuucucaagagccaggcaggaaggggagaacuggaggucaggaacaucauccuuuggccauuagcuagagaaccuaguuccuucaagagaggaugcauggagaccaggucauagcaaagggccggaagaucugccugaaucuuucagauauuucaacaacucaugaugggaaacucaccaucaaaggugugaaaaacaguggggaaaugaggaaaugccugauuauuacuuaauaguuucuugagucuaaacaaauagggcuuuguuggaaauuccuucugccucuucuguaucucuuuugaggucucuaguaacuuauaaaaagccgagucauuccuuuugggagccuggcaaagggaagagaguccuucuugaccuucggccgaaacacccuuaaaggagugucucugggcagcgcgcaagggagagggcugucgaguuggguugaccagaugacugaugccugagguggggccgagaugagggcacuuuggggcagggacaaguccggaugccagcauucccaccacaccugggcccuucuguccugcaggucggcaucguggggcggacgggagcugggaagucgucccugacccugggcuuauuucggaucaacgagucugccgaaggagagaucaucaucgauggcaucaacaucgccaagaucggccugcacgaccuccgcuucaagaucaccaucaucccccagguggggucuggguguggcccagggggugagccagagcuggcaagcccuaugauugcacugacagugguguauguauauuuuuggggcaaacauacauuuggcccuacuucaucguucuuuuuuuuuuuuuuuuuuuuuuuuuuccugaaacagggucucgcucuguugcccagaguggagugcgcuggcgcaaucucagcucacugcaaccuccgucucccaggcucaagcgauucucccaccccagccuccugaguagcugggacuacaggcacaugccaccacacccagcuaaauuuguuuuguacuuuuuuguggagaugggguuccacuguguugcccaggcugcccuugaacuccugggcucaagcaauccacccaccuuggccuccaaaagugcugggauuacaggcaugaggcaccguggcuggccuucauuguuuuuauugaaguuaggcugugcugcugcuucccugaauuuccucuuaguauaugauuaacaacgugggaauuaacugacuaucagucccgacuuccuguccccgggagggguaguuucagagcaucuagaaaaauccaaaaagacaccgucuucucucucugcugccagagucagacugagcaucucuaacccuuccaagagcuagacaagaaauaagacuuuuuaauuuucgauucacggggugcaccugcaggcuuguuacguggguauauugugugaugcugaugcuucggcuucuauggaucucaucacccaacuauugaacagaguacccgagagagaguaguuucucaaccauuacccuccuccaucuguccccacuuauggaggcuccagugucuaucauuuccaucuuuacaaccaugaguacccagaguuuagcucccucuuacaagugagaacacacaguauuuggugagaaauaaggauuuucuuuuucuuucucuuuucuuuuuuuucuuuuuuuaacugagacggagucucacucugucacccagugcaguggcacgaucucagcuuacugcaaccugcaccuccuggguucaagcgauucuucugccucagcuucccaaguagcugggauuauaggcacgcaccaccaugcguggcuaguuuuuguauuuuuaguagaaacgggguuucaccauguuacccaggcuggucucaaacuccugaccucgagugaucugccugccucggccucccauagugcugggauuacaggggugagccaacaugcuuggcugaaauaaggauuuucuagaccaauccccgcagguggauuccuuaauauguugccuuuuaguguaaucuucccuaaagugucuuagaagauucucuucugugguuggaugacgggagaauccacgggacuuuacuguuaggaaucaccugugcugcgucucauuucuggagguucucaacccacuugcauauugaaggcuccaggaaguuguauggaaaggaaaucuguuguauucugccaaacucagacuuuccagacuuuuuuuuuuuuuuccauuauuaaggcaauuuuuuuuuuggagauagagucuugcucuggagugcaguggcacaaucuuggcucacugcaacuuccgucucccggguucaagugauucuccugccucagucuccugaguagcugggacuacagguaugcaccaccaugcccagcuaauuuuuguauuuuuacuagagacaggguguugccauguuggccaggcuggucucgaacuccugaccuuaagugauccacucgccucggccugccaaagugcugggauuacaggcgugaaccaccguaccuggccuuuuucuccauuauuaacaucuccagaaauagugauuccaaggagcucugauaccccaccuucaacaguccuggccagaaguccuuaggucgccuccauccaugucagcgugacacaggugucacaugccguccacucucuucucucugaacaggacccuguuuuguuuucggguucccuccgaaugaaccuggacccauucagccaguacucggaugaagaagucuggacgucccuggagcuggcccaccugaaggacuucgugucagcccuuccugacaagcuagaccaugaaugugcagaaggcggggagaaccucagguaggcgggggugaacaaggagacaccggguaagguguccuaggcgccaucucgguagggguguuugaagauucuguccagaucugugucaccuggauuugagucccagaugaccauuugucccuucaccucuuggagccucaguuucuguaucuguaaaacgggucucaauccaggcucuuuguaccaugagguagaauaaccaggaugaccaguacauuuccuuuuauacacaccagcuccauucaguugauaguggcugucaguuguuaagcuauggaaagucuucuguaccaguuggucacuagcacugcucugagcccccagguccccaugcacuaccccagcugucuuggucucuaccaggauccuggagcucuguccaugacccagcaacuaaagcauuaaugccuggcacaccagcggaaccucugggguccugcuuuggugguguuuguuagugccugguucugguucuguuauccgucuccaugacaaccaaccauaaagccucaggcauguucaaccauaaagcaacgaucauugcugccauacgagggcagucagccagguggcucugcugaucucggcugggcucacaugcaugucugggagucagcuggcuguuggcugaucucggggucagcuggcuuuuggccucagguggggcaagaaggguauguuccgugcaucccucauucuccagcagaccagcuugggcauguugucauggcgauggcaggggcacaagagcgugcaagccccuauugcaucuaacaguauucuuuuggcuguccuuacuuuugcuggugucccauuggccaaagcaaggaacaugucugauuccagagccaccucucauggccccacaguuggauaagggaugcauggguaugaggccuuuuuuuuuuuuuuuuuuuuuuuuuuuugagacggagggucucacucuaucacccaggcuggagugcaguggcgcaaucucaucugcaaccuccgcccccaggcucaagcaauuguucugccucugccuccuaaguagcugggaugacaggugccugucaccaugcccaguuaaauuuugcauuuuuaguagagaugggguaucaccacauuguccaggcuagucucaaacuccuggccucaagcgauccacccgccuuagccucacaaggugcugggauacuaggugugagccacugugcccggcucuuauuuuuuuuuuauuuuauuuuuuuuaagagacagugucucacucuguugccuaggcuggaguacaguggauugaucucggacucuaacuccuggacucaagcaauccugccucagccucccaguaacugggacuacaagagcaugccaccacacccagcuaauuuguuuauuuuuguuuuuggagagaugggggucuugcuuuuuugcccaggcuggucucaaauuccuggcuucaagcuauccucccaccucagccucccaaagugcucagauuguaggugugagcugcuguuuugagaaugauucugaaccugcaucuugcugaauaggagaugugcucugauugauuagugaugucugcugcagacacagauguugggaguggacaugcuuuccuggucaagcaacauagagugucuccuuucgcuucucccagccugggccuagguucagggucaggggugguuugacccaacacuaucuccugguuuuuuucuuccggucaagugucgggcagcgccagcuugugugccuagcccgggcccugcugaggaagacgaagauccuuguguuggaugaggccacggcagccguggaccuggaaacggacgaccucauccaguccaccauccggacacaguucgaggacugcaccguccucaccaucgcccaccggcucaacaccaucauggacuacacaaggugaugccacuggcacaguggccucuaggcuuugggaguuugccuuacucacuggcucacucauuaauucauuaauucauucaacacuguccuuaucccuagugacagccccaguggguggauccucucuucauccuggaugguaccagcuauuucuuuuuuuuuuuuuuuuuuugagacagagucucgcuucaucucuggagugcaguggugugaucucggcucacugcaaccucugccucugggguucaagcauuucuccugccucagacucccgaauagcuggaacuacaggaaugugccaccacgcccaucuaacuuuuauauuuuuaguagugacaggguuuugccauguuggccaggcuggucucgaacuccugaccucaggcgaucugcccgccuccgccucccaaauugcugggauuacaggcaugaaccgcugugcccagugguaccagguauuucuaauaucaucuagucauucauucacgucagcgcaccugcgguguucccagacacuggggacucuguaggcugcugucagacaaagucccugccuccaggaccaaguagcuuauuagauggaggagacaaaaaauauacagagcaauaaaccaacaggauuccagagggcagcaggugcugggaaggacgcuugccaaggagacgggauagcgagugcugggcagggccacuguuuccauugaacacugcaggcccagugcguggggcccacaaaaagguuuuauuuuuuuuaaaaaaucagaagcaggccaggugcgguggcucacggcuguaaucccagcacuuugggaggccgaggcaggcagaucaccugaggucgauaguuugagaccagcuuggccaacacggugagacccugucaccauuaaaaauacaaaaaguagccaagugugguggugcgugcccauaaucccagguacuugggaggcugaggaaggagaauugcuugaaccugggagguggagguugcagugagcugagauugugccacugcaguccagccugggcaacagagugagacuccaucucaaaaaaaaaaaaaaaaaaaaaaagaauauaauccaaccuggauuuuauuuauacuaacacagucauaaaauagaauuucuagcauuuuguguggagaaagccaccuccguaggcaucagugccggggaccacaaaagucagaaugcugccauagugccaggguccugggggguuuugaguuuugugugggucaucucugaagaggugacauuuuagcugagaccugaacaaugaaaaggagucagccuugagaagaucugggacagcgaucugcaaccuuguucuuaagggccgggguaguuucagcuuugugggccacauggccucucagccacuugacuccaguguugccgugugaaagcagucauagauagugcacgaaugaaugagcauggcuauguuccaauaaaacuuuauucauaaaaacaggcaaggggucagauuuggccugcaggccacaguuugccaaccuuggaucuaaaggaagaacauucuaggcagccgguacagccgaauguaaaaaugaaugcgcuuaaugaauuugaaggcuagcaugaggaggccauguaccuagagguuggaauugaguggacaggggcaggagauuaggccagaaagguaggcaggggcuggaucuuagagcaccauguaaccacggugagaagcuuggaacuuacucuaagagcccuauaaagccauuggaagguuuuaagcagggaagugacaugaguuucuauuuuauuuuauauauuuuugagacagggucucacccugucgcccaggcuggagugcaguggugggaucacagcucacugcggccucaagugauccuccugccucagccuuccaaagugcugggauuauaggcgugagucucugcacccagcugacaugauguuucuaguucacugaguaccaccuacuaaguggcagaugcugaguuggugcuuuugaaauauaggacauagaaaugaggacagaagugggcagugucaaaucuuacaggaccuaaaauauuaggggucagccaacuauggcccacaggccacagaucuggcccccugcguguuuuuaugaauaaaguuuuauuggcacgcagccacaucuguucauuuuccuguugucucuggcagcuuucacacuauaaauacagcagagaugcguaguuguaacagaaagcauauggccugcagagccucaaguauuuacuaucuggccuuuuucagaaaaauguugccaaucguuauuguagacugugguaagaucuuuuuauuuuacucugaauguaauggaacagugaaugugaacagucaacacuguuaauaccauucacaccaugauugaugugggguagauauuaaggagcuggccucaugggaaucugacauugacuagaaauagggauugagggugagcaaccagcuggaagguacugcaccaguccuagcaaaaaguguuaggggccugacccgaagcagugacuugcccaggucaguugucccaggggcacgaggugcucaccccuccccuuccccucaugucuguauccccucucccucagggugaucgucuuggacaaaggagaaauccaggaguacggcgccccaucggaccuccugcagcagagaggucuuuucuacagcauggccaaagacgccggcuuggugugagccccagagcuggcauaucuggucagaacugcagggccuauaugccagcgcccagggaggagucaguaccccugguaaaccaagccucccacacugaaaccaaaacauaaaaaccaaacccagacaaccaaaacauauucaaagcagcagccaccgccauccgguccccugccuggaacuggcugugaagacccaggagagacagagaugcgaaccacccaaaacacgcacacccugccccuggugcccugagacagacacacagccucacgcccccaggaaugcaagugguuuccuggugcuucccacggaggaguuuuggcagccagacuucuggaggaauugguuguauagaagauccuagugaccaaauucagccuacugccucggaucucuccagccgaagucuguggacugcaagucuuugagaugcuucuggcucccaucaccucuaacauccuugucugggucuaccaggaacgcuucauuuccuuggggcugcaguuuugugguugaggggccuggagaaaaucauuuucuccccuuggcagugucccagggcccuggaugguccucuuaccaacaucuggucuuccaggcacucaaaagcugggaaccagcaucucagcgccagcucuaccaguucucguuuugggccagaggcagccucugcacucccacgccuguccuccuggaagggaccugguuggacuaacggcuaaccuggaccuggaacuguagggccaggggauugucucagggccgacguuccaccuggggcuucccuccccacccaccccgacuccaggcuuucccuuuuuucuuuuguucaacauuguaagaacaaucaaugcuguuauuacuguucccaccaugauugaugugggguaaauauuaaggagauggccucaugggaauuugaccuugacuagaaauagagacugagagugagcaaccagcuggaagguacuaugccaguccuagcagaaaaauguguuaggggccuggcccaaagcaguguugguugcuuacaguguugauugauuuuguucuuuuuucuuaccaccucuuuucuuucccucucaugguaccugcucaugguuaugaagcuuucaaaguaaagaacacgaaauaccucccaaguauuaccaguggguaccaaaaaaauguccccuugagucuuuuccuuguuuuuagauguuaauucucucccuuggcauccgguuagccccccagggggggcagcauuguggagaacuugauauuuaguuacugaugcucuuccaggacacgaaaagaacccaucuuugaauaucaaugauuuuuuuuuuuuaaguacuguuccggggagaaaaacagucucaaaacuugaacuucuugggaauagaaguguugggcugagaaguaacauucccaggaaauagugagaagcucgcccuguguuugaaaccguguuggucucuguguuccuggaagaaaacagggaagcagcaucuuuuaaagccuguucuuuaaggugucucguuagagcccaaaguggaauccggaaggcagccagagcugaggcugccccaagacucagacuugcuaagaauuacgccgccgacuucaaacccagagagcaucuuucuuuuaggcgaaaacgcauauauuuauuuuuuguaaguuauaccauucuuucacauuagauaaacuaaguuuugggggauccuuuuguaaugacuuacacuggaaaugcgaacauuugcaguaaaaaaauauauauauaucuauauauuuuauuucuuucuaa

SEQ ID NO: 192604 - RNA, 8800 nt, Homo sapiens
uuucuugaaagaggcauuuaccgagcgcccaauguaugccuggcacugggcugggugcugccaccuaagcgagcacgaccaaugcagucuaucagggaggcccagaucgccaagcagcggaccccugcgguccgccaugccacucccggcuccuagagcgccgcucagcacaccgugagcgcccaauaacuguugggcuucaaugacgccgcggaggcggccccguccccgcgcucccgccccucccgccagggcagcccgggaggccagacguugacgcugcagggagaggguggugggcgcagccgcuagggggcgcggcggggcggagcgcaccuuuccgcgggccgcggggauggcggcgcagggcguagggccugggccggggucggcggcgcccccggggcuggaggcggcccggcagaagcuggcgcugcggcggaagaaggugcugagcaccgaggagauggagcuguacgagcuggcgcaggcggcgggcggcgcuaucgaccccgacguguucaagugagcggggcgggugggggccgcaugcuagccagacaccccccgaccucugcuuuccggguacgcccggcccgcuggucgggaggagcccccgcccccguccuugucgggucuucagggagguggccgcgccgggcggagagggcucaccggccccgcgucuguccccgccaggauccugguggaccugcugaagcugaacguggccccccucgccgucuuccagaugcucaaguccaugugugccgggcagaggcuagcgagcgagccccaggacccugcggccgugucucugcccacgucgagcgugcccgagacccgaggucagagcugggcccgcugucccugccccaguggcggggguggcgggcggggagggggcaggcgcggcacagcggcggcguggcccugaguggccaggccugucugucggucuaggcccagcaccugcagggcccauccgugggcucugcuccugggcuucgcugccagccuuaggaggcacguccaggucagguggacgcagagugcguaccccagggugguccaggcuggguagggcuccuccgcuuagcuccccuccaccucuucacucaggccuucauccuacaacgucgggaaucaagacaguuuggggcugggcgcccuggcucacgccuauaaucuuugggaccccagggcgggaggaucguuugaggccaugaguuuuagaccacucugggugacagggugagauccugucucuaaauguuuuucaaaagacagucucgaucucuguccugugguauacagcauccagggaagugcccagggaccagggcaggcagaggucuuccugccuuuaccccaccugggcccaguuccugcgcaggggcuuggccaguccuggucagcuuucccucugaugacugcaggaagagagucagacgcggaacucccagggugcagaggccugcggggucugaagggccuccucccucuccaguguggugacugggcugaggagauucugggacugagagugucaugguggagccucugucccugcucauccucuccgcauguugcuucugcucccgauggcucucucugaaaugcagcacaaccuccuaggccaauggaagaaggcccagagcuggcucccugccuggaagcacgaggagacccgcacaggcauccugagaaggcguggagagcaggcugccuucauggggggagugccagggccugggcacccacacccgcugacccaagagggcccgggcaccugcgugcuggccucuucacugaccuucgcucugucugcucucuuugugucucucucugaccuccagaggccuccuuucucucugccaggaacaguagccccccugcaaggcccuccuuuuccuccagcccgcagccugcggccucuccgguucugcuccacagcccggcugccacacacucgccucucucuccaggccccccggguucccuccgccucucuugcugccuguucucuccuuuugcagguugcguuuauuggcuuaucucuggggguuggugcucucccuuguuuccauggaaacugccuggccccaggaggcccaagcagcuuugagcuccaagggcaggaccaugcaggccaucgcugcccugccgcuuagccacagggcacgauuucugacucgguuuauuagagacauaguguggcagucucuagaccccacagucgggcuggcaucuggggacaggaccaacacccccacaccccagaggcgaacuguggugaguguaaagagccccucuccaagggaagacagccggccagagugcggugugcugugcuggagagcacagccccaggcgugacaaacaccucggccucuuagaaguugucccuuaucuggacaggaagucuggaggcugaaacagagacucccaccuucccagagucuccugggcagugccacacagaugccauaugcuggccccguggccacacuccagcacucagcccccuugcccaccucacuccugaguuagcacacuuuccaggugucagcaggugugaucaggggcucagagccaggguccugugagagcccaggggucuuugguugcaccuccugcgugcacuuccugacagcgcccaccucacugccacccagagcucggacccaagggaggguggagaggggcugagggacaggccuggaguagggguguaugcacugcaggcugagaugagcaauugaggggcaaguguccagcaggagggagaaacugggaacagaguccuugucacuccaggggauguugcugcucacucagcacucacucagggcucugggagccaggccuagcucucagggcagaggguguggcagggaagugagaugaucacacucagagcccagugagaggcagugaggaaaaccaccagcgagaccagugugguggcucacaccuguaaucccagcacuuugggaagucaaggcagguggaucccuugagcucaggaguucaagaccagccugggcaacauagcaagaccccaucucuacaaaaaauacaaaaacuagccaggcagggcugggcgcgguggcucacgccuguaaucccagcacuuugggaggccgaggcgggcggaucucgaggucaggagauugagaccaucccggcuaacacggugaaaccccgucucuacuaaaaauacaaaaaaaauuagcugggcgugguggcaggugccuguagucccagcuacucgggaggcugaggcagaagaauggcgugaacuugggagguggagcuuacagugagccgagaucacaccacugcacuccagccugggggacagagcgagacuccgucucaaaaaaaaaaaaaaacuagccaggugggcauggugguggcgcccaucuguagucccagcuacuugggaggcugaggugggaggaucgccugagccugagggggauguugccgugagccaagagcuugugacuggacuccagccugggcaacagagcaagacccugucucaaaaaaaaaaaaaaaagaaaaaccgcuagcaauggagaugggaggaggcuucagagcccagagagcagcaaggguuacacagggggguaacaaggguuacagcaggaggggggucggcagagccccacacgugugagcuggggcagugggagggcgugggugaggcagagcgcuguccaggugcugguaggccgggggcgggaggaggcaggugggggggcacggucaagauguaugugaggguuguggcacuggaaaugcaggcauagaggggccaggaggauuagggggugcugugugagcgaaugggggcuccgagagaauuuacccaaggacaggaguggccuggagugcugggacccucagggucauuuguuccuugagggcucuguccuggaagcauagcccagguccuguaggcuggguggcagaaagccaggacaugagggcaccgaggcccuguggagauagaguggaaccugaggaggagguggaggggaauggggcagauguggggccacaccaggagugugcugcugagugagaagcagaggccacagauggaaugcugagagcucucugaggcccacauguuacagcaucugaccacacagagcuccggcugcccugguaauggcagaaucugggguggaggacauaagggggguuguuggagugauccggcuggggggcauggaggccauagguuucccacaggacucggguguggaguucuccaggcugugggccaggcccucucaagcuugccucugagcugcagcaggcacccuggguccucuggaugccugucccccagccauccagacagccuguggggacaaccaccaccagauucacucauacccacagggaaggggaaauagaaaaccccagaagcacagaggggcaaugcuugucuuggugagagucuggagucauugagggaaaaauaaauucagucaagcguucuauuuaaguuuagagaaacuauacguuuuaaaaguuguccagagcaugcauguaagaugacguuuggaguguggaagccaucucaccugagcugugcugccugauacaggaaccuugagccacacauggcuggcauggucauugcacugcgugugguaugcacagcagaugccaaaugaccgguacaaaagggaaugcaaaaaacccaccacaccuugggaguccacagcuacuggaucucuugagcucagcaguucaggacuagccagggcaacacagggagacccaaucucuacaaaacacaaaaauuagcagggcaugguggcacacaucuguaguuccagcuacuugggaggcugagguuggaggauugcuugagccugggagguugagguugcagugagcugugacugcaccacugcacuccagccugggugagagagugagacccugucucaaaaauaaacaaaaaaccccaaagugaaugaggcugggcauugguucacaccuguaaucccagcacuuugggaggcugaggcaggaucaucacuugaagcucggaguuugagaccagccugggcaaaauagcaagaccccacccauuucuacaaagaaacaagaaaaagaacagaggugaaugcaacaucuuaugaauaacuuauguacugauuacguauugaaauaauacguuggauauuuuagauuaaaguauuugagcuaauucugcauuuucuuuuacuuuuuauuuauuuauuuauuuuugagacagucuuguucugucacccaggcuggagugcaguggcacacucauagcucacugcagcuucaaccucgugggcucagacaauccucccaccuccucuugaguagcugggacuacaggugcacacuaccacacguggcuaauuuuuuaauuuuuuguagagauggaggucucacuguguugucccagcuggucucuagcuucuggccucaaaggauccucccgccuuggccucccaaaguaguggaauuacaggcaugagccacugaccccugcugagccaggcuguuuucaacauucaauggucauugacuaucuuuggcguuuaggagggcccuccagggaccaggcguaggggcaucagucaccccgcccucacaccccaaccugcagccacacuugguucaaucccacugucuagcccgucugacucaguagccccucccgagggagcagggcuaagcaaagcugguuuccccacugcaaggcacugcaggccauucuauucugggccuucucauccuucauaaagugaggaggccugaacagggcuccccacuaacccugagagcgcacaauuccugaagauuuccaggauuuucuuaguaucaguuauggcuuaaaguuauguugguuucacauuuccaggguuugucaacccugucagauuuaaagauaagcauuauuagccagguguggccccaugcuuguagucccagcuacaucggaggcugaggcaggaagaucccuccaggccgugaguuuggggcagcaaugaacugugauugcaucacugugcucuagaccaagugacagagcaagacucagucucuaaaccccccucccccaccacucaaaaaaaaaaaaaagcauuauuugcucuuuucugcuucccucucauccuuguuuccagaagggacugggucauugcugaggggaggagaggaagcucagauggcagcaagcugaagggaagccgacucugagucaggcccaagucugcggccugccaugcugcgugcuguggggagcugagagcgcaugggcaccuaagcacccagauuaggcugcggcuacagaagaucugacucugucuggccuggccugcggagggacuguggccucagaggaggaugcuggcccagugugggagcugcugcaggguggcggggcccgucugcucauggaagacagaauccuugccccuugaccagucaguggggacuagaauuauggcaguuuguaccacaagagaugcgugguggcuauugucugcuuugugccuuuuucacgagucacugcugggcugagguggccaaucaucacccaccacguguuccugacugcgcuccuccuuggcucagggcaacccugacuccaucuuuguugagucaagugugacaagcugacagaguuccaagcaugacaccgcuguaacccucaccaccaccaggcaagaaugagcaaagaucucauucucugaggaagaacuccccggaaacucaaaaggagggccguccuaucccugcaggguauggggagaauuuucugguauuagcauagaaagggagcuggagguaccucuggaagagcggggguccacggcaucucagacacaggagucucugcuuguucagggugacagauggugaaacagaaaugaccuaauggaucucuagacacccgguugcaucuuuucuccaggaauccaguuucccauugcaggguauuugacuacacuugauaagaggccagggaaggaccaggauugaggcuggguguucuguuggcugaacccuugucuggagucacccuaaaagugauggcaggggaguuccugcaagggacugccccaaaccuuuccaggaugagagccaguugggauuccaaaggaagaaacacuuaaugccaggguggucaguccaaagcauuuguuagggagcuuacauacagagggggcugcaguguacccucacgagggacagccaggaaagagguugugccuaggcacaccgcacugagggggugggguguggaguuucuaugagggugcaaggaauuuggcuggggugggaccaguuuccacgugcuuagcaacaugucagaucuuucaguguuccaggcaacaaccuaaacguguaucagugucugguaacaugcaagccccagccaggguuugagccugcagggggaacauguagcugauuaggucagaguagucaaggcacuuccucagucaggacaaaggaaacacuggggggaugaaaugggggacccaacacugagucaggcaggggacacaugcccuguuuagagcccacaggccagacccugccaggccagagcaggggagagcccuggccaaggcacuccacaugggggucugugaccccacgggcaagccugcuacccgggcacguuuguaccuuggaggguccucucagucuugccgaugcugucaacacccugagcccagggaaauccaucccauuaaaauaaaggucuggcccaagugugguugcagauuuuucuuggcuaucuuaaagaguaaaguaagcaaauuacaaaucaaagaaacucugaaccaguggucuucauccaagagagccucugguggucagaaggaaagucucaagcauucagacuguggcaggaacccugucauggaaucuggcagcuaaacccgaaagcaagaggcuugaccacugcagaacacucggguagguaggaaacaaugaaagagcuuccaaaaucaaaaucagaaacccaauuccaggacuuggugacugcaguacuuccugccugucaccaucuagggcagcucagaugugcaguccagcaugaacacaccuugaggaugaggcagcgcaucccugcugcugccgccgcugauggcaccaucagggcagacuagguuugcugaccaggcuagguguggaccagcacaccuaccuuucccuaaaugggcccguggcauguguccuuucaaaauguucccuuggcagugugcuccuugcauggcuuugcuccuaggacacauccaaaaggguccccugcacacugcgaagggcuucuggggcgugaccugucuuuagugguucugagucucaggacuuggggcugaugcagggccucuagcugaagggacuuugauggaaaugugcagacacaaauguugcccaaggaccacgaguacagcaggugcugcaguuacggggcacgcccauuccuaaucauugugcuuugugucuccucagggagaaacaaaggcagcgcugcccucgggggagcauuggcccuggcggaacgcagcagccgcgaaggauccagccagaggaugccacgccagcccagcgcuaccaggcugcccaaggggggcgggccugggaagagcccuacacggggcagcaccuaggauggggcagagacuuguugcaucuuuguccccagcaaaggcuacauguuaccuccuucaauugauaauaaaccuuucugagaugcagaggguccagguca

SEQ ID NO: 192605 - RNA, 8800 nt, Homo sapiens
ugaccuggacccucugcaucucagaaagguuuauuaucaauugaaggagguaacauguagccuuugcuggggacaaagaugcaacaagucucugccccauccuaggugcugccccguguagggcucuucccaggcccgccccccuugggcagccugguagcgcugggcuggcguggcauccucuggcuggauccuucgcggcugcugcguuccgccagggccaaugcucccccgagggcagcgcugccuuuguuucucccugaggagacacaaagcacaaugauuaggaaugggcgugccccguaacugcagcaccugcuguacucgugguccuugggcaacauuugugucugcacauuuccaucaaagucccuucagcuagaggcccugcaucagccccaaguccugagacucagaaccacuaaagacaggucacgccccagaagcccuucgcagugugcaggggacccuuuuggauguguccuaggagcaaagccaugcaaggagcacacugccaagggaacauuuugaaaggacacaugccacgggcccauuuagggaaagguaggugugcugguccacaccuagccuggucagcaaaccuagucugcccugauggugccaucagcggcggcagcagcagggaugcgcugccucauccucaagguguguucaugcuggacugcacaucugagcugcccuagauggugacaggcaggaaguacugcagucaccaaguccuggaauuggguuucugauuuugauuuuggaagcucuuucauuguuuccuaccuacccgaguguucugcaguggucaagccucuugcuuucggguuuagcugccagauuccaugacaggguuccugccacagucugaaugcuugagacuuuccuucugaccaccagaggcucucuuggaugaagaccacugguucagaguuucuuugauuuguaauuugcuuacuuuacucuuuaagauagccaagaaaaaucugcaaccacacuugggccagaccuuuauuuuaaugggauggauuucccugggcucaggguguugacagcaucggcaagacugagaggacccuccaagguacaaacgugcccggguagcaggcuugcccguggggucacagacccccauguggagugccuuggccagggcucuccccugcucuggccuggcagggucuggccugugggcucuaaacagggcauguguccccugccugacucaguguugggucccccauuucauccccccaguguuuccuuuguccugacugaggaagugccuugacuacucugaccuaaucagcuacauguucccccugcaggcucaaacccuggcuggggcuugcauguuaccagacacugauacacguuuagguuguugccuggaacacugaaagaucugacauguugcuaagcacguggaaacuggucccaccccagccaaauuccuugcacccucauagaaacuccacaccccacccccucagugcggugugccuaggcacaaccucuuuccuggcugucccucgugaggguacacugcagcccccucuguauguaagcucccuaacaaaugcuuuggacugaccacccuggcauuaaguguuucuuccuuuggaaucccaacuggcucucauccuggaaagguuuggggcagucccuugcaggaacuccccugccaucacuuuuagggugacuccagacaaggguucagccaacagaacacccagccucaauccugguccuucccuggccucuuaucaaguguagucaaauacccugcaaugggaaacuggauuccuggagaaaagaugcaaccgggugucuagagauccauuaggucauuucuguuucaccaucugucacccugaacaagcagagacuccugugucugagaugccguggacccccgcucuuccagagguaccuccagcucccuuucuaugcuaauaccagaaaauucuccccauacccugcagggauaggacggcccuccuuuugaguuuccggggaguucuuccucagagaaugagaucuuugcucauucuugccuggugguggugaggguuacagcggugucaugcuuggaacucugucagcuugucacacuugacucaacaaagauggagucaggguugcccugagccaaggaggagcgcagucaggaacacguggugggugaugauuggccaccucagcccagcagugacucgugaaaaaggcacaaagcagacaauagccaccacgcaucucuugugguacaaacugccauaauucuaguccccacugacuggucaaggggcaaggauucugucuuccaugagcagacgggccccgccacccugcagcagcucccacacugggccagcauccuccucugaggccacagucccuccgcaggccaggccagacagagucagaucuucuguagccgcagccuaaucugggugcuuaggugcccaugcgcucucagcuccccacagcacgcagcauggcaggccgcagacuugggccugacucagagucggcuucccuucagcuugcugccaucugagcuuccucuccuccccucagcaaugacccagucccuucuggaaacaaggaugagagggaagcagaaaagagcaaauaaugcuuuuuuuuuuuuuugaguggugggggagggggguuuagagacugagucuugcucugucacuuggucuagagcacagugaugcaaucacaguucauugcugccccaaacucacggccuggagggaucuuccugccucagccuccgauguagcugggacuacaagcauggggccacaccuggcuaauaaugcuuaucuuuaaaucugacaggguugacaaacccuggaaaugugaaaccaacauaacuuuaagccauaacugauacuaagaaaauccuggaaaucuucaggaauugugcgcucucaggguuaguggggagcccuguucaggccuccucacuuuaugaaggaugagaaggcccagaauagaauggccugcagugccuugcaguggggaaaccagcuuugcuuagcccugcucccucgggaggggcuacugagucagacgggcuagacagugggauugaaccaaguguggcugcagguuggggugugagggcggggugacugaugccccuacgccuggucccuggagggcccuccuaaacgccaaagauagucaaugaccauugaauguugaaaacagccuggcucagcaggggucaguggcucaugccuguaauuccacuacuuugggaggccaaggcgggaggauccuuugaggccagaagcuagagaccagcugggacaacacagugagaccuccaucucuacaaaaaauuaaaaaauuagccacgugugguagugugcaccuguagucccagcuacucaagaggaggugggaggauugucugagcccacgagguugaagcugcagugagcuaugagugugccacugcacuccagccugggugacagaacaagacugucucaaaaauaaauaaauaaauaaaaaguaaaagaaaaugcagaauuagcucaaauacuuuaaucuaaaauauccaacguauuauuucaauacguaaucaguacauaaguuauucauaagauguugcauucaccucuguucuuuuucuuguuucuuuguagaaauggguggggucuugcuauuuugcccaggcuggucucaaacuccgagcuucaagugaugauccugccucagccucccaaagugcugggauuacaggugugaaccaaugcccagccucauucacuuugggguuuuuuguuuauuuuugagacagggucucacucucucacccaggcuggagugcaguggugcagucacagcucacugcaaccucaaccucccaggcucaagcaauccuccaaccucagccucccaaguagcuggaacuacagaugugugccaccaugcccugcuaauuuuuguguuuuguagagauugggucucccuguguugcccuggcuaguccugaacugcugagcucaagagauccaguagcuguggacucccaaggugugguggguuuuuugcauucccuuuuguaccggucauuuggcaucugcugugcauaccacacgcagugcaaugaccaugccagccauguguggcucaagguuccuguaucaggcagcacagcucaggugagauggcuuccacacuccaaacgucaucuuacaugcaugcucuggacaacuuuuaaaacguauaguuucucuaaacuuaaauagaacgcuugacugaauuuauuuuucccucaaugacuccagacucucaccaagacaagcauugccccucugugcuucugggguuuucuauuuccccuucccuguggguaugagugaaucugguggugguuguccccacaggcugucuggauggcugggggacaggcauccagaggacccagggugccugcugcagcucagaggcaagcuugagagggccuggcccacagccuggagaacuccacacccgaguccugugggaaaccuauggccuccaugccccccagccggaucacuccaacaaccccccuuauguccuccaccccagauucugccauuaccagggcagccggagcucuguguggucagaugcuguaacaugugggccucagagagcucucagcauuccaucuguggccucugcuucucacucagcagcacacuccugguguggccccacaucugccccauuccccuccaccuccuccucagguuccacucuaucuccacagggccucggugcccucauguccuggcuuucugccacccagccuacaggaccugggcuaugcuuccaggacagagcccucaaggaacaaaugacccugagggucccagcacuccaggccacuccuguccuuggguaaauucucucggagcccccauucgcucacacagcacccccuaauccuccuggccccucuaugccugcauuuccagugccacaacccucacauacaucuugaccgugcccccccaccugccuccucccgcccccggccuaccagcaccuggacagcgcucugccucacccacgcccucccacugccccagcucacacguguggggcucugccgaccccccuccugcuguaacccuuguuaccccccuguguaacccuugcugcucucugggcucugaagccuccucccaucuccauugcuagcgguuuuucuuuuuuuuuuuuuuuugagacagggucuugcucuguugcccaggcuggaguccagucacaagcucuuggcucacggcaacaucccccucaggcucaggcgauccucccaccucagccucccaaguagcugggacuacagaugggcgccaccaccaugcccaccuggcuaguuuuuuuuuuuuuuugagacggagucucgcucugucccccaggcuggagugcaguggugugaucucggcucacuguaagcuccaccucccaaguucacgccauucuucugccucagccucccgaguagcugggacuacaggcaccugccaccacgcccagcuaauuuuuuuuguauuuuuaguagagacgggguuucaccguguuagccgggauggucucaaucuccugaccucgagauccgcccgccucggccucccaaagugcugggauuacaggcgugagccaccgcgcccagcccugccuggcuaguuuuuguauuuuuuguagagauggggucuugcuauguugcccaggcuggucuugaacuccugagcucaagggauccaccugccuugacuucccaaagugcugggauuacaggugugagccaccacacuggucucgcuggugguuuuccucacugccucucacugggcucugagugugaucaucucacuucccugccacacccucugcccugagagcuaggccuggcucccagagcccugagugagugcugagugagcagcaacauccccuggagugacaaggacucuguucccaguuucucccuccugcuggacacuugccccucaauugcucaucucagccugcagugcauacaccccuacuccaggccugucccucagccccucuccacccucccuuggguccgagcucuggguggcagugaggugggcgcugucaggaagugcacgcaggaggugcaaccaaagaccccugggcucucacaggacccuggcucugagccccugaucacaccugcugacaccuggaaagugugcuaacucaggagugaggugggcaagggggcugagugcuggaguguggccacggggccagcauauggcaucuguguggcacugcccaggagacucugggaaggugggagucucuguuucagccuccagacuuccuguccagauaagggacaacuucuaagaggccgagguguuugucacgccuggggcugugcucuccagcacagcacaccgcacucuggccggcugucuucccuuggagaggggcucuuuacacucaccacaguucgccucugggguguggggguguugguccuguccccagaugccagcccgacuguggggucuagagacugccacacuaugucucuaauaaaccgagucagaaaucgugcccuguggcuaagcggcagggcagcgauggccugcaugguccugcccuuggagcucaaagcugcuugggccuccuggggccaggcaguuuccauggaaacaagggagagcaccaacccccagagauaagccaauaaacgcaaccugcaaaaggagagaacaggcagcaagagaggcggagggaacccggggggccuggagagagaggcgaguguguggcagccgggcuguggagcagaaccggagaggccgcaggcugcgggcuggaggaaaaggagggccuugcaggggggcuacuguuccuggcagagagaaaggaggccucuggaggucagagagagacacaaagagagcagacagagcgaaggucagugaagaggccagcacgcaggugcccgggcccucuugggucagcgggugugggugcccaggcccuggcacuccccccaugaaggcagccugcucuccacgccuucucaggaugccugugcgggucuccucgugcuuccaggcagggagccagcucugggccuucuuccauuggccuaggagguugugcugcauuucagagagagccaucgggagcagaagcaacaugcggagaggaugagcagggacagaggcuccaccaugacacucucagucccagaaucuccucagcccagucaccacacuggagagggaggaggcccuucagaccccgcaggccucugcacccugggaguuccgcgucugacucucuuccugcagucaucagagggaaagcugaccaggacuggccaagccccugcgcaggaacugggcccaggugggguaaaggcaggaagaccucugccugcccuggucccugggcacuucccuggaugcuguauaccacaggacagagaucgagacugucuuuugaaaaacauuuagagacaggaucucacccugucacccagaguggucuaaaacucauggccucaaacgauccucccgcccuggggucccaaagauuauaggcgugagccagggcgcccagccccaaacugucuugauucccgacguuguaggaugaaggccugagugaagagguggaggggagcuaagcggaggagcccuacccagccuggaccacccugggguacgcacucugcguccaccugaccuggacgugccuccuaaggcuggcagcgaagcccaggagcagagcccacggaugggcccugcaggugcugggccuagaccgacagacaggccuggccacucagggccacgccgccgcugugccgcgccugcccccuccccgcccgccacccccgccacuggggcagggacagcgggcccagcucugaccucgggucucgggcacgcucgacgugggcagagacacggccgcaggguccuggggcucgcucgcuagccucugcccggcacacauggacuugagcaucuggaagacggcgaggggggccacguucagcuucagcagguccaccaggauccuggcggggacagacgcggggccggugagcccucuccgcccggcgcggccaccucccugaagacccgacaaggacgggggcgggggcuccucccgaccagcgggccgggcguacccggaaagcagaggucggggggugucuggcuagcaugcggcccccacccgccccgcucacuugaacacgucggggucgauagcgccgcccgccgccugcgccagcucguacagcuccaucuccucggugcucagcaccuucuuccgccgcagcgccagcuucugccgggccgccuccagccccgggggcgccgccgaccccggcccaggcccuacgcccugcgccgccauccccgcggcccgcggaaaggugcgcuccgccccgccgcgcccccuagcggcugcgcccaccacccucucccugcagcgucaacgucuggccucccgggcugcccuggcgggaggggcgggagcgcggggacggggccgccuccgcggcgucauugaagcccaacaguuauugggcgcucacggugugcugagcggcgcucuaggagccgggaguggcauggcggaccgcagggguccgcugcuuggcgaucugggccucccugauagacugcauuggucgugcucgcuuagguggcagcacccagcccagugccaggcauacauugggcgcucgguaaaugccucuuucaagaaa

SEQ ID NO: 192606 - RNA, 66448 nt, Homo sapiens
cucuauacgguuauguuccaaaguagauuagguauuaaaaagcuccuuuugucucccuuucucugggagaaaaguuaagaauucauuuuuugacaaacuuuagugucauuucauaccagcaauuuuauuuacacaauaagaacauacagguaucgucagagaucaucucuacauuucagaucuugacucaguuuaagggccaacaaaggaaggcuuuucucuuuccguuguuucuugccucuguuuuuuguuguacaaaguguguaguacuagcaagugcauuaccauagcaugucuuuaauuuucaauuugaaaucugaugugcuggagaaaagugcaucguaaguuuuuguuuuuguuuuuuuuccccuuacaaauucaaaggacuagaauaaugauagucaucuggaaaaaguaaaucaugaauggcuauaauuuugaaacugaugcuuaaugauggcagugauuuuuaagugugguaacaaacguuuugggagcauguauccucugucaagaugguacuaguaacagauucaaaguaguaccauaucguaucagacugauguggggguuuuuauguuugacaucaguuggugagccuguuguuccuuaguaaauugaugccauaagcuaaaguuaacauauucauauuuucccugccaauaguccuucauaaauaccuggucauaaacugaaaaaaaaguaauaucugcaauauaaauguguugucuauuagagacggggcuagaugucuuaaggauuucuaaguacaucuuaaaauuuauaauauagucguucauaccaagaaucaucuggggaauuuuaacaaaauauguauauguucuaaaccucaucacuaccccauaaaugcagcuuaggucuguaagucugaaggaguauguguaucuaucuggguguuguuuuauuuuuuuuuuuugagacggaguuucgcucuuguugccaaggcuggagugcaauggcacgaucuuagcucaccacaaccuccaccucccagggucaagcaauucuccugccucacccucccgaguagcugggauuacaggcaugcgccaccacgcccggccaauuuuguauuuuuaguagagacgggguuucuccauguuggucaagcuggucuccaacucccaaccucaggugauccaccugccucggccucccaaagugcugggauuacaggcgugugccaccacgcccagccuuggguguuuuucuuucagcuccuccaguacuuucauacuauucuaauaaauauauuuuguugguaugaagcuaugaagcaaaaguagcuauuaccaaugcauacauacaguacacugguuuuaaguuccaccucaaagugaaucuuagagccugguguaagugcuccacuuuagagauguaccuuaauuacuacuguauuugcaaauuaagggaaauuuaggucaucauuugauuuucugaaaucuaaaaggaacugaccaucauuaccaagucuuucuagauaaucaaggguagauggcuguuuuuaauguaggaauuaauguaggcauuccugcuuucagguuuaaguaugaaucaaagcauauuuuaauuugcuagugcaaauggacccagaauuggaagggcuauguaacuacacaguaugcacaccacagccaugucagugucacagauccucuugugcauucagcuuucuuaaaaacacaucaaaggcugcaaagaagcucagaaaaaacuaaauugaaggacagguggaauacaaugacucuaugugaggaacuugccaacucacaucuuucaaagccagaucagcuuauauaguacaugcauuauagucauaugaaauguugucuuggugcuuucuucuuggaggacuauggcagcagcuuuaagacuacuaacaaagauuauuacacaggucaucuuauccacaggcaaacugcuuugcacaacuagaacauuaacaguuguuuuuaaguuaaguucagaugaaacugucacaagacagacuugauguauuuuauauauacugggaaacuuuagaaacagccauuuauuauuuggauuaaaugugugauguguucugcaauuuggaauacacuuuucaguuuauagccagucuccacaugagcagauucauaccauugcaauacacaggaguucauaaauaagauucuacucagguaggcaguaacuagcaaguuuugagucaacaaagucucaguauuacauaguucucuucaccaaagaugagucucccggauuucagcaauaauuugacuggcuccuuguaaugccugcauuaaaggaaaaaaaauuuuaaaugcuuauuauaaaguuaugaaauuaaucugaauuacgcaggguaauuuuuccaauauauaugugguagguuuauaacuaaccaguuuauacuaaccaauaucuucucuggaauuagaaucuaaucaaguaccggccaggcgcaguggcucaugccuguaaucccagcacuuugggaggucgaggcgggcggaucaugaggucaggaguuagagacuauccuggcuaacauggugaaaccccgucucuacuaaaaauacaaaaaauuagcugggugugguggugggcgccuguagucccagcuacucgggaggcugaggcaggagaauggcgugaaccugggaggcggcgcuugcagugagccgagauugugccacugcacuccagccugggcgacagagccagacucccacucaaaaaaaaaaaaaaaaaaaaaaaaagauucuuaucaaguaccaacaggaaacaagccuagcuagaauauaaagacuauacauauccaagaaucaaacugcauuuaaaacuauuucuauguuucuaucuacuacccaaguauaaaaaaucaaaagguccacaauaccuuuagcauaucagcugcuucuuuccugcgcugugccauguccucagauucugucagaagaucauccaauaaggaugauuuauacagcuggccuacuagcucacucugaagagugucuuucacaugauuaaccaaaaaaugcauuacugccuuuggcacacugcaaaacacaaccaaauuauggaauuuuagccaaaauucuacuuuuaacaauuugggcuuagaugcuaaccucaugaaauaaaguuaaguaagaacacuacuacuuuggauauuucauuaauggcauaaucgcccuuuagauuuuugcuuaacuguaauuaaacauuaagaaaagcaguucucggccaggcgcaguggcucaugccuguaaucccagcacucugggaggcugacgcggguggacugcuugaggccaggaguuugacagcagccuggccaacauggugaaacaccgucugcacuaaaaauaaaaaauuagcugagugugguggcacaugccugugaucccagcuacucgggaggcugagauacgagaaucacuugaacccaggagguggagauugcagugagccaagaacgcgccacugcacuccagccugggcaacagagugagacugugucucaaaaaaaaaaacaaaagcaacaauucuugauacuuuaccuucuuuucaucaucuuuauuucaaaacucuucaauaagcauuuauucauaauagccaagaagugagaaaaauccaaacaucagcugaugaaugcuuaaacacaguauaucuacauaaucuaguauuauucacacaaaagauaugucacuuaaugacacggauaugcuuugagaaaugcauuauuaggugauuucauuacaugcacagcacagaguguacuuacacaaacguagaugguauagccuaugacacgccuaagcuauaugggauagccuauugcuccaggcugcaaacauguacagcauguuacuguacugaauagggaacuguaacacaauaguauuuguguaucuaaacauaggaaauguacagcaaaaacaugguaucauaaucuaacgggaacacauucaaauacguggucuguugacuaaaauguuauguggugcgugacuauacugauucauacuacaguauggaugaggcuuaaaaacauuaagugagccgggugcaguggcucacgccuauaaucccagcacuuugggaggccaagacagguagaucaccugacgucaggaguucgagaccagccuggccaacauggugaaacccgucucuacuaaaaauacaaaaauuagcugggcaugguggugcacaccuguuaucccagcuacucaggaggcugaggcaggagaaucgcuugaacccagaaggcagagguugaagugggccaagacugcgccacugcaccccagccugggcgacaaagcgagacuccaucucaaaaacaccuucugcagaggaugggggcaaggaaggaaacaaauggaauuuuuuucuucaggcccacaguguaaaacacuaggaacuguuauuucuacuacaagcuacggguuuaaaaagucuacaagcaaaaaagauaaaugguucuacagacaaaaaucauuuauuucaauaugaaguauuagacuguuuauuacucugugcaguaaaauucaucuuagcugcugacagauuaccaaaaacuggaugcagaauauuuucuaauagaucacuucacacaacuaaauguauauucucccuauuacugcaugaaaugacauaccaggcaacaugaaggagaagaugcaguagggacuagacacaugaaaaaacauucugaacgagaaaaaauacacauauuuccuaguaaaagacauucguuuugauacuuuggaaaaccaaguuaaauuaaaaaggcaagucaguguuacuagccaaaauaauuaaugaaacuacuaaauuaaaauuuaggaaaaagauuuucuuaaaugacucaaaauguggcagccagauagaacaaaagaaucucucauuuuuaauagcuuuuucuagcugauacaugagguccuagucauucuauguuaacaaaaugggucuugcuacaaguuacccaaggacuaucagaaaauccacuugaugauuuagaauaaaaaccuaaaauuguaaaaauacauguauuuuucaaaacagaucacagaaucauccagaaguauuaaaguccgucauuuauauuaaguaauacuaaccugucuugaauauucuuucugacaaugagaaaauaugauuuaaugagucguucaauaaccucacaaucucgcuguucccgagcagauaguuuucgugcaacaggaacuggcuaaauagggaugagggggaaaaaauauuacuuuugugacacuaaaauggcagcuuuaacaucugaaaguuauguaaguuuuugagacuuuuaguucuuucugucuaaucguuuuccuacuaacuuggucaccuaccuuauuaccuaaaccaaauugucauggcuuaccacaucuagcagguucacggcaugaccuuuuuguggacuggcuggcauaauuggaauggguuuugauuuuucuucugcuaauaacucuucagcuuuugaaguuuucagcauuccucuccaguugccugugguugguucuugaacaccaucuccaaccccaccaccuccagaugcaaccugaaaaaacauguuccaaaacauaccaaccacaucauaucugaccuuaacuaaaacaaaguucauuuuauuugacaguagucaauauacauccaguacccaucugaaguuuauucagacagauaaugaggucagaaggagacacuagguagcauguauaacuggaacccugaccuaucuaaauaauaaagaaguucugcucuaaguuguuugcaaggcaucaaccaacuuauguucuauuuaauuccuuuuuucuuuaucauucgcuaacuuuucaaaaucguuccucuucucccacccuucaaacacuaaauuguaggaaaaguauaugcugcccuuaaaaacaaaacuacucguuaaaagcacaaagaacugcuauucaguuuaauuucuuaaguaaucauuaacacuguuaaacucuaaaaguuccaugaacuuacgucucugaacuuaagaguuuauauguuucucaauuuacauuucuaauagucaacaaaaaugccauaagguauaaguaagaacucuuuaacaaaaagcaagacuacauuugcuauucuuaggcugacagucacugugaguuguuucaaaugcggaaugugacaaacaacagaaguccccucaaccucuguacucuuaaggauuugcugaaagaaaucuagugcuaccauuaaucacaagugcuuuuguaccuuguuuucuagaaaauguauuagucuugacuucuaaaagucaaaaaugacuuuauaauggaaaaacaauucaucaacauuuaagaggguuuuuuuuagguauucuuuaagaucuuacaaucuaaaaauggauuauauaaguuuaauagaggauuauggcaguuagaaaaaugguaguuugagguaucauucugaaucaaaauauuugcuaaaaucugucuuuaguaugucaguuaaggugaacuacauuuaaauauaaguaguauauuuauguuacacauuaacuuaaaaaugaguaauuagauuuuuaaauguuuguuaacuauacaugaaugacauaccaaaugaaaucuuaaggagagagagcacauucagugugacgucaugaaugaaauaaaacuugugcagugauuuagaugguuugauuaauaucugagcacagugggcugagagaagauaagacauuuauaaaccuuuauuugaaguucagaacuuuaaaucuggauaauuaaggaaaggagcuaaauggcagaaaaucuugaaauagcgaugagucugaauaauuuauacauuauuuaauuuuccucuaaaaugguuaucaagaauugaaaacagucucaaacucucacaguccccauuuguuuuuuuaauuugcuuaagcuucugaagcauaugugaagcuauauauaggguaacaagugcaaacuaacuggaagcauaagaaagaagcauuagaucuauuaguacugaacagaucucaagaucuuuaaagaggaaaggaaauguccaaaaauacaauuccaucucugaaaucuaggaaaucucugaauuuccuaccaaaauacuaaauuuaaaacuauucuugaagguaacaaaacagugagaaagccuauuauuguuacuaauuaaaacaacguuuaaugccaucuuccacagguuagauaaaaggaacauuaagaacauaacacagacaagagauagauaccacuacacaaacagguucuuuaauggugguauagacaguguuucagugagaaccaaagguaccaacauuuccauucugaagcaagagacucacauuuuuaguuucucuucugcuguccugaauuaacuguuaaaagauauguuaaaacaugcaauuuaacaagcaaaauuuaaauaccaauggguugaaauucaaaaagugcaggauaauuuccucuuuaaauuacuuuuucugugugcaucuucuauauugcaagcaaaagcaugucaacaauauaaacuaugcauugcauuguuauauaauuuuaaaauauauauuagacuaaagugaucugaccuuagcacaguaucccauauuaauauucuucuauucaguguauuguuuccagaagauuauguuguaccagagaacaaggcaugcaggcuuagauuaagaaucagaacagaccuugccaucagccucagcagaagcagcgggggagggcuccugggaggcaggugccaaagcacuuggaacuuuagaagacuaaaggcaaaaaauccaggggggaaaaaaaaucaaggaugcaaaaaugcauucaggaacauucuauaaaugaauuuuucccuucuguaaugaaaucguaaaauaacaugaaagaugaaaauaaucaugggagauuguuuauucugccuuauuuccuucaccauugucaccuuuguuaaaaguuuccuucagaugaauacauaagaaaaauccaaauccaaaagcuucauuuuuauuuuugguauuuaauaagauucuuuucuggcaaagaauucaagguaaaagauuuuuauacacacuuuaguauuacaacuauuuuaauuauuacuaguaauuaaaaccucuguucugugcauacuguuuuuuccaagaaacccucuuauuauaauaaaaucuugagucauuucagcuaugugcaaaguugauaaagucacugacugaauuuuuuuaaaaagcuugaugcuuaaaugcuuaaauaaaugcuuaaaucuacuuuuaagcauuuaugucagugaauucaaaauacuauuaucuuuaaaucacucaaaacccauuuuaaacuuguaugccuuuacucaguuaguuccaauggaguguuaaagggaggaaaagaagaaaaaauuacuccuaggacugaguaauauucugagcucaucaaucuaucuuuagguauugggaauaugcauuaaaaacauuuuuuuaccuugucucgugauacagcugaagguaauucucuggcuagccuguuucuccuuuguuccuaagaaacacaagcaaaacaaaagugauuauccaaguauugagauauaugccuacuaaaaaauguucauguuaauugaaaaguguggaguaacuuacagauacauccucucacuguugggacucaugccauaauuaucauauuuuaaaauaaauaagaaaucauuuaacccaaagcuucuuaaucuuuuuuuuuucugcccacacaccugaaggauacaauacacugucaguaacaguggcucccuguacuggggauucucaaaugaggggcaacagacugccaucuucucccccuuucccacuaagaaacagugauguaaacuguccucacauaaauguggaacgugguaagccuucaacauaaccauguggaauuugaaguccagagaucacagaaaacuccgcaaagccuuuaaaagucacucuaaccugaacaccuuuguguuaaacucaaacaacuccccucauaaaaccguaucuugaagaaguaucugugguugagguuauccuauaaaaauguuccauuucuuccuccaggaaauaguguugacaacugcuaguccuuucuguaaccuggcuaauuuaacacacugaucaauugccuacuguucuaauuugcuaauauuaucaaaguaacuuguacaaagcuaaagaaacugacaaauucaaauuagaaugucccgagcaucugcuauauccaagcaccaagauagguaaaagauuaugaaaauauuggccgggcacagugccucaugcuuguaaucccagcacuuugggaggccaaggugggcagaucacuugagggcaguucaagaccagccuggccaaaauggugaaacccugucucuacuaaaaauauaaaaauuagccaggcauggugccgcacaccuguaaucccagcuacucaggaggcugcggcaggagaacugcuugaacccaggaggcagagguugcagugagcagagcucaugccacugcacuccagccugggcgacagagugagacucugucuuaaaaaaaaaaaaaaaaaaaaaagauuaugaagauauagaaaucuguagauguuaauuaaugauggaucucucacaggcagcaucagauaaaguagaaacuauuuagguuaaagucacaauugcuccuaaguaggaaguauuucaugaacacaguccaacuugcaaaaaaauauaaguuaaagccucacaaugauuuuguuuuuguuuuuuguugaaauggagucucgcucugucgcccaggcuggagugcaguggugugaucuuggcucacugcaaccuccgccuccuggauucaauggauucucccugcugcagccucccuacuagcugggauuacaggcauccaccacccccggcuaauuuuucuauuuuuaguagagacaguuuugccacguuggccaggcuagacuugaacuccugaccucaggugaucagccugccucggccuaccaaagugcugggauuacaggcaugagccaccgcacacagcccacagugauguuucauguguaauaauuuuuuuugacagaaauuugacccaauuuuauuuuuucaugggcggguauucaguaauaaaaaauaacagauaauaaaaguauagauauuaacaaucuucaaaauaaaaaauuagcaugauaaaauguacauuuugaacagggauacaaagcaaaaggccacgguaucuagaauucucacccuagucuguuacuaaccaguuaugaucugagcugcuccuggaccccagcagauguggaguaccugcuuugcuaacuggacagcuuaccaacuauuuugaagcccuaguguccuaaucuguuaaugacaugaucugcccucaggguaugguaaagauuaaaugaaaauauccacauaaaguucucuggcacagucauuaaaaccagaaaccuauucauuuguagaaaaauacuaaucugaaaucauaucacauaugaccuugucaguguaacagaacuaccgcaaacacaaguuuuucaugauguuaguuucaauguaaaaaaaacuaaauccuuuaagugucuacaugcuaauuuuuaacauaacugugaucuggccuacuuucugaguguuuugaagugccuacucauguaugcauuuuggaauuuuuucugauaacaggaaucacccccagcuauguaaccaaaaauuaguucccuauaccuguguuaagaaggugcuugcuuccuauaauagugcccugcaaaauaagcaccaaaggaauaacugcuaucuguaagccucaagcuccccaguuuuuuuuuaagauggaguuucgcccuuguugcccaggcuggagugcaauggcgcgaucucagcucacugcaaccuccaccuccuggguucaaguugauucuccugccucagccucccuaguagcucagauuacaggcaccugccaccaagcccggcuaauuuuuuguauuuuuaguagagacgggguuucaccauguuggccaggcuggucucaaacuccugaugucaggugauccaccugccuugaccucccaaauugcugggauuacaggcaugagccaccacgucuggccaccccaucuguuuuaaccagaguugaagucaauaacacaggaucccuuccagcuucugaauugcauguuuacaauuuucucaccauggauaugcagaagaggaaauuugguauagcaggggacucaggucuuacugaauuagggaguagcagaaaaauguacuauuuuuggagaaaagcggcagagaaaaaaaauggcuucuggauaaauugcucuguccaccagccuuggcuccaucugagaucuuauucaauuuguuacauuaaaaucaaaaggaaagaaaagauccaugaaaugcagccaccccaguaguggugaaaaaagcacucugcuuuuccaaauuuaugcuaaguugguuaauucuugaguguuuccuucacagcuuucaaagccaaaugaaaagaauuuuaaauacuuuguuguacacacuuccccuguauaaacuauaaguuaccaaaauagagccagucacaccaaaucaaugaauuuucagauucuuucugaauuucaauuucauaagcagaaaguaauaaugccugcaggugguuuugagaauuaagaaaacaauguaauccccucagcauauuuccugacaugcagcaggcacuaauguggcacaugucuauuuuauaguuacuccaugcuaaauaaguuugauauaacugaguuacaacagauuuuucuaccugugaaaaagcauuuaagaauuauauuuaccucuauauuauuguucauuagcccacaagcaucagcaaagucuggauguuuuguguugauauaagccaguucaauugccacuaaguuauggaccuagaaaaaaaguaaguuaggcgauauacaaaaauacaucaaccauauuuuacuuugagaaauuuauauauaaaacuuaugaaacagacaauaccgaaaaaguacaggaaacuuaugccuaaauuacuugauaauuauauuccaacugauaaaucuuaugccaaacaauaauuuacucuagcuuuaaaauuauuuacauuucagcaucuaaaacugcauuucuaagagggaaaaauaacauuaaaguaacuacaaguauuuuacucuuagggaaaaauagucaucuaccuaaugcaaaucuaaauuccaacacuuuaugcaacuuugcuauuaaaacuucagaucauccacuauucccugucacuuuuuuaguucauuuucaacaauaagaaaauaaguucguaacaaggcauaaguuaaagauguuaacuuauuuggguaaaggauacaucuaaggaccugagguagugacugauuagccuuaacuauaaagcaccuaguuaaaauauuauauguaguucaaaauccuaagaggaaaauaaaaaagaaaaguuaaaauuaauuuauccagcccucuacagaauugcuaagucuuuuuguuuguuuguuuguuugagacggaguuucgcucucauugcccaggcuggagugcaauggcgcgaucucggcucaccgcagccuccaccucccagguucaagugauucuccugccugccucagccuccccaguagcugggauuacaggcaugcaccaccacgcccggcuaauuuuguauuuuuaguagagaggggguuucuccauguuggucaggcuggucucaaacuuccgaccucaagugauccacccgccucgacuucccaaaguguugggauuacaggugugagccaccacaccacugagucuuacagagagaauaaacuugagcccuuuauuaugugcuguccuaacaaaucucagguaucagaacagcacuuaucaguccagaacuggguaaaaagggucuauuaaaaugaagguccaaugauucugggcuaaauucagucuuagacaucagaaucugagggcuauccuugcuaaagaaacaaccaagcagcagcacuuacauuccaaggaugguuuuguacucuuaguaaaccuccacgggguucaccauccugagccaaggacccaaaugcacuuuuagugaucagaaagaaaacaaaaaacaaaaaacccagccaacaauuagaggcaugagggcaauuuuaaaugcuuaucccauauuucugccaauuucagcauuuuuauuuguguggauagcagcaacccacagaauaguagcaagcaacuacgauauuauaguuauuaggucauaacaagcaaacugcagaaguggccagauuacuccgauguaccucaaaguaacagugugcuauaaaugcucaguuuacugaggcuaaagauggaacuaauuuucucuuaagaucagugguacuaaauaauacagcaaagcuauucacaccccucaaucauaaaucuauuuucaagaaaacccaugccugcaggcuaacaaugauuaaaauaugaagaaaaaaugcacuuuauaccagaauuauuaaaaauuuuccuuuaaaaugagacugaaacucaacuuguuuuuccucccaauacacuggaaaacauuaugccuacacucuaaaguaaccauauaaugcuuauuaaaaagcagccaagcaaaaauuuaaacuuuuacuaauaguaauuacaaugaucuaugcuauaguagcucaccauuucauuuguaacaggcaaccuuuuacgaagaagacaagucaccacuucaacuauggcaucaugaaguuuaggaaaucguaacaauuccuacaaaugguagaugaaagaaaaacguguuuguuuuuuguuuuuuuuuuaagucauagucucacuaagccauccucccaccuuagccucccaaguagcugagacuacauguagaagccaccaugccaggcuaacagucauuuucuuuuacuuaaugaucacagaaauacugaauucaauuuggagacuacauuuaagaauccuauuucaaaucacuuucagguaagggaacuacagauuuuaccuuguaucccaucuuauacauuuccuuccacccagugaaaccaccacuucauguccuuuucuaguucaugugaaaccuguuacauuucucuccguuaccuguguacuguaauugcuacagugcugaaugauccuuugcauuuccucaugaaccaguuccacacagcggaggcugggcucuucuagacguuugauuugccgcuucaccaguaacucaaaugaaaccucaggcacaaauaaagcaggacgaggacccugagaaaauaaaacuuagaacucuuauuauauauguaauuucaguucuucccaaggguuaagaaagucacauuuuugguacuuuucaugaaaaaugcuuuuuaauuucaaauaugagagcaaaauaaacuguauaauuaaauuuaaaaagacacaguauauggguaagaaaaacuuuaaccucauuuuuuuuuacagucuaaaaagcuaaacauacucacaguagcauuucuaauggcagucaaaaugucaauaguguuaaggccaccaaguggaucaacagauucuaagguucgcccaaaagucucauggaaaauauaacaaauucuagcaccaccgcaucugaaaggcaaugaaguauaugguuucuggcauugcaaaaagggaaagaagauacaaguuagaagucuuucuagaagcuuuaagcucaucuuauuuucugagaaagccucagauaaacaauuucauucauucccauuaccauguguucuaacucagcucauuaugaacuaguuucucuaauuuuuuuaaaggggaaaaggaaucauuaaauuauauauauguaaauauaauaaauguucugacauaaaucaacaguuaacuaagaauugcuaagcaccuuuucucugcccuaguuuuccuugaggacaggaaacagugccuuauauuuauuuccauugauucacaaucugaaguagagguuggcaaacuuuuuccauaaagggucacauaguauuuuaggcuuuucaggccauacagucucugcugcaacuacucaacucuaccauuaagcacauaagcagccauagacaauauguaaauaaauaaguauagcuuguuagccaggcuugucucaaacuccugaccucaagugauccgcccgccuugaccucccaaagugcugggaucacaggcgugagccacccgugcccagcccuacucuugcuuuagacaaauuaaaucucucuuuuuuuguuguuuuguuucuuuuugagacggagucucgcugugucgcccaggcuggagugcaguggugcgcucuuggcuuacugcaaccuccgccuccuggguucaagcgauucuccugccucagccucccaaguagcugggacuacaggcaugugccaccaugcccaccuaauuuuuguauuuuuaguagagacgggguuucaccacguuggccaggauggucuugaucucuugaccucgugaucugcccaccucggccucccaaagugcugagauuacaggcaugagccaccacgcccagccuuagacaaauuaaaucucuugauauaguuacugagcaccuuauguuuccuaucuuguuuaauaacuagaaacccugguauuaucuuuuuuuaaauucaaguccaucugaauucuacaaauaccuuuauaaugccuccccaaaucaucccuuccucucuauuuuuacaaucacuauugaguacuuuuuuauacuagcucaggcaaaaaguacuagucuaauauuaugcuaacagaaguaagccaagcacaaaaggacaaauacugaaugauucaauuuauaugaaauaucuacaauaggcaaauucagagacagaaaguaaauucggccaggcacaguggcucacaccuguaaucccaacacuuuggaaggcugaggugggcagaucaccugaggucaggaguucaagacuagccuggccaacauggugaaacccagucucuacuaaaaaugcaaacaaauacaaaaauuagccaggugugguggugggcaccuguagucccagcuacucaggaggcugaggcaggaugauugcuugaaccugggaggcagagacuggcccaaacugugccacugcauuccagccucggcaauaaagugaggcucugucucaaaguaauaaaguaauuaauuaauuaaauuagagguuaccagggcuggagggaggagaggggaaugaguaauugcuuaauagauaagaauuucggcugggcgcgguggcucaugccuguaaucccagcacuuugggaggccgaggcaggcggaucacaaggucgggaguuugagaccagccuggccagcauggugaaacuccaucucuacuaaaaauacaaaaaauuagccgggcauaguagugcgcgccuguaaucccagcuacucgggaggcugaagcgggagaaucacuugaacccaggagguggaguuugcagugagccgagaucacgccacuacacuccaguuugggcaauagagugagacugucucaaaaaaagggggacugggcacaguggcucaugccuguaaucccagcacuuugggaagccagggcagguggaucacguguucaugagaucgagaccauccuggcuaacacagugaaaccucaucucuaauaaaaauaaaaaauaaaaaauaauuagccgggcgugguggcacacgccuguagucccagcuacucgggaggcugaggcaggagaaucacuugaacuugggaggcagagguugcagugagccgagaucgcgcaacugcacuccagccugggcgacagagcaagacagaaaaaacuucguaucuacagucuuguuccuagacacccuuccugccuuaucuccuauuaugucccaucacuauacuugcuguucuccaaaaacauuauucuugcauuauucuuugcuguugccaagccuaaaaugcccucucauuacugccuucucaaauucuauucagagcccaauucaaaugccuucuuaaauguggaguucucccaaacccugaaauaaauguaaauggucucucuucagugucugaaacgcuugauuagguggacacagauaauugguuuauuaacuguuuauaaagugugcauauacacuguauguacuuuucugaauaugaauuauaucuaacaauaagaaguauuuaaauaaaaguuauacuuuugcagccuaaucaagcccaguauuaccuugaccuacuuuacccacuaaacucuucaaaggcccauuugugguaaucuauuuuucucaauaugccguacauauaaccaauaauuagucugauaaauacucucuuuacggaguugacucauaugaagaccaucuugggcacacuaaaguauacagaacuacacauacacacacacacaaauucacguauaaaucugaacaagcucuguggauuguacccauguccaauuuucucacuuuguuauuguacuauaguuaugcaagauguccaacagugggggagaugggggaaaggguacacaguggagggugcaugggaccucccuguacaucacccugcaacuuccugugagucuauaauuauuucaaaauaaaaagguguucuaaugaggguguagagaaauggauguucuugcugguaguaaaacaguacaauaugcuaacaauaugcaauauguaaugaaagauucuaaggauguuauauccuuuaaucuaauaaacuuacuucuacaaauuuauccucaguguuuacuuggacacaaagccccaaagacagaugcagguaguccaucacagcuuauauguguauauaacagaaaacaaacuauccaguaguaggagacuggccuaacaaaugaggguauaucuaaaaaguaaaauacuaugcaaaucuucagacugauaauguaugagacagaaaguuauuuguuacaugauuugagaaaugauuccaagauagguauagcaucugauuuuuaaagacauguaguauaggcaucuauguguuguagaugcauacaaaaaugccuaggucaaugccaaauuuuaggaauuaucucagguuggugaaauuaagagugguuuuuuuuuccauuuucagagauagggucucuuuuuuuagcgccaucugcuugcagugcugccucuugcuccuccccaccaccacugcugcccugagucacugccugcacagcuccagccgccuggcuucucauaguagccacugauauuuggaguucuuacaacauggcagacauugacaaccugccuagcuaggguaguuaaaagaggagugaaugcucucaaaaaccugcaaguuaaaggugcacagauagaagccaaauucuaugaggaaguucacgaucuugaaaggaaguaugcuguucucuaucagccucuauuugauaagcaaucugagauuacuaauacaauuuaugaaccuacagaggaagaaugugaauggaaaccagaugaagaagaugagauuucagaggaguugaaagaaaaggccaagacugaagaugagaaaaacgaugaagaaaaagaagaccccaaaggaauuccugaauuuugguuaccuguuuuuaagaauguugacuugcucagugauaugcuucagaaacaugaugaaccuauucugaagcaugugaaagauaccaaagugaaguucucagaugcuggccugccuaugaguuuugucuuagaauuucaauuugaacccaguaaauauuuuacaaaugaagugcugacaaagacauauaggaugagguuagaaccagaaccagaugauucugaucacuuuuccuuugauggacaagaaauuauggguuguacagggggccagauagauuggaaaaaaggaaagaaugucauuuugaaaaccauuaagcagcagcagaaacacuagggacaugggacaauucguauugugacuaaaacaguuuccaaugacucuuucuuuaauuuucuugccccuccugaaguuccugagaguggagaucuggaugaugaugcugaagcuauccuugcugcagacuucaaaauuggucacuuuuuacgugagcauacaaucccaagaucaguguuauaguuuacuggagaagcuacugaagaugaugaugaugaguaugaugaagaaggugaagaagcagaugaggaagaggacaaaggagaugaggaaaaugauccagacuaugacccgaagaaggaucaaaacccagcagagugcaagcagcagugaagcaggauauauguggccuugaggauaaccugcacuguccuagccuaaacacaauucuuacuuacugccuuauguuuuuguauuuucuugguagacuggguaauuuuuguuuuaaaggacaggaaacugauauuuuaaagaccaaucuguucuaccuagcauuuucacuaguuuuucugccagguauguugaaugcacaaauucugucacacauguucauucgcugcuacauaauuugguucuucuggaauauuuauauagcucuuggaguacagcuaugaaaauuaacaacuguuaaaggaaacacuuuuuuuuuucguaauuuuuuccuugaagaaccaaaguauuuuuucagcuguuuguugaauaggguuaagucugcuuggauuagcugugccuuucauuacuuuguuacagaaaugcagggacuuguacuaagacaauccaucguuuaaaaaaaaaaaaaaaaccggcaugccagucgcgguggcucacgccugcaauccuagcacuuugggaggcugaggcaggcagaucaccugaggucaggaguucaacaccagccugaccaacauggugaaaccccgucucuacuaaaacacaaaaauuagccaggcaugauggcgggugccuguaaucccagcuacucaggaggcugagaugggagaaucacuugaacccgggagacggugguugcagugagcugagaucgugccacugcacuccaaccuggguggcugagcaagacucaucugaaagaaaaaaaaauuggcaagacaacuauaugguuaagaauuuaagaacuuccaguaugaccacacccaauaacuguauuagauuguuaauggauuauuguguuauaggugacauaguuaacuguaaaguaaccugacucaguauaguuacugguaccacagugaggugaauaaaacaggauuuuucagaaguuagccugaauuucacuguacuuuuaaauuuaaccuccauuaacuaagcaucuuuucuuugugguagggucuaccuucugcuucccuggaaaggaugaacuuacaucauuugacaagaccuguuuucaaguuauuuguuguuuguuugcuuguuuuuguagccuaaaauaaaaauuucaaauacaauuuuaguucuuacaagaugucuuaauuuuguaccaauucagguagaaggagaggccuagcuugaauuaaggguuauacucaguuuuuaccacauuauugaaaaggguaccagcuuuggaaagagauacuauacuaauaagcaaguguaaaaaaaaagaagaagaagaagaaaaucuucagugauacgaugcuuuaaaaaaaaaaauuaaaguucauuuucuuugggguagagcuagagagaaugccccaagcuucugugugguuucuucuaauucuuauugcuugaaguaugaguaugucacuuacccaugcuucuguuuacuauguauuaaaauguguaguacuguuuacuuaacuaccucauggauguguuaaggcauauucaguuaaaucucauaaaauguuucucauucucauuaaaagcucacauuuugggccuauuuguaaugccaguguugacacucagcauuuuguucacaccaugcuuugacaacuaaacuggaaaacaguuaucaaacuaaacuaucaguuagugaucuuuguguggcuucuauauauauuauuauauauauuauuauuuuuuauauauauauuaaauauuuaauuuauauuuaauuaauauaauuuauauauauauauauauauauauauauuuuuuuuuuuuuuuuuuggagauagagucucucucuguugcccaggcuggagugcaguggugcgaucucagcucacugcaaccuccaccaccuggguucaagcgauucuccugccucagccuccuaaguagcugggauuacaggcacgugccaccacgcccagcuaauuuuuguauuuuuaguagagaugggguuucaccauauuggccaggauggucuugaucucucgaccucguaaucugccugccucagccucccaaagugcugggauuacaggcgugagccacugcgccuggccaauguggcuccuauuuuuauagaaguagauggaugcacuauuucacaagguccaacaauuuuuuucuguaugacugcauaguaguaaauacuacagggauagcacauaguauuguagucaugagauuaaaguagagauaagacuauuuuugacaaaagaugccauuaaauuucagacuguagugccacauuuacaauaccucaggcuaauuacuguuaauuuugaggcaacuuucuuuugacgauggcgaggguggacuauuggauugucauuagaggaaggucuagauuuccugcucuuaacaaaauuacauugaauucauuuuuagaggugaugaaaacuuccuuuuugagaaguuaguguucaggucuuggaaugugaacacauuguuuguaaugcuauccauuccucuccugagauuuuaacuuacuacuggaaauccuuaaccaauuauaauagcuuuguucuauuuucaaaaucauuuccuuugcuuugauuagacacucuguuuuuuuguuuguuuugguagccguaguucaucuaaaugcagcuuuuucugaacuuuaaagauagaaucccuguuuuuuuuuuuuuuuuuuuuugagacagagucuugcucuguugcccaggcuggagugcaguggcaccaucucggcucaccacaaccuccgccucacggguucaagcaauucuccugccucagccucccaaguagcugggauuacagcugcccaccaccacgcccggcuaguuuuuguauuuuuaguagagaugggguuucaccauguuagccaggcuggucuugaacugaugucaggugauucacccgccucagccucccaaagugcugggauuacaggcaugagccacugugccuggccagaaucccauuuuuaacgaacugagguagcaaaauaaucuuuuucauucuuuuaggaaauaguuauugccaaagugaaggugucgauaauaccuggucuuguuauauaauggggaugugguuugcagaagaauuuucuuuauaaaauugaaguuucaagggauaucaguguuuaugccauuuuuccaguuccaaaauuauuccauuccauucuagaaaucugaaguauguaacuugaaauccuuaauaaaauuuggauucaauuaaaaaaaaaaaaggauggaauuucaauauguugcccaggcuggacuugaacuccugagcucaaggaauucuccuaccucagccuucugaguagcugggacuacaggugcacaccaacauguaauuuuguuuuuauguuuuauuuuuacuuaucugcauuuucuaauuuuugugagcaauuauacuguguguacuaaagaaacaaacacuuuaaaagcuaaauuauuuuuaaauacuuauuaaaauauuuaauacuuauuaaauacuuauaaaaauaaguaaauacuuauaaaauauuaaaauauuuaaaaauaugugacaauuuuacuuugcuuuauaucauuuacaaagcauauuuucacacaaccagacaucauccuauuaucucuacaaaguuauauuuuuguuuuauagaaaauaaaucuuaaucagauaaucugagcugaagucaucuucacaaaaggaaaagugaccuagcaaucuagguaaccaaaucuacagaaaaauuucuuacuuacagcuccgaaguuucaauauauuuugcaguuccuucaauaguguuacaauauucuguggcaaauuugguaauaaguuggaguaaaguagcacuuuuaucauccacggguucaccguagcuauuuagaagagacugauacugagcagcuagaacauuuauucuuguuuucaacucugguaaacaaucucugaugugaugcaucaguaaccuaaaaaagguuagaaaggaaggauuuaaaaguaaaauuguguauucuaaagcccuaaacaagucaaauuuuuacaauggggaaaaccuaucaaauaauuuguccuggcaaaugugauacugugaaauauauauuuggucuuugucuucauuuccuggcagucagcuccuaaaauccuuggacucuccaagagcauuaaggguguuuagagugucucugcaugcuaaugagaugacugguggcugggggucccuagauagcuucaggaugggagcuggucaccagaacagccucagaagagaggagagaggccaaacauugagcugaucaccaauggccaaugaagcuuccauaaaaacucaaaaggacacaguucauggagucuucagagaguugaacacaugaagguuccuggaguguggugugcccagagagggcacggaagcuccacauuccuucccacaugcccagcccugugcaucucuucaucuggcuauuuaucuauauccuuuguaauaugcuuuacaguaaguggguauaugcuaaguaguguuucccugaccucugugagccacucuaacaaauucaucaaacaugaaaaggggaucauggguacccugacuuauagccugucagucagaaacacaggcuacaaccugugcuuacaacuggcaucugacuugggggcagucuugugggacugaacccucaaccugugggcgcugacacuaucuccagguaaacaguguuagcauugaauuaaaggacauucagcuagaauccccuggagaauuccuugcuugauguauggggaaaacuccccauauaucugcucucaaaagcauucugugcuauacugauuaacugugugugaaaaggaaaaaaacaauuuugauugguuuuuccuaaauaauaaaagcaaggaaaaaaugcaaauuauuuucauauuacugcaauuaccacagagaaaauaagccacccaaucaauucuuccuauauaauuuugguuucauugacuugucauuuacaauugguacccagcaaagugaaaaucaaccuuauuaagauccaagucuaucagucuuuagggaauaagauaaaaguaagagaaaauggcuuccacuucagucauuuauaaaucaucuagaaagggcuucuaguccccacacaucaguggguauucagaauccaacguauaguuauuucuacagugaauagaaauaaaagacauucuauuucuuuguuuuuccaucucccuuuccugguaaauaaaacacauucuaagguaagaauagauaaugugaaaauuacaaauuuuaaucaguuccugaaaugcaaaguggaaaugaagucaucucuaguucuagccacaaaacuaaauuaacugucaaaauuuucguaauuaaaacauuuuaaaaucacuuguacauucauucuagacuacgugaugauguaaugucaaccaccccaauaaaaacagagacaucuacucuucaggaaccuacuauauaagaaaccauaagugaagcuguuaggaacaguaugaaaauguaaggaacugaaaaugaacccucucagacaccaauugguaaaaacaaacacaucucauuuccaaaagguaaaaaaauuaccuguuuagaguccuagcaagauacuuuguuccauuucuauuggccagagauggauauuucuuuugaagaaaagcauacucaucacggauugaaucaguuacacucuucuuguuguuaauaucuagcuggcuccugagguugaaaaaauaacgaaacuauucagcuuaacuguuguccucuuccuaccuuagaugaugacagcaccaggcauuguucucuaauaccugacagggacuguuuuauuuaauucucacaauaauuuuauguggcagguauuauuaccccauuguauagcaaggaacugaggcucacaaaaacuaacuuaccccaggucacacacuaacuggcauagccaagacuugaacuaagugaauuguaaguaacuagugccuaaauagaguaggccucauuauuaccauuaacuauagacaaaaacaauaaguaacagguauagacagguauaaaaauauaagaguaucuuagucaacuguauauuuuauccauggacagggaacuaauuucucccaaaaauaauuaaguuaacuugaagaacaaucaucuacaaacaacgaacaguguuaggccaccuccuuaccugaaaaaggagacagcuggaauugggaguggggaugggagaaugacaguggggaugggagaaugacaguaggguuggaauggaaggacauuaaaauagaagcagacaacuggaauggaucuuauguaucaggcaguaaaaacauuuucauuuucuaaaggcuugagacccaaagacauuaggugucauuuaaaccuacguuguaucuaguuuauguaagaacuaggacuauaacucagauuucaugauaauuucaguguuuccuaccauaugaaggcuuuggacuaaaagagauauucauccgaauccagcucuuucacuacccacgugacuuuugguuaaauguauaaccugagguuucugauuauaaaauagacaucaacaccuaccucaggggaugcugugaggauuccaagagauaccauuugcaaauugcucacaguagagugucuaaaacguaauuagacacucaauaauaauuuccuuuucccgauuuuuaauaccaacuauuuauaauuaggauaccuuuaauaaaauuucuccaagucacauccuggcaauuacacagaaucacuaaugcuagggauuaaaccaaucuauuaaaaucuugucaccuuuaauuagacacucaauacuaguuuccuuuucccaguuuuuaauaccaacuauuuauaaauuaggauaccuuuaauacaauuucuccaagucacauccuggcaauuacacagaagcaucacuaaugccagggauuaaaaccaaucuauuaaaauccugccaccuuaaacucuuucucgauugggugcacauuagauaauuuuucccuuacccaguaccuccucauacauagcuuaacaugauaggcaagaauucuuaaagccuggcuauuacaacauuucuuccauuuugugguauugcuuacuuuagaaacauuuuccaguaaaaaugucuauggggcaggcacaguggcucaugccuguaaucccagcaccugggaaaccaagguuggaggauugcuugagcccaggaagucgagacaagccugggcaacauggcaagaccuugucacuacaaaaaaauuuaaaauuagccagguguggugauacacaccuauagucucagcuacuugaaaggcugaagugaaaggaucacuugagcccagagguugaugcuacaaugagccacaaucacgccacugcauuccagccuaggcaacagagagagacccuauuucaaaaaaaaaaaaaaauucucucucuuuucucccuuuagggcaacggauucuuuagcaauaccaagaucauaauaaaagggagaaaaaauauaguacagcaucacauuucaaacagauuuuagaaauucagacuugcucugaagugagaaugcuuaucccauucuaagaaugcuuaucccaauucuuaucccauucuaacugcuaaccuguuaacuacuccaauuauuccaaguuugacuggaauaacccuucccaucaauacauccauggcaucaguacccgcauccaugagaucaaguuuagugauuacagcuaggguucugcgaccugguaaaugcaaaaagaaaaaagggcaaagaaaagaaagaaaaugauccauuaaauacaacuauuuaguguuaauaaaggaaaacccucaucuacaaucccacuuaguauuaccucugucaucauuuugguaaugccuuacuuaccagugcuuuuuuaaaaauaauguuaaacauuguguauaauuuuuuaaaacauuuuugccgggcacgguggcucacaccuguaauucuagcaguuuggaaggccaaggcggguggaucaccugagaucaggaguuugagaccagccugacuaacaugguaaaaccccaucucuacuaaaaauacaaaaauuagccaggcacaguggcagacgccuguaaucccagcugcucgggaggcugaagcaggagaauugcuugaacccgagaggcagagguugcagugagcugagaucgugccauugcacuucggccugggugacagagcaggacuccaucuaaaauauauauauauacuauacauauaaaauauauauacuauauuauauauaaaauauauauaguauauauauaaaauauguauaguauauauauaaaauauguauaguauauauaguauguauaguauauauuuauaauauauauacuauauauauuauauauacuauacauacuauauauacuauauauaauauauauacuauauauacuauauuuuauauauauauaaaauauauacuauauuuuauauauauacuauauauaguauauauaaauauauauaguauauacuauauauaguauauuuauaaaauauauauaguauauacuauauauauuuuauaguauauauauuucaguuacaaauauauauaucuaccuagguauauauauuuuuuauauauauaucuaccuagguauauguauuuuuuauauauauaucuaccuagguauauguauuuuuuauauauauaucuaccuagguauauguauuuuuuauauauauaucuaccuagguauauguauuuuuuauauauauaucuaccuagguauauguauuuuuuauauauauaucuaccuagguauauauauuuguaacugaaaaaugccauagguaaaauuguacacuaugcagagcaggacuccgucuaaaauauauauauauacuauauauauauaauauauauacuauauauuuaaaauauauauaguauauauuuaaaauauauauaguauauauuuaaaauauauauuauauauuauauauacuauauauuauauauaguauauauauuauauauacuauauauaauauauaguauauauaaaauauauaguguauauauaauauauaguauauauaaaauauauaguguauauauaauauauaguauauauauacuauauauacuauauauaaaauauauauaauauauacuauauauuuuauaguauauauaaauauauauaguauauacuauauauauuuuauaguauauauauuucaguuacaaauauauauacauagguauauauauaaaauauauauaaauauauaaaauauauauauaaaauauauauauauaccuauguauauauauuuguaacugaaaaauaccauagguaaaauuguacacuaugcagagcaguuggaacucucacacguugcuggugggagugguguagucauuuugggaaacagucuggcaguuucuuauaaaguuaaauuagcagucccauuccuagguguuuaaccauguuaagugagaaccaguguucauauaaaaaacuauaugcaaauaucuacagcagcuuuauucauaauuuucaaaaacuagaaacaacucacauauuucucagauggguagugaaauaccuaugguauuuucaguuacuauauauauauauauauauauacuauauauaguguauauauacucuauauauaguauauauauaaaauagauuuuuuucacauguaauuuuuuguugacucuuagggcuauuuuguaagcauuucaaaaaucuguauaaaauuuacauccaggugauauggcccaugccuguaauccuaacacuuuggaaggccaaggcagacagauugcuugagcccaggaguucgagaccagucugggcaaaguggugaaacucugucucuacaaaaaauagaaaacguagcagggugugguaguccuagcuacaggugaggcugaggugggagaaucaccugagcccaggucaaggcugcagugagccgugauugcaccacugcacuccacccugggcaacagaaugagacccugucucaauaaacaaaaaauaaaaauauuuacucuuuuuugguguacaguucuaagaguuuugacaaaugccaagagauaugucacaaccaacucaagacauugccacccccccccaccaaauuuucuuaugcuaaccaaucaaaccaguuuuccauuccuaguuuugccuuuucuagaguguuauauaaacgaaaucagauaguacauaaccuuuugagucuggcuucuuucauuuagcauaaugcauuugagauucauccguguucuuguauauuaauaguccauuccuuuuuauugcagaguagugucccauuguauggaauguaccauacuuuaguuucacuccccaucugaggaauaugugaguuguuucuaguuuuugaaaauuaugaauaaagcugcuguagacauuugcauauaguuuuuuauaugaacacugguucucacuuaacaugguuaaacaccuaggaacgggacugcuaauuuaacuuuauaagaaacugccagacuguuucccaaaaugacuacaccacucccaccagcaacgugugagaguuccaacugcucugcauaguguacaauuuuaccuaugguauuuuucaguuacaagcauuuuucuuuuuuuuugagacuguccuacucuguuguccaggcugaaaugcaguggcacaaucucggcucauuguaaccuucgccuccacaguucaagugauucucaugucucagccuccccaguagcugggacuacaggcaugcaccaccaugccuggcuaauuuuuguauuuuuagagagaugggguuucaccauguuggucaggcugcucuggaacuucuggucucaagcgauccgcucaccucagccucccaaagugcugggauuacaagugugagccaccaugcccagccuacaagcauuuuucuguacugcuacaaaucuacaaaaucauccuuuuuaauuauuucauauuuuauuauuauaauuuacuuaaucuuuccaacugcuggccauauuaaguuguuucuaauuuuuuauacuauaaauaauacugggcuggauuauuuccuuaugauguauuacuagauuaugauuaguaaucaaaccaggugcaguggcucacucuugcaaucccaacacuuugggagacugaggugggaagaucacuugagcccaggacugcaaguuugcagugaggcaugauugugccacugcacuccaggccugggcaacagagugagacccuacauccaaaaaaaaaaaaaaaagauuagauuaaaaauaugacaauaucuauggcucaagggucaguuuaaaauagaguuuauacauauaaaaugcuuaacagguuuuuguuuguuuuuuacgaaggucuggcucugagcccaggcaagagugcaauggcaugaucucggcucacugcaaccucugccucccgggcucaagccauccucccaccucagcaucccaaguagcuaggaccacagcccagugccaccauacccagcuaauuguuuuuugugguuuuuuuuuuuuaauagagauggggcucucacuuugcugcccaggcuggucucgaacuccugagcucaagugauccacccaccuuggccucccaaagugcuugguauuacgggcaugagccacugagcccagucuacuuuaaauaauaaaaauaaaauguaaauaaacucuuugauauaguuuaucuuuuaauuuaacugaaaugaacauuauuuacucaagugguaaaaaagaguuucuuaaaaacuugaaauauaaaauauuggggccaagcacgguggcucacaccuguaaucccagcacucugggaggccgaggcgggcggaucacgaggucaggagaucgagaccauccuggcuaacacggugaaaccccgucucuacuaaaaauacaaaaaauuagccaggcgugguggcaggcgccuguagucccagcuacucaggaggcugaggcaggagaauggcgugaacccgggaggcagagcuugcagugaaccgagaucgcgccacugcacuccagccugggagauagagcaagacuccaucucaaaaaaaaaaaaaaaaaaaauuguuaaagugacccugcuuaugggaauuuuuauuggcagauuggcagucuuagcacuauuuccuaucaaauuuuuauuugaaauuauucuucaaagcagggaaagaaaaacaugacacaaccuucagacccucugaauaguaaggugaaaaaaaugguuucuauaugaggccaugcauacauuuguuagcaacaauaguaaccacucucuuacaagcuagcauuuuauauauacuaugagaugugcacuacaucauuagucaagcaucagugacccacaguaugaacuaauccuuggggcuaaaaugcuucaugaaaggauuuuaccuucauuucuaaaaauccccugugccuugagcaugucuaaauauuaucuaccucugcagaauguagauaccauaauucucuacuguaccauaauaaucuacaaugauuaccuacuguguuuugguuuuuuuuaacagacagagucuauguugcccgggcugacuuugaacuccuggccucacgcaaugcucccaucucagccuucugaguagcugggacggcaggcacaugugaccacaccuggcuauguuauuuauucuuaaaagucaacuauucaaauaccuaggucacaaaacaagaaauccuuuuugcaaagccaccguauuauuuuuaaauuauuagguaaccauuacaaauaaaguuguaaaauauuuucgccuagucuguauagcaacuuaauaaccuuauuuuccaucagaauuucuauuuuuauaaacaaaaauaggaaagcauuaucuuuuaaauuuguauucaaaaccagagauacuguuuuuaaagagaaaaauuccuuucucaaggguagauuuaccauuguaaaauaagcaucucauuaaauuaacaucuguccuuaccaucuggaucuaccucucuugaaauuuuaagugccucugauguugccauaucuguauuagcagcagugacagcgaggauaauggaauuaggauuacugaugaaccgaagaaugagcucucugauuugaagcucaauauccuuagguugaucaccuacaggcaccuaaaccaaacagagaugagcaaggaacuaauaauuaaaaaucaacucagcuuuuuuacccacauuuaaucgauagaauauagguauauccauuuaaaaauaguuaaaauaaaaauaaagacauuacuaauauacuacaaugguauuuaugaaucugguaaugugucaagucucaaaguguaacucuugcaaauaucaaaaguugauuuaauacagucccauguuaagaacuggucaauguugauuggcuagauacaaauucauucacucauucauucaauuaccaaguguuuacuggcagccuacucuauuuuaggcacuuuucugaacgugauuucaggucaugucagauuauguuacaguagugaauuuuaaaaagaccaaacuuucugccuucguagaacuuauguuuuaguaauaacacgcauauaauaaacaaaaacauauauauaguauacagauggugguaagggcugugggaaaauaaggcagaacagcaggcuagggaaugauuagagaugauuuuuuucuuuuuuuuuuuuuuuuuuuuuuuuuuuuugagacagggucucacucuaucacauaggcuggagugcaguggugcgaucauagcucacuguaucuucaaacuccugggcucaaaugauccuccugccucagccucccaaagugcuagaacuacaagcauaagccacucugcaccuggccauuaggauuaugauuuuaauguuuuaaauuggauuauguuuuuaaauagaguaaucagggaaacuucacugagacaacugacacuuaagagaaugagcagaaauuaagccaauaagggagcaauaacauacagacaucugggggaagaaauuccaaagagagugaacaauaagggcaggaggcugaagcaacaggaguuaggagaagaauagggacguaacaaguagauauuuuagaccucuguaauaacuugggcuuuuagugaaaugggagagguuuuaagucaaggaaugacaaggaacuggagaaguuuugagccaagaaaugacacaaucgaauuuucacuuuaaucguaucacugucuacuaagaugagaucacaaggacgaccuauuauugauuauugugcaguaauccagguagcaugauaguggcuagaucaggacaguaaauaugaauuuauaaaacacgauugaguucuggauauacuguaaagguaggaagagccaagaggauuugcuggcaggaaguggaaugugggauaaauuagugucaaggaugacuacaaacucuggcuaagcaauugguagaauggaguugccauuuauuuauuuauuuagagacagggucucacucuguuggccagguuggagugcagugaugcaaucauagcucaccguagccucaaauuccuaggcucaagcaauccucuugccucagcugggacuacaugugugcaccaccaugcccgacuaauuuuuguauuuuuuguagagacguggucucccuauguugcccaggcuggucucaaacuccuggucucaaagaauuccucccaccuugaucucccaaagugcugggauuacaggauaagccacugcaccaaacagagauggccaaggaacuaacaauuaaaaaucaacucagcuuuuuuaugaguugccaauaaauggcaugaguugccauuuauugcgaugggggaagacuauagaaauaccaaaucuaguugaggaacaggucaggaauucgguauuagaguuugaaaugucuauuagacauuuaaguguauaugucgaauagcaacuagauauacaagucuggagauauuugaaugccgucaauauacagagccuuacguaguuaaagccauaaaaucugaugaaaucaucaaagggaaaguguaccuagagaaaacgagaguuccauaaacugagcucuggggcacuuacuguuuagacauuggggagaugagaagaaacagcaaaagagacugaaaaggaguggccagugagacuggagauaaaccuguagagugugguauccuggaagccaaguaaagaaaguguuucaaggagaaaggagggcucaacguuaucaaaugcugcuaacagaucaaagugauugcaaaaagaagcugauuauucucauaugggaugucaacgaagugaaaacaaccugaccaaaucuacaacuauuccuuccuuaccuuggucauuccuggcaaauccacaagugucaaauugacaacguugggugaaaaaaucuuaagaugaauugguucagggcuuacucccuaaaaauaaauuuuaaaauauauuaaaauuucaaugaacuaugaaguaauaaacuucauuucaaguacauagacauuaaugcuuuuaaaaaugaauuaaaucaugauuccuaaaacuuuuuuuuaacaaucaaaaccugaugaaacacaugggaagucagguagccagccauauuaacagguuauaauccuacuucuaucccuguaucauguuauauguacauguauuauauaccauguauuauuuuacauucuuuucucuugauuauaaacauaaauuuuuccuuugcuuucuuuuuuuuuuuuuuuugagacaaggucucacucugucacacaggcuggagugcaguggugcaaucauggcucacugcagccucaaaauccugggcucaagcaaucucuugccuuagccuccugaguagcugggacuacaaggugugcaccaccauguccagauaauuucuuguuuauauuuuguagagaccggguauuacaauguugcccaggcuggcauaugccauuccuuaaauauguuuaauagauuuagugcugaauaaaagaauaauguauuccucacuauccaaauuuaugagguuccgaguucagagaguaaggcguagauaacaaguuguccaaaucagccugguuccugaucuuugaauaucaaguggcaagaauguguacaguaagagauuucucaagaaguuuaucuaacucuuuaaucucuaguaagaauuuggauagugagagguaacguguauuuucucuccugcagacuaagaauacugcguaggcucccuccucuucaccacuggcccucuacaaguauuaggauugaaucaacuacauguaaaaagacacuuaugagauguuuauacccugucuuuguacaugcccuucuuuagccuuuaauauauccucucaucaccuguuuaacuaccuuauguuuucccucauuagcccacugaaaauucuaauuucccagcaaguuuuuaauauccuuuacuccacauucccuauacaauuauauuugcuauuuuagauuacucugugcuauuuuuccauuauaaauacuccaguguuccaaagccaacaaaugucacuaucuggcauaccuacuuagguuguauauuucucaggaucuuuauugccauggcauuccccuaucaguccaauacaaagcucugcccaguaccuuugcaacuccaaacucacagacauuuuaaauccuucagggcuauauguuaggcauaugcagucauuuacauauuuugacauaaaaauuauauaagaucaaaauaucauuuacuucauuacauacgugauuugggaaagaagagauguuucauagauuugggguugggggacuuuucaucuuuuagacacuguggaugaaaagcugcuagguaaguaaauuauauccucaacauaaauuaaacaucuuguagguauagacucaaucuucaaugacauucaguuuaguguaacuaaaaacauuucugaaucaucacaacacucuaaauucugguacuguguaaaauuaccaccaauugcugaguucaguaaguaaauggggacuguaggagagagaauucagacugauguuaugaucaauaacauuccaaaagccaaaaauaucccugauauaauuagaggaaugacgauaagcuaaucuaguuucuggccacuuuuucaacccguucuauacaacaugguuacuagaaauucaggaaaguauggcaacaguagcaguagcucaaagguaaccagccuagaguucaacaaugaacaaagcucagucagucacuguaacagcaacaaauauccugaacagucauaaagguuaacaugacucuaaaaaugccuuucugucaggaaauaaucuuuuagcauaguaacuggcagauacaaggauucaauauuuguugaauauuaguacuaggcuagggcccacuugugggauuaaaugugccucuggauaauauaagaauggagcuaagaacaaaaaggaagggaaauaaaaaucucaagagauaauauauaucucuugaaauauaaagagaaaaauaauaggaauaaagaagacagaagacagcaggauucaggcaaggcagugauaguaccuagugucaagauuaacaguaucuuagauacauaacuuacuucacauucucacaaucucagaaaauaagaaaaccaguugcuaauguauuauuuucauuuucacuaaaaaaaagaaaaaaaaauucccaauuugucucuuuuugcuuucauaagcaaaucuagccauacacagguaagaaaagaacuccucaaaagauauauauauaagugaaacaaugcuuccugaguuagaguacaaucaauccaucagaaaaagauaacuuauuguagcaauacuaaguagaauuauauaauaauguggcauguacaugacaggaacaacaauaaacaucuaaauaaaauauuugauuuauaugaaagcuuuaagaaagaaaagggauuuuaagcaaaguucuauauaucugugaaaauacuccauuuguuucaaaguccauuaugaauuuacaauguccaucgcuucucggccuuuuggcuaagaucaagaguaggaauuuacaaugcccuucacauauuauguacagaauaccucaauuauauauuuacugaugcuuaugccuucuagcucuaaaaagaugccuaccuuauuauuuccugaaauucuuucuguuucauuuucaauuucuugucgaauuucaucaaaauccguguaaagcuaaaaauuuuugaaauaaaaaagcauaauauucaaaauaagaucaaaaguucuuaagcuggagggggaguccauauacuucaaggaugucuauguauuugcuucagaaaauaaauaaaauucuaauguauacauauuuucugagcuaaggauuuauaguuuuuuuaugaguuuuuuucuguuuggcuuuuuuuuuuucuuugagagagggucugacucugucacccagacuggaguacaguggcacaaucacggcucacugcagccucaaccucacauccucaagccauccucccgacucagccuuccaaguagcuaggacuacaggugcaugccaccacgcggggcuaauuuuuuuuaguuuuuauagagacagggucccccuauauugccuaggcuggacucgaacuccugggcucaagugacccacccacuuuagccucccuaaguacugggauuacuugcauuagccacuaugccuggccauuacgaacuuuucaaagcuuccugaucccacaacaauuaagaaucaccaaaucacagagaaaaucggccucaauuucaaguguuuuccaauaaacaauugugguuagaaauguuacuaagauuuauuuuauaaggaauaguuauaguuacuuuaaaauaacguaauugccaaugauuagaaacuaaauuaucaaguauucauacaauauauuuuuuucaacauuauuucuucauuauaugcaugugugauuaccuuauuuuuggugugaagaaauuuaccccauucuucugcuuccaccccuggaaaaaagaaaaacucauuuauuggaaacuauggaaacuacuuuuuaucuuuaggaauucaaaaaggcaacauaauaaaacacuucuuaacuuguauuuaauuuugccauuaaguacaaguuaacaaguauuuuaaggucugcuaaauuauauuuuucuaaaauuguauuuucugcuaaauuauauuuuaaaaauuguaugguguauuucaaaaacaugaccaacuucaggcagagcugcucacaggucuucccacuaguugaaaucuagauuuugcaaauaaaauuguuuauuucucuucauauuuuuuuguguaguuauauuacaguaaaaggaauauucuuuaguuuugaaaaucuuacauauaaaagcaguuuucugacgaaaauaaaguuaguagcuaagaagaaaaauuaagaaucccacugaguagugcaaaaaacauauguaacagauguacacauaugacucaaggaaaaauuuuacaaugugucaaugaaacagcuaauucuucaguucuuuuuaaaaauuugguuuccuguugguuaccuguagagccacaacuugcuguuccuuuaaagagcucucucauuauuauagagcuagcugcuuuguaauuuacacacacuuucaaggugauuuucccccagggucaagacuguuuucccuuggaacuggaggcaggaaagaaauaaaauggaagaaaaggaaaaacaagaacccugguauaugcagcguaaggaguugccacucuccauuaguuuccagucauaggucuguuccucuuguacuugcugaaagaaggaaaauagauucacuguugcacugugugaaguagucuaaaacuuggagagcaagauauagucuguuuuucccagaaaaacuagaacuguuuaauuguggaaagauaaucuaacuuuaucuccuccaaacacagcuguuuugcuuuugucaaauuuagagaagguuaaaauaucuuaauaaguguauugaauaaugcauaucagccuccugaggucuaaauaaaaaugaucauaagauauucagacaaacagaagagugagucgguccuuugguggaauaaagguaaauaaaaccggauccuuuuugcagauaaaaugcucaccuacuuguagcuuaguaccuucuuccaagaagucucauuggaggacuggaguaaucuaggugaacagaacucacaaaaugcaaguacuacauaccaaagagcuguuucuaauuuaucuuauuauauuuaaaaaggcuuggcuucacaagcaugucuucaaaaauaaaaauaaaauaaauuacauucaccaccaaaaaagcuugcauuuugaugcaaugccaaaaaaaauaacaagaaccacuaaaaccugcaaucaauguggaugggcaaauaaaaauggaagaaaaaaaaauacacacagccuguaauaguacauaagcacacaugcaggcauaagagaaaaaaagggucaaaagcaaauggauaaaggaaaccuuuagaaaggugucuugaguuuuuccauguagcagggucuguaguuaaagagaaacagcacagaauaaguuuagugcuuaucccuaaaauuuuaaaccuuauuaaaaauucaaaugugcagaaaccugaucacauuucaaaugcacauagcauucaauuauucaaaauuuacugacgaaaguaaaguuaguggcuaagaagaaaaauuaagaaucccacugcgcagugcaaaauacaacuagaauuagagggauguauauaauauuuuuaagucauagaaacaaagcauauugcuugccauaacuuauuuuuaacauuuuuaggaaacaaccuuuccaauauaauuaguuauaucuggcuugucugaagguaguuaucucaauugacuguucagucaguuacagauggaacuccuuguucuacucuuucccgccuuacuacugcacuugacuagucuaaaaaauaaaaauuaaauuuuuaaaauuaauaaaaaaguuaugugaccauuauuucuaauucugacacaaaugaagcacaauuaauucacuauucaaaaauuugggccaaguguggggcucacacuucuaaucucagcacuuugagaagccgaggcagacggaucaccugaggucaggaguucaagaccagccuggccaacauggcaaaaccccgucucuacuaaaaauacaaaaauuagcugggcguaguggcacacgccuguaaucccagcuacucaggaggcugaggcaggagaauugcuugaacccaggagguuucagugagcugagaucauugugccacugcacaccagccugggcaacagagcaagacucugccuuaaaaaaaaaaaaaaaaaaaaaaacuuugccugagauaucugauaaccuacuacaggaaaagauaaauugccugauuuuuaaaaaucuacaaaauauacuaaauacaucuuucaaaaccuuaaaaguugguaaguauaugcaaguauuugccccauuagcuaagacuggacuauauaaggguauuuuauuugaaacauacauuggauuuaauagaacacugcagaaaguuaacucuugaccuucguggacucaguccaaagggagacuacuacguguaucacagcacccuaugcagaaaaauuaauccuaucuuuuuccuuuaauucuaauguguaauuuuacugcuuuuuggggggcaacugauugcuuuuacaaauagguuacuuaaugaaauggggguaaaauuucaaauuauaccaagauuuuaagcauuauucuacgaaacauguauguuugcauuuuuuuuuuuuuuuuaagacggagucuugcucuguugcccaggcuggagugcaauggcucgaucucggcucacuacaaccuccgccucccggguucaagcgauucuccugccucagccucccgauuagcugggauuacaggcacccgccaccacaccuagcuuauuuuuguauuuuuaguagagaugggguuucaccacguuggccaggcuggucucgaacuccugaccucaggugauccacccgccucggccucccaaagugcuaggauuacaggcgugagccaccgcgcccggccuauguuugcauuuuuuaaaaagaaaacaaaaaacuuuugcuuuaguucaacaacuuuucuccccaaaauaaauuuuuuuuucacauuuuuuuucaaauuucuacugacacuguucagaaguaucauauauagcacaauuuuggccuuuaaucagcaugcuacuuuuggauuuugucucaaaggaaagcugaggaaagcuugauuuauuucuuacaaauauaugaaagauaaccguggaguucuguucaaacugaaccaccacucuacucuaaaacauaguuuaguauuguuuuuaauaaaaauuuaacagaaaauucuuuuacaugggcagaaguagggggcaagcugagaugaccauaaaucuacauacugacaccucaguuaucccacaguugacagaaugaagaauccuaugcuaaauaaauguccugaugauugaauuauacauauuaaacacuaaaauauuuuacuuuagccaguuuugaugaagcuacaucuaagauggauuauacuucuccaugucaucuuagaauguacuacucugaaucuacuauugguaaccuaggucuuugucauguaacuaagccuucacuggcuaaauaaaaucccuacacaaaauguuaguaacugauuucuuuuuuuuuuuuuuuuuugaaaguuuauguuucuucccuuucuccucucuuauuaucaggcugucagguaguucacacucuucuagcuaacuauauuguuuaucugcuucaugguuucuaauuuucucuggguuagaaugauuuaugauaugcuagaauuguuuauucuaaggauaaagaagcuuugaugaaaaacuaacgaacugucuaugcuagaauaaaacacgugaaaucuaguacucaaauuuauauaaucuauauuguguuugggguaguugaguugucauuuuaagcaaauauauauacaaaaucagcacuaagcuuggaaaaaaacaguagguaggcagauuuacugaccaaccacuaagaggagacaucaacaaaacauaguggacauaaaaacaaagagauaccaaagagcugacacuacgauagcugaaauguacacccuuuucuaacaagcacaauuuuaucuaaggaaacacugcccacaauucaaauaguuucugagagacaggauaucaugggcccucucaaggugacagaagaaaauggaaaguuaaaaaaaaaaaaaagagagagagagaaagaccuaauaucauauagugucuuaaggucuuaguuucagauguuugguaaauuugaugaaaucaguggggaugaaauuuuauaaguguuauucuauauauuugaaggugaaccccagauuaauccaacaugauuaaauucaagguucagaacuucaauaaguauuagagaaaugcaaagugaugaauaacauacccagaagcuaccuaauguaauuaaaaggcucccacauagccacuggcagucuaucuaaaaauauuacuugcaacaucuacaacuacacuaauuugcuucagugacuaacauucuagagucauagcagaugcucaugagguuuuuuuuccccauuaaaaaaaaaauucaagucaucaccaccaacagcuccuacaguaaaugaaaaaaucagacacagaaauuaaaauaaguucaauuuugucaaaacuaucaucccaucuuaaaucagaauaagaaguagaauaaaacugcauugaaaacagaucucugcagauaagaaacagauaugguacucugcugcaaaaguaauuuaauaauuagagcuauguuacagaguucuauaaauaagaaagucugagccaaauacugaacuaaauaggaagauuaaauacguuacucucauucaacauuucaaaccucauuaauauaaguauaauuaacauaggauacauauuugguaagcaacuuaaaaucugcugauagacacagcauucccuaauauauuuucaauuuaaucaaaaaagaacgguuauaaaggacaaugccuauuuucuucuuuuuuuuuuuuuuuuuuuuugagacggagucucacucugucgccuaggcuggagugcaguggcgugaucucagcucacugcaaccucugccuccuggguucaagugauucuucugccucagccuccugaguagcugggacuacaggcaagugccaccaaaucuggcuaauuuuuguauuuuuagcagagacgggguuucaccauauuggccaggcuggucucgaacuucugaccucgugauccacccgccuugugaucagcacuuugggaggccaaggcgggcggauggcuugaggucaggaguucgagaccagccuggccaacaaagugaaacccugucucuucuaaaaauacaaaaauuagcugggcaugguggggggcgccuguaaucccagcuacuuggcaggcugaggcaggagaauugcuugaacccaguagguggagguugcagugagccaagaucauaccacugcacuccagccugggcgacagaguaagaccuccgucucaaaaacaaaacaaaacaaaaacuacucuuuuuuuuacauuaagaaagaugcauacuacuucucacaggacuucuaacuaugcuacagucacuaauuucuaauuaucuaaucaauucauaucuuuuuaagaauagaucaaaaaugaagagcuguaaaauaauuaucucaaaucugaaauuuaccauuuucuucuccuguuguuuuccguuuaucuucuugugaaacauggaccaguugcagaaugagaggucuccgggugacaauuccaguaccucugggaagcaggucccuccccaccaggcuuucuagcacugagcucuuuccgcugcucugaaaacagaauauauacaagagcaaaaugaguuucuuaacacauuuuuuguuaauucaauaaacuauauuaacaaaccagcauacagaauuauuuuaaaggaaaaauuagugcagagacuauuuuuuuuuuuuuuugagacggaguuucgcucuuguuggcuaggcuggagugcaauggcacgaucucggcucacugcaaccuccgccucccggguucaagcgauucuccugccucaaccucccaaguagcugggauuacaggcgugugccaccacgccuggcuaauuuuuuguauuuuuaguagagacgggguuucuccauguugauuaggcuggucucgaacucccgaccucaggugauccaccugccucagccucccagugcugggauuacagguguaagccaccaugcccggccacagacuuuuuaaaugaaagauaauuuuauuuccuauuacaugaucuauuuguuuuuaagccaaaaccagaaaauaacagcccuguuuucccauaauuaucccaccuguuuugauacuccaccaaccagguuucaaaaccuacacaauauugguauauauaaaaucaugccuauaauauguaguuguuuuacuguaaaugggacaguaaugcauaucuuuuucucuaaccuucuauuuuuauuauuauuauuacagugugucacucuauuacccaggcuagagugcaguggugugaucacagcuuauugcagccuugaccuccccaggauccggugauccucccacaucagccuucccaguagcugagacuacaggcacgcgcuacuauaccuggcuaauuuuuguauuuuguaaagguggggcuuugccauguugccuaggcuugucucaaacuccugggcucaagcaauccucccaccucagucucccaagugcugggauuacaggcaugaaccacugcuccuggccuaaccugcuuuuauuuuuaauguaauaaucagggauauuguuccauaucaauacauuaacuacuucuguguuaaucccagcacuuugggaggcugaggcgggcagaucaucugaggucaggaguucgagaccagccuggccaacauggcaaaacccugucucuacuaaaaauacaaaaauuagcugggugugguggcacgcgccuguaaucccagcuacucaggaggcugaggcaggagaauugcuugaacccgggagguggagguugcaguaagccgaggucacaccacuacacuccagccugggcauagagcaagacuccuucucaaaaaaaagaaauagcuaaaacaguauucuacuauguauaaaaccaaacccgaacugauaagcauuuagaugguuuuugguuuuugcuguuuuuaacaaugcugcaaugaaugugcuuauacauauaaccuuacucacuuaucuuauuaccucacuagauuuaguucauuuaaguuaaauugccguuauuaaugagcauacagauuuuaagcauucauagauacugccagacugcaaagaagagggaaucaagcuauacuuccaagaguuaccaguuuguucaauuugcuacagcuccaucaguauuaaacaucauugcuuuuuuuuuuuuuuuuuuuuuuugagauggagucuugcucugucgcccaggcugcuggagugcaguggcaccaucuuggcucucugcaaccucuaccucccagguucaagcaguucuccugccucagccucccaaguagcugagauuacaggcgugugacaccacgcccagcgguuuuguauuuuuaguagagacaggguuucaccaugugcgccaggcugguuucaaacuccugaccucaagugauccgcccgccucagccucccaaagcauuguuuuuugaaucuuugcuacuuugauagauggauaccgacagcucauuuaaauuuacauuccuuuauuauuaaggucaagcauccuuuucuuuaauggcuuucuguauuucuccuuuagugaucugcuuauucaaaugcuagccuuuuauauauuucuuauuaguuuauaauaaaguucuuuauccauaauaaguauuucaauuuuuguuguuuuaaauauuuuccaacuuuuuauuuugaaauuuucaaugccacaaaaaaaguugcaagaacgguaacagugaauacucauauaucuuaacauaauucaccacuuauuaacauuuugacacauuuacuuuaugucucucucuccuuacauguacacacaaagacuuuuuuccuuuugcugucccauuugagaguuaguuacagaaaucaugauacuccacucuaaacauuguggcaugcaucuccuaagaacaaggccguucuucuauagaaccacaauacaaugaucacauucaggauuuuuuuuuuuuuuaagagauggggucucauucuaccauucaggcuggagugcaauggcgugaucauagcucacugcagccucuaacuucuggccucaagagacccucaggccaccucugccucccgaguagcuaggauuccaggagccagccaccacaccacuuacauucaggaaauuuaacauacauacaauaccaauauccaauuacuaaauaaucaaaaauaucaauacuaacagcuaaugcgauaaauaaucaaguacuauauaaaccucuauuauacauuuuaaaaauuucuaaauuugccauuuuucuuaaguuugcaauaaacuuauuuuucuauacaguauauucuguacucuauuuuuuucuuagucaaaacuuguacuuuaaaaauuuauuuucuacaaaugcaaaaguccuaauuucaucaguuaugucagacagggucugcaggaagcagauggcccacucaaauuagauuaauuuaaagaggguuuauuuacauaaggacuauuuacaaagcugugggugaggcuuauaggaaaucacaagggauaaugcaguaacccaggcuaguaacaagagaacagcucucaucaccccgaagccuaaaaggaaggaccaggaggacuaagagugacacagccagccagcccaaggcuccuacauacagaauguaugagaugggggaaucaagaccgggacuuuuuuucuccucuuuccuccaauucccugccagggcuccucauuuccacauccaaaucagaagacagacgacauaggggcucauucauguuguccagaaagguccccuaugauggaaaacacaaaugcugaauggaucuggagaguuaaauugaggaauauaagacaugucugcgaaacugcaguugugauauccaggguagccccucucauuaaguaaaacagggugcuuuccaucauuucauuccuguacucugauacuguacucugaaauaauuuuaacaacauauagacauuuccaguucuuuauaugucugacaaaauguguccauaaaaaaaaaaaaucaaauucucugauuuucaaauuuauaggcauaacuacucauaauauucuuagaauguucauuuuucuuauuucuaauauuuuacguucuuuuuuuaugagacuuuccaaaugacuauuaaauugauuuuauuggccaaauauuuugcugauuuugcuuuguaauugauuuuuuuuaauauugcuaauuucuucuuccugggauuuuuuuuucuccuggugaaaggaggguuuaucuguucuuuaaaaaagcuccuugaguugaaacauuagcuuuuuucucuauuucagcuaccaacacuugcaacccucacccaccccuaacauaaacauacauuccucuaaucagucaucucuaucuucuuucuuccacaccaagagcugugguucucaaugacaguuugugacagaauuagaauaacacaauuacuuguuugcuuuuuauuucauguuacacacagauucucaaaauaauaacaccaauacuaccaccacgaacauuauuacugaaaguaguuuuuuaaauguuuugcauauaaucccuccauucuccuucccaccccuuuacagaucauaucuucuuucaaacccucauuuggucuuaguuacguguaauacaaaucaccagucuuuaaugugucucuagucauucugauucugacacccauucucuaguagauuccccaggaagggcuaaugggaaaaauauucuucaaauucuagcauauuguuugugacuuuuauuuuuuauauuuuuuuagagagucucgcucuaucaccuaggcuggagugcaauggcauaaucguggcucacugcagccuccaucucacugguucaagcgacucucuugccucagccucccaaguagcugggauuacagguacaugccaccacaccuggcuaauuuuuguauuuuuaguagagacgggguuucaccguguuggccaggcuggucucaaacuccugaccucaaagugauccgcccaccuuggccucccuacugucauaggagaaaggagacaaugaaauuccauauuuaagauaagaaaguguacaccagcccgguugugguggcucacgccuguaaucccagcacuuugggaggccgaggugggcagaucacuugaggucgggaguuugagaccagccuggccaacauggugaaaccccaucucuacuaaaaauacaaaaauuagccgggcgugguggcagaugccugcaaucccagcuacucaggaggcugagguaggauaaucacuugaacccgggaggcggagguugcagugagccgagaucacgccauugcacgccauuggacaacaauaacaaaccugucuuuaaaaaaaaaagacaguaaucugauuauuuuucuuuuuuuuuuuuagagacacugucuagcucuguugcccaggcuggagugcaguggugcaaucacagcucacugcagccuccaauuccugggcucaauagauucuccucucagccuuccaaguaacuuggacuacaagcucacaccaccacacccagcgugugcaugcaugcguguguagacagggucucacuauauuguguguguguguguguguguguguguguguguuuguguguguguguagacagggucucacuauauugcccaggcuggucucaaacuccugggcucaagcgauacccccaccuuggccucccaaaaguguugggacuacagguaugagcuaccacaccuggcccugauuuuccuuuacuuauaaagguaagagacuuugugacuucugccuguaugucugaggauuuuuauuuuuccuuuaaaguccaauaauuuuucuagacuaugucucaguauuggucuaccgugucacuuucuuagguaugugcuguacucuuccaaaauuuaguuccccaucuacuuuuauuucauuaaaauugucuuguauuguaauuuuuaguacccauucuguucccuugcuauaguuuucuucuuuggggacaccuaauauacauauguuggauuuucuuuacuuguuuccaacgugucaauuucuacaaaauucuuuuuacaucucuuuauuuuuaaugucuuucuccuuuucagcuucuuucccucauaagguauuaucuguuacguuuacuugcucuuguguuccuucuaauuugucuucauuucuaaaauaaauuuuguuucauuucauucauucauucacuuaauuuauccaagacaaggucucacucuguugcccaggcuggugugcgguggcaccagcacaguccacugcagccucaaccuucccaggcucaggugauccucccaccucacccucccgaguagcugggacuacacgcauacaccaucacauccagcuaauuuuucuauuuuuuguagagacaggguuuccccauguugcccaggcuggucucaaauuccuggacucaagcgaauccuccugccucagccuccuaaagugcugggauuacaggugugagccaccauguccagccauuuucuuuuauuuauaauacuucacuaucacuuaauuuuuuaauuuuucuuaugcaaauuaauuuuugaaaugucuuaucauuguagugucuucugucuugccuuuugucuuaauaucucacaguuuuuguuuguuuucuaaguaugucuuucuggugugcuuucauuuccuugucuaaggggucuuguuuuucuucaaaaauuugcaugacauuugacaacaaucauuucauacuguugacuuuugaaagaggcuuggcucugaauagcuacucugccuuuauacucuaaaaaucccucuuguuguuuucauauaguauucaaaaauauaguuucuugcuuucugagguaucuuggcccuguuuaccuccccugcuuuuaucuggaccuucucuuuccuuggucuguauucuucagaggauacucaauuguauccucgguuccuucuucuugugaggagugggccuggaagggagcuuugguuaguuuuuaaaguuucaugaaggagcgcuagucccuucagacuuuacaacugaucccuuucacucacccauuaucgaugugugcaauacccuucccaaauucccauuucagcugguauucuaaaaucggcccuuuaaaaagcuuuccagugauugccuuuggguuauuuacaauucuccgcuccaucagaaguuccacugcuuccuucugcuucuuccaguauggauaacaaugguuuguucccaaucugcugguauuugagcguuuguagagaaacauagucaacuaauuuucuuguacacauuuucuauguguuuuugguuuuccuauccuauuuguucuguuuuaggggaaagucauauagauauuuaggaaacuauucuaccacugcugucaucuucccaggaucccuaauauggauauuuaauccacuagagguaucaagacuaauguuuagucuuauaaaaguuauuuuauacuucagucauaaaaaggaauaagguaccgaugcacgcuccaacauggaugaaucuaaaaacauuauucugcuaaguuaaaguuagucagucacaaaagaccacauauuauuugacccuguuuauaugaaauguccaaaauauggccgggcgcgguggcucacgccuguaaucccagcacuuugggaggccaaggcaggcggaucacaaggucaggaguucgagaccaaccuggccaacauggugaaaccccaucucaacuaaaaauacaaaaauuacacgggcaagguggcacgcaccuguagucccagcuacucaggauaggcugaggcagcagaacugcuugaacccaggaggcggagguuguagugagccaagacugugccacugcacuccagccugggcaacagggcgagacuccaucucaaaaaaagagaaauguccaaaauaggcaaaucuauagcuagaaaguagauuauguggcuguuuagggacagagugaagaagaauggggagugacuacuaauggauaccagguuucuuucuagaaugaugguauauucuaaaauuaguuuaaaggugauggaaaggccaggcgagguggcacaugccuguaaccccagcaaugugggaggccaagguaggcagaucacuugaggccaaggaguucaagaccauccugggcaacauggugaaaccucaucuuuacaaaaaauaaaaaaauuagccaggcaagguugcacaugccuguaguaccagcugcucgggaggcuuagacagauggaucacuugagcccaggggauugaggcugcagugagccauggucaugccacugcacuccagccugggcaagagagugagacccugucuuaaaaagaaaagaaaaaagaaaaguuuaaggugaugguugugcgacucuauaaauaugcuaaaaaaaacacugaauuacacauuguaaauggguauguuaugguauagaguguaucucaguaaagcuguuaaaaaacaaaauaaaggagaaugacuucuuaaacaauauacaaaauguacaaaaccacagaagaaaagauaauucaaccacaauaaaauuaaaacuucuuuuccucacagaaaaaauucagggaaaacauuugugauccauaaguaacugguaaccaaaauguauaaauaacucccacaaaucaaauucuuaaaaauaccuaacaaaauaaugugcagagauaucaacaaaaacucacaaaacaaaaccucaaagagccaagaaacaugauaagaugcucacacucacuaguaaucaggaggaugcaauagaaaccacaaugagguaccauaaauuuaaaaugugacuauagaaaguacagauauaaauaaacuucacucuguugaugggaauguaaauuacagccauccugagaagcaauagcaauauccaauaaauauacccuacagucuggcaauuccacuccuugauucguuagagaaauucucaaacaugagacauuuauaugaauauccgcaguaccacuguuuacaaaaacagcuauagcaaacacuggggaacacacaaauuucaacaggauauauuccuauaauggaccauuauauagcaguauaagugaacaaacugggauuauauguguguauauaaauaaauuucacaugacuguguaaaaacauauauacagauuacagcuacuuugugacugauagugaguggaacuuccaccugauauaucccuauuauacuaugaaaauguacaaauaccugaaauguaaaaaugagccuaauguuaagauggauaggaaggacacugugacuaguucuguguggaguuugguagcacugugauucauuugaugcuucuagaaaccacaaaaaacuauacauuggagaaauuauggacucuguguucuuaugaugacuaguuaguucugaagcaccuggacauuaucugaagacuucauucuuggaauagaagaugacauuucaucccugacuccaguggaguucaagugugaauaaaaugauaugaacugcuuuugucauuucagaauuagacugagucacuucuuggaaaauauagcuccuaaaccccaguuuaggugcuguuaaaauaaguaucaucuaccucacggguacucauggugacugacucuuggagacucuagaaugcaccaaaacaaacaaacaaacaaacaaauuccagacauucaaacuaaaacuuuuaacauguugucgcuauuccugagaucccagcaggacuuccuggagccugugcuuaacuugaucucucugcuuagauuuuaauuaauuuugcuuaaauguaaaucuuauucuauagaauggaaugagcaaaauuuuaaauaauuaaaauauauaucaccacccaaaaagaaaaaaagagaaaaugguuauaguaugaaugaauacagaauuuuauaaucacaauuucccuaagaacucuauuaaacauuucuccaugcaguaacauuuacugugacagauuggaaucuaaugccagucugauucucuuucccguuuaagaaagcuuuuuuuuuuccucccuccuauuucaauuuagaagcuuguaguauucuuuuaauuucagaaauuuaaccaggguaugucucuucucucaauauuuaugugcagcaauugagaccugaagaugucguacuucagcucuggggaacuuuugucuuuuaucuguuaggauuaucguuucucuccucaucugcuccaagugcucuuaaucaaucaucuaugaucaggcuuuuggcucucuuagcacucaccuucaaucucuuaucucuaauaaauuccguaacauauguuuuugaucugccuuuuuaggacagguuguaacagacuuaauugugucuucccaaaauuuauauguugaagcccuaacccccaguaccucggaaugugacuauauuugcagacagggccuuuaaagaggcgauuaaguuaaaacaaguccagccgggcacgguggcucauaccuguaaucccagcacuucaggaggccaaggcggguggaucacgaggucaagagauugagaccauccuggccaacauggugaaaacccaaccccgucucuacuaaaaauacaaaaauuagcugggugugguggcacgugccuauagucccagcuacuugggaggcugaggcaggagaaucgcuugaaccagggaggcagagguuacagugagccgagaucgcgccucugcacuccagccuggcgacagagcgagacuccaucuaaaaaaaacaaggcuacuggggugcugggcccauaauccaaacugacugacauucuuacaagaagaggaaauuuagacacagagacaccacggacacagcaagaaggcagccaucuacgagccaaggaaaaaggccucaaaagaaaccaaaccugcugacacuuugaucuuggacuucuagccuccagaacugugagaaaauaaacuucugcuuuuuaagcuacccagucugugacauuuuguuauggcagcccuagcaaacuaauacagaaguuacaaacucaacugcgcacacaugcaaugaauaaaaucaauccagacuuuggucaaaaugacaucagaaugucaaccauacuucaguaaagugauuuuuuuaaugccaucagauuguauucugacauuuuguacaugaaaauaagaacauuucuauacaucugccccaaaaugcucauuuuucuuaaaauguacagccauuuuaaucaguaguaauggcuaacauuaaucgaacauacuacauugcuacuaccauuccaagugauuuaccucauuuaagucuaacaacucuaugagaugguuacuauuuaauucucacuuuauauaugaguuagcugaguuuuagaaaaauuauguaacuugcccagauauaauuagguaacaaguaacagggaugaauuauaacccaguagucuucaacuuucccacuuuugaugcagauguagaaguaggaaauauuucauugcuuauuuuacacuauaaagaaagacagcacauauaugaugauaacuggcaaccagggaaggcaacugggagcaauaggagcuguggcuaacuagauauuaacugacccaccuaaagcaggcauuauucaaauccacugggaauauggguuaaggguuaucagauuuucugauuuuuuuaaggcaaaaccagaaaucugggccuuucaacuaaaucuaccaauuuuuaaacauuggcaacuaauucauuuauuuuuaauacuguaugugucaacacacacagacuaaaugaaacacaucugugggcucccaauguuuuaccucucaucuagauucacuacuauaaaugguacuggcuucuucaacaauugguucuaucagugcuuuuucccccaccuggugauuuaaacaucccaugucuggguucuucccagaaagucgaguagcuacaagaguucuaaaguggcaaaaaucacagcuagcuuguucugaaaaucgggcuccacuggcacuacaaggccuucagauuuuuuucuccacaaacucccaaagcugauucaauaaccuguauuauauuuacgagcuaaagauuugugugccuggucucagugucaucuuuuaguuuuaguuucuuccaaacugcacuguauugggauuuuuaguguuuugaauuuauauuuugaaauguggccuuucauggaaaagguuuuguuguauuuucagcucuucccuaauaaucagcaucaguugggguugaggaguuaauaauguucauucauaccacauuaaccaaagcugaucccuuauucaacuucuaaguuuuaauuuuucauuguguaaggcagaccucucaauucuuuauuuugauauuaauauaguaaacauauaugucucaauauuuuacuuuuuauuuugaaauaauuuuagauuuacagaagguuuccuuauauauuugcuucacuuauuuaaauaaaauauuucuaagaguguccuuagaaauguuaaucuuaugguauuuaaaacagcuaaacuacgccgggcccaguggcucaugccuguaaucccagcacuuugggagggugaggcgggcagaucaccugagguugagaccagacugacuaacauggagaaaccuugucucuacuaaaaauacaaaauuagccaggcgugguggcgcaugccuguaaucccagcuacucgggaagcugagacaguagaaucacuugaacucaggaggcagaaguugcagucagccaggaucacgccauugcaauccagccugggcaacgagagcgaaacucugccucaaaaauaaaauaaaauaaaauagcuaaacuacaauguuucuaccauauagcucaaacccucuaccuaaugacaaaauauaaauaugaaguuuaaaccacuucauaauuuguaguuaauaugugggguguuuuuuguucuuaagagaccaggucucacuauguugcuuaggcuggagugcagcagcuauucacagcacaaucacagugaacuacagcccucaaccuccugggcucaagcagccuugccaccaggucucccaaguaaaagggacuacaggcacaggccaccacacuuggcuuaaaagaguguucuuauaugaacuuaauacccaaaauccaaacuuucuaaaauacugcagaccuaacaguccuuaggaaggaauuuuuucuugguuauaaaacuauagguccagugcuuucuagaucacuaagagagagauucagauaucugauaaggcagaauuaucgucugugaaaauccccacuucuuccauaaaagcaugaaaaagugauaugaaucuacacauccaagaagcucgaugaacucaaagcaggauaaacacaaagaaauacacacauugagauaaauuauaaucaaacuguugaaagacaaagacaaaugcuaaaagcagcaagagagaagcuaagagucaugaacaagggauccucaguaagacuaacaacagauacaacagacuucucaucagaaaccauaggggccacagcagcucugccuauggaguagccauucuuuuauuccuuuacuuuaauaaacuuguuuucaaagaaagaaaagagaaaagaaaccauaggagccagaggcaguaagauaaagugcuaaaagaaaaaaccuccccaucaaaaauucuaacuuaaaaugguuaagaugccaauaaaaccugaagcaaccuauagaggcaacacaauccccaucaaaaucccaacugucuuguuuacagaaauggagaagccaaaucuaaaauucauacggggcccacacaguggcucacgccuguaaucccagcauuuugggaggccaaggugggcagaucaccugagguuaggaguuugagaucaaucuugccaacguggugaaaccccaucucuacuaaaaaaacaaauauuagccaggcaugguggugggcaccuguaaucucagcuacuugcagccugaggugguuggaucgcuugaacccaggaggcagaggcugcaagugaaacgagaucacgccacugcacuccagccugggcgacagaguaagacuaccucucaaaauaaaauaauauaaaauaaaauucauauugaaugacaagggaccccaaacaaccaaaacaauuuugaaaaagaaaaacaaugcugguaaaguuacacuucucaaauuuuaaauauacuccaaagcuacaguaaucaaagcagaauagaacugagaauccagaaauaaacccauauaauaaaucuuuggcuggccaggcaugguggcucaugccuguauucccagcacuuugggaggccgagguggauggaucaccugaggucaggaguucaagaccagccuggccaacauggcaaaaccccguaucuacuaaaaaaaaauaccaaaaaaaauagcccggcgugauggcaggugacuguagucucagcuacuugggaggaugaggcagaagaaucgcuugaacucaggagguggaggcuguagugacccaagacugcaucauugcacuccagccugggugacagagugagacccugucucaacaacaacaacaaaaucuuugcucaacugauuuucaacaaugccaagacuauucaauggggaaagaacagucucuccaacaaaugguacuaggucaacuggagaagcacgugcaaaaaaaaugaaaugaaccccuaccucauaccauaccaagauguacucaaaauggaucaaaagccuaaauauacaagccaaaacuauaaaauaauuaggggaaaaaacauuaaaaaauaaaaaaaaaucuucacggcuuuggauuugucaaugccuuagauaugacaccauaaagcaauaaaaggaaaaaaaaagauaaauuagccuuaaccaaaaguaaaaccuuuuguguauugaaggacacuaacaaggaagcaaaaagacaaggccgggugugguggcucaugccuauaaugccagcacuuugggaggccaaggcaggcggaucaccugaggucaggaguucaagaccagccuggccaccugggcaacagagcgagacuccaucucaaaaaaaaaaaaaaaaaaagaaaaaaaagaacucuuacaaccucaacaauaagacaaccccaacaaacacaugaaaagauguucaacaccauuagucauuagggaaaugcaaaacaaaacuucacacccauuaggaugacuauaaucaaaaacagauaauaacaaauguugacaaagauacagaaaaacugcacccuucaaacauugcuggugggaauuuuaaaaugguguagcugcuguggaaaagugguugcucaaaaaguuaaacaaaauuaccauagaacccaguaauuuuacuccuagguauauaccaaaauaacugauaacagguacucaaauacuuguacaccaauauucacagcagcacuauucacaacagcuaaaaggcagaaacaacccaauugcucaucaauaggugauugaauaaaccaaugugguuuauacauauaacagaauauuacucagccauuaaauggaaaagaaagaagagggagugacagcucaauaguaguuuucuuucgugaugaaauuguuuuggaccuagacagagaugucauuaugaaugcacuaaaugacacugaauuauacauuuuauaaaagggcuaauuuuggcugggcacaguggcucacaccuguaaucccagcacuuugggaggucgagguggacggaucaccugaggucaugaguuugagacuagccugaccaacauggagaaacccugucucuacuaaaaauacaaaauuagccaggcauggcacaugcuuguaaucccagcuacuugagaggcugaggcaggagaaucacuugaacccgggagguggagguugcugugagccgagaucgcgccauugcacuccagccugggcaacaagagcaaaacuccaucucaaaaaaaaaaaaaaaaaaaaaaggcuaauuuuauguucugcaaauuucaccucaauuuuguuaaguuaaaaaaaagcagcagcucauaaucuauacaaaaaaagagaaaaacauaaauuuaucuaagaacacaagaaaacaaugcauaagcaggaauuaaauuauagucaauaaaugcuaaaauguagacagcagugcucauggagaaaaaaaagagagagggacaucaaacuaugaaaaaaguuguccauaagagaaggaaauggcauaggugucaaaaagugcuguuuuucaaauaaagaauuccagaaugauuuagcgcuuaaaaaaaaaagauaacaacaaguguugauaaggaugugcagaaaccugaacccuggaggggaugugaaauggugcagccacggcugggcgcagcagcucacgccuguaaucccagcacuuugggaggccgagguggguggaucauuugaggucaggaguucgagaccagccugaccaauauaaggaaacccucgccucuacuaaaaauacaaaaaguagccgggcaguaguggcgggcaccuguaaucccagcuacucaggaugcugaagcaggagaacgccuugagccugggaggcagagguugcgguaagccaagauagcgccacagcacuccagucugggcgagaaagugagacccugucucaaaaaaaaaaaaaaaaaaaggugcagccacuauggaaaacacuuugguaguuuuucagaaaguuaaacguaagaauuaucauaugaaucagcaagucuacgcuuagauauauacccaagagaaucaaaaauacacauucacugaccgggcgcgguggcucacgccuguaaucccagcacuuugggaggccgaggcggguggaucacgaggugaggagaucgagaccauccuggcuaacacggugaaacccugucucuacuaaaaacaaaaaauuagcugggcgugguagcgggcaccugcagucccagcuacucgggaggcugaggcaggagaacggcguaaacccgggaggcggagcuugcggugagccaagaucacgccacugcauuccagccugugugacagagcgagacuccaucucaaaaaaaaaaaaaaaauacacauucacacaaaaacuuguaaacgaauguucgcagagcauuauuuauucauaauagccaaaaaauagaaacaacccaaaaauucaucaauugaugaauaaacugugcuguaucuauacaauguaauauuuauuauucugccaugcuacauaauggaugaaccuaaaaaacauuauguugaguggcucaugccuauaaucccagcacuuugggaagcugaggcaggcagaucacuugaggucaggaguucgagaccagccuggccaacauggcaaaaccucgucucuacuaaaaauacaaaaaaauuagcugggugcgguagcacgcgccuguaauccgggcugaggcagaagaaucaccugaacccggaaggugaaggguugcagugagcugagauugugccauugcacuccagccugagcaacagagcaaaacucugucucaaaaaagaaaaaaaaaaagaauuauguugagcaacagaugccuggcacaaaagaucaaaucacauauuauaggauuccacuaaugugaaauaucccaaauaggcaaauccauacagacaaaaaguagauuagugguugccagugauaccugcuuuuuccaguaucaugcauuuuaaaauccaaugauucacuaauauauuuuucaaauuaggaucuaggaaccaucuguaucagagucaccgauggacccucacccacguggggcuuauaaaaucaaaaccugucagaagcugggggaggacaaaacgggggugacugcuuaugggcaggaguuuucuuuuucagguaaugaaaauauuuuggaauuacacuauggugguacaacuuugugaacauacuaaacgcugcugaguuguguauacuuuauaagggugaauuuuguguuacaugaauauuucaguauuuuuaauguuaaauuuuuaaaaguugauuugcaaauuagaaauuaaaauccaaauuacuggccgggcaugguggcucauaccuguuaucccagcaggaggcugaggcaggcagaucauuugaggucaggaguuugagaccagucuggccaacguuguaaaaugcugucucuacuaaaaauacaaaaauuaggccgagcacaguggcucaugucuguaauuccagcacuuugggaggccaaggcaaguggaucaugaggucaggaguucgagaccagccugaccaacacagugaaaccccaucucuacuaaaaauacaaaaauuagcugggcgugguggcaugcaccuguaaucccagcuacucaggaggcugaggcaggagaaucacuugaacucgggaagcggagguugcagugaguugagaucgcaccacugcacuccagccuggacaacagagcaagacuccaucucuaaaaaaauaaauaauaaaauaaaauaaaauccaaauuauuuuuaggcuaggugcaguggcucacaccuauacuccuagcacuuugggaggccaaggcaagaggaucauuugagcccaggaguuugagaccagccuuggcaacauaguaaggcagcgauuuuaaauuuaaaaaaaaaaauuagccagaugcgugccuguagucccagcuacucaggaggcugaggcaagaggacugcuugagcccaggaauuugagguuacagugagcuauggauuaugccacugcacuccagccugggugaaagagccagacccuaaaaaaauaaaaauaaaaaauccaaauuguuuuuccuuuuacauuugucugaauuacugaagauagaaugcugaaaucacugaaauaaaaggaaaaguguaaaguacauuacuaggaacacuaagccagagucucagguuaaugucaucuguauucggauaccuauauugggugguaguuuagauuacauaccuggagggcuccccuuuccaauucuuaauuuaagaaauaggauuaaauuucccaaguugagucacaaaaguuguuuuaagucuuaucuccucuacuugcaaaguuacaccauggucuaaaaguaucaucagccuucucucucuccccacugugucuguucauuucacacagauggucucuacuagaaaaaauaaaagcaauuuauuuagcuaacacauaaaacaugugaaugacugauagcuguaaacaggauucccucaccuccacuccuccaagucccuagcccccaaaugaguguuacuugggcauuucauaaaaccaaaguuuaaaacauuuaggggucagcaaugguugccugggaagugauauauuaaagcaagaaugccaccaaagucagcaugguacuggaugguaguaugccauagauucaaccuccccuaauuuuccugcuuuuuccaguaucaugcauuuuaaaauccaaugauucacuaauauguuuuucaaauuaggaucuaggaaccaucuguaucagaaucaccuauggucccucacccaacccaggcuuauaaaaucaaaaucucuggagacaggauccaggaaacuuaguuucaaagugauucuuaggccaggcggggugguucacaccuguaaucccagcacuuugggaggccgagacggguggaucaccugaggucgggaguuggauaccagccugaccaacauggagaaacucugucucuacuaaaaauacaaaauuagccgggcgugguggugcaugccuguaaucccagcuaugugggaggcugaggcaggagaaucacuugaagccgggaggcagagguugcagugaaccaagaucauggcacugcacucuagccugggcaacaagagcgaaacucggucucaaaaaaaaaaaaccaaagugauucuuaauacacacucaagucugagaaucacuguuccaaaaaguucaacaagauagaaacugaagccauuuaagguauggauaauauguaggauagagacuacacuugaaguuguuuuuuaauuuuuuuuuggaagaaucagggucucacucugucgcccaggcuggagugccaucgcagaaucauagcucacugcagccucaaacuccuggacucaggcaaucuucccaaguagcugggacuaccggcacacacuacacaccauagcaccuggcuaauuuauaccuguauucugaagacacaauuacugccgauagguauacuaggcagaacuaaguacagaacacuuauaugucuggaacucacucacuacaauuacuucauuaaauauaaaugugagguauacauauauguuacacaacaccaaagaguaaaaauggcagacaucacaaaguaaugguauacuaguauucaaaccaagaagagauucuuguuuccccaacacacuacaaaaaaggcgggggcgggggggcgguguggggagaaaauaggggcggggggggcgguguggggagaaaauaguuucuauucucucucuuucugcuggggugcagugacaugcacuccugcacgcaccacagccucaaccucccaggcucaggugauccucccaccucagccugcagaguagcugggacuacagguucgcaccaccaugcccagcuaauuuucguauuuuucguaaagauggaguuuccccacguugcccaggcuggucuugaacuccuggaaucaagugaucugccuaccucggauaauuucuauucuguauuucuucuguacuugaguaaaagacugauuaucagcuaauaagaacuuagauggaaauaacccucauuaaaucaaguagaaaaacugaccucuugagaaauuucaaacaccaacaugcaaauauagcauauaacugucaguacuaggaugguuuuugcacauguuaauggcuuucagaaggaugggaucuuuacuuuucucuccugccacucuguauuuugccaacagguuuacugaccaaaauaaacucuauuuuguguaaaaagaaaaaaacaacuuauugauuuuaaacuauuuaugcugacacacuauaucccuaauucuuuuacuuccucaugcuuaaaaagcacugagacucucuuuuaaaaguauguggaaaguuucuagugugcagcuagaagacacuucugaaucacuuacuaucaaagacuuaauuuauauuaucucuaacuuuuuacaaaaacagguuaguuuugaugauaaaagucccaguguuuuaaaacauugugguuagagugagcaauauuuacucaaaauauuuacagagcacuuacuauaugucccagacugaacaaaauuauguucaauaaaaaauaauccucguaauuuguuugaugcuucugagucuccaaacauuacaaauauuguuacaaauacuagaauacguaggcaagauugagcagaaucuuucccaauccuaucgcagaccaaggaaauguguuucuaaaacaauuucuauugcuucaacuauuuaaaagccaaaaaaacaaacaaacaaacaaacgaguacagggugucuauaguuuccaguguuuggauagccacuaauacuuugaacaguaaguuccuucugauagcacuuauacccuauacuauguaccuccuggaaaaugauggggaaaccgcuccuucucaauagaaaagauacuauuaagaaaugaaagcacuuaauaucaauauacuaauuucuaaaauccguuucucugaacucuaaucgaaguagcagagaaaaggaaaauuauacuucuccucugucacucuagaaauaacaguuauuuugccaacauuucugcauucaaaaaaaaaugaguuagcuaugagaagaccagagaaacugaugcccaauuuaggucacgaucacaaaacuguggaagacaaaaagcacagccuacgcagaaaaaucggauauuccuucccaacacccgcagaacucuagauacacguuuuguuuuucuuuuuuuaaaaugcugcuucggcguucucgaaaccugguggaauuauacugcaggaaaacacuggcgcucacgcaccguagcgucucucagccucaacagagcgauuccaaaacuaacuccgcagucccugggcaaggcaaggagggaaauaaaacacccgucucacgaaagccaacagugaugggaacagccagcccaccgagcccagcgagacccgagugccccgcgcgucccccaggugcccuuggaggcagcggcacgcggacgaggccgcgcccggucccagcggacuccaguuccgcccgccggccccauccuucccucuccuguccccgggacccgccgggcuagccaggcccgccgcgccggcuccgccccuggccgggccccggauucuccgccuugaugcaacgcugccccgggagggcgggugcggcagagcccggagagcccuggggcccccagcaaggcccuccucccacaggccccaaaggcuggcgcgggagugggcgcuggcgcgggagugggcacugccgcagcaccgaccaggccugcggccggggucuggcccgagcgaacgccgccugcugcucucaccugcguucccacuacgacgauuugaggcagcuggaugaugucggcgcccaccguguugaagacguccuggagcuuguuuaugacaggaauuagcgccuccaugacucugaaaacacggggccccagugcccgccggccacggcaaugaauggggccggggcccacaguucgccuccuuccuccucuccuccgcccucuccucggaagccggcacccauuggaccgggcccgccggcuaccugcccccucccggcaggccaugc

SEQ ID NO: 192607 - RNA, 66448 nt, Homo sapiens
gcauggccugccgggagggggcagguagccggcgggcccgguccaaugggugccggcuuccgaggagagggcggaggagaggaggaaggaggcgaacugugggccccggccccauucauugccguggccggcgggcacuggggccccguguuuucagagucauggaggcgcuaauuccugucauaaacaagcuccaggacgucuucaacacggugggcgccgacaucauccagcugccucaaaucgucguagugggaacgcaggugagagcagcaggcggcguucgcucgggccagaccccggccgcaggccuggucggugcugcggcagugcccacucccgcgccagcgcccacucccgcgccagccuuuggggccugugggaggagggccuugcugggggccccagggcucuccgggcucugccgcacccgcccucccggggcagcguugcaucaaggcggagaauccggggcccggccaggggcggagccggcgcggcgggccuggcuagcccggcgggucccggggacaggagagggaaggauggggccggcgggcggaacuggaguccgcugggaccgggcgcggccucguccgcgugccgcugccuccaagggcaccugggggacgcgcggggcacucgggucucgcugggcucggugggcuggcuguucccaucacuguuggcuuucgugagacggguguuuuauuucccuccuugccuugcccagggacugcggaguuaguuuuggaaucgcucuguugaggcugagagacgcuacggugcgugagcgccaguguuuuccugcaguauaauuccaccagguuucgagaacgccgaagcagcauuuuaaaaaaagaaaaacaaaacguguaucuagaguucugcggguguugggaaggaauauccgauuuuucugcguaggcugugcuuuuugucuuccacaguuuugugaucgugaccuaaauugggcaucaguuucucuggucuucucauagcuaacucauuuuuuuuugaaugcagaaauguuggcaaaauaacuguuauuucuagagugacagaggagaaguauaauuuuccuuuucucugcuacuucgauuagaguucagagaaacggauuuuagaaauuaguauauugauauuaagugcuuucauuucuuaauaguaucuuuucuauugagaaggagcgguuuccccaucauuuuccaggagguacauaguauaggguauaagugcuaucagaaggaacuuacuguucaaaguauuaguggcuauccaaacacuggaaacuauagacacccuguacucguuuguuuguuuguuuguuuuuuuggcuuuuaaauaguugaagcaauagaaauuguuuuagaaacacauuuccuuggucugcgauaggauugggaaagauucugcucaaucuugccuacguauucuaguauuuguaacaauauuuguaauguuuggagacucagaagcaucaaacaaauuacgaggauuauuuuuuauugaacauaauuuuguucagucugggacauauaguaagugcucuguaaauauuuugaguaaauauugcucacucuaaccacaauguuuuaaaacacugggacuuuuaucaucaaaacuaaccuguuuuuguaaaaaguuagagauaauauaaauuaagucuuugauaguaagugauucagaagugucuucuagcugcacacuagaaacuuuccacauacuuuuaaaagagagucucagugcuuuuuaagcaugaggaaguaaaagaauuagggauauagugugucagcauaaauaguuuaaaaucaauaaguuguuuuuuucuuuuuacacaaaauagaguuuauuuuggucaguaaaccuguuggcaaaauacagaguggcaggagagaaaaguaaagaucccauccuucugaaagccauuaacaugugcaaaaaccauccuaguacugacaguuauaugcuauauuugcauguugguguuugaaauuucucaagaggucaguuuuucuacuugauuuaaugaggguuauuuccaucuaaguucuuauuagcugauaaucagucuuuuacucaaguacagaagaaauacagaauagaaauuauccgagguaggcagaucacuugauuccaggaguucaagaccagccugggcaacguggggaaacuccaucuuuacgaaaaauacgaaaauuagcugggcaugguggugcgaaccuguagucccagcuacucugcaggcugaggugggaggaucaccugagccugggagguugaggcuguggugcgugcaggagugcaugucacugcaccccagcagaaagagagagaauagaaacuauuuucuccccacaccgccccccccgccccuauuuucuccccacaccgcccccccgcccccgccuuuuuuguaguguguuggggaaacaagaaucucuucuugguuugaauacuaguauaccauuacuuugugaugucugccauuuuuacucuuugguguuguguaacauauauguauaccucacauuuauauuuaaugaaguaauuguagugagugaguuccagacauauaaguguucuguacuuaguucugccuaguauaccuaucggcaguaauugugucuucagaauacagguauaaauuagccaggugcuaugguguguagugugugccgguagucccagcuacuugggaagauugccugaguccaggaguuugaggcugcagugagcuaugauucugcgauggcacuccagccugggcgacagagugagacccugauucuuccaaaaaaaaauuaaaaaacaacuucaaguguagucucuauccuacauauuauccauaccuuaaauggcuucaguuucuaucuuguugaacuuuuuggaacagugauucucagacuugaguguguauuaagaaucacuuugguuuuuuuuuuuugagaccgaguuucgcucuuguugcccaggcuagagugcagugccaugaucuugguucacugcaaccucugccucccggcuucaagugauucuccugccucagccucccacauagcugggauuacaggcaugcaccaccacgcccggcuaauuuuguauuuuuaguagagacagaguuucuccauguuggucaggcugguauccaacucccgaccucaggugauccacccgucucggccucccaaagugcugggauuacaggugugaaccaccccgccuggccuaagaaucacuuugaaacuaaguuuccuggauccugucuccagagauuuugauuuuauaagccuggguugggugagggaccauaggugauucugauacagaugguuccuagauccuaauuugaaaaacauauuagugaaucauuggauuuuaaaaugcaugauacuggaaaaagcaggaaaauuaggggagguugaaucuauggcauacuaccauccaguaccaugcugacuuugguggcauucuugcuuuaauauaucacuucccaggcaaccauugcugaccccuaaauguuuuaaacuuugguuuuaugaaaugcccaaguaacacucauuugggggcuagggacuuggaggaguggaggugagggaauccuguuuacagcuaucagucauucacauguuuuauguguuagcuaaauaaauugcuuuuauuuuuucuaguagagaccaucugugugaaaugaacagacacaguggggagagagagaaggcugaugauacuuuuagaccaugguguaacuuugcaaguagaggagauaagacuuaaaacaacuuuugugacucaacuugggaaauuuaauccuauuucuuaaauuaagaauuggaaaggggagcccuccagguauguaaucuaaacuaccacccaauauagguauccgaauacagaugacauuaaccugagacucuggcuuaguguuccuaguaauguacuuuacacuuuuccuuuuauuucagugauuucagcauucuaucuucaguaauucagacaaauguaaaaggaaaaacaauuuggauuuuuuauuuuuauuuuuuuagggucuggcucuuucacccaggcuggagugcaguggcauaauccauagcucacuguaaccucaaauuccugggcucaagcaguccucuugccucagccuccugaguagcugggacuacaggcacgcaucuggcuaauuuuuuuuuuuaaauuuaaaaucgcugccuuacuauguugccaaggcuggucucaaacuccugggcucaaaugauccucuugccuuggccucccaaagugcuaggaguauaggugugagccacugcaccuagccuaaaaauaauuuggauuuuauuuuauuuuauuauuuauuuuuuuagagauggagucuugcucuguuguccaggcuggagugcaguggugcgaucucaacucacugcaaccuccgcuucccgaguucaagugauucuccugccucagccuccugaguagcugggauuacaggugcaugccaccacgcccagcuaauuuuuguauuuuuaguagagaugggguuucacuguguuggucaggcuggucucgaacuccugaccucaugauccacuugccuuggccucccaaagugcuggaauuacagacaugagccacugugcucggccuaauuuuuguauuuuuaguagagacagcauuuuacaacguuggccagacuggucucaaacuccugaccucaaaugaucugccugccucagccuccugcugggauaacagguaugagccaccaugcccggccaguaauuuggauuuuaauuucuaauuugcaaaucaacuuuuaaaaauuuaacauuaaaaauacugaaauauucauguaacacaaaauucacccuuauaaaguauacacaacucagcagcguuuaguauguucacaaaguuguaccaccauaguguaauuccaaaauauuuucauuaccugaaaaagaaaacuccugcccauaagcagucacccccguuuuguccucccccagcuucugacagguuuugauuuuauaagccccacgugggugaggguccaucggugacucugauacagaugguuccuagauccuaauuugaaaaauauauuagugaaucauuggauuuuaaaaugcaugauacuggaaaaagcagguaucacuggcaaccacuaaucuacuuuuugucuguauggauuugccuauuugggauauuucacauuaguggaauccuauaauaugugauuugaucuuuugugccaggcaucuguugcucaacauaauucuuuuuuuuuuucuuuuuugagacagaguuuugcucuguugcucaggcuggagugcaauggcacaaucucagcucacugcaacccuucaccuuccggguucaggugauucuucugccucagcccggauuacaggcgcgugcuaccgcacccagcuaauuuuuuuguauuuuuaguagagacgagguuuugccauguuggccaggcuggucucgaacuccugaccucaagugaucugccugccucagcuucccaaagugcugggauuauaggcaugagccacucaacauaauguuuuuuagguucauccauuauguagcauggcagaauaauaaauauuacauuguauagauacagcacaguuuauucaucaauugaugaauuuuuggguuguuucuauuuuuuggcuauuaugaauaaauaaugcucugcgaacauucguuuacaaguuuuugugugaauguguauuuuuuuuuuuuuuuugagauggagucucgcucugucacacaggcuggaaugcaguggcgugaucuuggcucaccgcaagcuccgccucccggguuuacgccguucuccugccucagccucccgaguagcugggacugcaggugcccgcuaccacgcccagcuaauuuuuuguuuuuaguagagacaggguuucaccguguuagccaggauggucucgaucuccucaccucgugauccacccgccucggccucccaaagugcugggauuacaggcgugagccaccgcgcccggucagugaauguguauuuuugauucucuuggguauauaucuaagcguagacuugcugauucauaugauaauucuuacguuuaacuuucugaaaaacuaccaaaguguuuuccauaguggcugcaccuuuuuuuuuuuuuuuuuuugagacagggucucacuuucucgcccagacuggagugcuguggcgcuaucuuggcuuaccgcaaccucugccucccaggcucaaggcguucuccugcuucagcauccugaguagcugggauuacaggugcccgccacuacugcccggcuacuuuuuguauuuuuaguagaggcgaggguuuccuuauauuggucaggcuggucucgaacuccugaccucaaaugauccacccaccucggccucccaaagugcugggauuacaggcgugagcugcugcgcccagccguggcugcaccauuucacauccccuccaggguucagguuucugcacauccuuaucaacacuuguuguuaucuuuuuuuuuuaagcgcuaaaucauucuggaauucuuuauuugaaaaacagcacuuuuugacaccuaugccauuuccuucucuuauggacaacuuuuuucauaguuugaugucccucucucuuuuuuuucuccaugagcacugcugucuacauuuuagcauuuauugacuauaauuuaauuccugcuuaugcauuguuuucuuguguucuuagauaaauuuauguuuuucucuuuuuuuguauagauuaugagcugcugcuuuuuuuuaacuuaacaaaauugaggugaaauuugcagaacauaaaauuagccuuuuuuuuuuuuuuuuuuuuuugagauggaguuuugcucuuguugcccaggcuggagugcaauggcgcgaucucggcucacagcaaccuccaccucccggguucaagugauucuccugccucagccucucaaguagcugggauuacaagcaugugccaugccuggcuaauuuuguauuuuuaguagagacaggguuucuccauguuggucaggcuagucucaaacucaugaccucaggugauccguccaccucgaccucccaaagugcugggauuacaggugugagccacugugcccagccaaaauuagcccuuuuauaaaauguauaauucagugucauuuagugcauucauaaugacaucucugucuagguccaaaacaauuucaucacgaaagaaaacuacuauugagcugucacucccucuucuuucuuuuccauuuaauggcugaguaauauucuguuauauguauaaaccacauugguuuauucaaucaccuauugaugagcaauuggguuguuucugccuuuuagcuguugugaauagugcugcugugaauauugguguacaaguauuugaguaccuguuaucaguuauuuugguauauaccuaggaguaaaauuacuggguucuaugguaauuuuguuuaacuuuuugagcaaccacuuuuccacagcagcuacaccauuuuaaaauucccaccagcaauguuugaagggugcaguuuuucuguaucuuugucaacauuuguuauuaucuguuuuugauuauagucauccuaaugggugugaaguuuuguuuugcauuucccuaaugacuaaugguguugaacaucuuuucauguguuuguugggguugucuuauuguugagguuguaagaguucuuuuuuuucuuuuuuuuuuuuuuuuuuugagauggagucucgcucuguugcccagguggccaggcuggucuugaacuccugaccucaggugauccgccugccuuggccucccaaagugcuggcauuauaggcaugagccaccacacccggccuugucuuuuugcuuccuuguuaguguccuucaauacacaaaagguuuuacuuuugguuaaggcuaauuuaucuuuuuuuuuccuuuuauugcuuuauggugucauaucuaaggcauugacaaauccaaagccgugaagauuuuuuuuuauuuuuuaauguuuuuuccccuaauuauuuuauaguuuuggcuuguauauuuaggcuuuugauccauuuugaguacaucuugguaugguaugagguagggguucauuucauuuuuuuugcacgugcuucuccaguugaccuaguaccauuuguuggagagacuguucuuuccccauugaauagucuuggcauuguugaaaaucaguugagcaaagauuuuguuguuguuguugagacagggucucacucugucacccaggcuggagugcaaugaugcagucuugggucacuacagccuccaccuccugaguucaagcgauucuucugccucauccucccaaguagcugagacuacagucaccugccaucacgccgggcuauuuuuuuugguauuuuuuuuuaguagauacgggguuuugccauguuggccaggcuggucuugaacuccugaccucaggugauccauccaccucggccucccaaagugcugggaauacaggcaugagccaccaugccuggccagccaaagauuuauuauauggguuuauuucuggauucucaguucuauucugcuuugauuacuguagcuuuggaguauauuuaaaauuugagaaguguaacuuuaccagcauuguuuuucuuuuucaaaauuguuuugguuguuuggggucccuugucauucaauaugaauuuuauuuuauauuauuuuauuuugagagguagucuuacucugucgcccaggcuggagugcaguggcgugaucucguuucacuugcagccucugccuccuggguucaagcgauccaaccaccucaggcugcaaguagcugagauuacaggugcccaccaccaugccuggcuaauauuuguuuuuuuaguagagaugggguuucaccacguuggcaagauugaucucaaacuccuaaccucaggugaucugcccaccuuggccucccaaaaugcugggauuacaggcgugagccacugugugggccccguaugaauuuuagauuuggcuucuccauuucuguaaacaagacaguugggauuuugauggggauuguguugccucuauagguugcuucagguuuuauuggcaucuuaaccauuuuaaguuagaauuuuugauggggagguuuuuucuuuuagcacuuuaucuuacugccucuggcuccuaugguuucuuuucucuuuucuuucuuugaaaacaaguuuauuaaaguaaaggaauaaaagaauggcuacuccauaggcagagcugcuguggccccuaugguuucugaugagaagucuguuguaucuguuguuagucuuacugaggaucccuuguucaugacucuuagcuucucucuugcugcuuuuagcauuugucuuugucuuucaacaguuugauuauaauuuaucucaauguguguauuucuuuguguuuauccugcuuugaguucaucgagcuucuuggauguguagauucauaucacuuuuucaugcuuuuauggaagaaguggggauuuucacagacgauaauucugccuuaucagauaucugaaucucucucuuagugaucuagaaagcacuggaccuauaguuuuauaaccaagaaaaaauuccuuccuaaggacuguuaggucugcaguauuuuagaaaguuuggauuuuggguauuaaguucauauaagaacacucuuuuaagccaagugugguggccugugccuguagucccuuuuacuugggagaccugguggcaaggcugcuugagcccaggagguugagggcuguaguucacugugauugugcugugaauagcugcugcacuccagccuaagcaacauagugagaccuggucucuuaagaacaaaaaacaccccacauauuaacuacaaauuaugaagugguuuaaacuucauauuuauauuuugucauuagguagaggguuugagcuauaugguagaaacauuguaguuuagcuauuuuauuuuauuuuauuuuugaggcagaguuucgcucucguugcccaggcuggauugcaauggcgugauccuggcugacugcaacuucugccuccugaguucaagugauucuacugucucagcuucccgaguagcugggauuacaggcaugcgccaccacgccuggcuaauuuuguauuuuuaguagagacaagguuucuccauguuagucagucuggucucaaccucaggugaucugcccgccucacccucccaaagugcugggauuacaggcaugagccacugggcccggcguaguuuagcuguuuuaaauaccauaagauuaacauuucuaaggacacucuuagaaauauuuuauuuaaauaagugaagcaaauauauaaggaaaccuucuguaaaucuaaaauuauuucaaaauaaaaaguaaaauauugagacauauauguuuacuauauuaauaucaaaauaaagaauugagaggucugccuuacacaaugaaaaauuaaaacuuagaaguugaauaagggaucagcuuugguuaaugugguaugaaugaacauuauuaacuccucaaccccaacugaugcugauuauuagggaagagcugaaaauacaacaaaaccuuuuccaugaaaggccacauuucaaaauauaaauucaaaacacuaaaaaucccaauacagugcaguuuggaagaaacuaaaacuaaaagaugacacugagaccaggcacacaaaucuuuagcucguaaauauaauacagguuauugaaucagcuuugggaguuuguggagaaaaaaaucugaaggccuuguagugccaguggagcccgauuuucagaacaagcuagcugugauuuuugccacuuuagaacucuuguagcuacucgacuuucugggaagaacccagacaugggauguuuaaaucaccaggugggggaaaaagcacugauagaaccaauuguugaagaagccaguaccauuuauaguagugaaucuagaugagagguaaaacauugggagcccacagauguguuucauuuagucuguguguguugacacauacaguauuaaaaauaaaugaauuaguugccaauguuuaaaaauugguagauuuaguugaaaggcccagauuucugguuuugccuuaaaaaaaucagaaaaucugauaacccuuaacccauauucccaguggauuugaauaaugccugcuuuaggugggucaguuaauaucuaguuagccacagcuccuauugcucccaguugccuucccugguugccaguuaucaucauauaugugcugucuuucuuuauaguguaaaauaagcaaugaaauauuuccuacuucuacaucugcaucaaaagugggaaaguugaagacuacuggguuauaauucaucccuguuacuuguuaccuaauuauaucugggcaaguuacauaauuuuucuaaaacucagcuaacucauauauaaagugagaauuaaauaguaaccaucucauagaguuguuagacuuaaaugagguaaaucacuuggaaugguaguagcaauguaguauguucgauuaauguuagccauuacuacugauuaaaauggcuguacauuuuaagaaaaaugagcauuuuggggcagauguauagaaauguucuuauuuucauguacaaaaugucagaauacaaucugauggcauuaaaaaaaucacuuuacugaaguaugguugacauucugaugucauuuugaccaaagucuggauugauuuuauucauugcaugugugcgcaguugaguuuguaacuucuguauuaguuugcuagggcugccauaacaaaaugucacagacuggguagcuuaaaaagcagaaguuuauuuucucacaguucuggaggcuagaaguccaagaucaaagugucagcagguuugguuucuuuugaggccuuuuuccuuggcucguagauggcugccuucuugcuguguccguggugucucugugucuaaauuuccucuucuuguaagaaugucagucaguuuggauuaugggcccagcaccccaguagccuuguuuuuuuuagauggagucucgcucugucgccaggcuggagugcagaggcgcgaucucggcucacuguaaccucugccucccugguucaagcgauucuccugccucagccucccaaguagcugggacuauaggcacgugccaccacacccagcuaauuuuuguauuuuuaguagagacgggguuggguuuucaccauguuggccaggauggucucaaucucuugaccucgugauccacccgccuuggccuccugaagugcugggauuacagguaugagccaccgugcccggcuggacuuguuuuaacuuaaucgccucuuuaaaggcccugucugcaaauauagucacauuccgagguacuggggguuagggcuucaacauauaaauuuugggaagacacaauuaagucuguuacaaccuguccuaaaaaggcagaucaaaaacauauguuacggaauuuauuagagauaagagauugaaggugagugcuaagagagccaaaagccugaucauagaugauugauuaagagcacuuggagcagaugaggagagaaacgauaauccuaacagauaaaagacaaaaguuccccagagcugaaguacgacaucuucaggucucaauugcugcacauaaauauugagagaagagacauacccugguuaaauuucugaaauuaaaagaauacuacaagcuucuaaauugaaauaggagggaggaaaaaaaaaagcuuucuuaaacgggaaagagaaucagacuggcauuagauuccaaucugucacaguaaauguuacugcauggagaaauguuuaauagaguucuuagggaaauugugauuauaaaauucuguauucauucauacuauaaccauuuucucuuuuuuucuuuuuggguggugauauauauuuuaauuauuuaaaauuuugcucauuccauucuauagaauaagauuuacauuuaagcaaaauuaauuaaaaucuaagcagagagaucaaguuaagcacaggcuccaggaaguccugcugggaucucaggaauagcgacaacauguuaaaaguuuuaguuugaaugucuggaauuuguuuguuuguuuguuuguuuuggugcauucuagagucuccaagagucagucaccaugaguacccgugagguagaugauacuuauuuuaacagcaccuaaacugggguuuaggagcuauauuuuccaagaagugacucagucuaauucugaaaugacaaaagcaguucauaucauuuuauucacacuugaacuccacuggagucagggaugaaaugucaucuucuauuccaagaaugaagucuucagauaauguccaggugcuucagaacuaacuagucaucauaagaacacagaguccauaauuucuccaauguauaguuuuuugugguuucuagaagcaucaaaugaaucacagugcuaccaaacuccacacagaacuagucacaguguccuuccuauccaucuuaacauuaggcucauuuuuacauuucagguauuuguacauuuucauaguauaauagggauauaucagguggaaguuccacucacuaucagucacaaaguagcuguaaucuguauauauguuuuuacacagucaugugaaauuuauuuauauacacacauauaaucccaguuuguucacuuauacugcuauauaaugguccauuauaggaauauauccuguugaaauuuguguguuccccaguguuugcuauagcuguuuuuguaaacagugguacugcggauauucauauaaaugucucauguuugagaauuucucuaacgaaucaaggaguggaauugccagacuguaggguauauuuauuggauauugcuauugcuucucaggauggcuguaauuuacauucccaucaacagagugaaguuuauuuauaucuguacuuucuauagucacauuuuaaauuuaugguaccucauugugguuucuauugcauccuccugauuacuagugagugugagcaucuuaucauguuucuuggcucuuugagguuuuguuuugugaguuuuuguugauaucucugcacauuauuuuguuagguauuuuuaagaauuugauuugugggaguuauuuauacauuuugguuaccaguuacuuauggaucacaaauguuuucccugaauuuuuucugugaggaaaagaaguuuuaauuuuauugugguugaauuaucuuuucuucugugguuuuguacauuuuguauauuguuuaagaagucauucuccuuuauuuuguuuuuuaacagcuuuacugagauacacucuauaccauaacauacccauuuacaauguguaauucaguguuuuuuuuagcauauuuauagagucgcacaaccaucaccuuaaacuuuucuuuuuucuuuucuuuuuaagacagggucucacucucuugcccaggcuggagugcaguggcaugaccauggcucacugcagccucaauccccugggcucaagugauccaucugucuaagccucccgagcagcugguacuacaggcaugugcaaccuugccuggcuaauuuuuuuauuuuuuguaaagaugagguuucaccauguugcccaggauggucuugaacuccuuggccucaagugaucugccuaccuuggccucccacauugcugggguuacaggcaugugccaccucgccuggccuuuccaucaccuuuaaacuaauuuuagaauauaccaucauucuagaaagaaaccugguauccauuaguagucacuccccauucuucuucacucugucccuaaacagccacauaaucuacuuucuagcuauagauuugccuauuuuggacauuucucuuuuuuugagauggagucucgcccuguugcccaggcuggagugcaguggcacagucuuggcucacuacaaccuccgccuccuggguucaagcaguucugcugccucagccuauccugaguagcugggacuacaggugcgugccaccuugcccguguaauuuuuguauuuuuaguugagaugggguuucaccauguuggccagguuggucucgaacuccugaccuugugauccgccugccuuggccucccaaagugcugggauuacaggcgugagccaccgcgcccggccauauuuuggacauuucauauaaacagggucaaauaauauguggucuuuugugacugacuaacuuuaacuuagcagaauaauguuuuuagauucauccauguuggagcgugcaucgguaccuuauuccuuuuuaugacugaaguauaaaauaacuuuuauaagacuaaacauuagucuugauaccucuaguggauuaaauauccauauuagggauccugggaagaugacagcagugguagaauaguuuccuaaauaucuauaugacuuuccccuaaaacagaacaaauaggauaggaaaaccaaaaacacauagaaaauguguacaagaaaauuaguugacuauguuucucuacaaacgcucaaauaccagcagauugggaacaaaccauuguuauccauacuggaagaagcagaaggaagcaguggaacuucugauggagcggagaauuguaaauaacccaaaggcaaucacuggaaagcuuuuuaaagggccgauuuuagaauaccagcugaaaugggaauuugggaaggguauugcacacaucgauaaugggugagugaaagggaucaguuguaaagucugaagggacuagcgcuccuucaugaaacuuuaaaaacuaaccaaagcucccuuccaggcccacuccucacaagaagaaggaaccgaggauacaauugaguauccucugaagaauacagaccaaggaaagagaagguccagauaaaagcaggggagguaaacagggccaagauaccucagaaagcaagaaacuauauuuuugaauacuauaugaaaacaacaagagggauuuuuagaguauaaaggcagaguagcuauucagagccaagccucuuucaaaagucaacaguaugaaaugauuguugucaaaugucaugcaaauuuuugaagaaaaacaagaccccuuagacaaggaaaugaaagcacaccagaaagacauacuuagaaaacaaacaaaaacugugagauauuaagacaaaaggcaagacagaagacacuacaaugauaagacauuucaaaaauuaauuugcauaagaaaaauuaaaaaauuaagugauagugaaguauuauaaauaaaagaaaauggcuggacaugguggcucacaccuguaaucccagcacuuuaggaggcugaggcaggaggauucgcuugaguccaggaauuugagaccagccugggcaacauggggaaacccugucucuacaaaaaauagaaaaauuagcuggaugugaugguguaugcguguagucccagcuacucgggagggugaggugggaggaucaccugagccugggaagguugaggcugcaguggacugugcuggugccaccgcacaccagccugggcaacagagugagaccuugucuuggauaaauuaagugaaugaaugaaugaaaugaaacaaaauuuauuuuagaaaugaagacaaauuagaaggaacacaagagcaaguaaacguaacagauaauaccuuaugagggaaagaagcugaaaaggagaaagacauuaaaaauaaagagauguaaaaagaauuuuguagaaauugacacguuggaaacaaguaaagaaaauccaacauauguauauuagguguccccaaagaagaaaacuauagcaagggaacagaauggguacuaaaaauuacaauacaagacaauuuuaaugaaauaaaaguagauggggaacuaaauuuuggaagaguacagcacauaccuaagaaagugacacgguagaccaauacugagacauagucuagaaaaauuauuggacuuuaaaggaaaaauaaaaauccucagacauacaggcagaagucacaaagucucuuaccuuuauaaguaaaggaaaaucagggccaggugugguagcucauaccuguagucccaacacuuuugggaggccaagguggggguaucgcuugagcccaggaguuugagaccagccugggcaauauagugagacccugucuacacacacacacaaacacacacacacacacacacacacacacacacaauauagugagacccugucuacacacgcaugcaugcacacgcugggugugguggugugagcuuguaguccaaguuacuuggaaggcugagaggagaaucuauugagcccaggaauuggaggcugcagugagcugugauugcaccacugcacuccagccugggcaacagagcuagacagugucucuaaaaaaaaaaaagaaaaauaaucagauuacugucuuuuuuuuuuaaagacagguuuguuauuguuguccaauggcgugcaauggcgugaucucggcucacugcaaccuccgccucccggguucaagugauuauccuaccucagccuccugaguagcugggauugcaggcaucugccaccacgcccggcuaauuuuuguauuuuuaguagagaugggguuucaccauguuggccaggcuggucucaaacucccgaccucaagugaucugcccaccucggccucccaaagugcugggauuacaggcgugagccaccacaaccgggcugguguacacuuucuuaucuuaaauauggaauuucauugucuccuuucuccuaugacaguagggaggccaaggugggcggaucacuuugaggucaggaguuugagaccagccuggccaacacggugaaaccccgucucuacuaaaaauacaaaaauuagccaggugugguggcauguaccuguaaucccagcuacuugggaggcugaggcaagagagucgcuugaaccagugagauggaggcugcagugagccacgauuaugccauugcacuccagccuaggugauagagcgagacucucuaaaaaaauauaaaaaauaaaagucacaaacaauaugcuagaauuugaagaauauuuuucccauuagcccuuccuggggaaucuacuagagaaugggugucagaaucagaaugacuagagacacauuaaagacuggugauuuguauuacacguaacuaagaccaaaugaggguuugaaagaagauaugaucuguaaaggggugggaaggagaauggagggauuauaugcaaaacauuuaaaaaacuacuuucaguaauaauguucguggugguaguauugguguuauuauuuugagaaucuguguguaacaugaaauaaaaagcaaacaaguaauuguguuauucuaauucugucacaaacugucauugagaaccacagcucuugguguggaagaaagaagauagagaugacugauuagaggaauguauguuuauguuaggggugggugaggguugcaaguguugguagcugaaauagagaaaaaagcuaauguuucaacucaaggagcuuuuuuaaagaacagauaaacccuccuuucaccaggagaaaaaaaaaucccaggaagaagaaauuagcaauauuaaaaaaaaucaauuacaaagcaaaaucagcaaaauauuuggccaauaaaaucaauuuaauagucauuuggaaagucucauaaaaaaagaacguaaaauauuagaaauaagaaaaaugaacauucuaagaauauuaugaguaguuaugccuauaaauuugaaaaucagagaauuugauuuuuuuuuuuuauggacacauuuugucagacauauaaagaacuggaaaugucuauauguuguuaaaauuauuucagaguacaguaucagaguacaggaaugaaaugauggaaagcacccuguuuuacuuaaugagaggggcuacccuggauaucacaacugcaguuucgcagacaugucuuauauuccucaauuuaacucuccagauccauucagcauuuguguuuuccaucauaggggaccuuucuggacaacaugaaugagccccuaugucgucugucuucugauuuggauguggaaaugaggagcccuggcagggaauuggaggaaagaggagaaaaaaagucccggucuugauucccccaucucauacauucuguauguaggagccuugggcuggcuggcugugucacucuuaguccuccugguccuuccuuuuaggcuucggggugaugagagcuguucucuuguuacuagccuggguuacugcauuaucccuugugauuuccuauaagccucacccacagcuuuguaaauaguccuuauguaaauaaacccucuuuaaauuaaucuaauuugagugggccaucugcuuccugcagacccugucugacauaacugaugaaauuaggacuuuugcauuuguagaaaauaaauuuuuaaaguacaaguuuugacuaagaaaaaaauagaguacagaauauacuguauagaaaaauaaguuuauugcaaacuuaagaaaaauggcaaauuuagaaauuuuuaaaauguauaauagagguuuauauaguacuugauuauuuaucgcauuagcuguuaguauugauauuuuugauuauuuaguaauuggauauugguauuguauguauguuaaauuuccugaauguaaguggugugguggcuggcuccuggaauccuagcuacucgggaggcagagguggccugagggucucuugaggccagaaguuagaggcugcagugagcuaugaucacgccauugcacuccagccugaaugguagaaugagaccccaucucuuaaaaaaaaaaaaaauccugaaugugaucauuguauugugguucuauagaagaacggccuuguucuuaggagaugcaugccacaauguuuagaguggaguaucaugauuucuguaacuaacucucaaaugggacagcaaaaggaaaaaagucuuuguguguacauguaaggagagagagacauaaaguaaaugugucaaaauguuaauaaguggugaauuauguuaagauauaugaguauucacuguuaccguucuugcaacuuuuuuuguggcauugaaaauuucaaaauaaaaaguuggaaaauauuuaaaacaacaaaaauugaaauacuuauuauggauaaagaacuuuauuauaaacuaauaagaaauauauaaaaggcuagcauuugaauaagcagaucacuaaaggagaaauacagaaagccauuaaagaaaaggaugcuugaccuuaauaauaaaggaauguaaauuuaaaugagcugucgguauccaucuaucaaaguagcaaagauucaaaaaacaaugcuuugggaggcugaggcgggcggaucacuugaggucaggaguuugaaaccagccuggcgcacauggugaaacccugucucuacuaaaaauacaaaaccgcugggcguggugucacacgccuguaaucucagcuacuugggaggcugaggcaggagaacugcuugaaccugggagguagagguugcagagagccaagauggugccacugcacuccagcagccugggcgacagagcaagacuccaucucaaaaaaaaaaaaaaaaaaaaaaagcaaugauguuuaauacugauggagcuguagcaaauugaacaaacugguaacucuuggaaguauagcuugauucccucuucuuugcagucuggcaguaucuaugaaugcuuaaaaucuguaugcucauuaauaacggcaauuuaacuuaaaugaacuaaaucuagugagguaauaagauaagugaguaagguuauauguauaagcacauucauugcagcauuguuaaaaacagcaaaaaccaaaaaccaucuaaaugcuuaucaguucggguuugguuuuauacauaguagaauacuguuuuagcuauuucuuuuuuuugagaaggagucuugcucuaugcccaggcuggaguguaguggugugaccucggcuuacugcaaccuccaccucccggguucaagcaauucuccugccucagccuccugaguagcugggauuacaggcgcgugccaccacacccagcuaauuuuuguauuuuuaguagagacaggguuuugccauguuggccaggcuggucucgaacuccugaccucagaugaucugcccgccucagccucccaaagugcugggauuaacacagaaguaguuaauguauugauauggaacaauaucccugauuauuacauuaaaaauaaaagcagguuaggccaggagcagugguucaugccuguaaucccagcacuugggagacugaggugggaggauugcuugagcccaggaguuugagacaagccuaggcaacauggcaaagccccaccuuuacaaaauacaaaaauuagccagguauaguagcgcgugccuguagucucagcuacugggaaggcugaugugggaggaucaccggauccuggggaggucaaggcugcaauaagcugugaucacaccacugcacucuagccuggguaauagagugacacacuguaauaauaauaauaaaaauagaagguuagagaaaaagauaugcauuacugucccauuuacaguaaaacaacuacauauuauaggcaugauuuuauauauaccaauauuguguagguuuugaaaccugguugguggaguaucaaaacaggugggauaauuaugggaaaacagggcuguuauuuucugguuuuggcuuaaaaacaaauagaucauguaauaggaaauaaaauuaucuuucauuuaaaaagucuguggccgggcaugguggcuuacaccuguaaucccagcacugggaggcugaggcagguggaucaccugaggucgggaguucgagaccagccuaaucaacauggagaaaccccgucucuacuaaaaauacaaaaaauuagccaggcgugguggcacacgccuguaaucccagcuacuugggagguugaggcaggagaaucgcuugaacccgggaggcggagguugcagugagccgagaucgugccauugcacuccagccuagccaacaagagcgaaacuccgucucaaaaaaaaaaaaaaauagucucugcacuaauuuuuccuuuaaaauaauucuguaugcugguuuguuaauauaguuuauugaauuaacaaaaaauguguuaagaaacucauuuugcucuuguauauauucuguuuucagagcagcggaaagagcucagugcuagaaagccugguggggagggaccugcuucccagagguacuggaauugucacccggagaccucucauucugcaacugguccauguuucacaagaagauaaacggaaaacaacaggagaagaaaaugguaaauuucagauuugagauaauuauuuuacagcucuucauuuuugaucuauucuuaaaaagauaugaauugauuagauaauuagaaauuagugacuguagcauaguuagaaguccugugagaaguaguaugcaucuuucuuaauguaaaaaaaagaguaguuuuuguuuuguuuuguuuuugagacggaggucuuacucugucgcccaggcuggagugcagugguaugaucuuggcucacugcaaccuccaccuacuggguucaagcaauucuccugccucagccugccaaguagcugggauuacaggcgccccccaccaugcccagcuaauuuuuguauuuuuagaagagacaggguuucacuuuguuggccaggcuggucucgaacuccugaccucaagccauccgcccgccuuggccucccaaagugcugaucacaaggcggguggaucacgaggucagaaguucgagaccagccuggccaauauggugaaaccccgucucugcuaaaaauacaaaaauuagccagauuugguggcacuugccuguagucccagcuacucaggaggcugaggcagaagaaucacuugaacccaggaggcagagguugcagugagcugagaucacgccacugcacuccagccuaggcgacagagugagacuccgucucaaaaaaaaaaaaaaaaaaaaagaagaaaauaggcauuguccuuuauaaccguucuuuuuugauuaaauugaaaauauauuagggaaugcugugucuaucagcagauuuuaaguugcuuaccaaauauguauccuauguuaauuauacuuauauuaaugagguuugaaauguugaaugagaguaacguauuuaaucuuccuauuuaguucaguauuuggcucagacuuucuuauuuauagaacucuguaacauagcucuaauuauuaaauuacuuuugcagcagaguaccauaucuguuucuuaucugcagagaucuguuuucaaugcaguuuuauucuacuucuuauucugauuuaagaugggaugauaguuuugacaaaauugaacuuauuuuaauuucugugucugauuuuuucauuuacuguaggagcuguugguggugaugacuugaauuuuuuuuuuaauggggaaaaaaaaccucaugagcaucugcuaugacucuagaauguuagucacugaagcaaauuaguguaguuguagauguugcaaguaauauuuuuagauagacugccaguggcuaugugggagccuuuuaauuacauuagguagcuucuggguauguuauucaucacuuugcauuucucuaauacuuauugaaguucugaaccuugaauuuaaucauguuggauuaaucugggguucaccuucaaauauauagaauaacacuuauaaaauuucauccccacugauuucaucaaauuuaccaaacaucugaaacuaagaccuuaagacacuauaugauauuaggucuuucucucucucucuuuuuuuuuuuuuuaacuuuccauuuucuucugucaccuugagagggcccaugauauccugucucucagaaacuauuugaauugugggcaguguuuccuuagauaaaauugugcuuguuagaaaaggguguacauuucagcuaucguagugucagcucuuugguaucucuuuguuuuuauguccacuauguuuuguugaugucuccucuuagugguuggucaguaaaucugccuaccuacuguuuuuuuccaagcuuagugcugauuuuguauauauauuugcuuaaaaugacaacucaacuaccccaaacacaauauagauuauauaaauuugaguacuagauuucacguguuuuauucuagcauagacaguucguuaguuuuucaucaaagcuucuuuauccuuagaauaaacaauucuagcauaucauaaaucauucuaacccagagaaaauuagaaaccaugaagcagauaaacaauauaguuagcuagaagagugugaacuaccugacagccugauaauaagagaggagaaagggaagaaacauaaacuuucaaaaaaaaaaaaaaaaaagaaaucaguuacuaacauuuuguguagggauuuuauuuagccagugaaggcuuaguuacaugacaaagaccuagguuaccaauaguagauucagaguaguacauucuaagaugacauggagaaguauaauccaucuuagauguagcuucaucaaaacuggcuaaaguaaaauauuuuaguguuuaauauguauaauucaaucaucaggacauuuauuuagcauaggauucuucauucugucaacugugggauaacugaggugucaguauguagauuuauggucaucucagcuugcccccuacuucugcccauguaaaagaauuuucuguuaaauuuuuauuaaaaacaauacuaaacuauguuuuagaguagaguggugguucaguuugaacagaacuccacgguuaucuuucauauauuuguaagaaauaaaucaagcuuuccucagcuuuccuuugagacaaaauccaaaaguagcaugcugauuaaaggccaaaauugugcuauauaugauacuucugaacagugucaguagaaauuugaaaaaaaaugugaaaaaaaaauuuauuuuggggagaaaaguuguugaacuaaagcaaaaguuuuuuguuuucuuuuuaaaaaaugcaaacauaggccgggcgcgguggcucacgccuguaauccuagcacuuugggaggccgaggcggguggaucaccugaggucaggaguucgagaccagccuggccaacguggugaaaccccaucucuacuaaaaauacaaaaauaagcuaggugugguggcgggugccuguaaucccagcuaaucgggaggcugaggcaggagaaucgcuugaacccgggaggcggagguuguagugagccgagaucgagccauugcacuccagccugggcaacagagcaagacuccgucuuaaaaaaaaaaaaaaaaugcaaacauacauguuucguagaauaaugcuuaaaaucuugguauaauuugaaauuuuacccccauuucauuaaguaaccuauuuguaaaagcaaucaguugccccccaaaaagcaguaaaauuacacauuagaauuaaaggaaaaagauaggauuaauuuuucugcauagggugcugugauacacguaguagucucccuuuggacugaguccacgaaggucaagaguuaacuuucugcaguguucuauuaaauccaauguauguuucaaauaaaauacccuuauauaguccagucuuagcuaauggggcaaauacuugcauauacuuaccaacuuuuaagguuuugaaagauguauuuaguauauuuuguagauuuuuaaaaaucaggcaauuuaucuuuuccuguaguagguuaucagauaucucaggcaaaguuuuuuuuuuuuuuuuuuuuuuuaaggcagagucuugcucuguugcccaggcuggugugcaguggcacaaugaucucagcucacugaaaccuccuggguucaagcaauucuccugccucagccuccugaguagcugggauuacaggcgugugccacuacgcccagcuaauuuuuguauuuuuaguagagacgggguuuugccauguuggccaggcuggucuugaacuccugaccucaggugauccgucugccucggcuucucaaagugcugagauuagaagugugagccccacacuuggcccaaauuuuugaauagugaauuaauugugcuucauuugugucagaauuagaaauaauggucacauaacuuuuuuauuaauuuuaaaaauuuaauuuuuauuuuuuagacuagucaagugcaguaguaaggcgggaaagaguagaacaaggaguuccaucuguaacugacugaacagucaauugagauaacuaccuucagacaagccagauauaacuaauuauauuggaaagguuguuuccuaaaaauguuaaaaauaaguuauggcaagcaauaugcuuuguuucuaugacuuaaaaauauuauauacaucccucuaauucuaguuguauuuugcacugcgcagugggauucuuaauuuuucuucuuagccacuaacuuuacuuucgucaguaaauuuugaauaauugaaugcuaugugcauuugaaaugugaucagguuucugcacauuugaauuuuuaauaagguuuaaaauuuuagggauaagcacuaaacuuauucugugcuguuucucuuuaacuacagacccugcuacauggaaaaacucaagacaccuuucuaaagguuuccuuuauccauuugcuuuugacccuuuuuuucucuuaugccugcaugugugcuuauguacuauuacaggcuguguguauuuuuuuuucuuccauuuuuauuugcccauccacauugauugcagguuuuagugguucuuguuauuuuuuuuggcauugcaucaaaaugcaagcuuuuuugguggugaauguaauuuauuuuauuuuuauuuuugaagacaugcuugugaagccaagccuuuuuaaauauaauaagauaaauuagaaacagcucuuugguauguaguacuugcauuuugugaguucuguucaccuagauuacuccaguccuccaaugagacuucuuggaagaagguacuaagcuacaaguaggugagcauuuuaucugcaaaaaggauccgguuuuauuuaccuuuauuccaccaaaggaccgacucacucuucuguuugucugaauaucuuaugaucauuuuuauuuagaccucaggaggcugauaugcauuauucaauacacuuauuaagauauuuuaaccuucucuaaauuugacaaaagcaaaacagcuguguuuggaggagauaaaguuagauuaucuuuccacaauuaaacaguucuaguuuuucugggaaaaacagacuauaucuugcucuccaaguuuuagacuacuucacacagugcaacagugaaucuauuuuccuucuuucagcaaguacaagaggaacagaccuaugacuggaaacuaauggagaguggcaacuccuuacgcugcauauaccaggguucuuguuuuuccuuuucuuccauuuuauuucuuuccugccuccaguuccaagggaaaacagucuugacccugggggaaaaucaccuugaaaguguguguaaauuacaaagcagcuagcucuauaauaaugagagagcucuuuaaaggaacagcaaguuguggcucuacagguaaccaacaggaaaccaaauuuuuaaaaagaacugaagaauuagcuguuucauugacacauuguaaaauuuuuccuugagucauauguguacaucuguuacauauguuuuuugcacuacucagugggauucuuaauuuuucuucuuagcuacuaacuuuauuuucgucagaaaacugcuuuuauauguaagauuuucaaaacuaaagaauauuccuuuuacuguaauauaacuacacaaaaaaauaugaagagaaauaaacaauuuuauuugcaaaaucuagauuucaacuagugggaagaccugugagcagcucugccugaaguuggucauguuuuugaaauacaccauacaauuuuuaaaauauaauuuagcagaaaauacaauuuuagaaaaauauaauuuagcagaccuuaaaauacuuguuaacuuguacuuaauggcaaaauuaaauacaaguuaagaaguguuuuauuauguugccuuuuugaauuccuaaagauaaaaaguaguuuccauaguuuccaauaaaugaguuuuucuuuuuuccagggguggaagcagaagaaugggguaaauuucuucacaccaaaaauaagguaaucacacaugcauauaaugaagaaauaauguugaaaaaaauauauuguaugaauacuugauaauuuaguuucuaaucauuggcaauuacguuauuuuaaaguaacuauaacuauuccuuauaaaauaaaucuuaguaacauuucuaaccacaauuguuuauuggaaaacacuugaaauugaggccgauuuucucugugauuuggugauucuuaauuguugugggaucaggaagcuuugaaaaguucguaauggccaggcauaguggcuaaugcaaguaaucccaguacuuagggaggcuaaagugggugggucacuugagcccaggaguucgaguccagccuaggcaauauagggggacccugucucuauaaaaacuaaaaaaaauuagccccgcgugguggcaugcaccuguaguccuagcuacuuggaaggcugagucgggaggauggcuugaggaugugagguugaggcugcagugagccgugauugugccacuguacuccagucugggugacagagucagacccucucucaaagaaaaaaaaaaagccaaacagaaaaaaacucauaaaaaaacuauaaauccuuagcucagaaaauauguauacauuagaauuuuauuuauuuucugaagcaaauacauagacauccuugaaguauauggacucccccuccagcuuaagaacuuuugaucuuauuuugaauauuaugcuuuuuuauuucaaaaauuuuuagcuuuacacggauuuugaugaaauucgacaagaaauugaaaaugaaacagaaagaauuucaggaaauaauaagguaggcaucuuuuuagagcuagaaggcauaagcaucaguaaauauauaauugagguauucuguacauaauaugugaagggcauuguaaauuccuacucuugaucuuagccaaaaggccgagaagcgauggacauuguaaauucauaauggacuuugaaacaaauggaguauuuucacagauauauagaacuuugcuuaaaaucccuuuucuuucuuaaagcuuucauauaaaucaaauauuuuauuuagauguuuauuguuguuccugucauguacaugccacauuauuauauaauucuacuuaguauugcuacaauaaguuaucuuuuucugauggauugauuguacucuaacucaggaagcauuguuucacuuauauauauaucuuuugaggaguucuuuucuuaccuguguauggcuagauuugcuuaugaaagcaaaaagagacaaauugggaauuuuuuuuucuuuuuuuuagugaaaaugaaaauaauacauuagcaacugguuuucuuauuuucugagauugugagaaugugaaguaaguuauguaucuaagauacuguuaaucuugacacuagguacuaucacugccuugccugaauccugcugucuucugucuucuuuauuccuauuauuuuucucuuuauauuucaagagauauauauuaucucuugagauuuuuauuucccuuccuuuuuguucuuagcuccauucuuauauuauccagaggcacauuuaaucccacaagugggcccuagccuaguacuaauauucaacaaauauugaauccuuguaucugccaguuacuaugcuaaaagauuauuuccugacagaaaggcauuuuuagagucauguuaaccuuuaugacuguucaggauauuuguugcuguuacagugacugacugagcuuuguucauuguugaacucuaggcugguuaccuuugagcuacugcuacuguugccauacuuuccugaauuucuaguaaccauguuguauagaacggguugaaaaaguggccagaaacuagauuagcuuaucgucauuccucuaauuauaucagggauauuuuuggcuuuuggaauguuauugaucauaacaucagucugaauucucucuccuacaguccccauuuacuuacugaacucagcaauuggugguaauuuuacacaguaccagaauuuagaguguugugaugauucagaaauguuuuuaguuacacuaaacugaaugucauugaagauugagucuauaccuacaagauguuuaauuuauguugaggauauaauuuacuuaccuagcagcuuuucauccacagugucuaaaagaugaaaagucccccaaccccaaaucuaugaaacaucucuucuuucccaaaucacguauguaaugaaguaaaugauauuuugaucuuauauaauuuuuaugucaaaauauguaaaugacugcauaugccuaacauauagcccugaaggauuuaaaaugucugugaguuuggaguugcaaagguacugggcagagcuuuguauuggacugauaggggaaugccauggcaauaaagauccugagaaauauacaaccuaaguagguaugccagauagugacauuuguuggcuuuggaacacuggaguauuuauaauggaaaaauagcacagaguaaucuaaaauagcaaauauaauuguauagggaauguggaguaaaggauauuaaaaacuugcugggaaauuagaauuuucagugggcuaaugagggaaaacauaagguaguuaaacaggugaugagaggauauauuaaaggcuaaagaagggcauguacaaagacaggguauaaacaucucauaagugucuuuuuacauguaguugauucaauccuaauacuuguagagggccaguggugaagaggagggagccuacgcaguauucuuagucugcaggagagaaaauacacguuaccucucacuauccaaauucuuacuagagauuaaagaguuagauaaacuucuugagaaaucucuuacuguacacauucuugccacuugauauucaaagaucaggaaccaggcugauuuggacaacuuguuaucuacgccuuacucucugaacucggaaccucauaaauuuggauagugaggaauacauuauucuuuuauucagcacuaaaucuauuaaacauauuuaaggaauggcauaugccagccugggcaacauuguaauacccggucucuacaaaauauaaacaagaaauuaucuggacaugguggugcacaccuuguagucccagcuacucaggaggcuaaggcaagagauugcuugagcccaggauuuugaggcugcagugagccaugauugcaccacugcacuccagccugugugacagagugagaccuugucucaaaaaaaaaaaaaaaagaaagcaaaggaaaaauuuauguuuauaaucaagagaaaagaauguaaaauaauacaugguauauaauacauguacauauaacaugauacagggauagaaguaggauuauaaccuguuaauauggcuggcuaccugacuucccauguguuucaucagguuuugauuguuaaaaaaaaguuuuaggaaucaugauuuaauucauuuuuaaaagcauuaaugucuauguacuugaaaugaaguuuauuacuucauaguucauugaaauuuuaauauauuuuaaaauuuauuuuuagggaguaagcccugaaccaauucaucuuaagauuuuuucacccaacguugucaauuugacacuuguggauuugccaggaaugaccaagguaaggaaggaauaguuguagauuuggucagguuguuuucacuucguugacaucccauaugagaauaaucagcuucuuuuugcaaucacuuugaucuguuagcagcauuugauaacguugagcccuccuuucuccuugaaacacuuucuuuacuuggcuuccaggauaccacacucuacagguuuaucuccagucucacuggccacuccuuuucagucucuuuugcuguuucuucucaucuccccaaugucuaaacaguaagugccccagagcucaguuuauggaacucucguuuucucuagguacacuuucccuuugaugauuucaucagauuuuauggcuuuaacuacguaaggcucuguauauugacggcauucaaauaucuccagacuuguauaucuaguugcuauucgacauauacacuuaaaugucuaauagacauuucaaacucuaauaccgaauuccugaccuguuccucaacuagauuugguauuucuauagucuucccccaucgcaauaaauggcaacucaugccauuuauuggcaacucauaaaaaagcugaguugauuuuuaauuguuaguuccuuggccaucucuguuuggugcaguggcuuauccuguaaucccagcacuuugggagaucaaggugggaggaauucuuugagaccaggaguuugagaccagccugggcaacauagggagaccacgucucuacaaaaaauacaaaaauuagucgggcaugguggugcacacauguagucccagcugaggcaagaggauugcuugagccuaggaauuugaggcuacggugagcuaugauugcaucacugcacuccaaccuggccaacagagugagacccugucucuaaauaaauaaauaaauggcaacuccauucuaccaauugcuuagccagaguuuguagucauccuugacacuaauuuaucccacauuccacuuccugccagcaaauccucuuggcucuuccuaccuuuacaguauauccagaacucaaucguguuuuauaaauucauauuuacuguccugaucuagccacuaucaugcuaccuggauuacugcacaauaaucaauaauaggucguccuugugaucucaucuuaguagacagugauacgauuaaagugaaaauucgauugugucauuucuuggcucaaaacuucuccaguuccuugucauuccuugacuuaaaaccucucccauuucacuaaaagcccaaguuauuacagaggucuaaaauaucuacuuguuacgucccuauucuucuccuaacuccuguugcuucagccuccugcccuuauuguucacucucuuuggaauuucuucccccagaugucuguauguuauugcucccuuauuggcuuaauuucugcucauucucuuaagugucaguugucucagugaaguuucccugauuacucuauuuaaaaacauaauccaauuuaaaacauuaaaaucauaauccuaauggccaggugcagaguggcuuaugcuuguaguucuagcacuuugggaggcugaggcaggaggaucauuugagcccaggaguuugaagauacagugagcuaugaucgcaccacugcacuccagccuaugugauagagugagacccugucucaaaaaaaaaaaaaaaaaaaaaaaaaaaaagaaaaaaaucaucucuaaucauucccuagccugcuguucugccuuauuuucccacagcccuuaccaccaucuguauacuauauauauguuuuuguuuauuauaugcguguuauuacuaaaacauaaguucuacgaaggcagaaaguuuggucuuuuuaaaauucacuacuguaacauaaucugacaugaccugaaaucacguucagaaaagugccuaaaauagaguaggcugccaguaaacacuugguaauugaaugaaugagugaaugaauuuguaucuagccaaucaacauugaccaguucuuaacaugggacuguauuaaaucaacuuuugauauuugcaagaguuacacuuugagacuugacacauuaccagauucauaaauaccauuguaguauauuaguaaugucuuuauuuuuauuuuaacuauuuuuaaauggauauaccuauauucuaucgauuaaauguggguaaaaaagcugaguugauuuuuaauuauuaguuccuugcucaucucuguuugguuuaggugccuguaggugaucaaccuaaggauauugagcuucaaaucagagagcucauucuucgguucaucaguaauccuaauuccauuauccucgcugucacugcugcuaauacagauauggcaacaucagaggcacuuaaaauuucaagagagguagauccagaugguaaggacagauguuaauuuaaugagaugcuuauuuuacaaugguaaaucuacccuugagaaaggaauuuuucucuuuaaaaacaguaucucugguuuugaauacaaauuuaaaagauaaugcuuuccuauuuuuguuuauaaaaauagaaauucugauggaaaauaagguuauuaaguugcuauacagacuaggcgaaaauauuuuacaacuuuauuuguaaugguuaccuaauaauuuaaaaauaauacgguggcuuugcaaaaaggauuucuuguuuugugaccuagguauuugaauaguugacuuuuaagaauaaauaacauagccagguguggucacaugugccugccgucccagcuacucagaaggcugagaugggagcauugcgugaggccaggaguucaaagucagcccgggcaacauagacucugucuguuaaaaaaaaccaaaacacaguagguaaucauuguagauuauuaugguacaguagagaauuaugguaucuacauucugcagagguagauaauauuuagacaugcucaaggcacaggggauuuuuagaaaugaagguaaaauccuuucaugaagcauuuuagccccaaggauuaguucauacugugggucacugaugcuugacuaaugauguagugcacaucucauaguauauauaaaaugcuagcuuguaagagagugguuacuauuguugcuaacaaauguaugcauggccucauauagaaaccauuuuuuucaccuuacuauucagagggucugaagguugugucauguuuuucuuucccugcuuugaagaauaauuucaaauaaaaauuugauaggaaauagugcuaagacugccaaucugccaauaaaaauucccauaagcagggucacuuuaacaauuuuuuuuuuuuuuuuuuuugagauggagucuugcucuaucucccaggcuggagugcaguggcgcgaucucgguucacugcaagcucugccucccggguucacgccauucuccugccucagccuccugaguagcugggacuacaggcgccugccaccacgccuggcuaauuuuuuguauuuuuaguagagacgggguuucaccguguuagccaggauggucucgaucuccugaccucgugauccgcccgccucggccucccagagugcugggauuacaggugugagccaccgugcuuggccccaauauuuuauauuucaaguuuuuaagaaacucuuuuuuaccacuugaguaaauaauguucauuucaguuaaauuaaaagauaaacuauaucaaagaguuuauuuacauuuuauuuuuauuauuuaaaguagacugggcucaguggcucaugcccguaauaccaagcacuuugggaggccaagguggguggaucacuugagcucaggaguucgagaccagccugggcagcaaagugagagccccaucucuauuaaaaaaaaaaaaccacaaaaaacaauuagcuggguaugguggcacugggcugugguccuagcuacuugggaugcugaggugggaggauggcuugagcccgggaggcagagguugcagugagccgagaucaugccauugcacucuugccugggcucagagccagaccuucguaaaaaacaaacaaaaaccuguuaagcauuuuauauguauaaacucuauuuuaaacugacccuugagccauagauauugucauauuuuuaaucuaaucuuuuuuuuuuuuuuuuggauguagggucucacucuguugcccaggccuggagugcaguggcacaaucaugccucacugcaaacuugcaguccugggcucaagugaucuucccaccucagucucccaaaguguugggauugcaagagugagccacugcaccugguuugauuacuaaucauaaucuaguaauacaucauaaggaaauaauccagcccaguauuauuuauaguauaaaaaauuagaaacaacuuaauauggccagcaguuggaaagauuaaguaaauuauaauaauaaaauaugaaauaauuaaaaaggaugauuuuguagauuuguagcaguacagaaaaaugcuuguaggcugggcaugguggcucacacuuguaaucccagcacuuugggaggcugaggugagcggaucgcuugagaccagaaguuccagagcagccugaccaacauggugaaaccccaucucucuaaaaauacaaaaauuagccaggcaugguggugcaugccuguagucccagcuacuggggaggcugagacaugagaaucacuugaacuguggaggcgaagguuacaaugagccgagauugugccacugcauuucagccuggacaacagaguaggacagucucaaaaaaaaagaaaaaugcuuguaacugaaaaauaccauagguaaaauuguacacuaugcagagcaguuggaacucucacacguugcuggugggagugguguagucauuuugggaaacagucuggcaguuucuuauaaaguuaaauuagcagucccguuccuagguguuuaaccauguuaagugagaaccaguguucauauaaaaaacuauaugcaaaugucuacagcagcuuuauucauaauuuucaaaaacuagaaacaacucacauauuccucagauggggagugaaacuaaaguaugguacauuccauacaaugggacacuacucugcaauaaaaaggaauggacuauuaauauacaagaacacggaugaaucucaaaugcauuaugcuaaaugaaagaagccagacucaaaagguuauguacuaucugauuucguuuauauaacacucuagaaaaggcaaaacuaggaauggaaaacugguuugauugguuagcauaagaaaauuugguggggggggguggcaaugucuugaguugguugugacauaucucuuggcauuugucaaaacucuuagaacuguacaccaaaaaagaguaaauauuuuuauuuuuuguuuauugagacagggucucauucuguugcccaggguggagugcaguggugcaaucacggcucacugcagccuugaccugggcucaggugauucucccaccucagccucaccuguagcuaggacuaccacacccugcuacguuuucuauuuuuuguagagacagaguuucaccacuuugcccagacuggucucgaacuccugggcucaagcaaucugucugccuuggccuuccaaaguguuaggauuacaggcaugggccauaucaccuggauguaaauuuuauacagauuuuugaaaugcuuacaaaauagcccuaagagucaacaaaaaauuacaugugaaaaaaaucuauuuuauauauauacuauauauagaguauauauacacuauauauaguauauauauauauauauauauaguaacugaaaauaccauagguauuucacuacccaucugagaaauaugugaguuguuucuaguuuuugaaaauuaugaauaaagcugcuguagauauuugcauauaguuuuuuauaugaacacugguucucacuuaacaugguuaaacaccuaggaaugggacugcuaauuuaacuuuauaagaaacugccagacuguuucccaaaaugacuacaccacucccaccagcaacgugugagaguuccaacugcucugcauaguguacaauuuuaccuaugguauuuuucaguuacaaauauauauacauagguauauauauauauuuuauauauauauuuuauauauuuauauauauuuuauauauauaccuauguauauauauuuguaacugaaauauauauacuauaaaauauauauaguauauacuauauauauuuauauauacuauaaaauauauaguauauauuauauauauuuuauauauaguauauauaguauauauauacuauauauuauauauacacuauauauuuuauauauacuauauauuauauauacacuauauauuuuauauauacuauauauuauauauaguauauauaauauauauacuauauauaauauauaguauauauaauauauaauauauauuuuaaauauauacuauauauauuuuaaauauauacuauauauauuuuaaauauauaguauauauauuauauauauauaguauauauauauauuuuagacggaguccugcucugcauaguguacaauuuuaccuauggcauuuuucaguuacaaauauauauaccuagguagauauauauauaaaaaauacauauaccuagguagauauauauauaaaaaauacauauaccuagguagauauauauauaaaaaauacauauaccuagguagauauauauauaaaaaauacauauaccuagguagauauauauauaaaaaauacauauaccuagguagauauauauauaaaaaauauauauaccuagguagauauauauauuuguaacugaaauauauauacuauaaaauauauauaguauauacuauauauauuuuauaaauauacuauauauaguauauacuauauauauuuauauauacuauauauaguauauauauaaaauauaguauauauuuuauauauauauaaaauauaguauauauaguauauauauuauauauaguauauauaguauguauaguauauauaauauauauaguauauauauuauaaauauauacuauacauacuauauauacuauacauauuuuauauauauacuauacauauuuuauauauauacuauauauauuuuauauauaauauaguauauauauuuuauauguauaguauauauauauauuuuagauggaguccugcucugucacccaggccgaagugcaauggcacgaucucagcucacugcaaccucugccucucggguucaagcaauucuccugcuucagccucccgagcagcugggauuacaggcgucugccacugugccuggcuaauuuuuguauuuuuaguagagaugggguuuuaccauguuagucaggcuggucucaaacuccugaucucaggugauccacccgccuuggccuuccaaacugcuagaauuacaggugugagccaccgugcccggcaaaaauguuuuaaaaaauuauacacaauguuuaacauuauuuuuaaaaaagcacugguaaguaaggcauuaccaaaaugaugacagagguaauacuaagugggauuguagaugaggguuuuccuuuauuaacacuaaauaguuguauuuaauggaucauuuucuuucuuuucuuugcccuuuuuucuuuuugcauuuaccaggucgcagaacccuagcuguaaucacuaaacuugaucucauggaugcggguacugaugccauggauguauugaugggaaggguuauuccagucaaacuuggaauaauuggaguaguuaacagguuagcaguuagaaugggauaagaauugggauaagcauucuuagaaugggauaagcauucucacuucagagcaagucugaauuucuaaaaucuguuugaaaugugaugcuguacuauauuuuuucucccuuuuauuaugaucuugguauugcuaaagaauccguugcccuaaagggagaaaagagagagaauuuuuuuuuuuuuuugaaauagggucucucucuguugccuaggcuggaaugcaguggcgugauuguggcucauuguagcaucaaccucugggcucaagugauccuuucacuucagccuuucaaguagcugagacuauagguguguaucaccacaccuggcuaauuuuaaauuuuuuuguagugacaaggucuugccauguugcccaggcuugucucgacuuccugggcucaagcaauccuccaaccuugguuucccaggugcugggauuacaggcaugagccacugugccugccccauagacauuuuuacuggaaaauguuucuaaaguaagcaauaccacaaaauggaagaaauguuguaauagccaggcuuuaagaauucuugccuaucauguuaagcuauguaugaggagguacuggguaagggaaaaauuaucuaaugugcacccaaucgagaaagaguuuaagguggcaggauuuuaauagauugguuuuaaucccuggcauuagugaugcuucuguguaauugccaggaugugacuuggagaaauuguauuaaagguauccuaauuuauaaauaguugguauuaaaaacugggaaaaggaaacuaguauugagugucuaauuaaaggugacaagauuuuaauagauugguuuaaucccuagcauuagugauucuguguaauugccaggaugugacuuggagaaauuuuauuaaagguauccuaauuauaaauaguugguauuaaaaaucgggaaaaggaaauuauuauugagugucuaauuacguuuuagacacucuacugugagcaauuugcaaaugguaucucuuggaauccucacagcauccccugagguagguguugaugucuauuuuauaaucagaaaccucagguuauacauuuaaccaaaagucacguggguagugaaagagcuggauucggaugaauaucucuuuuaguccaaagccuucauaugguaggaaacacugaaauuaucaugaaaucugaguuauaguccuaguucuuacauaaacuagauacaacguagguuuaaaugacaccuaaugucuuugggucucaagccuuuagaaaaugaaaauguuuuuacugccugauacauaagauccauuccaguugucugcuucuauuuuaauguccuuccauuccaacccuacugucauucucccauccccacugucauucucccauccccacucccaauuccagcugucuccuuuuucagguaaggagguggccuaacacuguucguuguuuguagaugauuguucuucaaguuaacuuaauuauuuuugggagaaauuaguucccuguccauggauaaaauauacaguugacuaagauacucuuauauuuuuauaccugucuauaccuguuacuuauuguuuuugucuauaguuaaugguaauaaugaggccuacucuauuuaggcacuaguuacuuacaauucacuuaguucaagucuuggcuaugccaguuagugugugaccugggguaaguuaguuuuugugagccucaguuccuugcuauacaaugggguaauaauaccugccacauaaaauuauugugagaauuaaauaaaacagucccugucagguauuagagaacaaugccuggugcugucaucaucuaagguaggaagaggacaacaguuaagcugaauaguuucguuauuuuuucaaccucaggagccagcuagauauuaacaacaagaagaguguaacugauucaauccgugaugaguaugcuuuucuucaaaagaaauauccaucucuggccaauagaaauggaacaaaguaucuugcuaggacucuaaacagguaauuuuuuuaccuuuuggaaaugagauguguuuguuuuuaccaauuggugucugagaggguucauuuucaguuccuuacauuuucauacuguuccuaacagcuucacuuaugguuucuuauauaguagguuccugaagaguagaugucucuguuuuuauuggggugguugacauuacaucaucacguagucuagaaugaauguacaagugauuuuaaaauguuuuaauuacgaaaauuuugacaguuaauuuaguuuuguggcuagaacuagagaugacuucauuuccacuuugcauuucaggaacugauuaaaauuuguaauuuucacauuaucuauucuuaccuuagaauguguuuuauuuaccaggaaagggagauggaaaaacaaagaaauagaaugucuuuuauuucuauucacuguagaaauaacuauacguuggauucugaauacccacugauguguggggacuagaagcccuuucuagaugauuuauaaaugacugaaguggaagccauuuucucuuacuuuuaucuuauucccuaaagacugauagacuuggaucuuaauaagguugauuuucacuuugcuggguaccaauuguaaaugacaagucaaugaaaccaaaauuauauaggaagaauugauuggguggcuuauuuucucugugguaauugcaguaauaugaaaauaauuugcauuuuuuccuugcuuuuauuauuuaggaaaaaccaaucaaaauuguuuuuuuccuuuucacacacaguuaaucaguauagcacagaaugcuuuugagagcagauauauggggaguuuuccccauacaucaagcaaggaauucuccaggggauucuagcugaauguccuuuaauucaaugcuaacacuguuuaccuggagauagugucagcgcccacagguugaggguucagucccacaagacugcccccaagucagaugccaguuguaagcacagguuguagccuguguuucugacugacaggcuauaagucaggguacccaugauccccuuuucauguuugaugaauuuguuagaguggcucacagaggucagggaaacacuacuuagcauauacccacuuacuguaaagcauauuacaaaggauauagauaaauagccagaugaagagaugcacagggcugggcaugugggaaggaauguggagcuuccgugcccucucugggcacaccacacuccaggaaccuucauguguucaacucucugaagacuccaugaacuguguccuuuugaguuuuuauggaagcuucauuggccauuggugaucagcucaauguuuggccucucuccucucuucugaggcuguucuggugaccagcucccauccugaagcuaucuagggacccccagccaccagucaucucauuagcaugcagagacacucuaaacacccuuaaugcucuuggagaguccaaggauuuuaggagcugacugccaggaaaugaagacaaagaccaaauauauauuucacaguaucacauuugccaggacaaauuauuugauagguuuuccccauuguaaaaauuugacuuguuuagggcuuuagaauacacaauuuuacuuuuaaauccuuccuuucuaaccuuuuuuagguuacugaugcaucacaucagagauuguuuaccagaguugaaaacaagaauaaauguucuagcugcucaguaucagucucuucuaaauagcuacggugaacccguggaugauaaaagugcuacuuuacuccaacuuauuaccaaauuugccacagaauauuguaacacuauugaaggaacugcaaaauauauugaaacuucggagcuguaaguaagaaauuuuucuguagauuugguuaccuagauugcuaggucacuuuuccuuuugugaagaugacuucagcucagauuaucugauuaagauuuauuuucuauaaaacaaaaauauaacuuuguagagauaauaggaugaugucugguugugugaaaauaugcuuuguaaaugauauaaagcaaaguaaaauugucacauauuuuuaaauauuuuaauauuuuauaaguauuuacuuauuuuuauaaguauuuaauaaguauuaaauauuuuaauaaguauuuaaaaauaauuuagcuuuuaaaguguuuguuucuuuaguacacacaguauaauugcucacaaaaauuagaaaaugcagauaaguaaaaauaaaacauaaaaacaaaauuacauguuggugugcaccuguagucccagcuacucagaaggcugagguaggagaauuccuugagcucaggaguucaaguccagccugggcaacauauugaaauuccauccuuuuuuuuuuuuaauugaauccaaauuuuauuaaggauuucaaguuacauacuucagauuucuagaauggaauggaauaauuuuggaacuggaaaaauggcauaaacacugauaucccuugaaacuucaauuuuauaaagaaaauucuucugcaaaccacauccccauuauauaacaagaccagguauuaucgacaccuucacuuuggcaauaacuauuuccuaaaagaaugaaaaagauuauuuugcuaccucaguucguuaaaaaugggauucuggccaggcacaguggcucaugccuguaaucccagcacuuugggaggcugaggcgggugaaucaccugacaucaguucaagaccagccuggcuaacauggugaaaccccaucucuacuaaaaauacaaaaacuagccgggcgugguggugggcagcuguaaucccagcuacuugggaggcugaggcaggagaauugcuugaacccgugaggcggagguuguggugagccgagauggugccacugcacuccagccugggcaacagagcaagacucugucucaaaaaaaaaaaaaaaaaaaaacagggauucuaucuuuaaaguucagaaaaagcugcauuuagaugaacuacggcuaccaaaacaaacaaaaaaacagagugucuaaucaaagcaaaggaaaugauuuugaaaauagaacaaagcuauuauaauugguuaaggauuuccaguaguaaguuaaaaucucaggagaggaauggauagcauuacaaacaauguguucacauuccaagaccugaacacuaacuucucaaaaaggaaguuuucaucaccucuaaaaaugaauucaauguaauuuuguuaagagcaggaaaucuagaccuuccucuaaugacaauccaauaguccacccucgccaucgucaaaagaaaguugccucaaaauuaacaguaauuagccugagguauuguaaauguggcacuacagucugaaauuuaauggcaucuuuugucaaaaauagucuuaucucuacuuuaaucucaugacuacaauacuaugugcuaucccuguaguauuuacuacuaugcagucauacagaaaaaaauuguuggaccuugugaaauagugcauccaucuacuucuauaaaaauaggagccacauuggccaggcgcaguggcucacgccuguaaucccagcacuuugggaggcugaggcaggcagauuacgaggucgagagaucaagaccauccuggccaauauggugaaaccccaucucuacuaaaaauacaaaaauuagcugggcgugguggcacgugccuguaaucccagcuacuuaggaggcugaggcaggagaaucgcuugaacccaggugguggagguugcagugagcugagaucgcaccacugcacuccagccugggcaacagagagagacucuaucuccaaaaaaaaaaaaaaaaaauauauauauauauauauauauauauaaauuauauuaauuaaauauaaauuaaauauuuaauauauauauaaaaaauaauaauauauauaauaauauauauagaagccacacaaagaucacuaacugauaguuuaguuugauaacuguuuuccaguuuaguugucaaagcauggugugaacaaaaugcugagugucaacacuggcauuacaaauaggcccaaaaugugagcuuuuaaugagaaugagaaacauuuuaugagauuuaacugaauaugccuuaacacauccaugagguaguuaaguaaacaguacuacacauuuuaauacauaguaaacagaagcauggguaagugacauacucauacuucaagcaauaagaauuagaagaaaccacacagaagcuuggggcauucucucuagcucuaccccaaagaaaaugaacuuuaauuuuuuuuuuuaaagcaucguaucacugaagauuuucuucuucuucuucuuuuuuuuuacacuugcuuauuaguauaguaucucuuuccaaagcugguacccuuuucaauaaugugguaaaaacugaguauaacccuuaauucaagcuaggccucuccuucuaccugaauugguacaaaauuaagacaucuuguaagaacuaaaauuguauuugaaauuuuuauuuuaggcuacaaaaacaagcaaacaaacaacaaauaacuugaaaacaggucuugucaaaugauguaaguucauccuuuccagggaagcagaagguagacccuaccacaaagaaaagaugcuuaguuaauggagguuaaauuuaaaaguacagugaaauucaggcuaacuucugaaaaauccuguuuuauucaccucacugugguaccaguaacuauacugagucagguuacuuuacaguuaacuaugucaccuauaacacaauaauccauuaacaaucuaauacaguuauuggguguggucauacuggaaguucuuaaauucuuaaccauauaguugucuugccaauuuuuuuuucuuucagaugagucuugcucagccacccagguuggagugcaguggcacgaucucagcucacugcaaccaccgucucccggguucaagugauucucccaucucagccuccugaguagcugggauuacaggcacccgccaucaugccuggcuaauuuuuguguuuuaguagagacgggguuucaccauguuggucaggcugguguugaacuccugaccucaggugaucugccugccucagccucccaaagugcuaggauugcaggcgugagccaccgcgacuggcaugccgguuuuuuuuuuuuuuuuaaacgauggauugucuuaguacaagucccugcauuucuguaacaaaguaaugaaaggcacagcuaauccaagcagacuuaacccuauucaacaaacagcugaaaaaauacuuugguucuucaaggaaaaaauuacgaaaaaaaaaaguguuuccuuuaacaguuguuaauuuucauagcuguacuccaagagcuauauaaauauuccagaagaaccaaauuauguagcagcgaaugaacaugugugacagaauuugugcauucaacauaccuggcagaaaaacuagugaaaaugcuagguagaacagauuggucuuuaaaauaucaguuuccuguccuuuaaaacaaaaauuacccagucuaccaagaaaauacaaaaacauaaggcaguaaguaagaauuguguuuaggcuaggacagugcagguuauccucaaggccacauauauccugcuucacugcugcuugcacucugcuggguuuugauccuucuucgggucauagucuggaucauuuuccucaucuccuuuguccucuuccucaucugcuucuucaccuucuucaucauacucaucaucaucaucuucaguagcuucuccaguaaacuauaacacugaucuugggauuguaugcucacguaaaaagugaccaauuuugaagucugcagcaaggauagcuucagcaucaucauccagaucuccacucucaggaacuucaggaggggcaagaaaauuaaagaaagagucauuggaaacuguuuuagucacaauacgaauugucccaugucccuaguguuucugcugcugcuuaaugguuuucaaaaugacauucuuuccuuuuuuccaaucuaucuggcccccuguacaacccauaauuucuuguccaucaaaggaaaagugaucagaaucaucugguucugguucuaaccucauccuauaugucuuugucagcacuucauuuguaaaauauuuacuggguucaaauugaaauucuaagacaaaacucauaggcaggccagcaucugagaacuucacuuugguaucuuucacaugcuucagaauagguucaucauguuucugaagcauaucacugagcaagucaacauucuuaaaaacagguaaccaaaauucaggaauuccuuuggggucuucuuuuucuucaucguuuuucucaucuucagucuuggccuuuucuuucaacuccucugaaaucucaucuucuucaucugguuuccauucacauucuuccucuguagguucauaaauuguauuaguaaucucagauugcuuaucaaauagaggcugauagagaacagcauacuuccuuucaagaucgugaacuuccucauagaauuuggcuucuaucugugcaccuuuaacuugcagguuuuugagagcauucacuccucuuuuaacuacccuagcuaggcagguugucaaugucugccauguuguaagaacuccaaauaucaguggcuacuaugagaagccaggcggcuggagcugugcaggcagugacucagggcagcaguggugguggggaggagcaagaggcagcacugcaagcagauggcgcuaaaaaaagagacccuaucucugaaaauggaaaaaaaaaccacucuuaauuucaccaaccugagauaauuccuaaaauuuggcauugaccuaggcauuuuuguaugcaucuacaacacauagaugccuauacuacaugucuuuaaaaaucagaugcuauaccuaucuuggaaucauuucucaaaucauguaacaaauaacuuucugucucauacauuaucagucugaagauuugcauaguauuuuacuuuuuagauauacccucauuuguuaggccagucuccuacuacuggauaguuuguuuucuguuauauacacauauaagcugugauggacuaccugcaucugucuuuggggcuuuguguccaaguaaacacugaggauaaauuuguagaaguaaguuuauuagauuaaaggauauaacauccuuagaaucuuucauuacauauugcauauuguuagcauauuguacuguuuuacuaccagcaagaacauccauuucucuacacccucauuagaacaccuuuuuauuuugaaauaauuauagacucacaggaaguugcagggugauguacagggaggucccaugcacccuccacuguguacccuuucccccaucucccccacuguuggacaucuugcauaacuauaguacaauaacaaagugagaaaauuggacauggguacaauccacagagcuuguucagauuuauacgugaauuuguguguguguguauguguaguucuguauacuuuagugugcccaagauggucuucauaugagucaacuccguaaagagaguauuuaucagacuaauuauugguuauauguacggcauauugagaaaaauagauuaccacaaaugggccuuugaagaguuuaguggguaaaguaggucaagguaauacugggcuugauuaggcugcaaaaguauaacuuuuauuuaaauacuucuuauuguuagauauaauucauauucagaaaaguacauacaguguauaugcacacuuuauaaacaguuaauaaaccaauuaucuguguccaccuaaucaagcguuucagacacugaagagagaccauuuacauuuauuucaggguuugggagaacuccacauuuaagaaggcauuugaauugggcucugaauagaauuugagaaggcaguaaugagagggcauuuuaggcuuggcaacagcaaagaauaaugcaagaauaauguuuuuggagaacagcaaguauagugaugggacauaauaggagauaaggcaggaagggugucuaggaacaagacuguagauacgaaguuuuuucugucuugcucugucgcccaggcuggagugcaguugcgcgaucucggcucacugcaaccucugccucccaaguucaagugauucuccugccucagccucccgaguagcugggacuacaggcgugugccaccacgcccggcuaauuauuuuuuauuuuuuauuuuuauuagagaugagguuucacuguguuagccaggauggucucgaucucaugaacacgugauccaccugcccuggcuucccaaagugcugggauuacaggcaugagccacugugcccagucccccuuuuuuugagacagucucacucuauugcccaaacuggaguguaguggcgugaucucggcucacugcaaacuccaccuccuggguucaagugauucucccgcuucagccucccgaguagcugggauuacaggcgcgcacuacuaugcccggcuaauuuuuuguauuuuuaguagagauggaguuucaccaugcuggccaggcuggucucaaacucccgaccuugugauccgccugccucggccucccaaagugcugggauuacaggcaugagccaccgcgcccagccgaaauucuuaucuauuaagcaauuacucauuccccucuccucccuccagcccugguaaccucuaauuuaauuaauuaauuacuuuauuacuuugagacagagccucacuuuauugccgaggcuggaaugcaguggcacaguuugggccagucucugccucccagguucaagcaaucauccugccucagccuccugaguagcugggacuacaggugcccaccaccacaccuggcuaauuuuuguauuuguuugcauuuuuaguagagacuggguuucaccauguuggccaggcuagucuugaacuccugaccucaggugaucugcccaccucagccuuccaaaguguugggauuacaggugugagccacugugccuggccgaauuuacuuucugucucugaauuugccuauuguagauauuucauauaaauugaaucauucaguauuuguccuuuugugcuuggcuuacuucuguuagcauaauauuagacuaguacuuuuugccugagcuaguauaaaaaaguacucaauagugauuguaaaaauagagaggaagggaugauuuggggaggcauuauaaagguauuuguagaauucagauggacuugaauuuaaaaaaagauaauaccaggguuucuaguuauuaaacaagauaggaaacauaaggugcucaguaacuauaucaagagauuuaauuugucuaaggcugggcgugguggcucaugccuguaaucucagcacuuugggaggccgaggugggcagaucacgaggucaagagaucaagaccauccuggccaacguggugaaaccccgucucuacuaaaaauacaaaaauuaggugggcaugguggcacaugccuguagucccagcuacuugggaggcugaggcaggagaaucgcuugaacccaggaggcggagguugcaguaagccaagagcgcaccacugcacuccagccugggcgacacagcgagacuccgucucaaaaagaaacaaaacaacaaaaaaagagagauuuaauuugucuaaagcaagaguagggcugggcacggguggcucacgccugugaucccagcacuuugggaggucaaggcgggcggaucacuugaggucaggaguuugagacaagccuggcuaacaagcuauacuuauuuauuuacauauugucuauggcugcuuaugugcuuaaugguagaguugaguaguugcagcagagacuguauggccugaaaagccuaaaauacuaugugacccuuuauggaaaaaguuugccaaccucuacuucagauugugaaucaauggaaauaaauauaaggcacuguuuccuguccucaaggaaaacuagggcagagaaaaggugcuuagcaauucuuaguuaacuguugauuuaugucagaacauuuauuauauuuacauauauauaauuuaaugauuccuuuuccccuuuaaaaaaauuagagaaacuaguucauaaugagcugaguuagaacacaugguaaugggaaugaaugaaauuguuuaucugaggcuuucucagaaaauaagaugagcuuaaagcuucuagaaagacuucuaacuuguaucuucuuucccuuuuugcaaugccagaaaccauauacuucauugccuuucagaugcgguggugcuagaauuuguuauauuuuccaugagacuuuugggcgaaccuuagaaucuguugauccacuugguggccuuaacacuauugacauuuugacugccauuagaaaugcuacugugaguauguuuagcuuuuuagacuguaaaaaaaaaugagguuaaaguuuuucuuacccauauacugugucuuuuuaaauuuaauuauacaguuuauuuugcucucauauuugaaauuaaaaagcauuuuucaugaaaaguaccaaaaaugugacuuucuuaacccuugggaagaacugaaauuacauauauaauaagaguucuaaguuuuauuuucucaggguccucguccugcuuuauuugugccugagguuucauuugaguuacuggugaagcggcaaaucaaacgucuagaagagcccagccuccgcuguguggaacugguucaugaggaaaugcaaaggaucauucagcacuguagcaauuacaguacacagguaacggagagaaauguaacagguuucacaugaacuagaaaaggacaugaaguggugguuucacuggguggaaggaaauguauaagaugggauacaagguaaaaucuguaguucccuuaccugaaagugauuugaaauaggauucuuaaauguagucuccaaauugaauucaguauuucugugaucauuaaguaaaagaaaaugacuguuagccuggcaugguggcuucuacauguagucucagcuacuugggaggcuaaggugggaggauggcuuagugagacuaugacuuaaaaaaaaaacaaaaaacaaacacguuuuucuuucaucuaccauuuguaggaauuguuacgauuuccuaaacuucaugaugccauaguugaaguggugacuugucuucuucguaaaagguugccuguuacaaaugaaauggugagcuacuauagcauagaucauuguaauuacuauuaguaaaaguuuaaauuuuugcuuggcugcuuuuuaauaagcauuauaugguuacuuuagaguguaggcauaauguuuuccaguguauugggaggaaaaacaaguugaguuucagucucauuuuaaaggaaaauuuuuaauaauucugguauaaagugcauuuuuucuucauauuuuaaucauuguuagccugcaggcauggguuuucuugaaaauagauuuaugauugaggggugugaauagcuuugcuguauuauuuaguaccacugaucuuaagagaaaauuaguuccaucuuuagccucaguaaacugagcauuuauagcacacuguuacuuugagguacaucggaguaaucuggccacuucugcaguuugcuuguuaugaccuaauaacuauaauaucguaguugcuugcuacuauucuguggguugcugcuauccacacaaauaaaaaugcugaaauuggcagaaauaugggauaagcauuuaaaauugcccucaugccucuaauuguuggcuggguuuuuuguuuuuuguuuucuuucugaucacuaaaagugcauuuggguccuuggcucaggauggugaaccccguggagguuuacuaagaguacaaaaccauccuuggaauguaagugcugcugcuugguuguuucuuuagcaaggauagcccucagauucugaugucuaagacugaauuuagcccagaaucauuggaccuucauuuuaauagacccuuuuuacccaguucuggacugauaagugcuguucugauaccugagauuuguuaggacagcacauaauaaagggcucaaguuuauucucucuguaagacucaguggugugguggcucacaccuguaaucccaacacuuugggaagucgaggcggguggaucacuugaggucggaaguuugagaccagccugaccaacauggagaaacccccucucuacuaaaaauacaaaauuagccgggcgugguggugcaugccuguaaucccagcuacuggggaggcugaggcaggcaggagaaucacuugaaccugggagguggaggcugcggugagccgagaucgcgccauugcacuccagccugggcaaugagagcgaaacuccgucucaaacaaacaaacaaacaaaaagacuuagcaauucuguagagggcuggauaaauuaauuuuaacuuuucuuuuuuauuuuccucuuaggauuuugaacuacauauaauauuuuaacuaggugcuuuauaguuaaggcuaaucagucacuaccucagguccuuagauguauccuuuacccaaauaaguuaacaucuuuaacuuaugccuuguuacgaacuuauuuucuuauuguugaaaaugaacuaaaaaagugacagggaauaguggaugaucugaaguuuuaauagcaaaguugcauaaaguguuggaauuuagauuugcauuagguagaugacuauuuuucccuaagaguaaaauacuuguaguuacuuuaauguuauuuuucccucuuagaaaugcaguuuuagaugcugaaauguaaauaauuuuaaagcuagaguaaauuauuguuuggcauaagauuuaucaguuggaauauaauuaucaaguaauuuaggcauaaguuuccuguacuuuuucgguauugucuguuucauaaguuuuauauauaaauuucucaaaguaaaauaugguugauguauuuuuguauaucgccuaacuuacuuuuuuucuagguccauaacuuaguggcaauugaacuggcuuauaucaacacaaaacauccagacuuugcugaugcuugugggcuaaugaacaauaauauagagguaaauauaauucuuaaaugcuuuuucacagguagaaaaaucuguuguaacucaguuauaucaaacuuauuuagcauggaguaacuauaaaauagacaugugccacauuagugccugcugcaugucaggaaauaugcugaggggauuacauuguuuucuuaauucucaaaaccaccugcaggcauuauuacuuucugcuuaugaaauugaaauucagaaagaaucugaaaauucauugauuuggugugacuggcucuauuuugguaacuuauaguuuauacaggggaaguguguacaacaaaguauuuaaaauucuuuucauuuggcuuugaaagcugugaaggaaacacucaagaauuaaccaacuuagcauaaauuuggaaaagcagagugcuuuuuucaccacuacugggguggcugcauuucauggaucuuuucuuuccuuuugauuuuaauguaacaaauugaauaagaucucagauggagccaaggcugguggacagagcaauuuauccagaagccauuuuuuuucucugccgcuuuucuccaaaaauaguacauuuuucugcuacucccuaauucaguaagaccugaguccccugcuauaccaaauuuccucuucugcauauccauggugagaaaauuguaaacaugcaauucagaagcuggaagggauccuguguuauugacuucaacucugguuaaaacagaugggguggccagacgugguggcucaugccuguaaucccagcaauuugggaggucaaggcagguggaucaccugacaucaggaguuugagaccagccuggccaacauggugaaaccccgucucuacuaaaaauacaaaaaauuagccgggcuugguggcaggugccuguaaucugagcuacuagggaggcugaggcaggagaaucaacuugaacccaggagguggagguugcagugagcugagaucgcgccauugcacuccagccugggcaacaagggcgaaacuccaucuuaaaaaaaaacuggggagcuugaggcuuacagauagcaguuauuccuuuggugcuuauuuugcagggcacuauuauaggaagcaagcaccuucuuaacacagguauagggaacuaauuuuugguuacauagcugggggugauuccuguuaucagaaaaaauuccaaaaugcauacaugaguaggcacuucaaaacacucagaaaguaggccagaucacaguuauguuaaaaauuagcauguagacacuuaaaggauuuaguuuuuuuuacauugaaacuaacaucaugaaaaacuuguguuugcgguaguucuguuacacugacaaggucauaugugauaugauuucagauuaguauuuuucuacaaaugaauagguuucugguuuuaaugacugugccagagaacuuuauguggauauuuucauuuaaucuuuaccauacccugagggcagaucaugucauuaacagauuaggacacuagggcuucaaaauaguugguaagcuguccaguuagcaaagcagguacuccacaucugcugggguccaggagcagcucagaucauaacugguuaguaacagacuagggugagaauucuagauaccguggccuuuugcuuuguaucccuguucaaaauguacauuuuaucaugcuaauuuuuuauuuugaagauuguuaauaucuauacuuuuauuaucuguuauuuuuuauuacugaauacccgcccaugaaaaaauaaaauugggucaaauuucugucaaaaaaaauuauuacacaugaaacaucacugugggcugugugcgguggcucaugccuguaaucccagcacuuugguaggccgaggcaggcugaucaccugaggucaggaguucaagucuagccuggccaacguggcaaaacugucucuacuaaaaauagaaaaauuagccgggggugguggaugccuguaaucccagcuaguagggaggcugcagcagggagaauccauugaauccaggaggcggagguugcagugagccaagaucacaccacugcacuccagccugggcgacagagcgagacuccauuucaacaaaaaacaaaaacaaaaucauugugaggcuuuaacuuauauuuuuuugcaaguuggacuguguucaugaaauacuuccuacuuaggagcaauugugacuuuaaccuaaauaguuucuacuuuaucugaugcugccugugagagauccaucauuaauuaacaucuacagauuucuauaucuucauaaucuuuuuuuuuuuuuuuuuuuuuuaagacagagucucacucugucgcccaggcuggagugcaguggcaugagcucugcucacugcaaccucugccuccuggguucaagcaguucuccugccgcagccuccugaguagcugggauuacaggugugcggcaccaugccuggcuaauuuuuauauuuuuaguagagacaggguuucaccauuuuggccaggcuggucuugaacugcccucaagugaucugcccaccuuggccucccaaagugcugggauuacaagcaugaggcacugugcccggccaauauuuucauaaucuuuuaccuaucuuggugcuuggauauagcagaugcucgggacauucuaauuugaauuugucaguuucuuuagcuuuguacaaguuacuuugauaauauuagcaaauuagaacaguaggcaauugaucaguguguuaaauuagccagguuacagaaaggacuagcaguugucaacacuauuuccuggaggaagaaauggaacauuuuuauaggauaaccucaaccacagauacuucuucaagauacgguuuuaugaggggaguuguuugaguuuaacacaaagguguucagguuagagugacuuuuaaaggcuuugcggaguuuucugugaucucuggacuucaaauuccacaugguuauguugaaggcuuaccacguuccacauuuaugugaggacaguuuacaucacuguuucuuagugggaaagggggagaagauggcagucuguugccccucauuugagaauccccaguacagggagccacuguuacugacaguguauuguauccuucaggugugugggcagaaaaaaaaaagauuaagaagcuuuggguuaaaugauuucuuauuuauuuuaaaauaugauaauuauggcaugagucccaacagugagaggauguaucuguaaguuacuccacacuuuucaauuaacaugaacauuuuuuaguaggcauauaucucaauacuuggauaaucacuuuuguuuugcuuguguuucuuaggaacaaaggagaaacaggcuagccagagaauuaccuucagcuguaucacgagacaagguaaaaaaauguuuuuaaugcauauucccaauaccuaaagauagauugaugagcucagaauauuacucaguccuaggaguaauuuuuucuucuuuuccucccuuuaacacuccauuggaacuaacugaguaaaggcauacaaguuuaaaauggguuuugagugauuuaaagauaauaguauuuugaauucacugacauaaaugcuuaaaaguagauuuaagcauuuauuuaagcauuuaagcaucaagcuuuuuaaaaaaauucagucagugacuuuaucaacuuugcacauagcugaaaugacucaagauuuuauuauaauaagaggguuucuuggaaaaaacaguaugcacagaacagagguuuuaauuacuaguaauaauuaaaauaguuguaauacuaaaguguguauaaaaaucuuuuaccuugaauucuuugccagaaaagaaucuuauuaaauaccaaaaauaaaaaugaagcuuuuggauuuggauuuuucuuauguauucaucugaaggaaacuuuuaacaaaggugacaauggugaaggaaauaaggcagaauaaacaaucucccaugauuauuuucaucuuucauguuauuuuacgauuucauuacagaagggaaaaauucauuuauagaauguuccugaaugcauuuuugcauccuugauuuuuuuuccccccuggauuuuuugccuuuagucuucuaaaguuccaagugcuuuggcaccugccucccaggagcccucccccgcugcuucugcugaggcugauggcaaggucuguucugauucuuaaucuaagccugcaugccuuguucucugguacaacauaaucuucuggaaacaauacacugaauagaagaauauuaauaugggauacugugcuaaggucagaucacuuuagucuaauauauauuuuaaaauuauauaacaaugcaaugcauaguuuauauuguugacaugcuuuugcuugcaauauagaagaugcacacagaaaaaguaauuuaaagaggaaauuauccugcacuuuuugaauuucaacccauugguauuuaaauuuugcuuguuaaauugcauguuuuaacauaucuuuuaacaguuaauucaggacagcagaagagaaacuaaaaaugugagucucuugcuucagaauggaaauguugguaccuuugguucucacugaaacacugucuauaccaccauuaaagaaccuguuuguguagugguaucuaucucuugucuguguuauguucuuaauguuccuuuuaucuaaccuguggaagauggcauuaaacguuguuuuaauuaguaacaauaauaggcuuucucacuguuuuguuaccuucaagaauaguuuuaaauuuaguauuuugguaggaaauucagagauuuccuagauuucagagauggaauuguauuuuuggacauuuccuuuccucuuuaaagaucuugagaucuguucaguacuaauagaucuaaugcuucuuucuuaugcuuccaguuaguuugcacuuguuacccuauauauagcuucacauaugcuucagaagcuuaagcaaauuaaaaaaacaaauggggacugugagaguuugagacuguuuucaauucuugauaaccauuuuagaggaaaauuaaauaauguauaaauuauucagacucaucgcuauuucaagauuuucugccauuuagcuccuuuccuuaauuauccagauuuaaaguucugaacuucaaauaaagguuuauaaaugucuuaucuucucucagcccacugugcucagauauuaaucaaaccaucuaaaucacugcacaaguuuuauuucauucaugacgucacacugaaugugcucucucuccuuaagauuucauuugguaugucauucauguauaguuaacaaacauuuaaaaaucuaauuacucauuuuuaaguuaauguguaacauaaauauacuacuuauauuuaaauguaguucaccuuaacugacauacuaaagacagauuuuagcaaauauuuugauucagaaugauaccucaaacuaccauuuuucuaacugccauaauccucuauuaaacuuauauaauccauuuuuagauuguaagaucuuaaagaauaccuaaaaaaaacccucuuaaauguugaugaauuguuuuuccauuauaaagucauuuuugacuuuuagaagucaagacuaauacauuuucuagaaaacaagguacaaaagcacuugugauuaaugguagcacuagauuucuuucagcaaauccuuaagaguacagagguugaggggacuucuguuguuugucacauuccgcauuugaaacaacucacagugacugucagccuaagaauagcaaauguagucuugcuuuuuguuaaagaguucuuacuuauaccuuauggcauuuuuguugacuauuagaaauguaaauugagaaacauauaaacucuuaaguucagagacguaaguucauggaacuuuuagaguuuaacaguguuaaugauuacuuaagaaauuaaacugaauagcaguucuuugugcuuuuaacgaguaguuuuguuuuuaagggcagcauauacuuuuccuacaauuuaguguuugaagggugggagaagaggaacgauuuugaaaaguuagcgaaugauaaagaaaaaaggaauuaaauagaacauaaguugguugaugccuugcaaacaacuuagagcagaacuucuuuauuauuuagauaggucaggguuccaguuauacaugcuaccuagugucuccuucugaccucauuaucugucugaauaaacuucagauggguacuggauguauauugacuacugucaaauaaaaugaacuuuguuuuaguuaaggucagauaugaugugguugguauguuuuggaacauguuuuuucagguugcaucuggagguggugggguuggagaugguguucaagaaccaaccacaggcaacuggagaggaaugcugaaaacuucaaaagcugaagaguuauuagcagaagaaaaaucaaaacccauuccaauuaugccagccaguccacaaaaaggucaugccgugaaccugcuagaugugguaagccaugacaauuugguuuagguaauaagguaggugaccaaguuaguaggaaaacgauuagacagaaagaacuaaaagucucaaaaacuuacauaacuuucagauguuaaagcugccauuuuagugucacaaaaguaauauuuuuucccccucaucccuauuuagccaguuccuguugcacgaaaacuaucugcucgggaacagcgagauugugagguuauugaacgacucauuaaaucauauuuucucauugucagaaagaauauucaagacagguuaguauuacuuaauauaaaugacggacuuuaauacuucuggaugauucugugaucuguuuugaaaaauacauguauuuuuacaauuuuagguuuuuauucuaaaucaucaaguggauuuucugauaguccuuggguaacuuguagcaagacccauuuuguuaacauagaaugacuaggaccucauguaucagcuagaaaaagcuauuaaaaaugagagauucuuuuguucuaucuggcugccacauuuugagucauuuaagaaaaucuuuuuccuaaauuuuaauuuaguaguuucauuaauuauuuuggcuaguaacacugacuugccuuuuuaauuuaacuugguuuuccaaaguaucaaaacgaaugucuuuuacuaggaaauauguguauuuuuucucguucagaauguuuuuucaugugucuagucccuacugcaucuucuccuucauguugccugguaugucauuucaugcaguaauagggagaauauacauuuaguugugugaagugaucuauuagaaaauauucugcauccaguuuuugguaaucugucagcagcuaagaugaauuuuacugcacagaguaauaaacagucuaauacuucauauugaaauaaaugauuuuugucuguagaaccauuuaucuuuuuugcuuguagacuuuuuaaacccguagcuuguaguagaaauaacaguuccuaguguuuuacacugugggccugaagaaaaaaauuccauuuguuuccuuccuugcccccauccucugcagaagguguuuuugagauggagucucgcuuugucgcccaggcuggggugcaguggcgcagucuuggcccacuucaaccucugccuucuggguucaagcgauucuccugccucagccuccugaguagcugggauaacaggugugcaccaccaugcccagcuaauuuuuguauuuuuaguagagacggguuucaccauguuggccaggcuggucucgaacuccugacgucaggugaucuaccugucuuggccucccaaagugcugggauuauaggcgugagccacugcacccggcucacuuaauguuuuuaagccucauccauacuguaguaugaaucaguauagucacgcaccacauaacauuuuagucaacagaccacguauuugaauguguucccguuagauuaugauaccauguuuuugcuguacauuuccuauguuuagauacacaaauacuauuguguuacaguucccuauucaguacaguaacaugcuguacauguuugcagccuggagcaauaggcuaucccauauagcuuaggcgugucauaggcuauaccaucuacguuuguguaaguacacucugugcugugcauguaaugaaaucaccuaauaaugcauuucucaaagcauauccgugucauuaagugacauaucuuuugugugaauaauacuagauuauguagauauacuguguuuaagcauucaucagcugauguuuggauuuuucucacuucuuggcuauuaugaauaaaugcuuauugaagaguuuugaaauaaagaugaugaaaagaagguaaaguaucaagaauuguugcuuuuguuuuuuuuuuugagacacagucucacucuguugcccaggcuggagugcaguggcgcguucuuggcucacugcaaucuccaccuccuggguucaagugauucucguaucucagccucccgaguagcugggaucacaggcaugugccaccacacucagcuaauuuuuuauuuuuagugcagacgguguuucaccauguuggccaggcugcugucaaacuccuggccucaagcaguccacccgcgucagccucccagagugcugggauuacaggcaugagccacugcgccuggccgagaacugcuuuucuuaauguuuaauuacaguuaagcaaaaaucuaaagggcgauuaugccauuaaugaaauauccaaaguaguaguguucuuacuuaacuuuauuucaugagguuagcaucuaagcccaaauuguuaaaaguagaauuuuggcuaaaauuccauaauuugguuguguuuugcagugugccaaaggcaguaaugcauuuuuugguuaaucaugugaaagacacucuucagagugagcuaguaggccagcuguauaaaucauccuuauuggaugaucuucugacagaaucugaggacauggcacagcgcaggaaagaagcagcugauaugcuaaagguauuguggaccuuuugauuuuuuauacuuggguaguagauagaaacauagaaauaguuuuaaaugcaguuugauucuuggauauguauagucuuuauauucuagcuaggcuuguuuccuguugguacuugauaagaaucuuuuuuuuuuuuuuuuuuuuuuuuugagugggagucuggcucugucgcccaggcuggagugcaguggcacaaucucggcucacugcaagcgccgccucccagguucacgccauucuccugccucagccucccgaguagcugggacuacaggcgcccaccaccacacccagcuaauuuuuuguauuuuuaguagagacgggguuucaccauguuagccaggauagucucuaacuccugaccucaugauccgcccgccucgaccucccaaagugcugggauuacaggcaugagccacugcgccuggccgguacuugauuagauucuaauuccagagaagauauugguuaguauaaacugguuaguuauaaaccuaccacauauauauuggaaaaauuacccugcguaauucagauuaauuucauaacuuuauaauaagcauuuaaaauuuuuuuuccuuuaaugcaggcauuacaaggagccagucaaauuauugcugaaauccgggagacucaucuuuggugaagagaacuauguaauacugagacuuuguugacucaaaacuugcuaguuacugccuaccugaguagaaucuuauuuaugaacuccuguguauugcaaugguaugaaucugcucauguggagacuggcuauaaacugaaaaguguauuccaaauugcagaacacaucacacauuuaauccaaauaauaaauggcuguuucuaaaguuucccaguauauauaaaauacaucaagucugucuugugacaguuucaucugaacuuaacuuaaaaacaacuguuaauguucuaguugugcaaagcaguuugccuguggauaagaugaccuguguaauaaucuuuguuaguagucuuaaagcugcugccauaguccuccaagaagaaagcaccaagacaacauuucauaugacuauaaugcauguacuauauaagcugaucuggcuuugaaagaugugaguuggcaaguuccucacauagagucauuguauuccaccuguccuucaauuuaguuuuuucugagcuucuuugcagccuuugauguguuuuuaagaaagcugaaugcacaagaggaucugugacacugacauggcuguggugugcauacuguguaguuacauagcccuuccaauucuggguccauuugcacuagcaaauuaaaauaugcuuugauucauacuuaaaccugaaagcaggaaugccuacauuaauuccuacauuaaaaacagccaucuacccuugauuaucuagaaagacuugguaaugauggucaguuccuuuuagauuucagaaaaucaaaugaugaccuaaauuucccuuaauuugcaaauacaguaguaauuaagguacaucucuaaaguggagcacuuacaccaggcucuaagauucacuuugagguggaacuuaaaaccaguguacuguauguaugcauugguaauagcuacuuuugcuucauagcuucauaccaacaaaauauauuuauuagaauaguaugaaaguacuggaggagcugaaagaaaaacacccaaggcugggcgugguggcacacgccuguaaucccagcacuuugggaggccgaggcagguggaucaccugagguugggaguuggagaccagcuugaccaacauggagaaaccccgucucuacuaaaaauacaaaauuggccgggcgugguggcgcaugccuguaaucccagcuacucgggagggugaggcaggagaauugcuugacccugggagguggagguuguggugagcuaagaucgugccauugcacuccagccuuggcaacaagagcgaaacuccgucucaaaaaaaaaaaauaaaacaacacccagauagauacacauacuccuucagacuuacagaccuaagcugcauuuaugggguagugaugagguuuagaacauauacauauuuuguuaaaauuccccagaugauucuugguaugaacgacuauauuauaaauuuuaagauguacuuagaaauccuuaagacaucuagccccgucucuaauagacaacacauuuauauugcagauauuacuuuuuuuucaguuuaugaccagguauuuaugaaggacuauuggcagggaaaauaugaauauguuaacuuuagcuuauggcaucaauuuacuaaggaacaacaggcucaccaacugaugucaaacauaaaaacccccacaucagucugauacgauaugguacuacuuugaaucuguuacuaguaccaucuugacagaggauacaugcucccaaaacguuuguuaccacacuuaaaaaucacugccaucauuaagcaucaguuucaaaauuauagccauucaugauuuacuuuuuccagaugacuaucauuauucuaguccuuugaauuuguaaggggaaaaaaaacaaaaacaaaaacuuacgaugcacuuuucuccagcacaucagauuucaaauugaaaauuaaagacaugcuaugguaaugcacuugcuaguacuacacacuuuguacaacaaaaaacagaggcaagaaacaacggaaagagaaaagccuuccuuuguuggcccuuaaacugagucaagaucugaaauguagagaugaucucugacgauaccuguauguucuuauuguguaaauaaaauugcugguaugaaaugacacuaaaguuugucaaaaaaugaauucuuaacuuuucucccagagaaagggagacaaaaggagcuuuuuaauaccuaaucuacuuuggaacauaaccguauagag

SEQ ID NO: 192608 - RNA, 38246 nt, Homo sapiens
caggcggcccgcggggcggcggcgggaggaugccucgcgcccugccuaggcguuaacggccucagcgcgucccgggccgcgccgggaacgccugagagccgagcccgcgcugaccggggcccgggccggaugggcgcugcgggccggggcgcggaccgcggagcggccgugaguacgggcgggccuggcugcagcugcgcgggcgguuacuuuguggccacccaaggauacuguggcugcgggcgggcccgggaagcaccuguugggcguccgggcgggcgggggcgcgagcagggcgggccugugacuuuuuuguuccguuuuggauuuugauuuguugauauugggcucacuccguuuuggcacagacaacaacgccuaaucuuugauucccccgccguuucuucucuccaccucccccgcugucccucuucucccgccccgccgugaaaagauagggaaaauggacaagaucccugauuuuuggauuuuccuuccuuaaaaaauacagccucaacugggcaaggaaaugagggcaaaagaggucuccuaggaauguuuaucagaaaggcggaaaagcuuuucaaguagccacauaaagaucaugacuaaaauggagcguccucgguauuuaccacuuguggcauagguuucguuaacagagauugcaaaagccugagcuucagagaucuaaacaggguccgccucccccaugcuuggcucugauugacaucuuugauguccaaauuaugugcugaauucuaaggauggaaaaaaggcugagauucuauuuuaggcagauaaugaacauggaagacaucaauuuccccgccccacgcuuuuucuguuccguugcauuucuucuuccucuaucuaaaacauacccaccuuaaccugauguuuccuuugcuaagaauguuauucuucccacccaccagccccugacacuccuaauucccuacucaggucccaagacuagguuuaccaccacuggggagacuuuccaggcaccucaccugagcaagcuauagaugugacaaauguuugcugagccccugccaggugccaggagcugugcuuaauccugaugucauuuugucuuacaaucaugcacuggucccccucagggcucuugcgaggcaaugguaguggcauguuugaggaauaagaggaucuccaggaccuucaugguguuuccucuugggcccuacaggguagagucucaucuacuugugggaaccccuacggguugggcccauauugagcauuuauauaauaacugagcgcucuuaauuaccaaucugagcaauagucuucuuuuaaaauaacuucuuauuuuggaaaaacuuuaaauuuacauaaagguugcaaagauaguacagacaaucccaauauauccuacacccagugcucccuauccuuaccccauccuacacugcugugguacacuugccaauaugaaaaacaccugggugcauucuugucacuaaacuguggguauuaagccuuuucaccuuugaaucacuguaauuuauaaagccauuucucuguuuguuucuuuguuugagacagggucucacucuugcucaggauggagugcaguggcacaaacacgacucacugcaaccuccacauccugagcccaagugauccucuugccucagccucccauguagcuaggacuacaggugcacaccaccaugacugguuaacuuuacauuuuuuuuuguagagacuggggucucacuuaauguuucccaggcuggucuugaacuccuaggcucaagugauccaccugccucagccuccugaaguguugggauuacaggcuugagcugcuauaccucaccauaaagcuauuuucuuuagguugagagcaguguuccucuaacaucuguucuugauucuugccugucuucacuaaguuccaccagcaccugugucaaggggcagggaugcaggaaaagggaaagaggcuacccuauagguuuuuuccuuuuuucuuucuuuuuuuguugguuuguuuugguuuguuuauuucaacaaacaaauugguuuuuugagacaaggucucauucugucacccaggcuggaguauaauggcacugucuccacucacugcagccucaaccuccuagguucaagccauccaccugccuucugaguagcuggaaacacaggcacacaccaccauacccagcuaauuuuuugauuuuucuguagagacaggaucucacucuguugcuggucucaaacuccugagcugaagcgauccuccccccuugccucccaaagugcugagauuauaggugugagccaccacccccaguuaguuuuguuuuguuacuuuauuuguuuauuuuuugagacagagucucgcucugucucacccaggcuggagugcaguggcaugaucucggcucacugcagccuccaccuccaggguuaagcgauucuccugucucagccucccgaguagcugggauuacaggcaugugccaccacacccagcuaauuuuguauuuuuaguagagacaggguuucaccauguugcccaggcuggucucaaacucuugaccucagaugaucugccaccccucagccucccaaaguggugggauuacagguguaagccacagugcccagccuuguuuuguuauauuagagagacagagucuugcuuugucacucaagccugggguacaguggcacaaucauagcucacugcagccucaaccucuugggcucaagcaauccuacagccucagccuucugaguagcugggacugugggugugcaccaccaugcccagcuauauaaaaaaaaaauuuuuuuugguagauaugagguuugggguucucacuguguugcccagguugaucucaaacuccuggccucaagugauccuccagucucagccucccgauguguugggauuuacaggugugagcccagccuaccuugcaguuuguuuguuuguuuuuguuguuguuguuauuuuugagacagagucccacucugucgccaggcuggagugcaguggcgugaucucggcucagugcagccuccgccucccggguucaagcgauucuccugucucagccuccugaguagcugggacuacaggcacccgccacaacagccagcuaauuuuuguauuuuuaauagagacgggguuucaccagguuggccaggauggccucaaucuccugaccucaagugauccgccugccucggccucccaaagugcugggauuacaggcgugagccaccgcgccuggccaacccuguaguuuuaacauauuugucuccauggaagacuaauaaacaaaauuguuuugaauaugaagaagcaauagaagccccccugcuuucaaacuguucugugaugcuuuucauuagaguuaaaugaaguugacguaaauguuuuuaaguaguuagaucuaauaaucagugaaagcucuagggagugggaauuuugacaagagauuugagcggagguugaagaaaguucucaauagccaagacauagagggcuaaggguuuuuggagcaagcagugcgagauagauucaggaaagaagucaagagggugaaaucgauuccgccagcaaaugccaggacguuacaccugcuauacagaugcugaguaccaaaaaccuguuggcaggugagaguaaaauggaaauccuggagccaaccacuguugcccacaccccagaaagggguuaggagccguuauucaccccauugcucaguaggcccucuggcaccugcagggccuugggccggggccgggauuccugguggggcuugugaggugcuugcugagccccugccguccuguaacagugacacaugcuccugccguaaggcccuggucagacaccuaaacugugcccaaggaucaucccccuuaacaucucaugugacucugacugcccuguaaauugcacguuaccccacuuuacaaagaagguagcagaacuuggcuucaggucccagagccaacaaacacguggcacauuuugcaucaaagccugggaagccucucaaagcaagucagacccucuuucaccuuuguccugggggugaugacaucccuguugccaaaccucaccuacucccucccucguggugccaccugccuucucagcagcauuggcauauacccccgccacccaaacgcuucccccucaccuuuucugguuccucuuuguguaucuguuuuuuuuuuuuuuuuuccccccuucucuugccccaagacagggccuuuaaugucugaugagacuuuauuuagcaugaggguaaauaaaguaguuuuuaagauucucaaccucuuuucuucuaucucaauccagucuucugggugugguacccacucuuucaaccuaacaaggcuaguguugcacauaguuccuacaccuccccuuuucuuucuuuuuuuuuuuugacacagggucucacucugucauccaggcuggagugcaguggcgaucaccucagccucccgaguagcugggacgacaggcacgugccaccacaccugguuaauuuuuaaauuuuuuuuuagagacggguuuucgccauguugcccaggcuggucucgaacuccugaccucagaugauccucccaccuuggccucuuaaagugcugggauuacaggcaugagucaccaugcacagcccccucuucuuguuguuagcaagaaagcaccucuacugggaugugucccagggccuugguugugggaaacuuuguuacuaaugguagaaaaaaaaauguaguacagguucuuugaaaagaagcgcucaguacaagcacauuaucaguagucucaggagaggugguagagguaguacuugagcacaggugggaggagagauggaggagagagccuggagggccgaggcaccuggggccacugggcaauggaggagccaggccccuuggguuccccagagagcaggggcugguggggagucuacagagggccauggagcuuugucucagggcagccauauaggugguuugaugcugucagugagucccauugugcaccuaggcugcaguuccugaaauguggaggggagcuuuuccuccuguaaugcaaguagggaggaaguggauguguguggauggaagcuggaauugccaaaggcaaauuguacccaugcuguugcccuuuguuguaaauuuuuccagaccuuuccacaccugugacuucauguacuaugugagaguuugaauagucagugugggccagaugcuguagcucacgccuguaaucccaacacuuugggaggccaaggcggguggaucacuugaggucaggaguucaaggcaagccuggccaacauggugaaaccccaucucuacuaaaaauacaaacuuagccaggcauggugggaggugccuguagucccagcuauuugggagacugaggcacaagaauugcuugaauccaggaggcggaggcugcagugagccaagaucgugcuacugcacuccagccugggagacagagcgagacucuggaagccccaugauggaaaugucccugauguguguuuaucagugcauuuggccagucucuuuugguuaaacuuuguuguuguuguugcuuuuguugagaaggagucucgcucuguugcccaggcuggaguacaguggcacaaucuuggcucaccacaaccucugccucccggguucaagcaguucucccgccucagccucccuaguagcugagacuaaaggugcccaccaccacaccgagcuaauuuuuguauuuuuaguagagacgagguuucaccauguugguuggccaggcuggucucgaucuccagaccucaggugaucugcccaucucggccuccuaaagugcugggauuacagaugugagccaccgugcuagccucuauugguuaaacuugaggugguuucuaaucuuuuauuacaggcaguauuauuauaggaugauauuuuguuauuucagguaauaacugcuuuuauccaguuauuuugcacaugugcaucagccaaaggugaacuccccagaugaacccccauccagggcugugcuccuaggaauguuguggguguugccaaauggcuggaucacagagcaccuucaccagugguguugucaacuucuuaaauuuuuaaauuuaauuuauuauuuguagagacugucucgcucugucgcccagccuggagugcaguggugugaucauggcucacagcaaccuugaccuccuggccucaagugauccucccaucucagccucccaaguagcugggacuacaggugcacacccagcucauuuuuuuuuuuuuuuuuagagaugggggucuugcuguguuggccaggcugaucuugaacuccuggccucaaguaaucuucccaccuuggccucccaaaacacugggauuacaggcaugggccaccccugaccuuaucaacuuuuuuuuugagauaagaucguacucugucaccaaugcuggagugcaguggugugaucucggcucacugcaaccucucccuccugggccuaagugauucuccugccuuagccuuccaaguagcuggcaccacagucaugcaccaccaugcccggcuaauuuuuuuuuuuuuucuucaggauggaguuuugcucuuguugcccaggcuggaguacaauggcgcaaucucagcuaacugcaaucucugccuccuggguucaagcaauucuccugccucagccucccaaguagcuggcauuacaggcacacaccaccaugcccggcuaauuuuuguauuuuuaguagagaugggguuucaccauguuggccaggcuggucuagaacuccugacuucaggugauccacccgccucggccucccaaagugcugggauuacaggcgugagccagugugccugggcuuuuguauuuuuuuguagagacgggguuucaccauguugcccaagcuggucucaaacuccuggacucaagcgaugcacccaccuuggguucccaaagugcugggauuacaggugugagccaccacgccuggccuaacuuuuaaaaaaaucauugccaaccugcuaaguguuagacaguaugagugugccuucagaguugaacaucuacuugcauguuccaccuuggacaccgugguccaagguggggagacucuggcuuugaauccagcuucacaggucacuggcugugcaaccuugggugcucagguaaccuuuuuggacuucgguuuccccaugugcaucguggggcuaauaaggacacgcaucucuuagaacugcuguuaaucgugcgauucuuguauggugagcaguguaggacagggcugguguuggcuugccaaggcucugggagccgcugcacguccuuuuccaggagcuggugguuuuauccguuguccauucccuccgugauggcgguggccuuuucaucuuucuaaucccaaggacggugccuugccagugaggggugggagaggcaaagcuaaaagcagggaggccuccuccauggagaggaggggaaggaagggguggccgagugggagcggagguggagaagcuguggggacggcuggccgggcaggugacaccaccaccucucaccgcucaucccucuccucccuaaagagguggaccaugauauccugguuccacuuucuuuaugaauccuggcugaacauggcggggccacaugagcacuguuccuuccccgcucucccuggcauucuguccaccuggcacaccagccccuucaucgccacgcccagcagacgccccaguucuccuccagcuuugcagccucugacccugacgcacuggcuuccguaucugccugaggccuccuuuccaucucgggacacccuggagggcuccccggggaaguaauggggaugggacccacacucaccugccaggugguggcagugccaggggguagguggagcagccuggggauugaggggaacaggcuguccucuacacaggugccccagggauggggcgacgacccaguggggugguugaaaaagugaagggggcaccccagucugcacuccaucccaugaagugucagaagcugcuugguuuuguuugcuuccucaguguguuugucuuuagaagugugcuaccggcaccauauggacaugggccugauucacauucucuuaaaauaauuuuacaggcuuauuuuaggagagaaauuucuggauuccagaaaauuguuuuugcucuaaaaacauaccccacauuaaugucuauuuggggggauggauggcagcugcccuccaaacguggggacacacaguguccgagaguggagaugauuuuccuggugaauugcccagcauuuuccuuucaguuacuuacuucagggugguuccuuauuugccaauagaucuuguaaaagcccauuuacauugguuguuuccaaacuuggccauggguuccccagugcaacaguggaucugucauuuaaagccaaguuaaaacuuaacaugacaugccucucagugaccacaaauacagcccuggccacuacugccaggaccccuuugagggcuagugacaaggguugccaucaggacugagaccacaugaagcgcacgggaggcaucugugcagugaccagacucaaggcaggagacagggacagggacuugggggacauuugggacccagggcagcaggcucuucagguaagauugccuugggggcggggcuguauaaugaaggucuccaaauaaagcccaugcgaagugugcuugggaaacagcaagccuguuuugguuggaaacaaggcuuuuuguaauuagcggugcccucaguguuuacucugcagagcccuaggcacucugguccaggaagaguuaguagcguccucugcaucccacuggggaugugugacacucagagaaaccacaagguggaggcgagagcugagaucugagcuugucgcugcaucugucugccucacagcugggaggcucagccaguggcacuugcuguggggacagcccaggugcaggaaggggccagcaagggagggcagcaggcugggcuacagccaccaggggugguaucuccacugagaguuacaggcuuugagcaaauagagaacaguuacagcauggaggacccugggguaacacaggacccugauggggacgcaccgcuuccuccugccuggaacacugguggucagaggguccccucccuccuggggacuggacuguccuccgcugaugcuccucccucucaggccaggugggaccgagagcggagagcaccugugcucuggauugaguacccgccugugggacugugguggccgcuagcgggcagggaugccuauuucucaggauguugugagaauucaacggccugagaauuugccgacccuaaggugcagaugcaugauguaaagggcaaacgccugucuuuggcaacauucuugucauucugggggccuugcgccugaauagaugagauuccuuccuggaaccuucugggaccagcuuggggccacagcaggcugcggcugguccuuccuggacagcgcuggcagggcccuggcuugugcacugcucuuuggggaccaugguccuagacccuggggacaugugggucugggugaggugaaucugcagcugcccgcaccccacggccccugcccgcagagacuccuuggugcccauggguccauguuuuuaacaagcuuaccaguguuuaguggccauuucucauaucaaguacugauguuucuuuuuuuggacacggucucggucuguugcccaggcuggagugcaggggcaccaucacggcucaccauagccucgaccuccccggcuuaagcaauccuccaguuucagccucuggaguagcugggaccacaggcaugugccaccgugcccggcuauuuuuuuuuuuuuuuccuuugguagagacagggucucacuaucuugccugggcuggucucgaacuccugggcucaagugauccuccugcccuggcuuccaaaagugcugggaugacaggcgugagcugcugcacccggccgcaguagugauguuucaacccccauuuacuuuugcugucuccgugugaggauuccccugauacauauucauucccuagauauuuaagugccuuucaggggccaggacacuagucagugauuuuuuuucuaccaucuagauuuaauaaaaccacccaagugacuuuaaaauuuuaucauuuuaggcugggcacaguggcucacaccuguaaucccagcacuuugggaggccgaggcaggcggauaaugaggucaggagaucgagaccagccgaggcaagauagugagacccugucucuaccaaagaauacaaaaaauacaaaaaauuagccgggugugguggcgggugccuguagucccagcuacuugggaggcugaggcaggagaauggcaugaacccgggagauggagcuugcauugagccgagauugcaccacugcacuccagccugggcgacagagugagacuccgucucaaaaaaaaaaaaaaaaauuaccauuuuagggccagguaugguggcucaugccuguaaucccaacacuuugugaggcugaggcaggugggucacuugaggucaggaggucgagaccagccuggacaacauggugaaagcccaucuuuacuaaaaaaauauaaaauuagccgggcaugauggcacaugccuguaaucccagcuacuugggaggcugaggcaggagaaucacuugaacccgggaggcagagguugcagugagccgagauugcaccauugcacucgagccugggcggaaagagcgaaaguccauuucaaaaaaaaaaaagaaagaaaaaguaaaauaaaauuuuauuuucuuaggcuggugcaaugguucaugccucuaaucccagcacuuugggaggccaagguggguggauggcccgagccaggaguuugagaccagucugggcaacauagugaaaccuugucucuacaaaaaauacagaaaugaaccaagugugguggcgcacaccugucaucccagcuacuugggaggcugagguacaagaaucacuugaacccggaaggcagagguugcagugagcugagauuaugccacugcacuccagccugggcaacagagugagacccugucucaaaacaaaaacaaaaaaaaaaaaaaagaaaaaaauuuuuuaaugaacuauuuuuuuccccccaggaugaggucuugcuuuguuacccaugcuggagugcaguggugcgaucauggcucacagcaaccuccaucucccgaguucaagcuauucuccugccucagccuccugaguagcugggauugcaggugcccgccaccacgcauggcuaauuuuaguauuuuuaguagagaugggguuucaccacguuggccaggccggucucaaacuccugaccucaugauuugccugccuuggccucccaaagugcugagauuauaggugugagccaccaugcccagccuuaaugaacuauuucauaauuacaaaauacuaaauuauuuaagcagagugugaugagguuugaaggagguacacggagccugugccuguggaauguuccugaggucaagaggaacugcugcugugcugucccuggagugggacuggggcucugggaugggagacucacuuuucacucaauggaagauccuuuugccaucucaagacauacaugguacguacagaugagaaaugaagauuaauaaaauggacauguguauacccaacagcagcuuaaaaaauaaaaucccaggccaggcgugguggcucacaccuguaaucccagcacuuugggaggccaaggcggguggaucaccugaggucaggaguuggagaccagccuggccaacauggugaaacccugucucuacuaaaaauacaaaaaaucagcugggcgugaugacgugcaccuguagacccagcuacucaggaggcuuaggcaggagaaucguuugaaccugggaggcagagguugcagugaguccagccuggggaacagaaugagacuccgucucaaaaaaaaaaaaauuaauuaaaauaaaauaaaauuccagcuaggcacaguggcucacaccuguaauccuagcacuuugggaggcugaggugguggaucaccugaggucaggaguuugagaccaaccuggcuaacauggcaaaacccugucucuccuaaaaaugcaaaaauuagcugaauguaauggccugcaccuguaaucccagcuacucuggaggcugaggcaggagaauggcuugaacccaggaggcagagacugcagugaaccgagaucgcgccacugcacuccagccuggaugacagagugagugagacucuguuucaaaaaauauuaacuaaaaucccccaccaggugcagugugcacuucuguagucccagcuacuugggagguugaggcaggagaaucgcuugaacacaggaggcagaggcugcagugagccgagaucacgccacugcacuccagccuggaugacagagugagacucugucucaaaaaaacaauuaauuaaauaaaauccccugccaggcgcaccacucacugcuguagucccagcaacucgggaggcugagguggggagaucgcuugaacccaggaguucugggcuguaaugugcuaugcaguucaguuguccacacuaaguuaggcaucaauauggugaccucccaggagcaggggaccaccagguugccuaaagaggggugaacaggccuaaguugaaaacaaagcaggucaaaacucccauguugaucaguaguggcaucgugccuguaaauagccacugcacuccagccugggcagcauauuuaaaaaaaaauuaauuaaaaaaaaauaaucccccagaagucguugccaccccuuccugcccaggguccucacuuccugugcucuuacuccuaacacagguguccuuuguggaaggacaagcgaugugcaccaguguuggccccagagguuacggacuguggggugggggcuugcguuuucucccaaaagaugaucugcaguuaggcauucauggcauuuagaaauucaaaauaaacaaaacccuuggcaaauggccacuuguuuuguuuuuuuuuugcccccgagacagagucucacucuguugccuaggcuggaaugcaguggcacgaugucggcucacugcaaucuccgucucccagguucgagugauucuccuggcucagcccccugaaguagcugggauuacaggcaugcaccaccaugccuggcuauuuuuuuguauuuuuaguagagacagguguuuuuugguuuugggguuuuuuugagaacgagucucacucuguugcccaggcuggagugcaguggcgugaucucggcuuacugcaaccuccaucuccaggguucaagcauuucuucugccucagccucccaaguagcugggacuacaggcacgugccaccacaucuggcuaauuuuguauuuuuaguagagaugggguuucaccauauuggccaggcuggucuugaacuccugaccuugugaucugccugccuuggccuccgaaagugcugggauuacaagcaugagccaccgcgcuggccaaauggccacuuuuugaagugcuuucccuguauguguauaccauguucucuuuauggacuacuauuuagccuuaaaaaaagacaagggaauucuguaguaggcaacaacauggauguaccuugaagacauuaugugcucagugaaauaagccagguauggacaaacacugcaugauucugcuuacaugagguaucuagagaagucaaauucauggaaucaaacaucaggaugguagcugccaggggcuugguggaggaggaaaugggaauuuauuaauccacaggcauaaaguuucagguaaggaagaugaacgagcccuagagaucugcuguccauuguaccgagagucuacaauguucuguccacuuaaaauguguucaggacaaacagcaauuaaagaaaaaaaaauguugggccgggcacaguggcucaggccuguaaucccagcccuuuggaaggccaaagcagguggaucacuugaggucaggaguuggagaccggccuagccaacauggcgaaaccucuucucuacuaaaaauauaaaaauuagccagucauggugaugugcaccuguaauccaaacuacucaggaggcugaggcaggagaaucgcuugaacccaggagguggagguugcagugagccaagaucacgccacuguacuccagccugagugacagaacgagacucugucucaaaaaaaaaaaaaaaagaaaaaaaggcugggcaugguggcucacugcuguaaucucagcacuuugggaggcugcggcgggcagaucacgaggucaggagauuuagaccauccuggcuaacauggugaaaccucaucucuacuaaaaauacacacaaaaaaaauuagccgggcgugguggcacacgccuguaaucccagcuacucaggaggcugaggcuugaacccaggaggcggagguugcacugagcugagauugugccacugcacuccagccugggcaacagugcgagacucuguccuccccucccccccccaaaaaacccaaaauguuggccagguacaguggcucacaccuguaaucccagcacuuugggaggcugaggcagacagaucacuugaggccaggaguuugagaccagccuggccaacauggugaaacaccaucucuacuaaaaauacaaaaaaauuagcugggugugguggugugcaccuguagucccagcuacucugguggcugaggcaggagaauugcuugaacccagaaggcaggguuugcaguaagcugagaucacaccacugcacuccagucugagugacagagcaagacucucaaaaaaaaaaaaaaaaacaaaaucggccaggcaugguggcucaugccuauaaucccagcacuuugggaagccguggugggugggaggccaaggcggguggaucaugugaggucaggaguuugagaccagccuggccaacauggugaagccccaucucuacuaaaaauacaaaauuagcugggcaugguggugcaugccuguaggcccagcuacucaggaggcugaggcaggaaaauugcuugaacccaggagguggaggcugcagugagucgaaaucaugccauugcacuccagccugggugacagagugagacugucucaaaaaaucgcagucaggugugguggcugaugccuguaaucccagcacuuugggaggcuggggcgguuagaucacuugaacccaggcguuugagaccagcuuggguaacaaagugagaccccaucucuacaacaaaaaaauuagccaggcgugguggcaugggccuguagugucagcuacuugggaggcugagcugggaggauugcuugagcccaggaggucaaggcugcagugagcugugugaccaugccacugcacuccggccucggcaacagacugagaccuugucucacacacaaaaaagugauacugcuuuuuuuuuuuuuuuuuuuuugauacagagucucgcucugucacccaggcuagagugcauuggugcuaugucaguucacugcaaccucugccucccagguucaagugauucuccugccucagccucccaaguagcugggauuacaggcacucaccaccacgccuggcuaauuuuuuuuuuuuuuuuugagauggagucucgcucugucacccacgcuggagugcaguggugcgaucuuggcucccugcaaccuccgccccccagguucaaacgauucucccaccucagccuccugaguagcugggauuacaggugcgcuguaauuuuuguauuuuuaguagagacggguuucaccaucuuggccaggcuggucuugaacuccugaccucaugauccacccgccugggccucccaaagugcugggauuccaggcgugagccaccgcguccggccgccuggcuaauuuuuguauuuucaauagagacgggguuucgccauguuguccagacuggucucgagcuccugaccucaagugauccuccugccucacccucccaaaguguugggauuacaggcauaagucaccgccccuggcugauacuacuuauuuuaaaaugaugaacaaagugaagggcaguuucuguagcucucuacuugagucacuuggagcagggauucugaacgcuagagaccugaauacccaguuugugaauaaguuuccugucucucucuuagcugcuucacuucauauucuuaguaucuuuguuaaagggaaguccagggaaagaagagagaaaugaaaguuuauuaauuuaagucucauuuuaguaacaagaaacuuaguugaaaauaucacagagauugaacaugaguucaguaagaagugaagucagaacgcuuccuuccaugaacuggugcaacaugcauggauuugaaugagcuacugacaaguugucacaugacauccucgugcaccgugugggacauguggacaggagagcagagguggaaguggugcugggcuccuggagggugguggccgagcugauaccuguccccaugaccuccccagggcaugucagcaaguuucauggaagagaugccagauggaagagauggcaggguucagauucaugaagggcccaguaguucagggcaauagauaagaucuaauaaaauguacuguguuaacgcuaaaugugaggucuucuugauucuaagaaacccaagagaaaauuucaggauuggcacaagaugacuuaauagcagcuaguaagaaaaagaguuuaagguuuggggaaaucacccaucaggaauauccaauauaggcagacuuuuucagaaauucuuuaacauaauauuggagaaagaaauggacuucauuuagaagaugguguguguguguguguguguguauuuacacguguauaccuuuguacagaaauuuccuccacaaaauuccugcuagaugaagucaucucuguugauaaaugugaugaacuguugauuuuguuaaugaaaucggauucagcuugguuucucuucuccugcagaugugcuugguccagcaguauuccccugggaacuguucuccaggcgcugcagagcuccucugugcugucuguauccaccuguggucuguuuccgggcucucuuucaugucacauugaccuguuuuuguaucuuaugccagucuuuuuucuuuuauuuauuuauuuauauuauuauuuuuuuuugauggagccucgcucuguugcccaggcuggagugcaguggugcgaucucagcucacugcaagcuccaccuccugaguucacgccauucuccugccucagccucccaaguagcugggacuacaggugcccaccaccacgccccacuaauuuuuuuuguauuuuuaguagagaugggguuucauuguguuagccaggauggucuccaucuccugaccucaugauccacccgccuuggccucccaaagugcugggauuacaggcaugagccacugcacccagacucagacucuuuguuguuguuguuguuguuuuguuuuuguuuuuuuuuuuuuuugagacagagucucacucauuaccuaggcuaaguccaguggcacaaucucugcucauugcagccucgaccccuugggcucaagcaauccucccacuucagccucccuaguagcugggaccacagacacgugacgccacacuuggcuaauugaaaaacacuuuuuuugcguagagacagggucucacuguugcacaggcuggucucaaacuccugggcucaagcaauccuccugccuuggccucccaaagugcugggaugacaagugugagccacuauguccagccuuugccccacuucuugaaagauauuuucacugaauguaaaaucugagauaucaguuauuaucuuucagaaucauaauugucccuuucucugcugccuuuugggcucuuguuuuaccugggagcuuguucuguugaacaggucauuuuuccuuccucuggacacuuuuaagacuuuuuuccccuuuaucuuugguguuuugcaguuucauuauuugucuagcuguggcuuuauuuuuauuuauccugcuuuaggacuguugggcuuuuuaagucuguggauuaguagcuuuuccuuaauucuggagaauccacaaucaucaauuauucacaaagcgccucuaccccauuuucuucuugccucaaccuucugaaauccaaauaaaugucaucucucccugcuucacaucucuuaguuuaagacucauauuuccaccuuccucacuguuuuuuuguuuuuuuuuuuuuuuugagacggacuauugcucuguuacccaaggcuggagugcaguggcgcaaucucagcucacugcaaccuccgccucccggguucaagcaacucuccugccucagccuccugaguagcugagacuacaggcagacaccaccacgcccggcuaauuuuuguauuuuuaguagagacgggguuucaccguguuggccaggcuggucucgaacuccugaccuugugauccgccccccgcccccccagccccggccucccaaagugcugggauuacaggcgugagccagcgcgcccggccucucgcucuucuuuauucagcauaauuuauucugacguaucuucaguguagguauucucuuuuuauucuccuauuccuguuaaacccauugggcugaaugcuguuuauuucuagaaugucuacaccuguuuuucugcaaggucauuuuuuuucucguuugcuguugguuacauauacucucaagcucaucgguucccuccgugaguacagguaaguggaggagccucauggucugccucaggucuuugagauguugagucucuggaucugguccugcugcuggccuuuucuguccuugcucauggggcauuguuucugugaaugugugguuacuuuugacugcauuacucauuguccuggaaaaaugacuuugugggaauuuuucagaucuaggauaaagaugcuuccuccaaacuagguuuacgcuuccuucugccagguaccucagggcgcugucagccuaaagccaauuuaaacuaaauccaucaacugugagcuuuuggaaucuucucacuggugugaauuugggccauaaguccugugagggcuguccuaugaucacugcucugugggguggggaccagccuuagaguucucaucggaagcccgggguggcuggaugggggcagauguuuucagggcaagagcggcuuggcucgccucucugguuucugguuuccccagauggugccuggcggcuccucacugucuugucagccccuggaugccuuuaagaaaacauccuuuuauuuugucagcauuuuugguacuucucagugggagggcugguccaaguauuuggcuuaucauaguuuuacaaaaaguugguuucuaugaaaucuuaagucaccucuuuuuuaaaaauguaacuuuuagucugggcgcgguggcucacuccuguaaucccagcacucugggaagccggggcaggcagaucacuugaggccaggaauuugagaccagccuggacaacauggugaaaccccaucucuacuaaaaauacaaaaauuagucagguguagggccaggcgcaguggcucacgccuguaaucccagcacuuugggaggccaaggcagguggaucaacucagguugggaguuugagaccagccugaccaacauggagaaaccccgucuuuacuaaaaauacaaaauuagcugggugugguggcgcaugccuguaaucccagugcucgugaggcugagacaggagaaucacuugaacccgggagguggagguuguggugagccaagaucgugccauugcacuccagccugggcaauaagagcgaaacucugucucaaaaaaaaaaaaaaaaaaagaaaagaaaaagaaaaauuaggugugguggcacgugccaguagucccagcuacucaggaggcugaggcaggagaaucacuugaacccgggaggcggagguugcagugagcgcagauggugccaucgcacuccagccugggcgacagagauuccaucucaaaaaaauaaaaaaaauaaaaaaucuaccuuuuauguuuuuuauuugaacuauacauaguaagcagcgugggguuuuuuuguuuguuuguuuguuguuguuguuuuuucuugagauggagucucacucugucuccaggcuggagugcaguggugcaaucucggcucacugcagccuccgccucccggguucaagugauucuccugcuucagccucccgaguagcugguacuacaggcgcacgccaccacgcccagcuaauauuuguauuuuuaauagagacgggguuuucaccauguuggccaggauggucucgaacuccugaccuggcgaucugcccgccucagccucccaaagugcugggauuacagaugugagccaccacacccagccuuaauaguuuuuuugucuaguuacacuuuuucuuuuagagaacuugaaacccauuaaugcacauguacauacauaauccacacauauauguauauguauguguguguguguauauggcauauccauuuauccacauacuauacauacaugccuuacacuauaguuuccugaagcuuacaucacaggcacagucauguccacauuccaguaaugcuuaucauuccacgaccgauauggcuuaauguaugcuuuaguuuucagaauauaucacuuacuccuacgaaucaguaaggaaaggaccagcagcuaauagaaaaugugacaaagauuugaaaaggaggaaucauaaaaggugcccaccuguauggucagguugaagcaaauuaaagccacaaugagaugcugcugccuuauaccugccaggcagcagaaguguuaaaauuugaccauaucaaguuggcgggauaaagaucagcagggacucauguucgcugcuggcaggaugaccuugucaccggcacuugggaggugcugcugugugcacgggcaucugcuccugggauuguuccaacgaaacaccugccugugcggcucaggagaggugacagcgacagcagcaccauuuaguagccagccugggagccgauacacauccacaccccgucaguggcugcaugcaguguaucugacgggacaccaggugaagggggcccagcugcacauggggacagaggcagacuuggcugcacgucagcagagaagucucacagcaucgucggugucaaguucaaaacacggaacacgcagcaguguggcucagggccacacacggggcacagccaucaggacaagcaaagaccaagaagcaccaaguccaaguuaggcagcaucucaggccggggcaccaaggaagggcacagcagcgccguggugaccgggucccaguaccauccuggguggccgccaccggccguuugugucuuccguucacacgauuacaaacgcugcguucugcccacacacaucuucagucccagaugugagaaggugacccucuaaugcaggcgugccugcgcagguggggggcagacgccguccugggugucaucccauggaagggcacaggacaggcugcugccggagcagaggucacaugggguggggggcgguggggggugcaucucaggaggagcaggugugaggacacugcuggcgcuuggcucuucuucccagccccgugcucucgaauuuggggaaacccuugcucuucuguuuggccugaaagaaaauccggugugccugacucucugcaggccccuugucacaggccaggcugggguggugccaccaggaaaacuuggcgcacguccuguugcugaugauggcagcaucagucauggacuuaaccuucuuuuguuaaugagaccuuagaaauguaaaaaugauacacucuucuuuaaaauaauuguagucaguacacauaacucuuaccaucuuaaccauuucuaaguguacaguucagugacauuaaauauauucacauuuuuguacagccaucgccacccuccaaccuccagaauucuucauguugcaaaacugaaacacugcacccaugaagcggggacuccccugccccuggcagcucuuucugucucugagucccacuacucuaaguaccucauacaauauuuguccuuugugacuggcuuacuucacugagcauaguguccucaggguuccuccaugcuguagcugugacaggagcccccuccuguuaaaggcuggauaacauuccacuguaugcagacgccacauuuugaucaugagaaugcccguuuguggagggacacacuguugcuucccccucguggcuguuguggauaaugucgcugugagcaugggugugcagacauggcuuugagacccuguuuucaguucucguggauuuauacccagcaguggaauugcuggagcccaugguaauucuauauuucguuuuuugaggaauuaccauacuguuucccauagugccuccagcauuuuacauuuuuacccucaaugcacaaggcuccaauuccuccacauccucaccaacgcuuauuuuccgugugugcgcguugauaguagccguccuagagggugugugguggugucucaacgugguccuugucugccucccucaggaucagugacauggagcaccuuuucacgugcuugugggccaucuguauaucuucuucggagaaauguuuauauaaguccuuuguccauuuuuaaucagauugggguuguuuuguugaguuguaggaguuucuuaaauauauucuaauaacuauauagaauauagauauauagguccuuuguccauuuuuuaaucagauuguguuucuuuuugcugaguuuuuuuuaacauauucuaacaacuagaauauauagagaauauagauacauagguccuuuauccauuuuccuuuuuuuuuuuuuuuugagauguagucucacucugucgcccaggcuggagugcagugauauggucucggcucacugcaaccgcugccuccuggguucaagcaauucugcugccucggccucccaaguagcugggacuacaagcacccgccaccacgcccggcuaauuuuuuguauuuuuaguagagacgggguuucgccauguugacuaggguggucucgaucuccugaccuagugauccaccuucuucggccucccauaaugcugggauuacaggcgugagccaccacgccgggcccauacccggcccuuuauccauuuuuuaaccuguuuguuugauuugcugaguuguaguuguuuuuuuuuuuuuuuuuuacauauuccaauaacuaggauauauagagaauauggauauauagagaauauguauagagagaauauagaauauauguauucuagauauuaacaccuuaucagguauaugauuuaaaaauauuuucccucauucucuggguugccucuguugauaguauccuuugaagcacaaaaguuuuuauuuauuuauuuagagacaggguuucacucuguugcucaggcuggagugcaguuggacgaucucagcucacuugagccucaacuucccaggcucaagccauccucccaccucagcuaucccaaguagcugggaccacaggcacagggaccacacccagcuaauuuuguguauuuuuaguugagaugagguauugcuuuguugcccaggcugguuuugaguuccugggcucaagugguccacccaccucagccucccaaagugcugggaccacaggcgugagcacugcaccgagccagaaguuuugaauuuuuacgaagucuaaugugucuguuuuucuuuugcugcccaugcuuuugguaucguauccaagagaugauugccacauccaaugucaugaagcuuuuccccuguguuuccuucuaagaguuuuauagucuuagcucucacauuuaggucuuuuauuuugaguuaauuuguauacgguguuagguaagaguccaacuuuauauuuuugcagguggauauccaguuguugugacaccauuuguugaaagacuguccuuuccccauugaauggucuugacacccuguugaagaucaugugaccauacauaaggguuuauuucaggacuggaauuucuuaaagauuaaauaauacuggauccaucacucacauuccucaauguccuggugcucugcguggugaauucccggauucgggguggggugcauccagcccugccaccgggcccacucaccgggcgucuugguucugccucuccuuucauguuuccaaagccaaaccugguauaagaagaauuugaaucaauguuuuucucaaauuauuugcauguaaaaggaguucauuuuuucacuuccaacuaaauguaaagugguuaagcaguggcauggugucaguguucauuuugucuacaauugauacuaaagaguuggaucuuggucaggcgcaguggugcuuguaaucccagcacuuugggaggccaggcuugguggcguguuccuguaaucccagcuacucagaggcugagguagaagaaucgcuugaacccaggaggaggagguugcagcgagcugagauugcgccacugcacuccagccugggcaacagagugagacuccaucucaaaaaaaaaaaaaaauucuaguccugccacccccccaccccgcguguugcuucacaacacaugaaucccauauguaccugcuucacacgcauguucucucuguaacccaccacuuugucugauugguuggcagguuacguuuuucucucgucccagcuguguggacagugccacacgcccuccuggacaacgacggcucuugcgugcauuuuccaguguugcuuuugucagagaggccagcagagccacgguucuuccagaaccagcccugagcugagugaggagugcccaggagagauggugaaaaugacaaaguccaaaacuuuccaagcguaucugccgaacugucaccgaacguacagcuguauccacugcagagcacaccuggccaaucaugacgagcucaucuccaaggcaaguggcuuaugccaaaaaauugauggcacaaugauuaucugucauugugguaccuacauaguggaagaauauuuaagcaucacaugacuuccugagucugcuguguccugaacgucuagagccuucuaggcagcauuggugagcguuuugugcaugguuaaguguggcugugccacgaucucagaugugauccuggcauggugggcgguuuuccagggccaggcagcuggcacucccagggauuacgaggggcaaggugaaucacuuguuacucacagcagaaagccagagaggacugaaugagcaaaagaagucuagaaaaaucuguggaaaugguuuaauaauaaggguauuaagacauuuuaaaaacucagcaugguuaagaaggaaagggguugcucagaaaaaugccccagaggguguggcugcguuugucgguuguguaggagcccugggugaagcucuggcuggucucugugcauagaacccaugagcagccuugaagauguaaacaagauccccuggccccuccuuacugugcugagcuccucauuagcaguguguggcguugaucaucaaccaguugugaacauuuaaacaggccaaacaucauggaggagcugaugcucagucggaaugacaguguucuccacccauccucaggucaugacauccccccagccucaggucaugaacuccccgcauccucauacgucaugaccaccgauccucaggucaugaccucccacauccucacaggucaugaccucccccaugcucaauucaugacuugcacccauccucacggaucauuaccuccacucauccuuauaggucaugaccuccccccauccucacaggccaugaccuccccccauccucaggucaugacgucuccccaucuucacaggucacgaccacuuugggaacaaaguuugucaggaaguugugccuuucagaaaucuuuucuucuuuuuuuaaauagguauuuuauuuacuuuuauuuuuucuuguagagacaggguuuuaccauguugccaaggcuggucuuguacuccuggccucaagcgauccuccugccuuggccucccaaagugcugggauuauaggugugagucaccacgcccagccaggaaucucuuagguuuccuguuuaacucaagagaagaacauuuaccugcuuguauuuucaguagguaauagugagaggcuccucauuucuguucaucaucugagauagaaacuguugaacgaggcagaguuucugcucucucauugccucuggggcuccugugugcacugggaagugugaggugagaaguggaaggagccaggcaccccauuuccucgguguuuucugagguaggcuuaguguguaaaaugacaugagguaaugagaggcggagcugcucugggccccuggguaggggcagugaagcuuguggccuuguggagccccgugacaccuguguguuggccaugaccuaagcaggugaccugagcacugagagguggucaauguccggccccaugcaugguuuuguuucggaagcaugccagguguguuccuugcuacauggucaaaaggaauuugagaugcuucuguugaacagccuggaggucaucaaugagcuguuuuaaaaauuguaucagcugggcgugguggcucaccccuguaaucccagcacuuugggagaccgaggugggcggaucacuugaggucaggaguuugagaccagaccagccugaccaacauggagaaaccccgucucuacuaaaaaaaauacaaaauuagccgggugugguggcacaugccuguaaucccagcuacuugggaggcugaggcaggagaaucguuugaaccugggaggcggagguugcagugagucgagaucgcgccauugcacuccagccugggcaacaagagcgaaacucugucuuaaaaaaaaaaaaaaaaaaaaaaauuguaucaagaauagaagccuggcugggcuugguggcuuacaccuguaaucccagaacuuuggaaggccaagauggguggaucacuugaggucaggaguucaagaccagcauggccaacaugguaaaacacugucucuauuaauaaaguacaaaaaaauuagcugggcaugguggcacacaccuguaaucccagcuauuugggagacugagacaugagaauugcuucaaccugggaggcagagguugcagugagcugagaucacaccacugcacuccagccugggugacagaguaagacucugucucaaaaaaaaaaaaaaaaaaaaaaggcagaagccugcucagaagucauuuggugccaaaugagcauuucaggaugaaaaaaagugcugagaacuaagcucucugagcacacaggccaccaggaaggaucagaccucgugccuccaugggugaugggccgggcgagguggcaagaugacgacuagagugagcuuuucucccuuccguggugauucugaugaggauucauugagaccaucgagaacaccugccacgcagaacagaauccaguaccugcgaggcgagaggcacugucuucacagccucuaaguuuguauuugucacuaacaaggaauccccuggcucgagggagccuguugcugcuguaggcagcucugguuacuagaaggcuccauuuaguuagcaaacucugaucugugguccaaaucugccacaccaccuguuuaugcaaaguuuuaauagaucacagcugugcucaucuguuuacagaguaauuagaacagggaccauauguccuccaaagccuaaacuacuuaucuccuggcccuaauuuacaggaggaguuugcuggcgccaacucugauaagacagcucugaaucugaaucacagagcugcucuugucucugagccaaacccuauuuaaaaauaaggacuuucagaguaggugagaauuaggaaauucaguccagaauauugaagacugaugaggaugugggaaaagucuauaagaugauuauuaguuaaacugaacauagaauaauauuccuaaucccagaaugccacuuaagggaauacucauuuuuaagccugaaugcugaggaaaaagagccuccccagaucucaacagcuuaaaacacagguuuaguucaugcucaggugagaagucuaccagggacaacugggggcucuuguuuuuuguuguugcuguuguuguuguuugagauggagccuugcuuugucgcccaggcuagagugcaguggugccaucuccacucacugcaaccucugucucccggguucaagcaagucuucugucucagccuucugaguagcugggacuacaggugugcgccaccacaccaggcuaauuuuuuguauuuuuaguagaggggguuucaccauguuguccaggcuggucucgaacuccuggccucaagugauccucccacuuuggccuccgaaagugcugggauuauaggcaugaggcacugugccagguccuuuuaauuuuuuuuaaauuauauaauauugcacauaaucacauuaaaauaauguguauguguaaacgaggagacuugcuucuuccuccugccuuguccggcuccauuccuuggagaugucacuguuaguaguuuggcaucuguugucuuuauuuuguuuuaauagaaacacauuuuucacuuuaaauaaagggcucaaaugacacucacuuuacagcuaacuuuuccucacuuaguauuuuaugacuuuuaugacuauuuuuauuuuuauuuauuuauuuauuuauuuuuagacagggcuucuccugucacccaggcuggaguacaauggcauaaucucagcucacugcaaccuccaccucucgugcucaagcgauucuccugccucagccucccaaguagcugggaguacaggcucacagccaccaugcccugcuaauuuuuauauuuuuuguagggacaggguuuugccauguugccuagccuggucuugaacuccugaccucaggugauccacccacccuggccucucaaagugcugggauuacagccauggugccuagccuaugacuguuuuuccauaucugcuccuaccuucccauccccugcaugaggcccauaugcggaugcaguugcuuacucacuuauggaugaguaccugacuuccagguuaaauuuuuuuuucuuuuuuuuuuuuuugugagacggagccugacucgguagcccagucuggagugcaguggcgcgaucucggcucacugcaaccucugccucccgggucccgguucaagcaauucuccugccucagccuccugaguagcugggauuauaggcacgcaccaccaugcccagcuaauuuuuguauuuuuaguagggacgggguuucaccauguuggccaggcuggucuugaacuccugaacuugugaucugccugccucagccuugcaaaguacugggauuacaggcaugaaccaccgcgcccagccuuucuuaaaauuuuuuuugaggcagaguuucacucuagucgcccaagcuggagugcaauggcgcgaucuuggcucacugcaaccucccccucccagguucaagcaauucuccugccucagcuuccugaguagcugggaauacaggcacccuccaccaugcccagcuaauuuuuauauuuuuaucagagacgggauuucuccauguuggccaggcuugucuuaaaauccugaccucaggugauccacccaccucggccccccaaagugcugggauuacaugcgugagccaccgcgccuggccuauuuauguuuuuuagaggcagguucuugcucugucccccaggcuggagugcagugguguaaucauggcucucgaacuccugagcucaagcaauccuccugccucagcccguuuuuguuguuguuguuguuuguuuuccuaauuaugaacacuguaaccugugaccauuccugucacauuuccuuauacacucaagcugguuuguuguuuacaguaaauucuuagaagugggacugcuggguccuauagugugugcuuuuuccacuucgauauugucaaaucguguuucagucacauuccucauagccuuuugccuuuguuaggucaaaaaccccaaaaaagggcugggcauggugguucaugccugccaauacaaaaccaucuuuguuuuauacagaaauguugcuuuccuguuuucuuuccaaugaaauuuagauaugaaaaucugacagcguacaucauguaugacauaugcgguuuccuuugugggagugguauugagcgagcaucucuuaccagcucaccuaagacauuuuuaaaugacagccuccauuauaaacuguaauguaagccaggcgcaguggcucacgccugcaaucccgucacuuggggaggccgaagcaggcagauuacuucaguccaggaguucgaaaccagccuggccaacauggcgaaacccuaucucuaaaauauccuaucucuaaaaauacaaaaauuagcugggccuaguggcacgugccuguaguccuagcuacuggagaggcugaggcaggagaauugcuugaacccuggaggcagaggcugcagugaguccagauggugccacugcacuccagccugagugacaaagugacacuccaucucaaaaccccaacuccccccaaaauuuuugauuugguuugcauuucuuugauuauguuugaggucgauugagacuugaggcuggcacuggagcaggcguucccaccugucccgugagggcaaaggucguggggagugaccaagugcaucagggggugcagaugcccuauucuggcucuuucacgcucagccaucuuagcauacgugaauauaccaugagcuguuucucagcuuguuuuauuuuccuggugagauagaugucacuggaauggccuuucuccaagugaaaggccaucuugugcuaugacuuuuuuuuuuuuuuuuuuuucgagacgggguuucacucuuguugcccaggcuggagugcaguggcgcaaucuuggcucacuguagccuccaccucccggguuuaagugauucuccuauuuuagccacccaaguagcugggguuacuggugcccgccaccacgcccagcuaacuuuuguauuuuuaguagagacaggguuucaccauguuggccaggcuggucucaaacuccugaccucaggugaucugcccaccucagccuuccaaagcgcugggauuacaggcgugagccgccauacucagccaugcugugacuuuuaaaacauuucagugggaaaauauggacaccucccccuacccccuaauaucuggcagcgugagcacaucugaacugcugcagaagaggcggcgaggagagcauuuugaggaucuguggguuuucggguagagaaaaucauucgugauccccucucagaacuccucuaagguaaaguuguccagacauaugaagcucaccauuuaaaaacugaucuugccaugauucccaauaauagucacuugcagaauguugacgcagcagaaucagccacuccugucuacaaugaaaaacagcuugcagcuccguuaaguggcuguuauuagaaguggaguucuggaggggggacgccggugucugcucccggugacgcgucccggcgcagcuaacagccgcggggcuggacuccccugguucugggcagcaccgcuucguuccagaaagcacucgcagccaaucucacgggaccuucuucuuucaguccuuucaggggagccagggacgcgccuaccucuucaauuccgugugaguacccugguucagcccggggggagcggcacgggcccugggacggccuggauggcaccuacacagugcccuguguagaaucaccugggucuuuagggguccugaaagaacccaccauccccccgccgggaguuucugaaacgcgcuaaggaucuugcccccuagccugucccaucacugaucuuucccauugauggugguggcgggcagggcugggggagaggcacggcacugcucucugggaguuucccuguuuugggggaacucuuaggaggaugggguggggcccgcugagggggcagggccuggucaggggcgggccgggccugcagcgcaguggccccucuguccccgcagggugaacgugggcugcggcccugcagaggagaggguccuucucaccgggcugcaugcgguugccgacaucuacugcgagaacugcaagaccacgcucggguggaaauacgugagugccacaaggggaugcucgugccacaaggggauguggcacuaaguugccacugagccacaccuccccgugcaguguggcccaugguaccagucacagcacuuucagaaaccccaguuccucagccgaggugggaaguccagacuccagugaggcauggucucaccacugcccuccagccugggugacagugauaccccaacccaaaacaaaaaacaaaaacaccauguuuucaagcccuguuucuuccuaagccaggcucucugcacccagcccgcccucggcccgcugagcagagccuggugugggaggaggccgaggaggcugcagggggcugcgggaggcugugcccacugucagggacaagucuagaagaccucagcgccagaccugcuggagucagagacagagagcugccccaugagcucuuuaccccaaaucccucuuucucagggaccuugaauugaagguugcaaucgccaccuccucuccagccuucaccucuagcucccuucucucuccaccacauggcugaucuggccuccucaggcccugcaccuuccugccccgcuucccuccucuacgcugcccugaagucucucuuccaggcuccacucucucugaccuucguggccgaguccuccccucccccaggccaccugagauuccaugguuuugacccccuggccaucugccuucuguuggaugcucccaugccuuccccaguuguuguuguuguuguuuuguuuguuuuuugagauggucucaaacuccugaccucaagugauccacccaccucagccucccaaagugcugggauuacaggcgugagccaccgcgcccggccugccugccuuuguugaaggaggcuuucccauucuggcucugguguucuucggguccaggccaccugcucugccucuuuccugaauuccugaucaucucuggucucccagauuccucaugaguuuuggaaggccacaguucacaccauggaaacgggcuccacaagacuagcacgcaucccuagcccuuccccuggucagucagccccauacccaucugugggccccacuuccagaaacccgugccuucccugcauggccaccacacugcauuccccucuauggcugcacccgcuuccugcuggcacaguccuuccugugucugccacaccuggggcugccgcuuggguaggcaggauccaucuuggucaucugugucccuagcaccaggccacacacucagcaaaacaaaaugaugaggaugugucugugggagagauguuaacuccuccccaugaaggaccuucuccagauauccuguuuuuuguuguuguuuuuugagacagggucuuggucgaucucagcucauugcagcuuugaccuucugggcugaagcaguccucccaccucaaccucccaaguaccugggacuacaggcacaccacacccagcuaaguuuuugauuuuuguagaagaaaaucacuguguugcguaggcuugucucaaacuccuggacucaagucauccuccuuccuuggccucccaaagugcuggaaugacaggugugcaccacugcgcccagccuccagaugucuuugaccuguuuaugucacucucccuguauuugccuucacgcuaguuaugcacggaauuccuggaguguagucuuuugcaucucuucaagccucuuaaauugucccacauguaguaaauguucaguaaacagaucugcauucacacuguccuacaaguaaucccagcacuuugggagccugagguggaaggaucacuugaguccuggaggucaaggcugcagugagcuaugaccagaccauugcauuccagccugagugacagagugagaccuuaucucaaaacaaacaaacaaaugaaaaaccuuuuaguauaugcgcugccgaagcgagcacaugaaaaaccuuuaacaacaaaugcaaaguaaaccuacacugccucaauggacucaccuggaacagacccucccagcgccggaugagugcaccgcucagggaacaucuggguauauaguucauaguauagacuugggggggguuuuugccaaaagagugaugaaauugaaaagugaaaccuucuguccugaaaccuuugucucuucuuuuucaaggagcaugccuuugagagcagucagaaauauaaggaaggaaaauucaucauugagcuugcucauaugaucaaagacaauggcugggaguaaugugcgaacuuucccuucuccuuugaaugcuguuuugugaaagaaacugugaauguaauggaaacguaggagcaucuggugacagccuuucuugcccucugaccucaaaggcuagcugcgcauagcucuugacacucucggccaucucuguggguaaggugucccucggaucuguccucuucguguacacaguuguuucugaaaauuuucaaugagcuuuuucuaacuucucaaguucuagagaaagaauuaaccaacugaugacuuaccugccuaguuaauaucuuccuuucaccuuugucuucaauauaguugggcucugcuuuuuuaagguucaguugaaaaccaaacuggggccgggugcgguggcucacgccuguaaucccagcacuuugggaggccaagauggguggaucaccugaggucaggaguucuagaucagccuggccaacauggugaaaccccaucucuacuaaaaauacgaaaauuagccgggcaugguggcgagugccuguaaucuuagcuacucaggaggcuaaggcaggagaaucacuugaaccugggacacggagguugcagugagcuaagaucaugccaucgcacuccagccugggggacaaaagugagacaucgucucaaaaaaaaaaaaaaaagcuggguaugguggcgcaugccuuuaaucccagcuacucgggaggcugaggcacgagaaucacuugaacccaggaggcggagguugcagugagccaagaucgcgccacugcacuccagccuggcaauagggcgagacuccgucucaauuuaaaacaagagagaaccagacugagucucugaagaccacagggacagggucucuuuagauagcaagucucaccauucccuuuuuuagagaaaagguauuguagcccacccuccaccccgcuguuuuucuuaaauuugcagaacuucaaauuggcuauuccucuugcaaaugaacccuuaaaguacaguguuauuuaagaaucuuccagaggcagucaacagacuuauacacuaagggcauuuuugguuuuuagcuuguucaaaaacagaggccagcacagaugacauuuuagauacacucuaaauugagaauggugucuaguggaacauguuuauuuaagccaguagauuccuuaucuagaaagcaggugagcuagcccuuagagaaggcugucccggggcccgcagaggugcccuuacugaggugacagccucacagggucugguaccagggguugugcccucagcagugacagcagcuuaggugucaggcaguugcugaguggcugguccaugucuauagaguaacacacuggaccgaggaaaagucagauuucauuuucuacccuggauguacuugaagaaaaagaauuauuuuugcauaugaaagaggccagaacccacaggaaaaacuucaaaacuugacauuugccagaauguuuaaaauuuguucagaaaagguuaaagcaacaaguuuagccuuugugcaugaagacgccuggccugcuagacgcguugcccgucccugcguggugcugucccaugucacuugaacugauagaggggccugugcaaucuccuaaggccuguguuucugccauauauuuuauuauaaauuacaauccacucauccaccugcccuccaccaggagugggcaccccauaaggguuuaggccacuuugcagaggauggaggucaaaaaccacucccagauaaguuugguuuucaacauuuaguaacuugucucagggcagagggcaggcagggggaccgaggggcagcagauaggagagcacugagcccggauaguucucagccuggcaaguggcucugaagcugccuucagacaaggcuagucuaggggcaagagugcgagcuggcugacaauaagaacguggccaccugcccagcuucacaccucccccgacuucagcccuuccuaaacccagaccugcgguccaggcaggcacugggcugugcccacucgagcucacugcccacacacagcaugccuuugggugccaucucuuugcccaagccuggaagccuuggcaggugggaaaugccgcugcccuggugggcauggcacugagaugcauccacucagcaggagugacagaggcagaaguuccuuuaaagcacaucuuccacuuaggaaaggaaggaaaucuuuguacugucuuggaagccuccacauccggcuauggcccugcaagcugcuuuaucccugcgcuagucucccccgaggguuuaggcuggcccagcacauccuguccuccugagcucgcgugcagccacccagagcgcaggggucacugcacgcugcagggcucuugcugccauggucucaagccugaagaggcuccgcccacaagcuggcccaugaaguuagcaaugccuguggcuucagucaauugucuugagacugugaagaggcugaaagacaccuucccggguggaagaaggaguucacugaaaacuuaucuuaaacugacccuucccuuugagugagucuucauuccucucccaugugggaacccagccuccgaugccccggggacuaggggaaacaguuggagguucgugccguccccagccugccacgggugcgaggacagccaaguccugagugacucaagaugcuucacuuacauggaagaaacuucuaaaacucuaccgagugguuuuuguauauacuaaaguucuauuuagagcuuuucuguuuugggcaaguucgcugcuccuucuauuugggcacuuugguuuuuguacugucuuuugugacggcauugauugaacauuuuuuacuaguagucuuaugacuuuuguauuuuuuuuuuuuuuuguaauuuauaccaacaacacuuuuaucacuuuuuuuuuguugggcuucugcaaaauacaagcucauuuuuaaaccaaaugaacagaccaugagcuggcuucaggggaagugcuauucacaggaccauauccaccacccucuuaaauuccuaaacaauaucaucuaggacuucuauuuaaguuauuuaaaauaaaucuuccuugagagccuugggaggugaugucaggguuauaaauggcacagugcauuugcuguaggaaugugguuuggcauuguuuuauacacacaguauuuuuuauaccuuaaugcuuauucuugauggcaucugucagauauuagaauugaaaauaagaaucuucccaaaauccuuuaauuuaccugaugcccucaucaggucguuaaaaauucaaaugguuuuaauagcuaaaaaacuacaaauuaagcucuaaaacaaacaaacuacagaaauguaaaccuucauuugccaaagguccuugguggccuguccccugcccugggagcagauggcccugaagcccuucccucacugugcaggccaccgggugaggcuggacggucacccaugguggcuucacugcaaggagcaggacugccgagcucaagcacggggccuucagcuuccccuguccucuggccacaccgccagcccuugguccuuaucugugugagguuuacaaauaaagcuucugaugucaaauguuuaa

SEQ ID NO: 192609 - RNA, 38246 nt, Homo sapiens
uuaaacauuugacaucagaagcuuuauuuguaaaccucacacagauaaggaccaagggcuggcgguguggccagaggacaggggaagcugaaggccccgugcuugagcucggcaguccugcuccuugcagugaagccaccaugggugaccguccagccucacccgguggccugcacagugagggaagggcuucagggccaucugcucccagggcaggggacaggccaccaaggaccuuuggcaaaugaagguuuacauuucuguaguuuguuuguuuuagagcuuaauuuguaguuuuuuagcuauuaaaaccauuugaauuuuuaacgaccugaugagggcaucagguaaauuaaaggauuuugggaagauucuuauuuucaauucuaauaucugacagaugccaucaagaauaagcauuaagguauaaaaaauacuguguguauaaaacaaugccaaaccacauuccuacagcaaaugcacugugccauuuauaacccugacaucaccucccaaggcucucaaggaagauuuauuuuaaauaacuuaaauagaaguccuagaugauauuguuuaggaauuuaagagggugguggauaugguccugugaauagcacuuccccugaagccagcucauggucuguucauuugguuuaaaaaugagcuuguauuuugcagaagcccaacaaaaaaaaagugauaaaaguguuguugguauaaauuacaaaaaaaaaaaaaaauacaaaagucauaagacuacuaguaaaaaauguucaaucaaugccgucacaaaagacaguacaaaaaccaaagugcccaaauagaaggagcagcgaacuugcccaaaacagaaaagcucuaaauagaacuuuaguauauacaaaaaccacucgguagaguuuuagaaguuucuuccauguaagugaagcaucuugagucacucaggacuuggcuguccucgcacccguggcaggcuggggacggcacgaaccuccaacuguuuccccuaguccccggggcaucggaggcuggguucccacaugggagaggaaugaagacucacucaaagggaagggucaguuuaagauaaguuuucagugaacuccuucuuccacccgggaaggugucuuucagccucuucacagucucaagacaauugacugaagccacaggcauugcuaacuucaugggccagcuugugggcggagccucuucaggcuugagaccauggcagcaagagcccugcagcgugcagugaccccugcgcucuggguggcugcacgcgagcucaggaggacaggaugugcugggccagccuaaacccucgggggagacuagcgcagggauaaagcagcuugcagggccauagccggauguggaggcuuccaagacaguacaaagauuuccuuccuuuccuaaguggaagaugugcuuuaaaggaacuucugccucugucacuccugcugaguggaugcaucucagugccaugcccaccagggcagcggcauuucccaccugccaaggcuuccaggcuugggcaaagagauggcacccaaaggcaugcugugugugggcagugagcucgagugggcacagcccagugccugccuggaccgcaggucuggguuuaggaagggcugaagucgggggaggugugaagcugggcagguggccacguucuuauugucagccagcucgcacucuugccccuagacuagccuugucugaaggcagcuucagagccacuugccaggcugagaacuauccgggcucagugcucuccuaucugcugccccucggucccccugccugcccucugcccugagacaaguuacuaaauguugaaaaccaaacuuaucugggagugguuuuugaccuccauccucugcaaaguggccuaaacccuuauggggugcccacuccugguggagggcagguggaugaguggauuguaauuuauaauaaaauauauggcagaaacacaggccuuaggagauugcacaggccccucuaucaguucaagugacaugggacagcaccacgcagggacgggcaacgcgucuagcaggccaggcgucuucaugcacaaaggcuaaacuuguugcuuuaaccuuuucugaacaaauuuuaaacauucuggcaaaugucaaguuuugaaguuuuuccuguggguucuggccucuuucauaugcaaaaauaauucuuuuucuucaaguacauccaggguagaaaaugaaaucugacuuuuccucgguccaguguguuacucuauagacauggaccagccacucagcaacugccugacaccuaagcugcugucacugcugagggcacaaccccugguaccagacccugugaggcugucaccucaguaagggcaccucugcgggccccgggacagccuucucuaagggcuagcucaccugcuuucuagauaaggaaucuacuggcuuaaauaaacauguuccacuagacaccauucucaauuuagaguguaucuaaaaugucaucugugcuggccucuguuuuugaacaagcuaaaaaccaaaaaugcccuuaguguauaagucuguugacugccucuggaagauucuuaaauaacacuguacuuuaaggguucauuugcaagaggaauagccaauuugaaguucugcaaauuuaagaaaaacagcgggguggagggugggcuacaauaccuuuucucuaaaaaagggaauggugagacuugcuaucuaaagagacccugucccuguggucuucagagacucagucugguucucucuuguuuuaaauugagacggagucucgcccuauugccaggcuggagugcaguggcgcgaucuuggcucacugcaaccuccgccuccuggguucaagugauucucgugccucagccucccgaguagcugggauuaaaggcaugcgccaccauacccagcuuuuuuuuuuuuuuuugagacgaugucucacuuuugucccccaggcuggagugcgauggcaugaucuuagcucacugcaaccuccgugucccagguucaagugauucuccugccuuagccuccugaguagcuaagauuacaggcacucgccaccaugcccggcuaauuuucguauuuuuaguagagaugggguuucaccauguuggccaggcugaucuagaacuccugaccucaggugauccacccaucuuggccucccaaagugcugggauuacaggcgugagccaccgcacccggccccaguuugguuuucaacugaaccuuaaaaaagcagagcccaacuauauugaagacaaaggugaaaggaagauauuaacuaggcagguaagucaucaguugguuaauucuuucucuagaacuugagaaguuagaaaaagcucauugaaaauuuucagaaacaacuguguacacgaagaggacagauccgagggacaccuuacccacagagauggccgagagugucaagagcuaugcgcagcuagccuuugaggucagagggcaagaaaggcugucaccagaugcuccuacguuuccauuacauucacaguuucuuucacaaaacagcauucaaaggagaagggaaaguucgcacauuacucccagccauugucuuugaucauaugagcaagcucaaugaugaauuuuccuuccuuauauuucugacugcucucaaaggcaugcuccuugaaaaagaagagacaaagguuucaggacagaagguuucacuuuucaauuucaucacucuuuuggcaaaaaccccccccaagucuauacuaugaacuauauacccagauguucccugagcggugcacucauccggcgcugggagggucuguuccaggugaguccauugaggcaguguagguuuacuuugcauuuguuguuaaagguuuuucaugugcucgcuucggcagcgcauauacuaaaagguuuuucauuuguuuguuuguuuugagauaaggucucacucugucacucaggcuggaaugcaauggucuggucauagcucacugcagccuugaccuccaggacucaagugauccuuccaccucaggcucccaaagugcugggauuacuuguaggacagugugaaugcagaucuguuuacugaacauuuacuacaugugggacaauuuaagaggcuugaagagaugcaaaagacuacacuccaggaauuccgugcauaacuagcgugaaggcaaauacagggagagugacauaaacaggucaaagacaucuggaggcugggcgcaguggugcacaccugucauuccagcacuuugggaggccaaggaaggaggaugacuugaguccaggaguuugagacaagccuacgcaacacagugauuuucuucuacaaaaaucaaaaacuuagcuggguguggugugccuguagucccagguacuugggagguugaggugggaggacugcuucagcccagaaggucaaagcugcaaugagcugagaucgaccaagacccugucucaaaaaacaacaacaaaaaacaggauaucuggagaagguccuucauggggaggaguuaacaucucucccacagacacauccucaucauuuuguuuugcugaguguguggccuggugcuagggacacagaugaccaagauggauccugccuacccaagcggcagccccagguguggcagacacaggaaggacugugccagcaggaagcgggugcagccauagaggggaaugcagugugguggccaugcagggaaggcacggguuucuggaaguggggcccacagauggguauggggcugacugaccaggggaagggcuagggaugcgugcuagucuuguggagcccguuuccauggugugaacuguggccuuccaaaacucaugaggaaucugggagaccagagaugaucaggaauucaggaaagaggcagagcagguggccuggacccgaagaacaccagagccagaaugggaaagccuccuucaacaaaggcaggcaggccgggcgcgguggcucacgccuguaaucccagcacuuugggaggcugagguggguggaucacuugaggucaggaguuugagaccaucucaaaaaacaaacaaaacaacaacaacaacaacuggggaaggcaugggagcauccaacagaaggcagauggccagggggucaaaaccauggaaucucagguggccugggggaggggaggacucggccacgaaggucagagagaguggagccuggaagagagacuucagggcagcguagaggagggaagcggggcaggaaggugcagggccugaggaggccagaucagccaugugguggagagagaagggagcuagaggugaaggcuggagaggagguggcgauugcaaccuucaauucaaggucccugagaaagagggauuugggguaaagagcucauggggcagcucucugucucugacuccagcaggucuggcgcugaggucuucuagacuugucccugacagugggcacagccucccgcagcccccugcagccuccucggccuccucccacaccaggcucugcucagcgggccgagggcgggcugggugcagagagccuggcuuaggaagaaacagggcuugaaaacaugguguuuuuguuuuuuguuuuggguugggguaucacugucacccaggcuggagggcaguggugagaccaugccucacuggagucuggacuucccaccucggcugaggaacugggguuucugaaagugcugugacugguaccaugggccacacugcacggggagguguggcucaguggcaacuuagugccacauccccuuguggcacgagcauccccuuguggcacucacguauuuccacccgagcguggucuugcaguucucgcaguagaugucggcaaccgcaugcagcccggugagaaggacccucuccucugcagggccgcagcccacguucacccugcggggacagaggggccacugcgcugcaggcccggcccgccccugaccaggcccugcccccucagcgggccccaccccauccuccuaagaguucccccaaaacagggaaacucccagagagcagugccgugccucucccccagcccugcccgccaccaccaucaaugggaaagaucagugaugggacaggcuagggggcaagauccuuagcgcguuucagaaacucccggcggggggaugguggguucuuucaggaccccuaaagacccaggugauucuacacagggcacuguguaggugccauccaggccgucccagggcccgugccgcuccccccgggcugaaccaggguacucacacggaauugaagagguaggcgcgucccuggcuccccugaaaggacugaaagaagaaggucccgugagauuggcugcgagugcuuucuggaacgaagcggugcugcccagaaccaggggaguccagccccgcggcuguuagcugcgccgggacgcgucaccgggagcagacaccggcguccccccuccagaacuccacuucuaauaacagccacuuaacggagcugcaagcuguuuuucauuguagacaggaguggcugauucugcugcgucaacauucugcaagugacuauuauugggaaucauggcaagaucaguuuuuaaauggugagcuucauaugucuggacaacuuuaccuuagaggaguucugagaggggaucacgaaugauuuucucuacccgaaaacccacagauccucaaaaugcucuccucgccgccucuucugcagcaguucagaugugcucacgcugccagauauuaggggguagggggagguguccauauuuucccacugaaauguuuuaaaagucacagcauggcugaguauggcggcucacgccuguaaucccagcgcuuuggaaggcugaggugggcagaucaccugaggucaggaguuugagaccagccuggccaacauggugaaacccugucucuacuaaaaauacaaaaguuagcugggcgugguggcgggcaccaguaaccccagcuacuuggguggcuaaaauaggagaaucacuuaaacccgggagguggaggcuacagugagccaagauugcgccacugcacuccagccugggcaacaagagugaaaccccgucucgaaaaaaaaaaaaaaaaaaaagucauagcacaagauggccuuucacuuggagaaaggccauuccagugacaucuaucucaccaggaaaauaaaacaagcugagaaacagcucaugguauauucacguaugcuaagauggcugagcgugaaagagccagaauagggcaucugcacccccugaugcacuuggucacuccccacgaccuuugcccucacgggacaggugggaacgccugcuccagugccagccucaagucucaaucgaccucaaacauaaucaaagaaaugcaaaccaaaucaaaaauuuuggggggaguugggguuuugagauggagugucacuuugucacucaggcuggagugcaguggcaccaucuggacucacugcagccucugccuccaggguucaagcaauucuccugccucagccucuccaguagcuaggacuacaggcacgugccacuaggcccagcuaauuuuuguauuuuuagagauaggauauuuuagagauaggguuucgccauguuggccaggcugguuucgaacuccuggacugaaguaaucugccugcuucggccuccccaagugacgggauugcaggcgugagccacugcgccuggcuuacauuacaguuuauaauggaggcugucauuuaaaaaugucuuaggugagcugguaagagaugcucgcucaauaccacucccacaaaggaaaccgcauaugucauacaugauguacgcugucagauuuucauaucuaaauuucauuggaaagaaaacaggaaagcaacauuucuguauaaaacaaagaugguuuuguauuggcaggcaugaaccaccaugcccagcccuuuuuugggguuuuugaccuaacaaaggcaaaaggcuaugaggaaugugacugaaacacgauuugacaauaucgaaguggaaaaagcacacacuauaggacccagcagucccacuucuaagaauuuacuguaaacaacaaaccagcuugaguguauaaggaaaugugacaggaauggucacagguuacaguguucauaauuaggaaaacaaacaacaacaacaacaaaaacgggcugaggcaggaggauugcuugagcucaggaguucgagagccaugauuacaccacugcacuccagccugggggacagagcaagaaccugccucuaaaaaacauaaauaggccaggcgcgguggcucacgcauguaaucccagcacuuuggggggccgagguggguggaucaccugaggucaggauuuuaagacaagccuggccaacauggagaaaucccgucucugauaaaaauauaaaaauuagcugggcaugguggagggugccuguauucccagcuacucaggaagcugaggcaggagaauugcuugaaccugggagggggagguugcagugagccaagaucgcgccauugcacuccagcuugggcgacuagagugaaacucugccucaaaaaaaauuuuaagaaaggcugggcgcggugguucaugccuguaaucccaguacuuugcaaggcugaggcaggcagaucacaaguucaggaguucaagaccagccuggccaacauggugaaaccccgucccuacuaaaaauacaaaaauuagcugggcaugguggugcgugccuauaaucccagcuacucaggaggcugaggcaggagaauugcuugaaccgggacccgggaggcagagguugcagugagccgagaucgcgccacugcacuccagacugggcuaccgagucaggcuccgucucacaaaaaaaaaaaaaagaaaaaaaaauuuaaccuggaagucagguacucauccauaagugaguaagcaacugcauccgcauaugggccucaugcaggggaugggaagguaggagcagauauggaaaaacagucauaggcuaggcaccauggcuguaaucccagcacuuugagaggccaggguggguggaucaccugaggucaggaguucaagaccaggcuaggcaacauggcaaaacccugucccuacaaaaaauauaaaaauuagcagggcaugguggcugugagccuguacucccagcuacuugggaggcugaggcaggagaaucgcuugagcacgagagguggagguugcagugagcugagauuaugccauuguacuccagccugggugacaggagaagcccugucuaaaaauaaauaaauaaauaaauaaaaauaaaaauagucauaaaagucauaaaauacuaagugaggaaaaguuagcuguaaagugagugucauuugagcccuuuauuuaaagugaaaaauguguuucuauuaaaacaaaauaaagacaacagaugccaaacuacuaacagugacaucuccaaggaauggagccggacaaggcaggaggaagaagcaagucuccucguuuacacauacacauuauuuuaaugugauuaugugcaauauuauauaauuuaaaaaaaauuaaaaggaccuggcacagugccucaugccuauaaucccagcacuuucggaggccaaagugggaggaucacuugaggccaggaguucgagaccagccuggacaacauggugaaacccccucuacuaaaaauacaaaaaauuagccuggugugguggcgcacaccuguagucccagcuacucagaaggcugagacagaagacuugcuugaacccgggagacagagguugcagugaguggagauggcaccacugcacucuagccugggcgacaaagcaaggcuccaucucaaacaacaacaacagcaacaacaaaaaacaagagcccccaguugucccugguagacuucucaccugagcaugaacuaaaccuguguuuuaagcuguugagaucuggggaggcucuuuuuccucagcauucaggcuuaaaaaugaguauucccuuaaguggcauucugggauuaggaauauuauucuauguucaguuuaacuaauaaucaucuuauagacuuuucccacauccucaucagucuucaauauucuggacugaauuuccuaauucucaccuacucugaaaguccuuauuuuuaaauaggguuuggcucagagacaagagcagcucugugauucagauucagagcugucuuaucagaguuggcgccagcaaacuccuccuguaaauuagggccaggagauaaguaguuuaggcuuuggaggacauauggucccuguucuaauuacucuguaaacagaugagcacagcugugaucuauuaaaacuuugcauaaacaggugguguggcagauuuggaccacagaucagaguuugcuaacuaaauggagccuucuaguaaccagagcugccuacagcagcaacaggcucccucgagccaggggauuccuuguuagugacaaauacaaacuuagaggcugugaagacagugccucucgccucgcagguacuggauucuguucugcguggcagguguucucgauggucucaaugaauccucaucagaaucaccacggaagggagaaaagcucacucuagucgucaucuugccaccucgcccggcccaucacccauggaggcacgaggucugauccuuccugguggccugugugcucagagagcuuaguucucagcacuuuuuuucauccugaaaugcucauuuggcaccaaaugacuucugagcaggcuucugccuuuuuuuuuuuuuuuuuuuuuugagacagagucuuacucugucacccaggcuggagugcaguggugugaucucagcucacugcaaccucugccucccagguugaagcaauucucaugucucagucucccaaauagcugggauuacaggugugugccaccaugcccagcuaauuuuuuuguacuuuauuaauagagacaguguuuuaccauguuggccaugcuggucuugaacuccugaccucaagugauccacccaucuuggccuuccaaaguucugggauuacagguguaagccaccaagcccagccaggcuucuauucuugauacaauuuuuuuuuuuuuuuuuuuuuuuaagacagaguuucgcucuuguugcccaggcuggagugcaauggcgcgaucucgacucacugcaaccuccgccucccagguucaaacgauucuccugccucagccucccaaguagcugggauuacaggcaugugccaccacacccggcuaauuuuguauuuuuuuuaguagagacgggguuucuccauguuggucaggcuggucuggucucaaacuccugaccucaagugauccgcccaccucggucucccaaagugcugggauuacaggggugagccaccacgcccagcugauacaauuuuuaaaacagcucauugaugaccuccaggcuguucaacagaagcaucucaaauuccuuuugaccauguagcaaggaacacaccuggcaugcuuccgaaacaaaaccaugcauggggccggacauugaccaccucucagugcucaggucaccugcuuaggucauggccaacacacaggugucacggggcuccacaaggccacaagcuucacugccccuacccaggggcccagagcagcuccgccucucauuaccucaugucauuuuacacacuaagccuaccucagaaaacaccgaggaaauggggugccuggcuccuuccacuucucaccucacacuucccagugcacacaggagccccagaggcaaugagagagcagaaacucugccucguucaacaguuucuaucucagaugaugaacagaaaugaggagccucucacuauuaccuacugaaaauacaagcagguaaauguucuucucuugaguuaaacaggaaaccuaagagauuccuggcugggcguggugacucacaccuauaaucccagcacuuugggaggccaaggcaggaggaucgcuugaggccaggaguacaagaccagccuuggcaacaugguaaaacccugucucuacaagaaaaaauaaaaguaaauaaaauaccuauuuaaaaaaagaagaaaagauuucugaaaggcacaacuuccugacaaacuuuguucccaaaguggucgugaccugugaagauggggagacgucaugaccugaggauggggggaggucauggccugugaggauggggggaggucaugaccuauaaggaugaguggagguaaugauccgugaggaugggugcaagucaugaauugagcaugggggaggucaugaccugugaggaugugggaggucaugaccugaggaucgguggucaugacguaugaggaugcggggaguucaugaccugaggcuggggggaugucaugaccugaggauggguggagaacacugucauuccgacugagcaucagcuccuccaugauguuuggccuguuuaaauguucacaacugguugaugaucaacgccacacacugcuaaugaggagcucagcacaguaaggaggggccaggggaucuuguuuacaucuucaaggcugcucauggguucuaugcacagagaccagccagagcuucacccagggcuccuacacaaccgacaaacgcagccacacccucuggggcauuuuucugagcaaccccuuuccuucuuaaccaugcugaguuuuuaaaaugucuuaauacccuuauuauuaaaccauuuccacagauuuuucuagacuucuuuugcucauucaguccucucuggcuuucugcugugaguaacaagugauucaccuugccccucguaaucccugggagugccagcugccuggcccuggaaaaccgcccaccaugccaggaucacaucugagaucguggcacagccacacuuaaccaugcacaaaacgcucaccaaugcugccuagaaggcucuagacguucaggacacagcagacucaggaagucaugugaugcuuaaauauucuuccacuauguagguaccacaaugacagauaaucauugugccaucaauuuuuuggcauaagccacuugccuuggagaugagcucgucaugauuggccaggugugcucugcaguggauacagcuguacguucggugacaguucggcagauacgcuuggaaaguuuuggacuuugucauuuucaccaucucuccugggcacuccucacucagcucagggcugguucuggaagaaccguggcucugcuggccucucugacaaaagcaacacuggaaaaugcacgcaagagccgucguuguccaggagggcguguggcacuguccacacagcugggacgagagaaaaacguaaccugccaaccaaucagacaaagugguggguuacagagagaacaugcgugugaagcagguacauaugggauucauguguugugaagcaacacgcgggguggggggguggcaggacuagaauuuuuuuuuuuuuuugagauggagucucacucuguugcccaggcuggagugcaguggcgcaaucucagcucgcugcaaccuccuccuccuggguucaagcgauucuucuaccucagccucugaguagcugggauuacaggaacacgccaccaagccuggccucccaaagugcugggauuacaagcaccacugcgccugaccaagauccaacucuuuaguaucaauuguagacaaaaugaacacugacaccaugccacugcuuaaccacuuuacauuuaguuggaagugaaaaaaugaacuccuuuuacaugcaaauaauuugagaaaaacauugauucaaauucuucuuauaccagguuuggcuuuggaaacaugaaaggagaggcagaaccaagacgcccggugagugggcccgguggcagggcuggaugcaccccaccccgaauccgggaauucaccacgcagagcaccaggacauugaggaaugugagugauggauccaguauuauuuaaucuuuaagaaauuccaguccugaaauaaacccuuauguauggucacaugaucuucaacagggugucaagaccauucaauggggaaaggacagucuuucaacaaauggugucacaacaacuggauauccaccugcaaaaauauaaaguuggacucuuaccuaacaccguauacaaauuaacucaaaauaaaagaccuaaaugugagagcuaagacuauaaaacucuuagaaggaaacacaggggaaaagcuucaugacauuggauguggcaaucaucucuuggauacgauaccaaaagcaugggcagcaaaagaaaaacagacacauuagacuucguaaaaauucaaaacuucuggcucggugcagugcucacgccuguggucccagcacuuugggaggcugagguggguggaccacuugagcccaggaacucaaaaccagccugggcaacaaagcaauaccucaucucaacuaaaaauacacaaaauuagcuggguguggucccugugccuguggucccagcuacuugggauagcugaggugggaggauggcuugagccugggaaguugaggcucaagugagcugagaucguccaacugcacuccagccugagcaacagagugaaacccugucucuaaauaaauaaauaaaaacuuuugugcuucaaaggauacuaucaacagaggcaacccagagaaugagggaaaauauuuuuaaaucauauaccugauaagguguuaauaucuagaauacauauauucuauauucucucuauacauauucucuauauauccauauucucuauauauccuaguuauuggaauauguaaaaaaaaaaaaaaaaaacaacuacaacucagcaaaucaaacaaacagguuaaaaaauggauaaagggccggguaugggcccggcgugguggcucacgccuguaaucccagcauuaugggaggccgaagaagguggaucacuaggucaggagaucgagaccacccuagucaacauggcgaaaccccgucucuacuaaaaauacaaaaaauuagccgggcgugguggcgggugcuuguagucccagcuacuugggaggccgaggcagcagaauugcuugaacccaggaggcagcgguugcagugagccgagaccauaucacugcacuccagccugggcgacagagugagacuacaucucaaaaaaaaaaaaaaaaggaaaauggauaaaggaccuauguaucuauauucucuauauauucuaguuguuagaauauguuaaaaaaaacucagcaaaaagaaacacaaucugauuaaaaaauggacaaaggaccuauauaucuauauucuauauaguuauuagaauauauuuaagaaacuccuacaacucaacaaaacaaccccaaucugauuaaaaauggacaaaggacuuauauaaacauuucuccgaagaagauauacagauggcccacaagcacgugaaaaggugcuccaugucacugauccugagggaggcagacaaggaccacguugagacaccaccacacacccucuaggacggcuacuaucaacgcgcacacacggaaaauaagcguuggugaggauguggaggaauuggagccuugugcauugaggguaaaaauguaaaaugcuggaggcacuaugggaaacaguaugguaauuccucaaaaaacgaaauauagaauuaccaugggcuccagcaauuccacugcuggguauaaauccacgagaacugaaaacagggucucaaagccaugucugcacacccaugcucacagcgacauuauccacaacagccacgagggggaagcaacagugugucccuccacaaacgggcauucucaugaucaaaauguggcgucugcauacaguggaauguuauccagccuuuaacaggagggggcuccugucacagcuacagcauggaggaacccugaggacacuaugcucagugaaguaagccagucacaaaggacaaauauuguaugagguacuuagaguagugggacucagagacagaaagagcugccaggggcaggggaguccccgcuucaugggugcaguguuucaguuuugcaacaugaagaauucuggagguuggaggguggcgauggcuguacaaaaaugugaauauauuuaaugucacugaacuguacacuuagaaaugguuaagaugguaagaguuauguguacugacuacaauuauuuuaaagaagaguguaucauuuuuacauuucuaaggucucauuaacaaaagaagguuaaguccaugacugaugcugccaucaucagcaacaggacgugcgccaaguuuuccugguggcaccaccccagccuggccugugacaaggggccugcagagagucaggcacaccggauuuucuuucaggccaaacagaagagcaaggguuuccccaaauucgagagcacggggcugggaagaagagccaagcgccagcaguguccucacaccugcuccuccugagaugcaccccccaccgccccccaccccaugugaccucugcuccggcagcagccuguccugugcccuuccaugggaugacacccaggacggcgucugccccccaccugcgcaggcacgccugcauuagagggucaccuucucacaucugggacugaagaugugugugggcagaacgcagcguuuguaaucgugugaacggaagacacaaacggccgguggcggccacccaggaugguacugggacccggucaccacggcgcugcugugcccuuccuuggugccccggccugagaugcugccuaacuuggacuuggugcuucuuggucuuugcuuguccugauggcugugccccguguguggcccugagccacacugcugcguguuccguguuuugaacuugacaccgacgaugcugugagacuucucugcugacgugcagccaagucugccucuguccccaugugcagcugggcccccuucaccuggugucccgucagauacacugcaugcagccacugacgggguguggauguguaucggcucccaggcuggcuacuaaauggugcugcugucgcugucaccucuccugagccgcacaggcagguguuucguuggaacaaucccaggagcagaugcccgugcacacagcagcaccucccaagugccggugacaaggucauccugccagcagcgaacaugagucccugcugaucuuuaucccgccaacuugauauggucaaauuuuaacacuucugcugccuggcagguauaaggcagcagcaucucauuguggcuuuaauuugcuucaaccugaccauacaggugggcaccuuuuaugauuccuccuuuucaaaucuuugucacauuuucuauuagcugcugguccuuuccuuacugauucguaggaguaagugauauauucugaaaacuaaagcauacauuaagccauaucggucguggaaugauaagcauuacuggaauguggacaugacugugccugugauguaagcuucaggaaacuauaguguaaggcauguauguauaguauguggauaaauggauaugccauauacacacacacacauacauauacauauauguguggauuauguauguacaugugcauuaauggguuucaaguucucuaaaagaaaaaguguaacuagacaaaaaaacuauuaaggcugggugugguggcucacaucuguaaucccagcacuuugggaggcugaggcgggcagaucgccaggucaggaguucgagaccauccuggccaacauggugaaaaccccgucucuauuaaaaauacaaauauuagcugggcgugguggcgugcgccuguaguaccagcuacucgggaggcugaagcaggagaaucacuugaacccgggaggcggaggcugcagugagccgagauugcaccacugcacuccagccuggagacagagugagacuccaucucaagaaaaaacaacaacaacaaacaaacaaacaaaaaaaccccacgcugcuuacuauguauaguucaaauaaaaaacauaaaagguagauuuuuuauuuuuuuuauuuuuuugagauggaaucucugucgcccaggcuggagugcgauggcaccaucugcgcucacugcaaccuccgccucccggguucaagugauucuccugccucagccuccugaguagcugggacuacuggcacgugccaccacaccuaauuuuucuuuuucuuuucuuuuuuuuuuuuuuuuuuugagacagaguuucgcucuuauugcccaggcuggagugcaauggcacgaucuuggcucaccacaaccuccaccucccggguucaagugauucuccugucucagccucacgagcacugggauuacaggcaugcgccaccacacccagcuaauuuuguauuuuuaguaaagacgggguuucuccauguuggucaggcuggucucaaacucccaaccugaguugauccaccugccuuggccucccaaagugcugggauuacaggcgugagccacugcgccuggcccuacaccugacuaauuuuuguauuuuuaguagagaugggguuucaccauguuguccaggcuggucucaaauuccuggccucaagugaucugccugccccggcuucccagagugcugggauuacaggagugagccaccgcgcccagacuaaaaguuacauuuuuaaaaaagaggugacuuaagauuucauagaaaccaacuuuuuguaaaacuaugauaagccaaauacuuggaccagcccucccacugagaaguaccaaaaaugcugacaaaauaaaaggauguuuucuuaaaggcauccaggggcugacaagacagugaggagccgccaggcaccaucuggggaaaccagaaaccagagaggcgagccaagccgcucuugcccugaaaacaucugcccccauccagccaccccgggcuuccgaugagaacucuaaggcugguccccaccccacagagcagugaucauaggacagcccucacaggacuuauggcccaaauucacaccagugagaagauuccaaaagcucacaguugauggauuuaguuuaaauuggcuuuaggcugacagcgcccugagguaccuggcagaaggaagcguaaaccuaguuuggaggaagcaucuuuauccuagaucugaaaaauucccacaaagucauuuuuccaggacaaugaguaaugcagucaaaaguaaccacacauucacagaaacaaugccccaugagcaaggacagaaaaggccagcagcaggaccagauccagagacucaacaucucaaagaccugaggcagaccaugaggcuccuccacuuaccuguacucacggagggaaccgaugagcuugagaguauauguaaccaacagcaaacgagaaaaaaaaugaccuugcagaaaaacagguguagacauucuagaaauaaacagcauucagcccaauggguuuaacaggaauaggagaauaaaaagagaauaccuacacugaagauacgucagaauaaauuaugcugaauaaagaagagcgagaggccgggcgcgcuggcucacgccuguaaucccagcacuuugggaggccggggcugggggggcggggggcggaucacaaggucaggaguucgagaccagccuggccaacacggugaaaccccgucucuacuaaaaauacaaaaauuagccgggcgugguggugucugccuguagucucagcuacucaggaggcugaggcaggagaguugcuugaacccgggaggcggagguugcagugagcugagauugcgccacugcacuccagccuuggguaacagagcaauaguccgucucaaaaaaaaaaaaaaaacaaaaaaacagugaggaagguggaaauaugagucuuaaacuaagagaugugaagcagggagagaugacauuuauuuggauuucagaagguugaggcaagaagaaaaugggguagaggcgcuuugugaauaauugaugauuguggauucuccagaauuaaggaaaagcuacuaauccacagacuuaaaaagcccaacaguccuaaagcaggauaaauaaaaauaaagccacagcuagacaaauaaugaaacugcaaaacaccaaagauaaaggggaaaaaagucuuaaaaguguccagaggaaggaaaaaugaccuguucaacagaacaagcucccagguaaaacaagagcccaaaaggcagcagagaaagggacaauuaugauucugaaagauaauaacugauaucucagauuuuacauucagugaaaauaucuuucaagaaguggggcaaaggcuggacauaguggcucacacuugucaucccagcacuuugggaggccaaggcaggaggauugcuugagcccaggaguuugagaccagccugugcaacagugagacccugucucuacgcaaaaaaaguguuuuucaauuagccaaguguggcgucacgugucuguggucccagcuacuagggaggcugaagugggaggauugcuugagcccaaggggucgaggcugcaaugagcagagauugugccacuggacuuagccuagguaaugagugagacucugucucaaaaaaaaaaaaaaacaaaaacaaaacaacaacaacaacaacaaagagucugagucugggugcaguggcucaugccuguaaucccagcacuuugggaggccaaggcggguggaucaugaggucaggagauggagaccauccuggcuaacacaaugaaaccccaucucuacuaaaaauacaaaaaaaauuaguggggcgugguggugggcaccuguagucccagcuacuugggaggcugaggcaggagaauggcgugaacucaggagguggagcuugcagugagcugagaucgcaccacugcacuccagccugggcaacagagcgaggcuccaucaaaaaaaaauaauaauauaaauaaauaaauaaaagaaaaaagacuggcauaagauacaaaaacaggucaaugugacaugaaagagagcccggaaacagaccacagguggauacagacagcacagaggagcucugcagcgccuggagaacaguucccaggggaauacugcuggaccaagcacaucugcaggagaagagaaaccaagcugaauccgauuucauuaacaaaaucaacaguucaucacauuuaucaacagagaugacuucaucuagcaggaauuuuguggaggaaauuucuguacaaagguauacacguguaaauacacacacacacacacacacaccaucuucuaaaugaaguccauuucuuucuccaauauuauguuaaagaauuucugaaaaagucugccuauauuggauauuccugaugggugauuuccccaaaccuuaaacucuuuuucuuacuagcugcuauuaagucaucuugugccaauccugaaauuuucucuuggguuucuuagaaucaagaagaccucacauuuagcguuaacacaguacauuuuauuagaucuuaucuauugcccugaacuacugggcccuucaugaaucugaacccugccaucucuuccaucuggcaucucuuccaugaaacuugcugacaugcccuggggaggucauggggacagguaucagcucggccaccacccuccaggagcccagcaccacuuccaccucugcucuccuguccacaugucccacacggugcacgaggaugucaugugacaacuugucaguagcucauucaaauccaugcauguugcaccaguucauggaaggaagcguucugacuucacuucuuacugaacucauguucaaucucugugauauuuucaacuaaguuucuuguuacuaaaaugagacuuaaauuaauaaacuuucauuucucucuucuuucccuggacuucccuuuaacaaagauacuaagaauaugaagugaagcagcuaagagagagacaggaaacuuauucacaaacuggguauucaggucucuagcguucagaaucccugcuccaagugacucaaguagagagcuacagaaacugcccuucacuuuguucaucauuuuaaaauaaguaguaucagccaggggcggugacuuaugccuguaaucccaacacuuugggagggugaggcaggaggaucacuugaggucaggagcucgagaccagucuggacaacauggcgaaaccccgucucuauugaaaauacaaaaauuagccaggcggccggacgcgguggcucacgccuggaaucccagcacuuugggaggcccaggcggguggaucaugaggucaggaguucaagaccagccuggccaagauggugaaacccgucucuacuaaaaauacaaaaauuacagcgcaccuguaaucccagcuacucaggaggcugaggugggagaaucguuugaaccuggggggcggagguugcagggagccaagaucgcaccacugcacuccagcgugggugacagagcgagacuccaucucaaaaaaaaaaaaaaaaauuagccaggcgugguggugagugccuguaaucccagcuacuugggaggcugaggcaggagaaucacuugaaccugggaggcagagguugcagugaacugacauagcaccaaugcacucuagccugggugacagagcgagacucuguaucaaaaaaaaaaaaaaaaaaaaagcaguaucacuuuuuugugugugagacaaggucucagucuguugccgaggccggagugcaguggcauggucacacagcucacugcagccuugaccuccugggcucaagcaauccucccagcucagccucccaaguagcugacacuacaggcccaugccaccacgccuggcuaauuuuuuuguuguagagauggggucucacuuuguuacccaagcuggucucaaacgccuggguucaagugaucuaaccgccccagccucccaaagugcugggauuacaggcaucagccaccacaccugacugcgauuuuuugagacagucucacucugucacccaggcuggagugcaauggcaugauuucgacucacugcagccuccaccuccuggguucaagcaauuuuccugccucagccuccugaguagcugggccuacaggcaugcaccaccaugcccagcuaauuuuguauuuuuaguagagauggggcuucaccauguuggccaggcuggucucaaacuccugaccucacaugauccacccgccuuggccucccacccaccacggcuucccaaagugcugggauuauaggcaugagccaccaugccuggccgauuuuguuuuuuuuuuuuuuuuugagagucuugcucugucacucagacuggagugcaguggugugaucucagcuuacugcaaacccugccuucuggguucaagcaauucuccugccucagccaccagaguagcugggacuacaggugcacaccaccacacccagcuaauuuuuuuguauuuuuaguagagaugguguuucaccauguuggccaggcuggucucaaacuccuggccucaagugaucugucugccucagccucccaaagugcugggauuacaggugugagccacuguaccuggccaacauuuuggguuuuuugggggggggaggggaggacagagucucgcacuguugcccaggcuggagugcaguggcacaaucucagcucagugcaaccuccgccuccuggguucaagccucagccuccugaguagcugggauuacaggcgugugccaccacgcccggcuaauuuuuuuuguguguauuuuuaguagagaugagguuucaccauguuagccaggauggucuaaaucuccugaccucgugaucugcccgccgcagccucccaaagugcugagauuacagcagugagccaccaugcccagccuuuuuuucuuuuuuuuuuuuuuuugagacagagucucguucugucacucaggcuggaguacaguggcgugaucuuggcucacugcaaccuccaccuccuggguucaagcgauucuccugccucagccuccugaguaguuuggauuacaggugcacaucaccaugacuggcuaauuuuuauauuuuuaguagagaagagguuucgccauguuggcuaggccggucuccaacuccugaccucaagugauccaccugcuuuggccuuccaaagggcugggauuacaggccugagccacugugcccggcccaacauuuuuuuuucuuuaauugcuguuuguccugaacacauuuuaaguggacagaacauuguagacucucgguacaauggacagcagaucucuagggcucguucaucuuccuuaccugaaacuuuaugccuguggauuaauaaauucccauuuccuccuccaccaagccccuggcagcuaccauccugauguuugauuccaugaauuugacuucucuagauaccucauguaagcagaaucaugcaguguuuguccauaccuggcuuauuucacugagcacauaaugucuucaagguacauccauguuguugccuacuacagaauucccuugucuuuuuuuaaggcuaaauaguaguccauaaagagaacaugguauacacauacagggaaagcacuucaaaaaguggccauuuggccagcgcgguggcucaugcuuguaaucccagcacuuucggaggccaaggcaggcagaucacaaggucaggaguucaagaccagccuggccaauauggugaaaccccaucucuacuaaaaauacaaaauuagccagaugugguggcacgugccuguagucccagcuacuugggaggcugaggcagaagaaaugcuugaacccuggagauggagguugcaguaagccgagaucacgccacugcacuccagccugggcaacagagugagacucguucucaaaaaaaccccaaaaccaaaaaacaccugucucuacuaaaaauacaaaaaaauagccaggcaugguggugcaugccuguaaucccagcuacuucagggggcugagccaggagaaucacucgaaccugggagacggagauugcagugagccgacaucgugccacugcauuccagccuaggcaacagagugagacucugucucgggggcaaaaaaaaaacaaaacaaguggccauuugccaaggguuuuguuuauuuugaauuucuaaaugccaugaaugccuaacugcagaucaucuuuugggagaaaacgcaagcccccaccccacaguccguaaccucuggggccaacacuggugcacaucgcuuguccuuccacaaaggacaccuguguuaggaguaagagcacaggaagugaggacccugggcaggaagggguggcaacgacuucugggggauuauuuuuuuuuaauuaauuuuuuuuuaaauaugcugcccaggcuggagugcaguggcuauuuacaggcacgaugccacuacugaucaacaugggaguuuugaccugcuuuguuuucaacuuaggccuguucaccccucuuuaggcaaccuggugguccccugcuccugggaggucaccauauugaugccuaacuuaguguggacaacugaacugcauagcacauuacagcccagaacuccuggguucaagcgaucuccccaccucagccucccgaguugcugggacuacagcagugaguggugcgccuggcaggggauuuuauuuaauuaauuguuuuuuugagacagagucucacucugucauccaggcuggagugcaguggcgugaucucggcucacugcagccucugccuccuguguucaagcgauucuccugccucaaccucccaaguagcugggacuacagaagugcacacugcaccuggugggggauuuuaguuaauauuuuuugaaacagagucucacucacucugucauccaggcuggagugcaguggcgcgaucucgguucacugcagucucugccuccuggguucaagccauucuccugccucagccuccagaguagcugggauuacaggugcaggccauuacauucagcuaauuuuugcauuuuuaggagagacaggguuuugccauguuagccagguuggucucaaacuccugaccucaggugauccaccaccucagccucccaaagugcuaggauuacaggugugagccacugugccuagcuggaauuuuauuuuauuuuaauuaauuuuuuuuuuuuugagacggagucucauucuguuccccaggcuggacucacugcaaccucugccucccagguucaaacgauucuccugccuaagccuccugaguagcugggucuacaggugcacgucaucacgcccagcugauuuuuuguauuuuuaguagagacaggguuucaccauguuggccaggcuggucuccaacuccugaccucaggugauccacccgccuuggccucccaaagugcugggauuacaggugugagccaccacgccuggccugggauuuuauuuuuuaagcugcuguuggguauacacauguccauuuuauuaaucuucauuucucaucuguacguaccauguaugucuugagauggcaaaaggaucuuccauugagugaaaagugagucucccaucccagagccccagucccacuccagggacagcacagcagcaguuccucuugaccucaggaacauuccacaggcacaggcuccguguaccuccuucaaaccucaucacacucugcuuaaauaauuuaguauuuuguaauuaugaaauaguucauuaaggcugggcaugguggcucacaccuauaaucucagcacuuugggaggccaaggcaggcaaaucaugaggucaggaguuugagaccggccuggccaacguggugaaaccccaucucuacuaaaaauacuaaaauuagccaugcgugguggcgggcaccugcaaucccagcuacucaggaggcugaggcaggagaauagcuugaacucgggagauggagguugcugugagccaugaucgcaccacugcacuccagcauggguaacaaagcaagaccucauccuggggggaaaaaaauaguucauuaaaaaauuuuuuucuuuuuuuuuuuuuuuguuuuuguuuugagacagggucucacucuguugcccaggcuggagugcaguggcauaaucucagcucacugcaaccucugccuuccggguucaagugauucuuguaccucagccucccaaguagcugggaugacaggugugcgccaccacacuugguucauuucuguauuuuuuguagagacaagguuucacuauguugcccagacuggucucaaacuccuggcucgggccauccacccaccuuggccucccaaagugcugggauuagaggcaugaaccauugcaccagccuaagaaaauaaaauuuuauuuuacuuuuucuuucuuuuuuuuuuuugaaauggacuuucgcucuuuccgcccaggcucgagugcaauggugcaaucucggcucacugcaaccucugccucccggguucaagugauucuccugccucagccucccaaguagcugggauuacaggcaugugccaucaugcccggcuaauuuuauauuuuuuuaguaaagaugggcuuucaccauguuguccaggcuggucucgaccuccugaccucaagugacccaccugccucagccucacaaaguguugggauuacaggcaugagccaccauaccuggcccuaaaaugguaauuuuuuuuuuuuuuuuugagacggagucucacucugucgcccaggcuggagugcaguggugcaaucucggcucaaugcaagcuccaucucccggguucaugccauucuccugccucagccucccaaguagcugggacuacaggcacccgccaccacacccggcuaauuuuuuguauuuuuuguauucuuugguagagacagggucucacuaucuugccucggcuggucucgaucuccugaccucauuauccgccugccucggccucccaaagugcugggauuacaggugugagccacugugcccagccuaaaaugauaaaauuuuaaagucacuugggugguuuuauuaaaucuagaugguagaaaaaaaaucacugacuaguguccuggccccugaaaggcacuuaaauaucuagggaaugaauauguaucaggggaauccucacacggagacagcaaaaguaaauggggguugaaacaucacuacugcggccgggugcagcagcucacgccugucaucccagcacuuuuggaagccagggcaggaggaucacuugagcccaggaguucgagaccagcccaggcaagauagugagacccugucucuaccaaaggaaaaaaaaaaaaaaauagccgggcacgguggcacaugccuguggucccagcuacuccagaggcugaaacuggaggauugcuuaagccggggaggucgaggcuauggugagccgugauggugccccugcacuccagccugggcaacagaccgagaccguguccaaaaaaagaaacaucaguacuugauaugagaaauggccacuaaacacugguaagcuuguuaaaaacauggacccaugggcaccaaggagucucugcgggcaggggccguggggugcgggcagcugcagauucaccucacccagacccacauguccccagggucuaggaccaugguccccaaagagcagugcacaagccagggcccugccagcgcuguccaggaaggaccagccgcagccugcuguggccccaagcuggucccagaagguuccaggaaggaaucucaucuauucaggcgcaaggcccccagaaugacaagaauguugccaaagacaggcguuugcccuuuacaucaugcaucugcaccuuagggucggcaaauucucaggccguugaauucucacaacauccugagaaauaggcaucccugcccgcuagcggccaccacagucccacaggcggguacucaauccagagcacaggugcucuccgcucucggucccaccuggccugagagggaggagcaucagcggaggacaguccaguccccaggagggaggggacccucugaccaccaguguuccaggcaggaggaagcggugcguccccaucaggguccuguguuaccccaggguccuccaugcuguaacuguucucuauuugcucaaagccuguaacucucaguggagauaccaccccugguggcuguagcccagccugcugcccucccuugcuggccccuuccugcaccugggcuguccccacagcaagugccacuggcugagccucccagcugugaggcagacagaugcagcgacaagcucagaucucagcucucgccuccaccuugugguuucucugagugucacacauccccagugggaugcagaggacgcuacuaacucuuccuggaccagagugccuagggcucugcagaguaaacacugagggcaccgcuaauuacaaaaagccuuguuuccaaccaaaacaggcuugcuguuucccaagcacacuucgcaugggcuuuauuuggagaccuucauuauacagccccgcccccaaggcaaucuuaccugaagagccugcugcccugggucccaaaugucccccaagucccugucccugucuccugccuugagucuggucacugcacagaugccucccgugcgcuucauguggucucaguccugauggcaacccuugucacuagcccucaaagggguccuggcaguaguggccagggcuguauuuguggucacugagaggcaugucauguuaaguuuuaacuuggcuuuaaaugacagauccacuguugcacuggggaacccauggccaaguuuggaaacaaccaauguaaaugggcuuuuacaagaucuauuggcaaauaaggaaccacccugaaguaaguaacugaaaggaaaaugcugggcaauucaccaggaaaaucaucuccacucucggacacuguguguccccacguuuggagggcagcugccauccauccccccaaauagacauuaaugugggguauguuuuuagagcaaaaacaauuuucuggaauccagaaauuucucuccuaaaauaagccuguaaaauuauuuuaagagaaugugaaucaggcccauguccauauggugccgguagcacacuucuaaagacaaacacacugaggaagcaaacaaaaccaagcagcuucugacacuucaugggauggagugcagacuggggugcccccuucacuuuuucaaccaccccacugggucgucgccccaucccuggggcaccuguguagaggacagccuguuccccucaauccccaggcugcuccaccuacccccuggcacugccaccaccuggcaggugagugugggucccauccccauuacuuccccggggagcccuccagggugucccgagauggaaaggaggccucaggcagauacggaagccagugcgucagggucagaggcugcaaagcuggaggagaacuggggcgucugcugggcguggcgaugaaggggcuggugugccagguggacagaaugccagggagagcggggaaggaacagugcucauguggccccgccauguucagccaggauucauaaagaaaguggaaccaggauaucaugguccaccucuuuagggaggagagggaugagcggugagaggugguggugucaccugcccggccagccguccccacagcuucuccaccuccgcucccacucggccaccccuuccuuccccuccucuccauggaggaggccucccugcuuuuagcuuugccucucccaccccucacuggcaaggcaccguccuugggauuagaaagaugaaaaggccaccgccaucacggagggaauggacaacggauaaaaccaccagcuccuggaaaaggacgugcagcggcucccagagccuuggcaagccaacaccagcccuguccuacacugcucaccauacaagaaucgcacgauuaacagcaguucuaagagaugcguguccuuauuagccccacgaugcacauggggaaaccgaaguccaaaaagguuaccugagcacccaagguugcacagccagugaccugugaagcuggauucaaagccagagucuccccaccuuggaccacgguguccaagguggaacaugcaaguagauguucaacucugaaggcacacucauacugucuaacacuuagcagguuggcaaugauuuuuuuaaaaguuaggccaggcgugguggcucacaccuguaaucccagcacuuugggaacccaaggugggugcaucgcuugaguccaggaguuugagaccagcuugggcaacauggugaaaccccgucucuacaaaaaaauacaaaagcccaggcacacuggcucacgccuguaaucccagcacuuugggaggccgaggcggguggaucaccugaagucaggaguucuagaccagccuggccaacauggugaaaccccaucucuacuaaaaauacaaaaauuagccgggcaugguggugugugccuguaaugccagcuacuugggaggcugaggcaggagaauugcuugaacccaggaggcagagauugcaguuagcugagauugcgccauuguacuccagccugggcaacaagagcaaaacuccauccugaagaaaaaaaaaaaaaauuagccgggcaugguggugcaugacuguggugccagcuacuuggaaggcuaaggcaggagaaucacuuaggcccaggagggagagguugcagugagccgagaucacaccacugcacuccagcauuggugacagaguacgaucuuaucucaaaaaaaaaguugauaaggucagggguggcccaugccuguaaucccaguguuuugggaggccaaggugggaagauuacuugaggccaggaguucaagaucagccuggccaacacagcaagacccccaucucuaaaaaaaaaaaaaaaaaugagcugggugugcaccuguagucccagcuacuugggaggcugagaugggaggaucacuugaggccaggaggucaagguugcugugagccaugaucacaccacugcacuccaggcugggcgacagagcgagacagucucuacaaauaauaaauuaaauuuaaaaauuuaagaaguugacaacaccacuggugaaggugcucugugauccagccauuuggcaacacccacaacauuccuaggagcacagcccuggauggggguucaucuggggaguucaccuuuggcugaugcacaugugcaaaauaacuggauaaaagcaguuauuaccugaaauaacaaaauaucauccuauaauaauacugccuguaauaaaagauuagaaaccaccucaaguuuaaccaauagaggcuagcacgguggcucacaucuguaaucccagcacuuuaggaggccgagaugggcagaucaccugaggucuggagaucgagaccagccuggccaaccaacauggugaaaccucgucucuacuaaaaauacaaaaauuagcucggugugguggugggcaccuuuagucucagcuacuagggaggcugaggcgggagaacugcuugaacccgggaggcagagguuguggugagccaagauugugccacuguacuccagccugggcaacagagcgagacuccuucucaacaaaagcaacaacaacaacaaaguuuaaccaaaagagacuggccaaaugcacugauaaacacacaucagggacauuuccaucauggggcuuccagagucucgcucugucucccaggcuggagugcaguagcacgaucuuggcucacugcagccuccgccuccuggauucaagcaauucuugugccucagucucccaaauagcugggacuacaggcaccucccaccaugccuggcuaaguuuguauuuuuaguagagaugggguuucaccauguuggccaggcuugccuugaacuccugaccucaagugauccacccgccuuggccucccaaaguguugggauuacaggcgugagcuacagcaucuggcccacacugacuauucaaacucucacauaguacaugaagucacagguguggaaaggucuggaaaaauuuacaacaaagggcaacagcauggguacaauuugccuuuggcaauuccagcuuccauccacacacauccacuuccucccuacuugcauuacaggaggaaaagcuccccuccacauuucaggaacugcagccuaggugcacaaugggacucacugacagcaucaaaccaccuauauggcugcccugagacaaagcuccauggcccucuguagacuccccaccagccccugcucucuggggaacccaaggggccuggcuccuccauugcccaguggccccaggugccucggcccuccaggcucucuccuccaucucuccucccaccugugcucaaguacuaccucuaccaccucuccugagacuacugauaaugugcuuguacugagcgcuucuuuucaaagaaccuguacuacauuuuuuuuucuaccauuaguaacaaaguuucccacaaccaaggcccugggacacaucccaguagaggugcuuucuugcuaacaacaagaagagggggcugugcauggugacucaugccuguaaucccagcacuuuaagaggccaaggugggaggaucaucugaggucaggaguucgagaccagccugggcaacauggcgaaaacccgucucuaaaaaaaaauuuaaaaauuaaccaggugugguggcacgugccugucgucccagcuacucgggaggcugaggugaucgccacugcacuccagccuggaugacagagugagacccugugucaaaaaaaaaaaagaaagaaaaggggagguguaggaacuaugugcaacacuagccuuguuagguugaaagaguggguaccacacccagaagacuggauugagauagaagaaaagagguugagaaucuuaaaaacuacuuuauuuacccucaugcuaaauaaagucucaucagacauuaaaggcccugucuuggggcaagagaaggggggaaaaaaaaaaaaaaaaacagauacacaaagaggaaccagaaaaggugagggggaagcguuuggguggcggggguauaugccaaugcugcugagaaggcagguggcaccacgagggagggaguaggugagguuuggcaacagggaugucaucacccccaggacaaaggugaaagagggucugacuugcuuugagaggcuucccaggcuuugaugcaaaaugugccacguguuuguuggcucugggaccugaagccaaguucugcuaccuucuuuguaaagugggguaacgugcaauuuacagggcagucagagucacaugagauguuaagggggaugauccuugggcacaguuuaggugucugaccagggccuuacggcaggagcaugugucacuguuacaggacggcaggggcucagcaagcaccucacaagccccaccaggaaucccggccccggcccaaggcccugcaggugccagagggccuacugagcaauggggugaauaacggcuccuaaccccuuucuggggugugggcaacagugguuggcuccaggauuuccauuuuacucucaccugccaacagguuuuugguacucagcaucuguauagcagguguaacguccuggcauuugcuggcggaaucgauuucacccucuugacuucuuuccugaaucuaucucgcacugcuugcuccaaaaacccuuagcccucuaugucuuggcuauugagaacuuucuucaaccuccgcucaaaucucuugucaaaauucccacucccuagagcuuucacugauuauuagaucuaacuacuuaaaaacauuuacgucaacuucauuuaacucuaaugaaaagcaucacagaacaguuugaaagcaggggggcuucuauugcuucuucauauucaaaacaauuuuguuuauuagucuuccauggagacaaauauguuaaaacuacaggguuggccaggcgcgguggcucacgccuguaaucccagcacuuugggaggccgaggcaggcggaucacuugaggucaggagauugaggccauccuggccaaccuggugaaaccccgucucuauuaaaaauacaaaaauuagcuggcuguuguggcgggugccuguagucccagcuacucaggaggcugagacaggagaaucgcuugaacccgggaggcggaggcugcacugagccgagaucacgccacugcacuccagccuggcgacagagugggacucugucucaaaaauaacaacaacaacaaaaacaaacaaacaaacugcaagguaggcugggcucacaccuguaaaucccaacacaucgggaggcugagacuggaggaucacuugaggccaggaguuugagaucaaccugggcaacacagugagaaccccaaaccucauaucuaccaaaaaaaauuuuuuuuuuauauagcugggcaugguggugcacacccacagucccagcuacucagaaggcugaggcuguaggauugcuugagcccaagagguugaggcugcagugagcuaugauugugccacuguaccccaggcuugagugacaaagcaagacucugucucucuaauauaacaaaacaaggcugggcacuguggcuuacaccuguaaucccaccacuuugggaggcugagggguggcagaucaucugaggucaagaguuugagaccagccugggcaacauggugaaacccugucucuacuaaaaauacaaaauuagcugggugugguggcacaugccuguaaucccagcuacucgggaggcugagacaggagaaucgcuuaacccuggagguggaggcugcagugagccgagaucaugccacugcacuccagccugggugagacagagcgagacucugucucaaaaaauaaacaaauaaaguaacaaaacaaaacuaacugggggugguggcucacaccuauaaucucagcacuuugggaggcaaggggggaggaucgcuucagcucaggaguuugagaccagcaacagagugagauccugucucuacagaaaaaucaaaaaauuagcuggguaugguggugugugccuguguuuccagcuacucagaaggcagguggauggcuugaaccuaggagguugaggcugcagugaguggagacagugccauuauacuccagccugggugacagaaugagaccuugucucaaaaaaccaauuuguuuguugaaauaaacaaaccaaaacaaaccaacaaaaaaagaaagaaaaaaggaaaaaaccuauaggguagccucuuucccuuuuccugcaucccugccccuugacacaggugcugguggaacuuagugaagacaggcaagaaucaagaacagauguuagaggaacacugcucucaaccuaaagaaaauagcuuuauggugagguauagcagcucaagccuguaaucccaacacuucaggaggcugaggcagguggaucacuugagccuaggaguucaagaccagccugggaaacauuaagugagaccccagucucuacaaaaaaaaauguaaaguuaaccagucaugguggugugcaccuguaguccuagcuacaugggaggcugaggcaagaggaucacuugggcucaggauguggagguugcagugagucguguuugugccacugcacuccauccugagcaagagugagacccugucucaaacaaagaaacaaacagagaaauggcuuuauaaauuacagugauucaaaggugaaaaggcuuaauacccacaguuuagugacaagaaugcacccagguguuuuucauauuggcaaguguaccacagcaguguaggaugggguaaggauagggagcacuggguguaggauauauugggauugucuguacuaucuuugcaaccuuuauguaaauuuaaaguuuuuccaaaauaagaaguuauuuuaaaagaagacuauugcucagauugguaauuaagagcgcucaguuauuauauaaaugcucaauaugggcccaacccguagggguucccacaaguagaugagacucuacccuguagggcccaagaggaaacaccaugaagguccuggagauccucuuauuccucaaacaugccacuaccauugccucgcaagagcccugagggggaccagugcaugauuguaagacaaaaugacaucaggauuaagcacagcuccuggcaccuggcaggggcucagcaaacauuugucacaucuauagcuugcucaggugaggugccuggaaagucuccccaguggugguaaaccuagucuugggaccugaguagggaauuaggagugucaggggcuggugggugggaagaauaacauucuuagcaaaggaaacaucagguuaagguggguauguuuuagauagaggaagaagaaaugcaacggaacagaaaaagcguggggcggggaaauugaugucuuccauguucauuaucugccuaaaauagaaucucagccuuuuuuccauccuuagaauucagcacauaauuuggacaucaaagaugucaaucagagccaagcaugggggaggcggacccuguuuagaucucugaagcucaggcuuuugcaaucucuguuaacgaaaccuaugccacaagugguaaauaccgaggacgcuccauuuuagucaugaucuuuauguggcuacuugaaaagcuuuuccgccuuucugauaaacauuccuaggagaccucuuuugcccucauuuccuugcccaguugaggcuguauuuuuuaaggaaggaaaauccaaaaaucagggaucuuguccauuuucccuaucuuuucacggcggggcgggagaagagggacagcgggggagguggagagaagaaacggcgggggaaucaaagauuaggcguuguugucugugccaaaacggagugagcccaauaucaacaaaucaaaauccaaaacggaacaaaaaagucacaggcccgcccugcucgcgcccccgcccgcccggacgcccaacaggugcuucccgggcccgcccgcagccacaguauccuuggguggccacaaaguaaccgcccgcgcagcugcagccaggcccgcccguacucacggccgcuccgcgguccgcgccccggcccgcagcgcccauccggcccgggccccggucagcgcgggcucggcucucaggcguucccggcgcggcccgggacgcgcugaggccguuaacgccuaggcagggcgcgaggcauccucccgccgccgccccgcgggccgccug

SEQ ID NO: 192610 - RNA, 56367 nt, Homo sapiens
gcuccaggaagugcgggggcuccagccgcccggccggccgcgaugcauucuggggaaggagcagcaccaaauccaagauggcggccagcaggaggcugaugaagguaaaagccauucucuggcagcggccgggcguggggcggcguccuaggcuccggauccccgaggcaggcggcggcuucucagggcgcugccgucuggcuuccugcccuacacggccucgucgguucccugggccgcgcgcaggcucaaggugcuaacggggcuggccuaggccgcagccugggcgggagcgcaaggccgcgcugggagccgcugucggccccucagcccggcccggggcguucacgccacucuccgcccggagcuuggccgcgucccccugucgcggaggccgcgguccgaucugagggcgucguuaaugugagagcccgguugggaggcuccaaaccgggcgccuucggggaaggcccgagcgccggagccccugcccggagcccgcgccgcggaaccgccccgcccugggccgcagcgcgccgggcuugcagcuccgcuuggcccggccgcagcucgggagucugggagguucgggcuaggaaagagagaaggaggccaggcggccaaaguuaggucaguuuguuggugggucguuuggaauugcgcuggguccuagcaaacugucgccuugugacugcagagucacacagcggguaaguuccaacuccaggaaggccugaggucggccccgaucgcggcgcgguucugcuucccucuccuccacucagucaucccgaucuccccucccugauaaagugccauuuuuggggggauaacgguugauuucagucguucgaaucaaaacgggccaaaguuuauaauaauaauuugguacuuuggaucuugaaugcagcagggugcuuucucgcuaauuggcaccuuuuggugaggaacacaugcuaaauuggcuuaguacuuuugccaguggauuugccaagguccucuguagcccaccccgccagcaucugugagucggcggcuggguagugcugccggccugcaacgggccggaaauuaaaaaaaggcccaggagccaguuuccugaggggagauaaagagcugggguucguucuaggcggagcagugcuugguagagcuagacauugaacuuggagccacagucucugagcauucccuccgucccugggaacguuuccuuucuuuuguucccuaagggcuagagaggacauuaacuuuauaaaacuggaguggaagugggcacaaaagaacagucagaggacuucagaccucuccucaucucuuaagcuagugacaccaccauucaccagauaaggggucgguuaauggcuuucuuuccuacccuacucccaggugcagucguccauuaacccuuguggauuuaaauuuagaaagauuucuggagugcaggccgggcgcgauggcucacgccuguaaucccagcacuccugggaggccgaggcgggcggaucacuugaggucaggaguucaagaccagccuggccaacauggugaaacccugucucuacuaaaaauauaaaaauuagcugggcgugguugcauuugccuguaaucucagcuacccgggaggcugagguggaagagucgcuugaacccggcagguggagguugcagugagccaaguuugcaccacugcacuccagccagggcgacagagugagacuccaugucaaaaaaaaaaaaaaaaaaaagauuucuggagugcaugccuugcuuucuaauguuacugaaauuacucugaaucuauauccucaucucucaggugcccucccaagugcucuccuccccagacuaccccugacggacaccagaguucuuuuaaagcagauaacucaauucuuucacuccuguuaaaaaccucuaugguguuauuguccucagcaguuaauccuaaccucuuacuuggcaugcaggaccuuucugagacuggcugaaagcaaucccuugagccucaccuccugcccuuugguuucccacaguucuugcaccuaaucacaguagcuacuauuuuuccagcuuuuacuucgugcuuuauaugcaugaucauguuuaauccuuccugugaaguagacauugugauuuccauuuugucgaugagaaaagauucuuuggcuugcccaggguuaccuagcuagggagagugaguugugaucgaauucgguucuuucuccaaagcaaagucuccugcucuuacuugcugucugaugucccuuugcacguguuguuugcucuacccaagaaaagcugccuucuccucacuucucccuuccagagaagucccagguucaacuccagugccaacuacucugugagcccgugcucccacaucccccuucagaauguguuguuuccuccuuugugugaccacagcgcuuucuuuauauuucucuuugagcacuugucacaaucucuuuguguuacagacuugucuuuccuguacuggguucugagaucccgaagggcagggaucuugaccuaauucauccugguagcccccuagccuaucccaguugacccaguuuggaaucuccaggcucucaggggucuaagaggggacuuauuaugguuuuaaaauuauuacucuguuucuaaaaaaaaacagaccuuggaaaaaaauuguaacauuaacugaguauuuauuaaguauuagguuauuuacguaagucaucuuuucaacacucaaaguuaguguauugucauuuguauuuuuuauaaaugaggacauugugagguuaaguagguuaagggaguuaccuaagguagaauuguggaacgugguggggagagagaagacgcugacucuuccuggcuccaggauccaaauuccaugccucuugucaggcugucuuucuuacucaaaggcugcauggagcgguguguuguuucuuaaguugaggauggaaaggcuuucaguucacuaggggaacaccaguuauguaaugcugaucauuggcugugagaaucaauguuuaagacuguuuuuuuuuucuuuuaaaggaagaaaaauuauugauacaaguugauaaacagucuuuucaguacauagggugguaauaaagugauuuucguuggugaaaaguuggggcuuagugcauggaacagugccuuaggcauagcaaucuagcaaauguugaaugaucaaauuaauuacaucuuaaagaacuuuagauuucuguuaaaaauguuuucuaggacauuccacagcaaagauuucuuuguaacaauggacugucugcagauaguguaaaacacauuauuaaaaguagagugauuuacauauacuacacugagaaguuauuuuaggcaaagugaguaugauaaagucuuuuauuucaaaagcacuugccaggaggcuuaaccucuuuuagaagccuuuuuaggaauuacaguguuaauaaaacauuaaguacauuuuaauuugcaagcagcuaauuuagcauuguuggcuacaaccagauuguaaccauugcuucaaucaggauggggaaauugcugcaaaagccaaaagugaaaccuuuauguguggcuuaggcaacugauugccaucugaucauuucuuugcagcuucacacugcacacauuuccccuaagggcccuccuguugaguagcuucccagaagggcuuuucucagaggggaaaucuguggauuuagagggguguguguguaaugucuuauuacuuaucaugacauaacuguugaguuaaggaguuucacucuuguugcccaggcuucagcgcgauggcacgaucucugugcacuacaaccucugccucccagguucaagcgauucuccugccucagccucccaaguagcugauacuauaggugugcaccaccacucccugcuaauuuuguauuagaaaggagguuucaccauguuugccaugcuggucucuaacuccuaaccucaggugaucugcccgccgaggccucccgaagugcugggauuacaggugugagccacugcgcccagccuaaugcuauuuaaaaauguucacucagaacuucauauuguuauauuuucucccaguucauagucauaguaggaggaaccucuaaaaguucauuccuuggguuucguuguauuaagcagugagguaguuugcuuuugaguauagguuuagauucugagguugggugauuaaggagauagagcaaugaguaugucacauguuucaggaggugaggggaguuuuauaugugauguuaugccaguguaaauguccugaauccacugaggcuuugugaauugagaaaaacguugcgucuuuuuuucuaaauucaugcauuccaguaaguugggacuguuucagccucccuuaaugguauucuuuguaaauguuugggacaggugaugggaaggaguauacucaauuauugcaacauuugggaccuuuuaagguauuuacuagaaaacucugaggcaggccaggcguggugacucacaccuguaaucccagcucuuugggaggccgaggugggcggaucaugaggucaggaguucgagaccagccuggccaacauagugaaacccccgucucuacuaaaaauccaaaaaauuagcugggcgugguggugggugccuguaaucccagcuacucgggaggcugaggcaggagaauugcuugaacccgggaggcagagguugcggugagccaagauugugucauugcauuccagugcgagacuccgucucaaaaaaaaaaaaaaaaaaagaaaacccugagacaaaaacucuugucucaggguacuggggccuuuucugaucuuguuaaaacucuaaauuaggagacuguugcuuuaaaauuuuauuauaagaggacacuugaaaguauucucauuuuauuggaacauuuauuacguuuaagauauuucuauauucuuugcuacagcaguaaaugugagagccacauuucuuugcagcuucacacugcacacacacugcacacacugugcacauuagagagccacagagacguuccuccugagccagacuccaaccacuuccagaguuuucuugggaacggcacauagaucuguaggcaucugagucuuagcuccuccugugacucucucccucuggccccaugcaucuccuccugucccaccuuaguuaaugguucacuugucuacucaguugcucaaggaaaaaacgccagcggagcccuucucggcucuuccucccuugucuagucaccuggcggauucugcugaacuaugccuucagucucucuucucugccugucuucucuccauccccacucccacucccaaugccacugccacucccacugccucaguucaggccaucccuguuugugguagacaccugcaucgagcuccuuaaugguucaucuaaacuccuuacuggucagcgcacucucugucccacacuacuccuaaccagcagugcaucagaguaguguaugguguggugugcaguagagaagugcacaugagcaggcccugcucucagagauuggagcagaauuuaguagggugaggaugaggcugggacucuggauuacaagugcacauuccuuagcuuuuuccuucaaggucuugucucaccagccuugucucuccccacuugcccguugaguccccuaaaaacagcaugcuuugcacacacacucuggaucucgugauuggcaucccugucucuucucuguaccaggguaacuuuuugaccuuugagacucagcucaaggggcaauuccucugcccuugaggagcucaacaaaggagaaaaauggcacguaccuggaacaaagaaauccugggcuggccacugugugcuagaugucugccaccugaauaauggcuugcaggagagggaaagacccccucugacacugaggaggaggucgaacuuggccuggcccuuuaagcacgaguaggguuucagcaguugaagaagacggacuggguggccagugagguugagucucucucaucccucaggagggcugugggcagugccuaugggaaaugcuuugaggagccccagagaccaucugccuacuccccagugcugcuugcgucugaccuugugccgucccgcuuuggguuuuaguuaggccagccccugagaugcuuuccagaaguguugaggcauuggcuugauuuuaccccagauuggcauguccagugcaccugguuccuccagagcuaggagaccucccucugccaggccagccuuggagggugagcuaccucucuauagaggggucacugagggcagugcugauggauuuaaggacagguggcagagaugccauagccuuuagguugaggggccagaucuacauaucuccuggaugcuacagcuauccaggagaaguggcaugccacucacucagaaagggcuuugcauguaucuccuguggccagcuucaucaugccuguucuugggggacauaaauaagccuaaccuccccaagccccccaccccuauaagaaagggaggaaggggcuuuugcucagagcaaagcuguuuagaggaagacuacagcauagcaguuaaaagcucagguucuggaguuucaauccugggccugccaugucuuagcugagugacccugggcaaguuacuuuaccucucugugccuuaguuacuucguccgugugugaagguuaaaugaguuaauauauaccaacugcuuagaagagugccuggcauauaguaagugugagcuacuuguagauauuauugggaauaaccaagacauguuccagggcagggaggugaccagccugacaggaggggaggauuuggaggagugauaggagaugguauugcaaagguguuuucgggacagguuggggccagucugccuggacauacccucaucacugagagcccauucucuuaccugugguacucucuuauucuguagguuggagaaagaguuacugagacagcugugugaauguuuguuuaaaaauguuggcugggggccaggcgcgguggcucaugccuguaauccuagcaccuugggaggccgaggugggcggaucaugaggucaggagauugagacaauccuggccaacauggugaaaacccaucucuaccaaaaauacaaaaauuaaccaggccugguggugcgugccuguaaucccagcuacuagggagggggaggcagaagaauugcuugaaccugagaggcagagguugcagcgagcugagaucgugccacugcacuccagccugggugacagagugagacucugucucaaaaaauguuggcuuggcgcaguagcucacaccuguaaucccagcacuuugggaggcuaaggcagguggaucacuugaggucaggaguucgagaccagccuggucaacauggugaaaccccgucucuacuagaaucacaaaaaaauuagcugggugugguggcaugugccuguaaucccagcuacucgggaggcugaggcaggagaauugcuugaacccaggaggcagagguugcagugagccaagaucaugccacugcacucuggccugggcaacagaguaagacuccaucucaaaaaaaaaaaaaaaaaaagaaaaggaaaaagaaaaauguuuacuuggcugggcgugguggcucauauccgaaucccagcacuuugagaggucaaggcggguggaucacuugaggagaccagcaugggaaacaugacgaaaccccaucucuacuaaaaaaaaaaaaaaaaaaauacaaaaaucagccgagugugguggugcaugccuguaaucccagcuacucuggaggcugaggcaggagaaucgcuugaauccgggaggcggagguugcagugagcugagauggugccacugcgcuccagccugggugauagagcgagacucucgaaagaaaaaagagaaaaguuuacuuuucccaacaaaguugaauagcuuuuuuuuuuuuuuuuuuuuuuuuuuuuggagacggagucucacucugucacccaggcuggagugcaguggcaccaucucagcucacugcaaccucugccucccauguucaagccauuccuccugccucagccucccgaguagcuggaacuacagauaugcgccaccauacccggcugauuuuuguauuuuuaguagagacgggguuucuccauuucccaggcuggucucgaacuccugcccucaggcgauccacccaccuuagccucccaaaggauuacaggcgugagccacugugcccagcuuaaaauugaauagcucuugaacucaaaauuugucuuucuaauaucucagaaauuuaccuugcauauuguaaacauccaguguagugugacagucacuguguccaaagaugagcauaggugcuauggaaggcucccacaggugcugaacuggggcagggguggagguuugaaagcaacuuuuuuuuuuuuuuuuuuuugaggcggagucucgcucuuucacccaggcuggaguacaauggugugaucuugguucacugcaaccuccgccucccggguucaagcaauucuucugccucagccuccugaguagcugggauuacaggcgcacgccaccacgccuggcuaauuuuugcauuuuuguuuuuuuuuguuuuuuuuuugagauggaaucuugcucuggcgcccaugcuggagugcaguggugcgaucucggcucacugcaagcuccaccucccagguucacgccauucuucugccucagccucccgaguagccaggacuacaagugcccgccaccaugcccagcuaauuuuuuuguauuuuuaguagagacgggguuucaccauguuagucaggauggucucgaucuccugaccuuaugauccuccugccucggucucccaaagugcugggauuacaggcgugagccaccaugcccggcccccaauuuuuguauuuuuaguagagcugggguuucaccauguugguuaggcuggucucaaacuccugaccuugugauccgcccaccucggccucccaaaauucuaggauuacagaugugagccacugcgccuggccgaaagcaacucuugauugagaaguugaggucucagauguaauauucuugcuucuugucuucucuuuccuuuuuuuuuuuuuuuuuuuugagacgcagucucgcucugucgcccaagcuggagugcaguggcacgaucuuggcucacugcaaccuucaccucuggguucaagcaauucucccugccucagccuccugaguagcuggaauuacaggcgugugccaccaugccuggcuaauuuuuuuuuuuuuuuugagauggagucucgcuguguugcccaggcuggagugcagugguacagucuuggcucacugaaagcuccgccuccuggguucacgccauucuccugcuucacccucucgaguagcugggacuacaggcgcucgccacuacacccagcuaaucuuuuguauuuuuaguagaaacgggguuucaccauguuagccaggauggucucgaucuccugacuucaugauccacccaccuuggccucccgaagugcugguauuacaggcgugagccaccgugccuggccugauuuuugcauuuuuuaguagagacgggguuucaugguguuggccaggcuggucgugaacuccuaaccucaggugauccgccugccucagccucccaaauagcugggauuacaggcgugagcuaccgcacccagcccuugucuucucuuucaaccuugaagcagaaaguuaagaaaguugcuucugguggcuguguaguuucuccuucugacccuugcugcacacauacucuagaauuccagagcugugugagggaucuuggaaagcagacaccaguggccucuguuuacagaugaggaggcugaagucagugguggagccaggcccaacaucaagguccccugcucucugggccuugcuccugcuuuuuagaugguugcuuuuggucuugaggaagggacaagauggagaagaagaggguucauuucagauucgguggcuguuuggguuuuguuuguuuugguuuuuaacacuuccagggcuguguugauuauaguuuucuguauuucacuuucuugucagauuuugucccuacuuuccuagcauagguaggcagagcggggaacauucucuuuugacagcccuuaucccagcaggcacaucugcaaccaaagcaggugcuaaugucaaagggcucaugggcuaaugucagggcucaugugaugcuccaucuuucugagaggagaccaccugacucacggugaggaagaggguguaacucagagguugaauagccucugaacccgucugagauggcuuauaaaaaaguguuucacaccagcacgccucucauuaagaacagucagcggccgggcacgguggcucaggccuguaaucucagcacuuugggaggcugaggugggaggaucaugaggucaagagaucgagaccauccuggcuaacacagugaaacccugucucuacuaaaaauacaaaaaaaaauuagccgggcgugguggugggcgccuguagucccagcuacucgggaggcugaggcaggagaauggugugaacccgggagucggagcuuguagugagccgggauugcgccacugcacuccagccugggugacagagcaagacucugucucgaaagaaaaaaaaaaaaaagaacagucagcauaagaaaaccuaagcuuccugaaggauucuccacgaguuuuacacaggcaguucccgucgugcccauuuguccugugucaggcuuugugugguugagucuguuguggacagacuugaagaggucggugucccagcccucaaggagcugucagucugguaggggggugcuggacucuggaguuuguaauggaggucaggaaugccaggcacacccauguacagauggacacggaaacaccuuccaggaaugaggcccggcagccagaagcuggugucaaggccugcugaguuggagcuuuggccaugcuucccccaugcuuacuguggagguugugggcagugcguuccucuaagccucuguugaguguuuucuuugucauguccucuuagaaugaccaccugagaaggagugugcuguaaccucugagaagcacugugcugugauagaguaagaguucagauguagauuucugccuuugacuccuuaguguugugccuuugagccucagugcccugauuuguccagcagaugaugagaugacuucauaaaguuaugaucauagcuaaguguauuauuuauuuauuuauuuauuuauuuauuuauuuauuuauuuuuugagauggaguuucacucuugucacccaggcuggagugcaauggugugaucucggcucacugcaaccucugccuaccagguucacgcaauucuccugccucagccucccgaguagcugggacuacaggugcccgccaccacgccuggcuaauuuuuguauuuuuaguagagacggggguuucaccauguuggccaggauggucucgaacuucugaccucagguuauccaccugccucggccucccaaagugcugggauuacaggcgugagccaccaugcccagccccagguguaauuaguuaugaugauaacuaaauguaagauagcuaccauacugcugaccuauggaagggaugaugucuuggcauggguccugcccccuuagcuaaauguuaguugaaaugagagaauugcauuagaaggccaugaggcuuauguuuagauuuucaguauauugaauuacauuuaagucaugauuuaguggccaggcacgguggcucaugccuauaaucccagcacuuaggaaggcugaggcaggaggaucacuugagccuaggaauuugagaccagucugcccaacauagugagacccugucucugcaaaaaauaaaaugauuaacugggcauauuggcacaugccuguagucgcagcuucucagaaggcugaggugggaggaucacuugagcucuggagguugagacugcagugagccgugaucaugccacugcacuccagcgucggcaacaaagcaagacccugucucagggggaaaaaaaaaagucaugauuuuagugucauugcuaacgguugucuuaugcaagcuuggaaaguuugcauuucuguuacaauuauuuacuuugauagaccaguuauacuggaauuugguagauuuaaggcagguuuauguaacuuuccucagauguccagcuccaucugccagguuuuguuuugccugagcaguaggagccuagaaauauuccuugcacaacacaggcacauaaugacuagcugugcaggacuagggaaaauacugaauauguucauguuuuuguugauguaaauauuggucaauacuauuccagagcaagcuaagcccuccugggaucccacagaguaaacaggaaaaccugcucuguccguuucuaaugggagcauuaacucacugcuuuggguggcugagauagucaaaaaagagcaauuucagugcagguucuaguccugggcaugcucuauacaaguucuuugacuuggacaucucugagccuuggcuuuaccaucugugaaauggggcuaauaugccccacuugcccaucucaggacuaugaauuguaaacagugcagaauggccuuauaauugaccacuuccucucaagccauggcuaccccuuucccagcaucucuuuguuuucuguucuuguuggaauuacucuuuucuuuucuuucuucuuuuuauuuucuuugagauagacucucacucuguugcccaggcuggagugcaguggcgcgaucucggcuuacugcagccucugccuccugaguuaaagcaguucuccugccuuagccucccgaguaguugggacuacaggcaugugccaccaugccuggcuaaguuuuuuguauuuuuaguagagacaggguuucaccauguuguucaggcuggucucgaacuccugaccuugugauccccccaccucagccucccaaaaugcgggauuacaggugugagccauuguaccggacuuaauuuuuguauuuuuaguagagauggaguuucaccauguuggccaggcuggccucgaacuccugaccucauaugaucugccggccucagccucccaaagugccgggauuacagacaugagccaccaugccuggccucuuuucuucaagagacaaggucuugcuccguugcccaggcuggagugcaguggcaugaucauaacucauuauaacucauuauaaccucgaauuccugggcucaaaggaucguccugccucagccucuuggguagcugggacuacaggugugugccaccaugcccggcuaauuuuuuuuuuuuuuuuugagauggagucucacccuguugcccaggcuggagugcaguggugcaaucuuggcuuauugcaaccucugccucccagguucaaacaauucucccaccucagccccccaaguagcugaagacuauaggugaacacuaccaugcacagcuaauuuuugcauuuuuugguagagaugggguuuugccauguuuuccaggcuagucugaaaccccugggcucaagcaguccaccugccuuggcuucccaaagugcugggauuugagccaccaugccuggccauuuuguuauccuuauuauuuguagagaugggaucuugcuauguugccuaggcuggucuugaacuccuggccucaagcgauccuccuaccuugacuucccaaaaugcugggauuauaggugugagccacugugcuggccgguguucacuuaaaggaaaaaaaaaccuucaggcugggcacgguggcucacacuuguaaucccagcacuuugggaggccuagaugggcagaucaccugaggucgggaguucgagaccagccugaccaacaugaauaaaccccugacucuacugaaaauacaaaauuagccgggcaugguggcgggcgccuguaaucccagcugcucgggagucugaggcaggagaaucacuugaaccugggaggcggggguuguggugagccaagaucacaacauugcacuccaaccugggcaacaauaguguaacugucucaaaaaaaaaagaaaaaaaaauucagaacaagcugugcccaguagcucaugccuauaaucccaccacuuugggaggcugaggcagguggaucaccugaggucaggaguuccagaccagccuggccaacauggcaaaaccccaugucuacugaaaaaaaaaaacaaaaauaauuagccaggcaugguggcaccugccuguagucccagcuacucaggaggcugaggcaggagaaucgcuugaaccugggaggcggagguugcagcgagccaagaucgcaccacugcacuccagucugggugacagagugagacuucaucucaaaaaaaaaaacaaaaaaacaaacaaaaaaaaaaacaguucagaacaacgucuggguuucggugcuuauagacuuguagucagagggauuuuuuccaugugcuuagcucagugggagguuuuaguccuuuuaggagcuuguuucuagcuguagaaaugacacugcauucaucaaggcuccaguuuuuuccuugccaagaaacugggugguaugaaugugguggguuuuuuuuuguuguuguuuuuuuuuuuugcgauggagucucgcucugucacccaggcuggagugcaguggugcaaucucggucuacugcaaccucugccucccagguucaggcuguucuccuaccucagccucccaaguagcugggauuacaggcaugcaucaugacuccuggcuaauuuuuguaguuuuuuguuuuuugagccggaguuucacuauuguugcccagccuggagugcaauggcgcgaucucggcucacugcaaccucugccucauggguucaaguaauucuccugccucagccacccgaguagcugggauuacaggcgcuugccaccacgcccaguuaauuuuuguauuuuuaguagagacgagguuucaccauguuggccaggcugcuguugaacuccugaccucagguuccaccugccucagccucccaaagugcugggauuacaggcgugagccaccgugcccggcccucaauauggugauucuuaagcagagcagggguugcacaucacagucaucugggagcacuccccucagaaagguacccaucuuguacuggaggcugaugcaauaagcagguccuagauggcgccuaggcacagucagcucuccuuccuucuccccuguacccaucuaagcccuuccccugccucucugcauagggguauuaaacagcccccaggggcuuggccaugcacccuggcugaaaguucuggcccugaucaugagugcccugaguugguaaacacugcagcuaaacugguuuccuuucugcuucccuaacgcccccacugauuucugcccuccaugucucugcauacacauuucccacacauggacaccuguucucuagcaguucugucuucccccgucuuucaaggcccaucucagagccugucuuccacaaagcuguucccuccacuggugucugcuagacuuuccucacugugaccuaaagguuccuagagcagcguuucucaguucuuuuaacccacccucaacagccaagaaaaguggccuuaagcuuuacuuuccuuuagggauacuacaggccuuuugccauuuaacagauauaaaaugacacagugguauggaauaugcuuguuuacauuguaccaguguccuugcauugagacuugcugcccauaguacugcugugacaucugaagcaucccugacuggccccacugguuauucuucugcacgucuguucaccugcuccuggcacugacuucagaggagacucaagaggguguauaguacagucuugcccagugcagguggcuucuuucugacagcccuggccacuggcagcccugucugccccacccauuugaguaucuauaaugacaugacgacugcugccccgagucaggggggcuuagaccacgugaagguagcauuaaagaguuuggcacugagucaaaagcugccugggauagugaacacuuacuggccccaauucuuucuucuuuacucauauagaagguugaauccuuugcaggugaacuuuuuaaauuuuaauuuuuuuuuucuucugagguggaguuucacucguugcccaggccggaguucaauggagcgaucuuggcucacugcaaccuccugccuccuggguucaagcgauucuccugccucagccuccugaguagcugggauuacaggcgugugccaccaugcugggcuaauuuuguauuuuuaguagagacgggguuucuccauguuggucaggcuggucucgaacucccgaccucaggugauccgcccgccuuggccucccaaagugcugggauuacaggcaugagccaccgugucuggccuaaauuuuuuuuuuuuuuuuugagacagagucucgcucugucacccaggcuggagugcaguggggugaucucagcucacugcaaccuccaccucccggguucaagcgauucuucugccuuagccucccgaguagcugggacuacaggugucaccaccacgccuggcuaauuuuuguauuuuuaguagagaugggguuucaccauauuggccaggcugguguugaacuccugaccuuguguucugccugccuuggccucccaaagugcuggaauuacaggcgugagccaccacacccggccucggccuaaauuuuaaauuuuaaguuuuauuuuauuuuuauuuuuuugagacaaggucucacucugucacccagacuggagugcaguggcaugaucaugggcucaggcaauccuuccgcuucauuuuuuaauuuuuuuguagagaugaggucuuacuguguggcccaggcuggucuccaacuccuggccucaagugauuuucccgcuucggcaacccaaagugcugggauuacaggagcacuuugggaggccgaggcggguggaucccuugagguuaggaguuggagaccagccuggccaacauggcaaaaccccaucucuacuaaaaauacaaaaaugagcugggcaugguggugcgugccuguagccccagcuacucaggaggcugaggcauaagaagcacuugagccugggaggcggagguuggagugagcugagaucacgccuccacacuccagccuggagagcgagacuccgucucaaaacaaacaaacaaaaaacaacaaaauguggaauuacuggcauaagccacuucguccaaccagcaggugaacuuuuuaacguuugaagacagauguaugucaucuucacauuucuuuaggccauagguuccuggaccuuuugauuguuccugguaggacaugguccuugcuguucuuguccugagcagcccuuauuugauguggucuucuaaaguaugguguccagaacuggacacagcauuuggcucugaauaguucaggguggccuggacgcuaaacauggcacaaacgauuggucagcuaaaccagucaguuuuucaugcugcugcuaagguucaugccuugugcuuggugaaaaauuaaguguuuggaaccaaguccaggucuuuacuggaucucuaaaauauuucauucugugacuuggggugugguuuugcuauccaggauccuuagagguuuggucuuuaagccuguauucguuccuucccugauaugugguaccuaacuacaucucucucagcccacuucccaccagggugacuucaggccaccaguucuaaagccauucgauucuccucagcucuucuugauccagccucuguuuauccauuuuguacagaaacauuguaguggcuguugagagaaaggagcaucccuuuuagccagggcuuggggagcuccuuagaggaacaggcauuugagagaggcuuucaaugaugagcauguuggggauguggggcuggugauaggcaggacaguuagggacauccuuccagaagacauccuggggaaagacauagaggggggaagucaccaggcugacuugguaggauucugcacacugcucauuuggguugcaccaagagcuuuaguuggaauuacuggguugcaccaaagaguuuuagcuggaaauauuggaugggaggauuccuacauauuuuguugggggaagggucgucuagugcuguuggauuucuuuucuaguuuuucuuuuuuugagacagggucuugcucuguugaccaggcuggaguguaguggcaccaucauggcucacugcagccucaaccuuuuggacucaacuggucaucccaagucagccuccugaguagcugggaccacaggcauacaucaacacaccuggcuaauuuuuuaauuuuuuuauuuuuguagagauagggucuugcuguauugcccaggcuggucuugaguuccugugcuuaagugauccuccugccuugaccacccaguguugggauuacgggugugagccaccgccccuggcuccuggccuagauuuauuuuauuuauuuuauuuuguugagacggagucucacucugggagucugcacccaggcuggagugcacuggcgugaucucagcucacugcaaccuccacuucccagguucaagcgauucuccugccucagccucccgaguagcugagacuauauauaggugcacgccaccaugcccagcuaauuuuuguauuuuuaguagagaugagguuucaccuuguuggccgggcugguucucaaacuccugaccucaagugauccgcccaccucggccucccaaagugcugggauuacaggcuugagccacugcacccagccuuuuuuuuuuuuuuuuaaacggagucuugcucugucacccaggcucaagugcaguggugugauugcagcuuaccacaaccuccaccucccggauuccagugauucuccaaccucacccucccaaguagcugggaauacaggagucaaccaccaugcccggcuaauuuuuguauuuuuaguagagacaguguuuuaccaugucggccaggcugcucucaaacuccuguccucaagugauccacccgccucagccucccagaguguugaagcguuggaauuacaggugugagccacugugcccggccuuuuuuuuuuuuuuuuuuuuuuaagauagguucucgcucugucgcccaggcuggaguuggaguacaauggugugaucuuggcucacggcaaccucugucucacuuguucaagcaauucucaugccucagccucccgaguagcuggaacuacaggcaugcaccccuaugccuggcuaauuuuuguauuuuuaguagagaugggguuucaccaugucagccaggcuggucucaaacuccuggccucaagugauccaccugcuuuggccucccaaaaugcugggauuacaggcaugaaccaccacgccuggcgcuggcauagauuccuuuuuuuuuugagacgaagucuugcucugucaccaggcuggagugcaguggcgcgaucucggcucacugcaaccuccgacucccugguucaagcuauucuccugccucagccucccgaguagccgggacuacaggcaggcgccaccauguccaccuaauuuuuguauuuuuaguagagacgggguuucaccauguggucucgaucuccugaccucgugauccacccgccuuggccucccaaagugcugggauuacaggugugagccaccgcgccucgccuagauuucuugauuaguggcuccugagggguucugaaaccuggccuugugugaggguuaccuggggagauuuugaacaguuuucuaggccucauuguagaccccaaaaagaagcaaaagaggaacuuuguuaacugcuuugccaagacgcagguguguacaucugagcugugugacugagcacuggcuauauacagcaguguccuguucucccaucuccucucaggacuugaguccguggccuucugcuggggcccagggcccaucucuccuguuagugcuugcaaagcuguuaaguaaccaucccucucugccaugcuucacacuuugcccuggagugggcaucaagcucucugggguugaguuuggggcauggguguuuuccauuuucaggagcuggguggcaccccugggcuuuuucaguuccccucuauacacugaagucuacuugggcuccgaaguggaccucauucugagaagcauugcucucuuucuccugcaccaccugcccugguugggaagccugcuguccccaucaagagaaggaaugugugagcugccuggugcuuucccuugaacucucucuuugucagcacugcaccaucagcccugagcagcugacuuggguugcuucuugcucugagcagaacugaaacaaaccuuugugggaguguuauuuguaagcaucugucauucuuggcuuuggucuuccuaacucuguucuagagcugggcugcucuugcgguuuuuaucagguccuuucuucugucauuuguaacauccuuuugaauuccacuucuuggaauuuacauugguuuccuucaauuccuucccuaauucuucacugucaggaccauucucaguuaucggggcacaguuuugcuugaggguuuacaaccaucuugaggguuugagucaucuggccuuuugagucucagauauucagauggaacugaucucugaaugauuccaauuuuucuucuuucuuuuuuuuuuuuuuuuuuuuuugagauagggucucacucuaguugcccuggcuggagugcagugguuguaaucuugacucacugcacagccuugacugccagggcucaggugauucuuccgcuuucaccucucagccucccaaguagcugggaccacaggcauguaccaccaugccuggcuacuuuuuuuuauuuuuuauuuuuauuuauuuauuuuugagacagagucuugcucugucacucaggcuggagugcaguggcgcaaucuuggcucacuacaaccuccgccuccuggguucaagcaguucucugccucagccucccaaguagcugggauuauaggugccugccaccacgcccggcuaauuuuuuguauuuuuaguagagacgggguuucaccaucuuggccaggcuggucuugaacuccugaccucgugaucuaccugccuuggccucuuaaaguguugggauuacaggcgugagccacugcacccgggcuguauuuuuuuuaguggagacaguguuuugccauguuggccaggcuggucuugaauuccugggcucaagcagucugccugccuuggccucccaaaaugcugggauuacaggugugaaccacugcgccuggccugaauuuaucuucuugaaguuguuuuccucaguggaggcaugauuggaauuuuuuuuuuuuuuuuuuuuugagacggagucucgcucugucacccaggcuggagugcaguggcgcaaucuuggcugacugcaagcucugccuccuggguucacgccuuucuccugccucagccucccgaguagcugggacuacaggcgcccgccaccaugcccggcuaauuuuuuuuguauuuuuaauagagacgggguuucaccauguuagccaggauggucuugaucuccugaccucgugauccgcccaccucggccucccgaaaugcugggauuacaggcgugaaccacugcgcccggcaugauuggcauuuugggcuaaauaguuucuguccacaggaccgucuugugcagugcaggucuuuuagcauccuggccacucauagugcccgugguucucaguagaagcuguagaggauguugggaaauugggguggguuggucacagugccuggcaucugucucaggguaagggcuugggaggcucaagugcagagucguaucuggaugccagcaacacccuguugagaaacuuucuacuaugguaugcucaucauucucugaagaugucagggccuguuuguuuguuugccuguuucucucacuuuugccuuauaaucaguucuuccuuguugguuagaaucauguaaaggagguugccuuuucugucuuuggagagcuuaacuugacggcaagguaaguugggaguuuaugugauaacccuacuuaggauucucugagcuucccaacccugcugucauuagcauccucaggguugcccauucuucuuucuggccagguguguggcucacucccauggcaguauuucuuuuaucuuugucuguggauccccuggaucuccuugauaccaaagcaccaguaaguguccuuucugcaccccugcccuuagugcuccucacugacugcuuccucuccuuuuucuugagcaagauacaguuuuucacucucauguuacaguugaguuccaucuugccauauuuuuauaauucuugugaaauuuaccuuguguuuaucaucccuacuuuauuuuuuuauuuuuuuauuuuuucgagacagaguuucgcucuuuucgcccaagcuggagugcaguggugcgaucuuaguucacugcaaccucugccucccggguucgagcgauucuccugccucagccucccgaguagcugggauuacaagcgcccaccaccacacccggcugauuuuuguguuuuuaguagagaugggguuucgccauguuggccaggcuugucucgaacuccugaccucaggugauccacccaccuuggcuucccaaaguguugggauuacaggcgugagccaacgcacucagccaucacccauacuuuauacuguuggaguguggauuucugaaaccauaaaguauauuuacagaugauuuuaaaauuuguuuugucccauaaauguuagauaucuucacuguuguuucuucuuuuuuuaguugucuaguuucaaaguucuguguggcauauuuuuuuccuaucuguauuugguuuaaaacauuuuguuugcuaggacuccagccuuaagggacgugcaugguauacccuguccuuagccaagaaucuuacucuaguaucuugagccaaggucaaaaaagccaaacacagcauuggaacuguauuuauagaaaauccuucccaccccagauuccuuuuuccucccaaagccccagcuucccauccacccaccaaccuggucauuaagcacauguuugagcaccacugugagccaggcgcuggcaggaccagggcuuccugaucccugcccuuguugagcuuacauucuauuuggagaguggaaggagguggcagugugggugugagaucucuuccccuuucugagucugcccaggcuucauaauccccaggggagcauuucuuaugagucuugugagcaggaggaccagguggcaguuggcagguuggaguggucccucagguuccguaccuccuuaugcagggaaagaggggccucaugcagguggagaggggccaggccaccccauuccucacugcaggagguugcagcccaugccgcuaacgccuccucagggagaaauggauccaucaucgcucccagcagugccucuucucucaccacagcuauagccugugagaaaucccuauguucaggcuccacccacacuugcuggaccagaauuucuggggcugggcccaaguccaggugauuguggugggcagaugagggugacaggcaggagcacccuguggggggaaacuugugccuguugccugcuaugaagcaccaguguguuccaccucuuccguguauucauucacugcacucucccucucugcugcucugggccgggcgcccagcacaucuuccuacucagaaccaguaaccugggcuccgguucccccuuccuugccaauuguuuccuucccugccuguguagccucagggugccuuuuaaacuaccacugugugauggaaguaugaggugcaaggaucuuuugggcuugaugugggggcugauagggagcccccaagccacugugaguugaaguaccacguaaggagguucuggagggugcuggagcugggccagaggaagcagccuggcgaaggaggcagggcucagcuggauggugcucgggcugcagaagagaaggugccugacagguguggaggcggcuuuugugccacuggaugggaggccgggcugaggcggguagaguggcacuucaugugucagaguggaggaauguuggcgaggcugguguucuggcaggagggcauugcugggugguuuggguuauagcgccugccaggcauucacugagauguuggaggcaaugggaaaugucaggcuggugcacaguugaaaaacaggugacagacaguucugaagacaucucaggcaggacccugaagucguaaaguugugcuuucugggugaaauggcacuugcugcauugacuguuuauacaacaauaaccccacauauuugcaagggguccuguugcccacaacauggcuucccuuuccuuuucugcacucugggucuguuuugcagcugaggaaacaggcucagugaagguuucccguccccacccccccacucccaccccagucccagacuggaugguucucuuugcugugugcccauguugagguggaguccuucugaaaucacacuuauagcacuggguagaaaacuggauaugcguuugugucugguuuguucccaguccccaguuuuauucaucuuuagcuucucagcauccggugcauaaucagugcuuaaugaaucuugauuggaagguaucagguguagagcaccucaggauagcuccugccacaugucugcccuaugcagggugcugagggauuuaaacagccauggugaccaacccaaagaggaggugguacgucugcagaagcaugguucccccuguccuauucagggggguucacugaggugggggcuugucuuggucuggggcauggggagaggcaacaaccuugcagaggggaccgccauggcagcuccaugccuccuuaaccacuccaagcacaguuuaguccucacuguccaauuuugucauuagcauuuuuggcacuugguuuaauuugagggcaucaggagggaucuuaauauguggugcuuuccccuauuugacaccccuuuaugcuuugucaaucaacaggagcuugaagaaauccgcaaaugugggaugaaaaacuuccguaacauccagguugaugaagcuaauuuauugacuuggcaagggcuuauuguuccugugaguauugaacacuuccacuuccuaccagauuauucuuuaaggugaugugugugcuguugggcuuguuuuucugcuccuuaguaggcucuuagucuaggcagccagcagaugcacagaaguggcugucgcucuagggugauaagguagggaguguagccuuggguccugaguagagucacaucuuggcacucguuuugucaaauucagggaguccugagcuuugcagaucuguagacacagagaaaaggagugugucugugcuccugcucuuuccugacuucccugcgccuggccugauggaucagcaggaccuucuucucugagcuccucaggaggggacaagcauuccccucuagauauuuugcuuucucucuugguuuugcauucaugucucuaacccuuuggauaccuguauuucgggcuuuauuccugguccccuccaaccugugccuuccauuugucucaagucccuuuuccuaauugcccacauguuccccucaccccaugucuuuucuggggcuuaugccuccagugucugcccccacagcccagcucccccaucucacagucuucugccuucugaugggcucaaggcccuccuaacgauggcuuuccuuagcacccucuuagugccuacucuuuucugcauccuuugauccccuccccuucaagaggcuugucuuauaauuaacuccaguuugcaaucccccuuccucucacucuccugaaaccacgucacacccagcccacaggcugcccccacuguugucacaccucuagcucggcagugcuggcaucauggcccuugcuugccuccugagcuuuuggagcacgggcagcauuccagcccccaguccugugaccagccugccacucgcuccuguucugccacuccuuccuccucacucuuaaacaugacucuuguuggucuccugcuguucuccuguucuguuuugucucgggacccuacuacuuucggcaucauagaugauuaugccagacaugaaggauucccacaccugucuccauuccugccuucuccccggaagcugcaccaucuguccaccaggcggccucacuuggucauuguguagccuucagcuaccucagcucacacccuuguccugcgugagugcccuccuuuccuguucuuccucauccacucaccuucucuguuccuuuucauucccacuuugcacaucugagccucuggcccuugcccugugccugccgcuguccuguauauaauuuguucucauggauggauuggcugcuuugccaaagcagagcauggagcaugcuuccuccuguagaugcuucuuccugaugcugguuauaaggucaugagcauggagcaugcuuccuccuguagaugcuuccuccuguagaugauuucucccuguagaugcuuucuuccugaugcugguuauaaggugagcauggagcaugcuuccuccuguagaugcuuucuucuugaugcugguuauaaggugagcauggagcaugcucccuccuguagaugcuuucuucuugaugcugguuauaaggucaugcuuuuuuuuuuuuaagucccugaauuugaucagcaguuauuggauuuguaguuuauuuccauaaucauuuggauaacuaaggaaagauaugcuuuguaaugauuuaguaugcucagaauguuuaaaucugggagcuuccagucugauuuugaagaugaguccuuuagauuucuuuaggcuugaugguguuagggcucagggcaaaggguguggguggcagagacaccucugcaugggagggguuggccugugagugcagcccuugccuacucuagggaccugaagauggccgggaccaucugaccucuugucccuuuucuaauugagauuguguagucuacugagcaaagaaaugaacaguuaaucuguggcucuuuggaaaaugauaaaaaugaauggaaugguuuuaagugguaaggcuugggcagucuggcccugagaauuuaguggccugagagccugcuagccagcuccacggguagauugcugcugggcaugcucugccccaacucaugcaaaggccucccucugguuucacgcuggcaggggcuauggagcagugggcuaagaucuuacuagggcaaagguggaggcuggcugguagaauccaagugugcuugggcugaggcucuggggagcuauccaggccaaaguuucaccuuggagacgguaagcaacagccagggcugcucuugucccuguguauaccacuucuucucgguccucucccuugcuuucuuccagggccccuggguuuguaugaggaauguuucaaugaagucuucuuccuucuccagagcaguuaaggcauuguugacaucugacauccccaggguccacacuuguaccccaaccugggcuuuaggucuuccugcauuggacgggcugggccagcaugggaaucuacuauacaaacucaccugaggucugcccaguugggguaaaaguagagccaggccgaugaaggcauggcagcccagcccugguccuuaguggagaguggugcuguccuuggguagccaccuagcgauugcccuggucguagugcacagaggagggcaggugggagggaaggcuggggagguacuuccuagagacuucauuguugccaacgcaacucuggucuauucccuuuaaacauuuguuuuucuguaauuuuuuuucaucuaagaugcuaagguaacgucuaaggaagaaaauauuacccauaaucacaucaucaagaaauucaguuacauuuuguguacugcccuuuaggaacuagaggugugguagucacccuucuugaagcuucuagcccagugaauguguuuacucuuaaccuucagcauacuuccucucagccuuuuuucaugcaguuucuuuuuuuucuuuuuaauugaguuggagucucgcucugucgcuaugcaguggcacgaucucggcucacugcaaccuccgccucccggguucaagcgauucuccugccucagccucccaaguagcugggacuacaggugcgcaccaccacaccccgcuaauuuuuguauuuuuaguaaagacgggguuucaccauguuggccaggauggucucagucucuugaccuugugauccacccuccucagucucccaaagugcugggauuacaagcgugagccaccacgcuggccuucaugcaguuuuuaauaaaccauuucauaacuucauaauaauguuuugguuuuuugaggcaggguuuugugcugucacccaggcuagggugcaguggugugaucauggcccauugcagccuugaauuucugggcucaagcaauccuccugaguagccaggacuacaggugugugccaccacacccagccaauuucuuuuuauuuuauuccauuuuauuuuauuuuuugagacagucuuacucugucacccaggcuggagugcaauggugugauuuugguucacugcaaccucagccuccuggguucaagugaugcuuauacaucagccucccgaguagcugggauugcaggugugcaccaccaugcccagcuaauuuuuguucuuguuuuugagacagagccuugcucuguugcccaggcuggggagugcaguuaugcgaucucggcucucugcaaccuccaucucccggguucaagcaauuuuggcuaauuuuuguacuuuuaguagagacuggguuucuccauguuggucaggcuggucucgaacucccgaccucaggugauccacccaucucagccucucaaagugcugggauuauaggcauaagccauugcgcccauccuguaacgucuuaaauuuccacuacaaagguuccaguucauccacauccuugcuaacauuuguuauuuuacuuuuuuuuuguuuuuacguuacagccauucuaguugguauguagugcugucucauugugguuuugauuucuguuuucuucauacuaaggauguagaacauguuuuugcaugguguguuuuuuguuuuuuuguuucuuuuugagacagggucucacucuguugcccaggccagaaugcagaagcacagucucgucucacugcaaccucugccucccggguucaagugauucucccaccucagccucccgaguagcugggacuauaggcgugcaccaccacaccuggcuaauuuuuguauuuuuugguagagacaggguuuuaccauguuggccaggcuggucucgaacuccugaccucaagugaucuguccgccucagccuaccaaagugcugggauuacaggcuugagccaccgugccuggccugaugcacuaaaguuuuaaauuuuuuaauuuaauuuuuauuuuuagagaaggggucuugcucugucauccaggcuggagugcaguggcucaauaauggcucucugcagccccagacuccugggcucaagcagucuucccaaguagcuggcacuauaggcacaugcugcaacccccagcuaauuuuaauuauuuuuucuguagagauggagucuugcuguguugcccaggcuagucuugaacucccaggcucaagugguccuccuggcuuagccucugaaagcucugggauuuacagaugugagccaucacaccuggccuuaaauuuuuaauaaagaaguccaauuuaucuauuuuuaauuuuguugccuauacuuugguuugauuuuuaagacacuguugccaaauccaaggucaugcaaauuuuccugaguuuucuucuaagaguuuuauaguuuuagcucuuaaauuuggaucuuugauccauuuauauguagauuuuuuuuuuuuuuuuuuuuuuuuuuuuuuuugagacaggcucucguucuguugcccaggcuggaguacaguggcaugaucauggcucaccacagccucaaccucccaggcucaagcgauccucccaccucagccuccagaguagcugguacugaaggcaugagccaccacgcccagcuaauuuuuguauuuuuuuuuuuuuuuuuguagagaugggguuuugccauauugcacaggcuggucuugaacuccuagacucaagugauccgccugccuuagccucccaaagugcugggauuacaccacuaugcccugccucauuucuuauuuuaauaauaugagucuuuucucuuuuuccuuuuaucagucuagcuaaaguuuuuucaauuuuguugaucucuucaaggaagguuucauuaauguguguguguguguuuuucauuuaucuccucugugcuuacuauuuacuucuuucuuguguuauuacuuucuuuguuccuuaaaauauccaguuagauuauugauuucagacuugcuuuuucaauguagguauuuaaagcuguagauucccuuugagcacuacuuuugcugcauaacuuaaguuuugguaugucauuuuuuuuucugaggauauuuucuaauuucccuugugauuucuucuuugacccauugcuuguuagagaguacguuuaauuuccccauaauugugaguuuucuaguucuguuauugauuucuaguucccuuuccuucucccuuucccuuuccuuuuuuuuuuuuuuuuuuaaauaaauagagaugggggcugggugcaguggcucacaccuauauucccagcauguugggaggcugggguggaaggaucgauugagccuaggaguucaaaaccagcuugggcaauauagcaggaccccgucucuauuuuauuaaaauaauaauaauaauaaauggguucucccuguguugcccaggcuggucucaaacuccugggcucaagcgauccuccugccucagccucccaaagugcuggaauuacaagcaugagccaccaugcccccacccgccuaguuccauuucuuuuuuuuuugagacagagucacucugucucccaggcuggagugcaguggugugaucucagcucacuacagccucuaccuccuggguucaagcaaucuuuugccucagccucccuggcagcuggggcuacaggcauacaccaccacgcucggcuaauucuuuuguauuuuuaguagacacaggguuucgccauguuggccaggcuggucuugaacuccuggccucuuucaccuuuuugcaguuacauuuguaguuagaccucucaccuucuuucugcaagcuuauuugcacagcaguugcuccuaaaauccacgcccuccggaugccucauuccuccuuucugcauugccccucuggccuuugaugggagcugcauccugccucccugggcucagcacuugccuguaauugucaguucuuuucugcuuccugcuaauugugccacucugccuucucucuccccuacuuccgucuccuguagcuguaaugguugagaccaaugagggcagcccuguuuucugagggcacacuggaguuguuuuggggagaaagaguaucccccuacauugauggggcuguugagcuccuaucacagccagacacaagguucuauggacagaggccacagagaagccacccuccuggaauccauggucucuuaagcacugaguguggcuccaccugcaaggcacuuaagaccaaacagaagcagggcagcggugggugggagggugacaauaucuggacugcauaguggaaggcagugugagcagaaacuaugaaaaaauauaggcagugugaggacauauguguaguuugcauagauguacagaaauuaaggccuuugagagcaccauguaugcacagagaacguucuugggcugugcagcagaggccugacggcauccuggggaauggggugucuggugggauuuuuuguuuguuuuguuuuuuucacuucuauuuuuggugugagugcuguauuuuuuccauucuugggagaaaagugaauuauguaugagaaguacucauggcuauuugagcccaaaaggaaggaauggucuuugucaaauucgguuaauggagauugugauuuuaauuguagauacaauucagaagguaguuuaugaacauuaugaaaugaaagauuggaaaaccaguucuaaaauacuuauuccuggccgggcgcgguggcucaugccaguaaucccagcacuuugggaggccgaggcaaguggaucaccugaggucaggaguuugagaccagccuguccaauguggcaaaaccccgucucuacuaaaaauacaaaaaauuagccgggccugguggugggcgccuguaaucccagcaauuugggaggcucagccaggagaaucgcuugaaccggggagguggagguugcggugagcugagaucgugccauuguguuccagccugggcaacaagagcaaaacuccaucuaaaaaaacaaaacaaaacaaaacaaacaaaaaaacuuauuccuacuauuuacuuccaaagggaauacgauugaacucuuuaguguugaaguauuuguugccggccgggugcaguggcucaugccuguaaucccagcacuuugggaggccaggggaggcggaucacuugaggucgggaguucaagaccagccuggccaacauggcaaaaccccaucucuacuaaaaauauaaaaauuagccgggcgugguggcaggcaucuguaaucucagauacuagagaggcugaggcaggagaauuacuugaacccaggaggcggaggccgcagugagccaagaucgcgccacugcacuccagccugggcgacagagugagacuccaucucaaaaaaaaggaaauauuuguugccaaagaacuguauuaugaaaaauccccaaaaccaaguuguugaaaacaguacaaagaagucaucuucagaaaccaauauuagaacaagaugaaucucauguggcagauuuuuugauucaaauaaccaaaaagccuguuuucagaagagacaauaaauacuuaaaggcaaggagggacgugguggcugacaccuguaaucccagcacuuuguggggcugaggaggguggaucaccugaggccaggauuuugcgaccagccuggccaacaugaugaaacccuaucucuacuaaaaauacaaaaaauuagcuggguguggcggcaggugccuguagucccagcuacuugggaggcagaggcaggagaauugcuugaacccaggagguggagguugcagugagcugagaucgcgucauugcacuccagccucggugacagagcgagacucuuucaaagaaaaaucaaucaaucaaucaaucauacuuaaaggcaauuuacaaaguuaaguucuugugacuuucgaacauggaguaaggacauauuccauguucagaagucacaagaacuuaaccuccuaaacuuaacucuuuuggguuuuuuuguuuuuuuguuuuugagacagagucucucucgucccccaggcuggagugcaguggugugaucucagcucacugcaaccucuguuucauggguucaagugauucuccugccucagccuccuaaguagcugggauuacaggcguguaccacuacgccuggcuaauuuuuuuguauuuuuaguagagaugggauuucaccauguuggucaggcuggucuugaacuccugacuucaagugauccacucaccucagcaucccaaagugcugggauuauagguaugagccacugugccuggccuaacucagcucuugacaagguuccagaguggaucacgaaggcuugagagcauagaaaccagccuggggcagggccaggcacgguggcucacucacgccuguaaucccagcacuuugggaggcugaggcaggcgggucacgaggucaggagaucgagaccauccuggcuaacacggugaaacccugucucuacuaaaaauacaaaaaaauuagccgggcgugguggugggcgccuguagucccagcuacucuggagguugaggcaggagaauggcgugaacccgggaggcggagcuugcagugagccgagauugcgccacugaacuccagccucagcgacagagacuccaucucaaaaaaaaaaaaaaaaaagacaaaccagccuggggcacuccgagcagggcaagccgcguccccuuguucucucuuaacaggggacuggacuguguagggauaggcagcccacagggcuggucucaguagacaucccuguggcagggaaagcuucagcuuuguuaguucacugggugaaaaagguuagccacagggaaaggaugcugcuguggagucgccaccaagcuaggcagaagugacaacagugcacaggacccuucaguccaucugaagccuggcaugaagaaggagcagcaugcuaguuagauccaaacuaggauccagcucuucaggucagccaugaguccugucugugguguccuacagccagcuaggaacacaccacaaggacgugccauguagcagcaguccaagucagacaaccagaagacaccuugacuuccucuguggcugccagagagcuguaugguggucuucccugcuucacagcagugacaugaaacggugacuucugugggaugaaggacucugggucuuuacuugggaagggaaaacaugaaguggaaugggguuuuaggauucuugaaagguugccaugggaaaggaagauuagauuugaccacaggguuagagcuaggacaagugggugaaagaccccagauaguucggugccauauggcaaagagcuuccucuuagucuuagcugccacaaaauggcuuugugccaugggagguugauaucaagagcugugaaggaucugagauuuuuacccuacuugcagccugaaaagguguccugccaauuuauuggauguugguggaagacucgagaaaagggccaguuccccucguccccgcaucccacaaaggugaugaggaugggcccagauggauaccugcagaugugggggguuguguuccgggacaggaaggcugaguuuaggggaggucucaggccagucacucaaucguacuucacuugcuccauuuccaaaugcaagugauggcagcacuggcuucccaggguugguguuaggggaccaggaggggcggaauaugggcuggagauggcacggaaaagcaccuggcaucuaaguacuugagaaacuuuggucaaauuuuuuuaaauuggcuuucccagguugaaaugaucaacucuuauuuacaugcaugcauuauaaugacuagaagcaaauacaggaaaauguuagccauacuauauauaaaagaaaauccacuuuaaaaccgguaucuuucuuucuuuauaaauagcaagugggccgggugcgguggcucacaccuguaaucccagcacuuuggaaggccgaggcaggcggaucaccugaggucaggaguucgagaccagccuggccaacauggugaaaccuugucucuaguaaaaauacaaaaaaauuagcugagaguuguggugcaugccuguagucccagcuacuugggagggugaggcaggagaaucgcuugaacucaggagguggaggcugcagugaaccgagaucgugccauugcacuccugccugggugacagagcgagacucugucuuaaaaaaaaaaaaaaaaaaaaaaaagacaagugggcuggucgccguggcucacgccuguaaucccagcacuuugggaggcugaggcgggcggaucaugaggucaggagaucgaaaccauccugguuaacacggugaaaccccgucucuacuaaaaacacaaaaaauuagccgggugugguggugggugccuguaguccuagcuacucgggaggcugaggcaggagaaugauaugagaggcagagcuugcagugagccgagauugcgccacugcacuccagccugggcgacagagccagacucugucucaaaaaaaaaaagacaaguggauaaaaagucuguccuagaauuuagacauggauugaaaagguguuuuuugauuuuuuuuuuuuuuuuuuuuuucugagacagggucucacucuugccgaggcuggaaugcagugguguaaucauagcucacugcagccucaaacuccugggcuuaagcaauccucccaccucggccuuccaaagugcuggaguuuaaguuuuugaacuaguuuagaguguguaaaauuaucauaaggaauuaauuuacaucucaaaugacuuccucaauacagcaguaugagcuuagggagcacaagacagucaaaggcaggcauaacagaaaaacacuagucguguucaugugaagauaaugcugaaaucagcugggcguaguggcucacgccuguaauccuagcacuuugggaggcugacuuggguggauuuuugagcucaggaguucaagaccauccugggcaacacggugaaaccccgucucuacuaaaauacaaaaaauuagccggacguggcagccugcgccuguaaucccagcuacuugggaggcugagagacaggacaaucguuugaacccgggaggcggagguugcagugcugagaucccaccauuacacuccagccugggcaagcgugagacucuaucucuaaauaaauagauaaugcuaaaaucuuugguuuauuugacauugaaauguugcagcuuaaguuggaggcaaauuuucugcaauguuuuauaauauauauauuuuuuacaacaaaaccauguuuuuucauuaacaucccuuguuauuucugaguggccuucccaaagggcaaguuuagcucuaauguugaaauucacuuguagagcuguaggccuuuacccggaagguauaucuuauguuuuaauuuuugcaugccucuuucaccaaaaaucucugggacaggcacauaguuugugugacuuaugcacaccugagccacuccuuugaccauccacagauccccagacuaggaaagaggcccagagaaguucagaugaguuuggccaaguucccuggguggugagaggccuggccugccucauguaguaacagaacugcuucuuuuuuuuccuuccucuuuuuggaagaaaaaagaggcaggaucucacugucuuguccaggcuggaaggcaguggcgugaucauggcucacuacagccuuaacaacuaacaacuuaaaacuauagccucaagcaguccuccuaccucagccuccugaguggcugggacuacaggugugcaccagcagcacgcacagcuaauuuaaaaaaauuguuagcaacaaagugagauccugucuuuacaaaaggacuuguuuuuguuuuguuuuguuuuuuugagagaacaccuugcucuaucgccuaggcaggagugcaguggugcagucuuggcucacugcagcggugugaucuuggcucacugcagccggugccuccuggguucaaccaguucucaugccucagccuccugaguagaugugauuacaggugcgugccaccacgcccagcuaauuuuuuguauuuuuaguagagacagaguuucaccguguuagccaggauggucucgaucuccugaucucgugauccaccugccucggccuuuuuuuaguauagauaggguuucuuuuuuuucuuuuucuuuuucuuuuugagauggauuuucacuuuuguugcccaggcuggagugcaauggcacaaucucagcucaccacaaccucugucucccagguucaagugauucuccugccucagccucccaaguagcugggauuacaggcaugugccaccacgccuggcuaauuuuuguauuuuuaguagaaacgggguuucaccauguuggccaggcuugucucaaacuccuggccucaagugaucugcacauuucagccucccaaaguguugggauuacaggcaugagccacugcgcccagucuguuuuuggcuuuuuugagacagguucucauucugucacccaggcuagaguguagaggugugaucauggcucacugcagccucagccuccugggcucuugugauccuccugccuuagccucccaaaguguugggauuacgggcaugagccacugcacccagccaaaucugcuucucuugagcuuugcccaugugucaggcauguaggacuuuauaguccuuaucucucaucauaaacucuggguacaggcuguugcuacucccauuuuacagauguacaggaacauucucagacucuuuaagcuaggaagaggcaaagucugaggcuagaccugcuaacuuggggccagauggccucauucaugcuucaccccagcuccucggacaggaccuggcccacaguggggaacaggggagguuggucaguccuggacaaucagugaagaccuuuagcagauuucaccaaccaaaagucaugcaggaaagugugcgcgcgcgcgugugugugguauguguguguguguguggugugugugugugugucuuacucuguugcccaggcuggagugcaguggcacaaucuuggcucacugcaaccucugccucccagguucaagugauucuccuggcucagccucccagugugccaccacacccagugagggaaagcuauuuuuacauggcucaagcaguguaaaugacaaugauguuuacuuacuuccccccaccaccaccaccauuuaauucuccucuugaaaacuaaaagcuggcuggguauggugcaucacuccuauaaucccagcacuccagcacuuugggaggaucacuugaacucaggaguuugaggccagccuggacaacauagugagacgccaucacuauaagaaauaaaaaaauagcugagugugguggcauaugccuguagucccagcuacuugggaggcugaggugggaggauugcuagagcccgggaagucaaggcugcagugaaccgugauugcaccucugcacuccagccugggugacuccccacagaugaauaugcugacagugguuucagcugcucgguggugauucagaccuggacgcguggcuucaguagcccuggggccacacugccugcccgcagccuccugucuugcucuaugcuauuccuuccaagucccugccaucuagucuuuaguccucucugccugggaggccucuuccacuccucagccuuaugucaucuuauccauccuuuaaggcccuugcuccaugccuccccucccagggcagggcuuggauguaggagaauguggagaacuggcgcacgccagccuugcuccccagcagaggagcucuguuuacuggagugcguacuuaggccacggcuugaagauauggggcugggguguagggcugucaagauuguuccuggggccaggugcaguaguucacuccuguaaucccaacacuuugggaggccgaggccggcaguucaccugaggucaggaguucaagaccaggcuggccaacauggugaaaccccaucucuacuaaaaauacaaaaaaaaaaaaauuagucgggcaggguagcggguaccuguaaucccagcuacuuaggaggcugaggugggagaauugcaugaaccagggaggcagagguugcagugagcugagaucgcgccacugcacuccagccugggcgacagagcgagacuccgucuuaaaaaaaaaaaaaaaaaaaaaaagauuguucuugggcucucugugaagcuuggauuucuuuggguugggugugccauggcaagugccauggcagaccugggugagggaaaagggaguacaaugggaagggcuuccccagcucuggagauagguaggguuggggagaggccaaaagacucuuugcugagucaucucucaggcuccuggggccaucagaguguccaggccccaaaggugguuuucgggugguucuaggggcaaggggcuagggcauggugcuggcccugccuggugaucaccuguugagugaccagcucagguccccaggguccagccauugagcugacuacuguuucuacccugggaagauugagcuggccaggacuuggcaucaaggcaguuauuuggacuucuaguacucacaguguauucugguuggguuguaacuuaccucugguacaacucuacuuguaucuucagaaaagaucaagagauauuugcaaaaacauaauaugauaaaggacugucuaaaggacaaagaacacuuaaaacucuauaauaagaaaacaacaauaaauaacaccgugcaucucuuagaaugaccaaaauccagaacacugccaaaugcugcugaggacguagagcaacaggaacucucgcucuuuccuggugggaaugcaaaauggugcagccaccuuggaagacaaguuaggcgguuucuuucauuuauuuauucauaaaaucuuuuuaacaaagaaauugagucucucucuugcccaaaauggagugcagaagcgugaucacagcucauugcauucucaaacuccugggccuaagaaguccacccuucuuagccucugaaguagcugagacuacaggcacaugccaccaugccaggccaauauauuuauuuuguuauuauuuuuugagauggaaucuugcucugucacccaggcuggaguguaguggcgcaaccucaguucacugcaaucucugccucccggguuuaagcaauucuccuaccucagccucccaaguagcuggacuacaggcgugcaccacuacgcucugcuaauuuuuuuguauuuuuaguagagacaggguuuuaccacguuggccaggcuggucuugaacuccugaccucaagugaucuacccagcuuagccucccaaagugcugggauuacaggugugagccacugagccuggcccaggcuaauauauuuaauuuuuuuuuuuuuuuuuuuuuguagagauggggucuuguuauguuucacaaacuggucuugaacucccggccucaagugauccucccucccuggccucccacagugcucagauuacagacaugagucacugcuccuggcccaguuuggcaguuuuguuuuguuuuuuuuuugagacucagucucgcucuuucguccaggccagacugcaguggcgcaaucuccacucacugcaagcuccgcuucccagguucacaccauucuccugccucagccuccugaguagcugggacuacaggcgcccaccaccacguccagcuaauuuuuuuuuguauuuuuaguagagacgggguuucacuguguuagccaggauggucucgaucuccugaccucgugauccaccugccuuggccucccaaagugcugggauuacaggcgugagccaccgcgcccggccggcaguuucuuacaaaacuaaacauaugucuuaccauuggauccagcaauuacauuccuugguauuuagccaaaugaauugaaaacuuguauccacacagaugcuuauaacagcuuuauucauuaauugcuaagguuugaaagcaaccaagauguccuucaguggguuaauggauaaauaaauugugguauaucuagacaaaugacauucaacacuaagaagaaaugagucugggugcaguggcucacaccuguaauccuaguacuuugggaggccgagacaggcagaucucuugagcccaggaguuugagaccaaccuggacaacauagcaaaacccagucucuauaaaaauacaaaaaaauuagcugggggugguggugccuaucuguagucucagcuacuugggaggcugaggugggaggauugcuugagccugugaagucaagguugcaaugagccaagaucacgccaccauccagugggcaacagagcaagacccugucaaaaauaaauaaguaaguaugaagugggggaaaaacaaguaacggcugggcacaguggcucacgcuuauaaacccugcauuuugggaggccgaggcaggcagaucacuugaggucaggaguucaagaccagccuggccaacauggugaaaccgcaugucuacuaaagauacaaaaauuagcugggcauugaggcgggugccuguaaucccagcuacuugggaggcugaagcaggagaauugcuugaacccaggaggcggagguugcggugagccaagaucgugccauugcauucuagccugggcaacagacucugaaaaaauaauaauaauaaaaagaacaaauagcuucuaacgacaaauuuauuucucacuuauugaggcugggaagucugaagaucaaggugccaacagauucaguggcaacugagggccggcuucaugguuuauagauggugccuuuucacugugucuuuauaugauggaaagggcaaggcaguucucaggggccucuuugauaaggacaccaaucccaucaugaccuaaucacuucccaauggucccaacuccuaauaccaucacauuggugauuagguuucaacauaagauuuuuggggagauacauucagacauagcagcuacauauugcaugauuccagcuaucaugucugauaaccacacaaaaccuauagaaugugcaacaccaaguaugagcccuaacauaaacuagggaagcugagugguaaugauguguuaagguaaaagguucauuggugguaacaaauuugccccucuggugagggaugcugauagugggaaaagcuguguguguucaggggcaggggguauuuaggaauucucuguccuuuccucucaguuuugcuguauaccuaaagguguucuaaaaaguaaagucuauuuuuuaaaaaaguaugaagagaccaggacaucaaucucaagccccuucucaguuuagcagauagcuugcucuagaaauacuuuuggguggcuggguuguccugaagguggcagggcuucaguugauacuugaaucccuugaaauaaauugauuuuucagauaaacaauuaaaacauuccugucuuggccauagguuuaugaaccaugguguguucauuuugaucucucuuuccuuccaggacaacccuccauaugauaagggagccuucagaaucgaaaucaacuuuccagcagaguacccauucaaaccaccgaagaucacauuuaaaacaaagaucuaucacccaaacaucgacgaaaaggggcaggucugucugccaguaauuagugccgaaaacuggaagccagcaaccaaaaccgaccaagguaagacaugugccugugucuuccucggagggggucuuugggggugcugcucuggggugggggcuucugguaccagaucagacagaauccagagaaucuuucagguacacgaaaaauguagcugagguccugucagaccuugugggaauggcucaucucagcugaacuuuugaccuguauaggguuugaggaggccuuuccagugcucagcccugggcugccauccacagugggaacacacauggacagacaagcccaguggcuugcugcuggugcagagaggugcaggcacuggucccuggaagggaugaaggacuguggggcugccuacaaggggaagggagagugggauuuaagguggccucaugcaguaguuagugccugaacucagacuugaaggaggaaaggagguuggagagggccuuccaggcuauaggaagggcaugggcuagagccuaguugcucgggugaugugaggggagggacagaggcagauguaagggcaguauucccagaugaaggcacguaguuggcuuuagugggccugggauucccuggaguuggauguggcugugcguggugcacaugucuguguguggcugugugaacauaaacaugcucauucuucugggaagaauauuugagucaguauugugguuguccucccuuuuguccccuagaagugacuaguuuguuauggacugugucugguuuucauuuaauucuagacuuucuuuugaaguccuaaucucauauuuugauggcuuccuuuuaaguaccuaaaccaguauaaagucuguuuagauuagaguggaugaagcuggcacuugagaggcugcaaguggaggguuucuuuuaggggugcugcucuaggguaggggcucauggguccuuccugaugccagaucagacggaguccagagaacuccuaccuuaccaggugcacgcaaaguauggcugaggugccaccagucccugugggaauaacucagcugaacuuuugaccugcacagggauugaggaggucccuuguuuuagugauugaaaaaagccuuggaagguggaguucaaagccuugcgcaagaaaaaucaagccucacuuguuggaaguaaucaccaugaaaggugcccauuagacucccacacugaguagaagaaaggagugggugcuaaacauucagucagggcagaacagucucuagugggcuugguccuuguuuguguacaagcugauguuuauaaaagcuugacacaguucuucucagugccugguuuuuucuuuucuuuucuuuucuuuuuuggaaacggagucucgcucugucaccaggcuggagugcaguggcgcgaucucugcucacugcaaccuccgccucccgaguucgcgccauucuccugccucagccuuccgaguagcugggacuacaggcacccgccaccacgcccggcuaauuuuuuguauuuuuaguagagacgggguuucaccauguuagccaggauggucucgaucuccugaccucgugauccgcccgccucggccucccaaagugcugggauuacaggcguaagccaccgcacccagccgauuuuuucuuuucuuuucuuuuuuuuuuuuuuuuuuuuuuuuuuuugagacggagucacccaggcuggagugcagugaugccaucccagaucacuguaaccuccgccucccggguucaagcaauucuccugccucagccuccugaguagcugggauuacagccaccacgcucggcuaauuuuuguauuuguaguagagacgggguuucaccacguugaccaggcuggucucgaacuccugacauuaggugauccaccugccucagccucccaaagugcugggauuacaggcaugagccaucaugcccggcgagccugguuuuuuucuguacagauuccuagcacugucgaaaaccuauagcugcauuugaucaagaguguucaguaauuccuggaguccuugccgagucaugucuguuaacccaucgugccuggggaguggcaguccuuccaggccagguugcccaggaaagcccugcaccucagguucuggccacaaagaguucugaggcuccucccuuaccuguagacugagaggguggggcuagggccagggaggcucucaggagauggaugcacgugcuuugccaccucucauggggcugcugcauagaaggccguggcaggguuauucacuuuuuaccuuccuauccaggugcacugccaaaaugcucugcuuuuucagacuguggcugcuucucccccacccccaagagccaaauaacuuaggggcagcuuuuaauuuuuuuuuguaaaaaguacuguugacuugggauuuuuaagguaaaaauuuugguacaggagcuauucugugugccaugauggacagaacuggaauugcuauuuugugauuugggacaguugaggauuccuuccuagaacauuauuauguagauuguuuguggcauggccuugauccccauccucacauacaucaagaauguuguuccuugcacuugacggccacauucccauguuuguuaucuauuacugcauuauaaccccuaucaaaacuuuguggcuuaaaguaauaccaguuuauuaguuuuuacucuggagguuggcugggcuuagcuacaugguucuacagcugacuguucauuccuggggucacucaugcagcuguauugaggugggaacucaacuuggcugggaagagcugguaggcauagugcacaugugcggaaaugguauuagcuaaggcacuucgguucucuuuguguucucuuauuuuccacaaggcuacauuggaccccuucauagcaugguggucucaggguuccagggugaaggcauagaacugguacggugucacuucuguggauucuuuuggucaggcaaguccagauuuaaugagagggaaaauagacuucagcucuugaugggaggaguaugcaggaugggagacaugauggcagaggugggacaggcaggcaagguugcugaguccccuugcugccuccucaggcccacuugggccugcuuuucccaaauggcagcuccucuggacaugccauuccuucucccaccugccugauucuucauauguugggugucccuguuuuucuggugcuauuuccugacugcuguucagcugccacuguccugcaaagccugccuuuuuaaaugccucaccauuccuucauuuguuucuuaaauaugggaagugaaagugccaccugaggccgggcacaguggcucacgccuguaaucccagcauuuugggaggcuggggcaggcagauugcuugagccaaggaguuugagaccagccugaggaacauggugaaaccccgucuguaccaaaaaaaaaaaaagaaagaaagaaagggaaaaagccacuugugccacccuccugcuguaaucuuccagcgcucuuccuuugucuccagagcaccugcucaugauuuuugucuccugcccuuguccuuagaaacuucagcguucccaauuauggcuucucucagauccagccuugaaguucuuugaccuccucaauucacaaccuguagcugacuuuagccacccacaaguacagaaaaguaagcauaauggaagaaauaguaauaugaaaagaugcucauaugacccagcaauuccacucuuagcuauaucuacccaagagaaaugaaaacauaugcccaauaaaaacuuguacacagauguucauagcaccauuauucacaauggauaagaagugaaaagagcccaaauguccaucaauuggugagugaauaaacaaaaugugagccaggcgugguggcucacgccuguaaucccagcacuuugggaggcugaggcggguggaucaccugagguccggaguucaagaccagccuggccaacauggugaaacccugucucuacuaaaaauacaaaaaauuagcugggugugguggcgggcgccuguaaucccagcuacaugggaggcugaagcuggagaaucacuugaaccugggaggcagagguugcagugagccaagauugugccauugcacuccagccugggcaacaagagccaaacuccgucucaaaacaaaacaaaacaaacaacaaaaaaugguguaucucuacaaugaaauauuauuuagccauaaaaagcaaugaaguacugucuuaugguacauaaaccuugaaaauaugcuaaaugggccgggcgcgguggcucacgccuguagucccagcacuuugggaggccaaggcgggcagaucacaaggucaggagauugagaccauccuggcuaacauggugaaacccugucuuuacuaaaaauaaaaaaaauuagccgagcuugguggcaggcgccuguagucccagcuacucgggaggcugaggcaggagaauggcgugaaccugggaggcggagauugcagugagccgagaucacgccacugcacuccagccugggcgacagagcaagacuccgucucaaaaaaaaaaaaaaagaaagaaaauaugcuaaaugaaagaaccauccauggaaggccacauauuguaugauuccauuuguaguugagccucauuguucauagagucugcguuugcgaauuugccuacucacuaaaguuuuuuguagccccaaaaucaauacucucggcacucgucuaucacagaugugugcgugugcagagcagcaaaaaauuugaaguaccccaugcacguguuccagcugagguugugugguugaacagugcgaugcccugccuucuuguuucagcucucaacugaagcaagugggcugucuaaugccaaacuucuuggauuuugugcuuuuuguuggugauuuugcuuuggccccaaacguggugcugaagugcugucuaguauuccugagcacagaaggucaugauaugccuuuuggagaaaauacaugugugagauaagcuuuauuugggcaugaguuauagugcugcugagucaauauuaccuauuaaauaaggugucuuuaaacacacauaaaacaaaguuauauauuaaucagcuggcaaaaaugugagcagaggcuuguuugaaccuaaaccucuguuucccuuaggagcaaugauucaguaucauuaauucaauguucauggcaaguuuauagaacauaagcacuacagauaaaauucagcuguauaugggaugcucagacuaggguggauccauugagacaaaguagauuagugauugucagggucuaggaggaggagaauaggaagugacuacugagaguggguuuucuuuuugggggaugaaaauguuccaggcugggcguggugggucacgccuguaaucccagcacuuugggaggccgaggugggcggaucacaaggucaagagauccagaccauccuggccaacguggugaaaccccgucccuacuaaaaauacaaaaaaaauuagcugggcacgguggcgugcaccuguagucccagcuacucaggaagcugaggcaggagaaucacuugaacccgagaggcggagguugcagugagcugagaucacgcuacugcacuccagccugggugacagagugagagcgagacuccaucuccaaaaaaaaaaaaaaaaauuagccaggcguggugacaggcaccuguaaucccagcuacuuggggggcaaaaaaacaaaacaaaacacccccccccuuuuuuuaaagcacauuccauggaaggcuacaacauugcauaucuuuuuggguugaagguacauugacauuuuauucuuugacaaugaagcucccuggauuuuuaugaaaaggaggggaaaucacaaauauuguuuacauccgcuauugcagagaaacugucauuaagaacaaaagggccaggcacgguggcucaugucuguaaucccagcacuuugggaggccgaggcgggcagaucacgaggucaggagaucgagaccauccuggcuaacacggugaaaccccgucucuacuaaaaacaccaaaaauuagccgggcgugguugcgggcaccuguagucccagcugcugccacugcacuccagccugggcaacagagcgaaacucugucuuaaaaaaaaaaaaaaaaaaagaaaaggaacaaaaggaaggaaauauuauaggcuuuauucucugaugagaauauagugagaguaaaagguaaaauuggcuaauuuguuguguggguuuuuuguuuuuuguuuuuuguuggggggacagagucucacuuugucacccaggcuggagugcaguggcauaaucuuggcucauugcaaccuccgccuccuggauucaagcauuucuccucccucagccucccgaguagcugggacuacaggcgcaugccaccacaccuggcuaguuuuuuguauuuuaguagagacaagguuucaccauauugcccaggcuggucuugaacuccugagcucagacagucugcccacuucggcuucccaaagugcuaggguuacaagugugagcugcugcgcccggccuguuguauguuuuuaagccccuacauuuugcagaaaaaaaaaguacuucugaggagcauuugggucauggaagagaccaagaacccagggcuggauguuuuauaaaauauaauuuuaauaugcuguccuauauaugaaaaauguugauagagggccacaguuguaauuuguaaagcagacaaucugucagguguucuuacuagcaaaauaaguucagcucagcugaaguuuauuauaguuuagcuaaggagccagaaaugcacccaggggaacagcgaaagaaugaaauacuuaucagaacuacuaaguaaauuuaaaaauacucagacuugaggccgggcaugguggcucaugccuguaaucccagcacuuugggaggaugagauggguggaucaugaggucaggagaucaagaccauccuggguaacauggugaaaccccaucuuuacuaaaauuacaaagaauuagcaaggcgugguggcggaugccuguagucccagcuacuggggaaguugaggcaggagaaucccuugaacccaggagguggagguuucagugagcugagauugugccacugcacuccagccugggcgacagagugagacgccaucucaauuaaaaaaaaaauucagacuugaucaaauuagugaaacuauaaaaaauaacgaaauagacaaauggcaucuuuugagaaauaggucuuuaaauuuuuauuuugccaggugcaguggcucacgccuguaauccagcacuuugggaggcggaggcagguggaucacgaggucaggagaucgagaccauccuggcuaacacggugaaaccccgucucuacuaaaaaauuacagaaaauuagccgggcaugguggcaggugccuguaaucccacuacccgggaggcugaggcaggagaauggcaugagccugggaggcggagcuugcagugagccgagauugugagcugugauugugccacuaacucagccugggcgacagagcgagacuccaucucaaaaaauauauauauauauuauuuuuuuuuugcgauagggucuugcugugucacucaggcugaguauaguggcacaaucacagcucacuacagccucaauauugugggcucaagcaaucaucccaccucagccucccaaggagcugggacuacaggcaugugccaccacaaccggcuaauuuuauuuuuuauuuuuuguagaggccaggucuugcuauguugcccaggccagucucagacuccuggccucaagugauccuuccuccuuggccucccaaagugcugggaauacaggugugagccaccaaccucugcauuaguuaccaaggugaugauagugagaaguagagagccuaaguauucauaucagagagugaggugaaaacuccugagcgugccccuaacgaaguacucagccuguccuuagcccagugagguuucuaaaaugcuaaugcgguaguaauucuccuguuacagggccauuucuaaucaugggaaaggaaggggagccaccuauuugugcucuuaggcgacuguggcucaauuuccagcccugaagucaagaacagccaggaaaagggagcagucucacaccgaggguggugugcacugaaauacacuguggccagucagccaagggugggcuucguuuauuaaauaaauaaauaaauguuuauuaaauaaaaauauaccuccagggccugcugccucuagagguacagguggcuuguacagggaggugauaccaccuaccccugaagaggcuuagagacugaauuagaggccacccuggccugcagagagcuuuccaggccccuugccccugcuugcuguucacaguccacccuccuugcccauccacccccaacaaacguggaaccugucagcauugcaugcgcaaugcccuccucgccucugccccacugcuucaccucuacccacuguggucacaggagcccucucuuucccauucucaccaggcacaguaaaaagcagagguuaggcagguggguuuuggacaccaggccaggaguacuuugugcuguggcccucacuuaaugugugcuguugaaugauuaugccuuugcauaugacucagccagcaucagcauuuuguuuuauuuauuuacuuuugagacagagucucgcucuguugcccaagcuagagugcaguggcacgaucucggcucacugcaacugccgucucccggguucaagcgauucuccugccucagccuccugaguagcugggacucuaggcaugggccaccaugccuggcuaauuuuuguauuuuuaguagagacgggguuucaccauguugcccaggcuggucuugagcuccugaccucaggugaucugccuggcuagcauuugcauuuuaauccauuucuuguaaugcugaaugaacaauaugagcccuuaauaaaggaauugaccaggugcaguggcuucaugccugucauccuagcacuuuugggaggaugaggcgguaggaucacucaagcccaggaguuugagaccagccugggcaacauagugagaccccaucucuacaaaaaacuaggccaggagcaguggcuaacacccguaaucccaacuacucucaaggccaaggugggaggauuguuugagcccaggagauaagacugcagugagcugugauugcaccacuguacucuagccuagguuaaaaaaaaaaauuagcuggacgugauggcaugugcuuguagucucagcuacucaggaagcugaggcaggaggaucauuuacacccaggaguuugaggguaccgugcaguaaaguaugauugagccacugcacuccagucugagugacagcaagacugucuaaaaaaaauaagaaggaauuuguggcaucagcaguucggagaagaggggcacuguuuuacagugggaaggaacauucugagggugcugguccugacagggucagggggcaacuguggcaaaguaugugaggagguguggguagcagcugcuucugauuccccacuauccuuccacccuggggcacgucugggcuacggcaccuagggggaguacuguggcacccaucagagccaucagcgugacaucugccuguggucuugacaaugugaugcgauggcgguugucagcuucccauuggcuggccccagugacccuuucuagaggguucagaaacuccuaagggucuuccagaguugggucauugcgcauugacaagugcagcgccaucacauacccuucucucuagugcccacucagucaccuuaaccgaaacuucccugagccgagcauggugcugggugcugggcugaugcagggaaguucuacccgguccugcccugaagaaagugacccugugugcaugcaugagagugagcagucaguucaauacuaggccuccuaucuccagaguacacaagaggacuggauuagccgggcaugguggugcacgacuguaguccuggcuacuugggggacugaggcuggaggauugcuugaggucaacccaggagguugaggcugcagugagccaagauggugccacugcacugcagccuaggugacagagugagacccugucccuccuccccaaccccccgccaagaaaaaagggcugggagugacugagggcuaagaccuccccagguguuaggucaggaaggcuuccuggaggcggaagcacaucacugugaacaauuauccacuguaguguuagcuauuuguuguccaucagugucuucuaaucacagaggaaagaugaguuuucuggcagucagaauuuuggauaaauaggaggcagcuuuggcuuaaaagcacauuagcuguaaaucaguuguaaagccagaguuuuguucccggauuagcugccucuugccugugccauuucugagacuguguuaaccccccaugccuuguccuucucuuggcaguaauccagucccucauagcacuggugaaugacccccagccugagcacccgcuucgggcugaccuagcugaagaauacucuaaggaccguaaaaaauucuguaagaaugcugaagaguuuacaaagaaauauggggaaaagcgaccuguggacuaaaaucugccacgauugguuccagcaagugugagcagagaccccgugcagugcauucagacaccccgcaaagcaggacucuguggaaauugacacgugccaccgccuggcguucgcuuguggcaguuacuaacuuucuacaguuuucuuaaucaaaaguggucuagguaaccuguaaagaaaggauuaaaaauuuaagauguucuaguucugcucucuuuguuuuaaaaaucacugcuucaaucuacuucaaaagaaugguguuucuuuucuuguccaauuuuauccaaaaucuucaaguuacauuuaacccauaagguuuaaaaaaaaggaaaaaaaacgguugugguucccuuucuucccuacccuugccacucccacuuucuggcaccgaguuuauuuuucacuuacuuacuuccccagaccccgggcucgccuccacaaaggagaaaagacugcccuggcgguccugguggcuuuucuuagcauguguggcacuguugcccagugugggaguugguuuaaauucuccugacuccaguuuauaacauccuuuuaaaaaauuuaaaaacaaacagccacaccccuccuccaguccuucuccucaguucuugugugaaacuccagcugauguuaccacaguaacaucaguuaauugggcaagcccugaugucaguguguguaacugaccucuggccuggccugcacagagaagcccuauaaucacaggucugugguggccccgaaauggggggccugcuagucaggaggaugcugugcacacugugugugaugaaucucgccagaaaggcuccugaggucccagguuggcacuucucccugcagccauuguagaagaucugcugguccuugcaggcaaagcuacagccagaauguccguuugaaacuccuagcucaucugucaccgagcuucauccgaaugugccacggagcuugcucuccacuuccuccgugcaguggcccugccacagcccucccucggcacacuuugacccuuuguaggauuggaauuagcaggacucggcuauuuaaagcaccagucuggggucgccugggccccugcugacccccuccuccagagcagccagcccagcccgggaacaagacggacuuccucucccuucggacucacagccuuugcagagucaagcuccacuugaagcucacucaguaauauccuuucaauguguuuuauauuguuuugacugccuuuuuuuguagaaauaaaaauugaccuuagaauuuaucgucagauaaacuuguaaagauuugaauauuaaugucuuuucaaggcaaaugggauuguccccgcacuaguagagaauccaugucgcucugacaccccaaggaagccgacgauccaaaugccgugugucaccaaccccgcuucugccacuggcggcuucccuucuuggcucuugggggggacuagauccuguggagaagaugacuuaaacuuugcuuuuuguuuuaauuuuaauucuauaacuugagaucuuuccggggccuacaggcguguaagacagcuuggucuggucugugcagaaguggggagugaugggcagguucggcagccuaacauuguucaggcgcauggccccugcgguguguacacgaacucggcuucuuuuguccuagguacgccaagggcagguuucuggagacucccuugugcccgggauggcaagggcaccgggcuggcguuuccacaucugucuucauuagcagaaaagugaugauggauuuuauuucacucacacuccaguuuguaauaaaaugccaaauucugucagcuauccaaacaagccaccauuuguucuuguugcuucucuggauccagaaauguugccauucuuggaaacugucccauugcuucguauuucugccaacguagcucugccugccugucaaccccucacugcacucugcucaucacgggaggauaccugugugccggcagccccucagggacucucagcccuggcacuggcaccccaggguuggccccgucagcagaggcuuggcuuucgagccagugggugucucuccuuugggccugggcggcuugcuccugccagccaugccuucaggguaggcucugagcaagcuggcgaacagcccuggcugcuccaaaaccaaaaagcuggguccucuggaggaggggcgagcuguggagcagccacccacugcugccccaagcucacucaggaauucacacccgccugguuucuugaagugugcuggguccuucccucugcucccuacuccccaccacggcagagaauaggcuuucuaagaugcugcgaucccguucugcugcccguaauaaaaaugcucucagacacug

SEQ ID NO: 192611 - RNA, 80034 nt, Homo sapiens
gguuugggccuggcucugugacugaggcggcggcgguggcggccaagcgggauacgggcggcgggagcuggggaacaggcauggacguuuccgggcaagagaccgacuggcggagcaccgccuuccggcagaagcuggucagucaaaugugaguaguggucggggcagggggcuggauugugggaccuuccuccuuagcguggcgggcgaggccagggccggacccgugagaaaccuacggcgccgggagacagaaggcgccggggacuugcgugggucccagggcucgggcccccccgucuguccccuccguucccgacauggacugcucguuugcuuuccuggggccgagcucugcaaaccaacgagcccuggcuuaugaaucaucgucuugagcuuucucauucgucauuugugugcuuugggugcagacuuucccccgcuuuuugaaccacacugaauagggaaagggagagaagcagccggcuguaguggguuuagcagggcugggugcuucaugguuucucuuccagaaaagcgcaucaacggugaaagaaagugaugggaggaggguggauguaagaugagauugggaagguaguuguuuggggugugggcggugggacggaggaucugagggugaccccccgaaggaauguggacuuugccgaaggauggcaggaagccgcugucaggaagcgaucgucguuucuggaggagagcgugaagagcuggggucaguggccccgcucagaggaacucuagccccucaccaccgacugcuuguuucuguuagcaguuuuuuucaugcgcguccgugugaagagaccaccaaacaggcuuugugugagcaauaaagcuguuuauuucaccugggugcaggugggcugaguccgaaaagagagucagcgaagggagauagggguggggucguuuuauaggauuugggaagguaauggaaaauuagucaauuguucucuggugggcagggauggaucucacaaaguacauucucaaggguggggagaauuacaaagaaccuucuuaagggugggggagauuacaaaguacauugaucaguuaggguggggcaggaacaaaucacaaugguggaaugucaucaguuacggcuguuuuuacuucuuuuguggaucuucaguuacuucaggccaucuggauguauacgugcaagucacaggggaugcgauggccuggccugggcucagaggccugacaguuuuuaacugagcuuauuggcguguugugcucgccacagauuugccugagacacagccccuuuccugagggaugguaaaggaaccgucacagcgcagucuugucagucuguaauguguauacugcagggguuucuugcgaagcggcgguuaacuugagcagaccaggggcagucuagugaguaggugacgaauaaauugaguccuagaaagacaaguaggagugugaauagccaccauuccaagcugaggaguuaggaaacaugagcauuuacugcguggagggaggaucuuguaggcugagaguucuggggcucgaggaguaagagagcccaggagaugauggaaugagggugagcagguacuagcacuuuaguggggguguugugccaaggaauugagccuguguuuggcauguggcauucuuuggaguagugaaaugccaguguugggaauaugccuagagucccugucccuggagauggaugcagggcagagaagagagaccaguuaagcuauuaagagaguuugaacauuuggagggaguagggaaccuguccuuuuucauccuuauauucucacugcuagcucacugccugccacauugcuccguaaaaugauuguggcaugaccuagucgggcgggagauuauaaaggccugcauuagacagugguagaaacugaaagaggaagacagauuccagaggagggggaacguagacaauucuugaugacuaacuggauggaggggggugggguguggggugaagcauuguggaaggaaggaagccgggcugaaugcugggaaaccuuucaguacaguggaaagaguagggacuguagaguuaguagcuaugggcuuugggaagaauagccuugggauauuucuggggauauugcacaaucagugaacaguguuuuacugauaaaauauaguuaucuguaggugaaaacuugagagauaucccacuucaggguuccugcaagaaaaguccccagggcaaggguucuucucugggaaagcccagaauuaagaacuggaagggugaguugucaucaaagaaaauggggguaggggaaguguuaagagggcugggagggugauugaagaguuuauggguguugagugacuggauacuucauaacucagcuuuauuuugcuuccgggagaauugaguucuuuauuuuuuucgauauugcuguuuguguguuuuucuguugccgcucuaacaaauuaccacaaguuuagcaucuuaaaacaacacaccuuuagccaggugugguggcucacgccuguaaucccagcacuuugggagacugaggcaggcggaucacgaggucaagagacugagacccauccuggccaacacggugaaacccuaucucuacuaaaaauccaaaaauuagcugggugugauggcgcacaccuguagucccagcuacucaagagucugaggcaggagaauugcuugaacccgggaggcggagguugcagugagccgagaucgcaccacugcuaucccgccuagugacagagcgagacuccaucucaaaaacaaacaaacaaaaaacacacauuuaucauuugguaguuucuguaggucagagguccaaguagguuccacuaggucuccugcuaucaaggccuaucaaggcugaaaucaagacguuggcagggugcauuucuuacugaaugccuugggguggaacuugcuugcaagcccauuuaugcuguuggccauauucaguuccuugagcuuguaggacugaggugcccucuuuccuuacuggcuguuagccaggagucagucuuuguucccagaagcugcccgaauuccuucucaugcuuuuuaugugucucccuccagcgagggccaguucuucugccacaucucucugauuucagcuagagaaaauauccugcuuuucagggcucagauuagauuuagugcacacagagaagccaggauaaucucuuuauuuuaaaguuuguaauuuuaauuacaucugcagaauuccuuuugacauguaauguagcauauucacaaguucuagggauuaggcacgagaugggcauucuccuaccacagccgggaagagcaguuucagagguugccuucccuaggugauguggguguucucaguucucaaauuugucuguuuucucucuaggguucacuuucucucuaggguucacguugaaagucgugauucuuggugccuugauuuauugugcucauaggguuaaaaaaagauuugcauuagaauucuagacauaccuuuaacucuuaacuuccucccauguuuuuacacuguuguuuaaauuuggccauuuugggaaaugcuuuauacccaaguaauuuauaguugaugaagggauagagaaagugucuugcuuguggcaccgugacucacaccuguaaucccagcacccugggaggcugagaucugggacuacuugaguccaggaguuugagaccagccuagguaacauaaacaaauacaacaaucagcugggugugguggcgugcacucguagucccagcuacucuggaggcugagguggggggaucgcuugagccugggaggucgaggcugcagugagcuacguucacaccacugcacuccaaccugggccacagagcaagacccuucucaaaaaaagaaaaaaaaaaagcauucugaguuuugacagagaagaaaacauuugaugguuacuuaucugucucuaccaagagccuagggaacaaugccccagagcaugagcugguauauagucuagucuccuggcucccacugagaaaaagggauuuugaguugaggcuggcuaugacuagacagccauugcagggacucuccaguucagccucuuagcccuccacugccuccaccucaucugggcccauucugggcuguggucuccugcucucuucccagucccauccuucuucccccaacagcacaagugagggugaggccuaaaguguagccacugcccugcugcagaacaaucagugacuuuucuuagcauuagaauaaaacuccagaugucccacccucccagccccucacccugaccugguauagucaucucuucuccuacccccaccguguucugaccucucuggucuuucagcuucuugaacauucuaagcuuuuuuuuuuuuuuuuuggagacaagaucuugcucuguggcccagguuagagugcagugguacgaugauagcucacugcagccuugaccucccagggucaaacgauccucccacuguagccuucugaguagcugggacuacaggcacacaccaccacgccugacugauuuuuauauuuuuuguagagaugagguuucaccauguugcccagacuggucuugaacuccuggguucagaugauccucccuacuagccuuccaaagcacugggauuacagaugugagcuacuaugccuggccccugagcucuuucuuuuuaaccaauuuauuaucaaguguuuaagguauugaaaaaugaguagacuccuccccaccacuguauucaugacuagcuccuucuuuuaggugucugcucaguaucagauacucagaggauccuucccugcuugaucuaaaguuggucaccgccucugauauguuuuaucucagcccuuuuuaguuucccauaggaccucauaccuaugaagcuugguaccugguauacaaaacacuuguugaggaguggaauaguauuuucuugggggcugugugagucaccucuuuuuuuuuuuuuuuuuuuuuugagguggagucucgcucuguugcccaggcuggagugcagugucacaaucucagcucacugcaagcuccgccucccagguucacgccauucuccugccucagccuccugaguagcugggacuacaggcgcccgccaccacgcccagcuaauuuuuuuuuuuuuugagacagagucucacucuggagugcaauggugugaucucgguuccuucaaccucugccucccggguucaagcgauucuccugccucagccucccgaauagcugggguuacaggcaugcgccaccaggcccagcuaauuuuuguauuuuuaguagagacgggguuucaccauguuggucaggcuggucucgaacuccugaccucgugauccacccgccucggccucccaaagugcugagauuacagacaugagccaccacgcccggccgggucaccucuuguauuacagugguauucuuuauuuuuuuauuuuuuuaagagacagggucuugcuuugucacuugggcuggagugcaguugguaugaucauagcucacugcagccucaaacuccuggacucaagugauucuccagugcagugguauucuuuaccugaaccaguguacauugugaagcucuggagccccugcuuucuccacuuguuacacuuguuagccuuucuuuuucuuucuuuuuuuuuuuuuuugagacggagucucgcccuguggcccaggcuggagugcauuggugcgaucucagcucacugcaaccucugccucccggguucaagcaguucucugccucagccuccagaguagcugggauuacaggcacccgccaccacuccuggcuaauuuuuguauuuuuaguagagacgggguuucaccaucuuggucaggcuggucuugaacucccaaccucaugacccaccugccucggccucccaaaguguugggauuacaggcgugagccacugcaccuggccuagccuuucuuaaucgugucccucaucaaugaaaugguagaaagccaaucuguuuuacaggugugguagaagggaaaaaugaagagaccucuguacaagccuuugcagaggucuugggacucaguggugagcucccugccaccaccuccugugcccuugcaggaguaggagaucuauagucuuggagaauaagggugauaccccaauaccccaagccugguuagggaaauugaugacccuuauuggagccuguggggagguaguugggaaauuguuaguagcuucauguuggcauuuucuuuuuugaaacagaaucuugcucucuccuccagguuggagugcaguggcaugaucuuggcccacugcaaccucuggcucccaggcuuaagcgauccucccaccucagcauucccaaguagcugguacuacagacgcaugccaccaggcccagcuaauuuuuguauuuuguguaagagacaggguuucaccaugucucccaggcuggucuugaucuccugggcucaagugauccaccugccucagccucccaaagggcuaggauuacaggugugagccaccgugcuugccuuuguugacucuuuauugaacaucuacucucccugcagaaacugcaggauaagccacccuuagaaccaauuuaacuggccuuuuuggggcuuggaccuuccucaugggauugcuggguuaauguugagccugucucugggcuauaggcucucagagaacaagagugcaucugcaaugacuagugcugcaccugucauacagguuuguagaaaauauuuaagcugugaaugaacaaaaggaccuuaucagcuauuuucuuucaauucuuuuugguuuuucugugauccuauucuugagacuuuuaucccucccaccccucuguacagcagauugcacauauaaagaugaaauaaauagauguccauugggcaaaacaauacagagaggaggugacacagcuggggaaggacaguccaguaucugaugaagugccagaaggggcuuagggggagcauggaauggagcuggaacugccaggucagccaccucuucuagugaagccuccagagagacgugagcuccaaguaagacaacacaaggaacaaaacauacaacugaacagcaacuuccaagggucuggagaggucuucagaaggauagggagugcccuuaaacuugcaagcccagauucugccugugggucauggucgugccauaggcagaagccagugagucagccuuggcggagcuuuuucuguggcuuuucccacucacagcucugugcccuucuggugcagcuccagcccuuguuuuccagcuucauagccugguugucacauaaauggcugcacuggcuuacaggugucuguguauaaccuauugcuagaauguccauuccuugaggcuaggggcccugucugucccucucuucacuuucauagccccagugccccauagggcugcuccugaugggcaaauaggaagugguuguugagccucuaggccagucgugacagugaccugaggggacuugagcccucagucaucugcucaggaguucagggcuuucucaacagcagcugacgugcggcaggcaugcuaugccaagcccuguugcaggaguugacagauguugacucauccccucuucaugcuuucuuugucaguagauguacauguuacucacauuuauaagaugaggaaaaugagaccuagaggagaggccacugcugcuuagaguuacucuacauguuguaaaucagggguguccagucuuuuggcuucccugggccauguaggaagaagaauuguuuugggccacacauaagauacacuaacacuaaugauagcugacgagcuaaaaaaaaaaaauugccaaaaaaucucauaauaaaguuuacgaaggcugggcguaguggcucacgccuauaauccuagcacuuugggaggcuaagguggguggauugcuugaggucaggaguuugagaccagucugggcaacauggugaaaccccauuucuacuaaaaauacaaaaauuagcugggcaugguggcgggcaccuguagucccgguggggaggcugaggcaggagaaucgcuuaaacccgggaggcagagguugcaaugagccaaggucgcgccacugcacuccagccuggcgacagagugagacucagucucaaaaaaaaaaaauauauagaccaaccuggccaagauaauaaaaccucgucucuacuaaaaauacaaaaauuagccaggcauaguggugcacaccuguagucccagcuacuugggaggcugagguaggagaaucgcuugaaccugagaggcggagguugcagugagucaagaucacgccacuucacucuagccggugacagagcaagacucugucucaaaacaaacaaaaaaaauuaaaaauaaauaaguagguugggcgcgguggcucacaccuguaaucccagcacuuugggaggcugaggcgggcggaucaccugaggucaggaguucuagaccagccucaacauggagaaacccugucucuacuaaaaauacaaaauuagcugggcauggugguacaugccuguaaucccagcuacucaggaggcugaggcaggagaauugcuugaaccugggaggcggagguugcagugagccgagaucacgccauugcacuccagccugggcaacaagagcgaaacuccgucucaauaaauaauaauaauaauaauaauaauaaauaaguaaauaaaugaaugguugcugaaccacagcaggacaagacagacaaaccccuuuuauuuguuuuuguuuuuuggacccuaacagcagaggaagagccagccagcaagccccuuuugaucuuuggccucugccaaccaguaccccccagaccuuaacccccagcccuaccaggucccuuuuguaagugaccccacaugccuaccacaguugcaggcccugacauccacccugaccagaggucuuccagcuauuacugguguuugugaugcuguggcuguggccagucaaggacccaugcugggcaucccgagguaggaaggaccaugaccacgugauuaucucccugccacuaucauggcagggcugugggguacuagccuccuuuaaagcauuccuuaggacaguaauuucuguuaaauaucuggagggcaaacauuuuaaggaauuuuaaugaauuuuuaaaaauucaaaaugaaaaauuuaaaucauaaaaccaaauagaagaaagaccccuauguccauauacgcaccacucugcuucagugauuaucaacucuugucucauguacuugaccuccacacaauuauuauuacuauuuuuugagaaagggucuuguuauguugcccaggcuggagugcagcaguacaaucauagcucacugcagccaacuccugggcuuaagugaucuuccugccuuagcuucccaaguagcugggacuaaggguaggcgccaccaugcuggcuaauuuucuuauuuuuuuuuuuuuugguagagaccaggucuugguuuguugcccaggcuggucuugaacucuuggccucaagugagccuccugccuuugccucccaaaguguuggauuacaggcaugagccacuacgccuggccauccccaguuauuuugaugcccagacuguuuuaguggcugcccacugucuguggauucuguucuuagucuugauccuucgugcagugucugcaccugccugccaguuccuugaccugugcuccaucauaccaagcuggcaguggauccucagacaaucucaguucuuacucccugcucuguguccaguuuguuugccuaccuaaaagauccuuccuuuucguggcugagcagugcagccguucuccaaggagacugggccuucugcugcccccaccacccugcucuuuucacugcccccaccccgcugcucuuuucacaggcuuggugaggaguuuccagguugcacuugguuuguuugaaggcuuaucuccuccuagucugaacucgucagggcaggagcuugaaucaaucauuuccugccucucaggacugcuguagcagggggauuccuagaucuguccagugccaguuuccugaguacugcugcaggcccauuucagcugcuauggugaugggggcuguccugaggggacauucaccucagguagagauggcagaaacaccacaggaagaugcaaccagucagcucagcugggggcacuuaaauuagauccauuuuuuuucuggaaggccuuuuggcaauacuguuuaucccaguaccuuaaaaaugucgauuuccuccaagggcgcaaucaggaaaguauucaaagccugauggugaugagggugcucauugccgcaucauugucucaggagugggauuugugaaacagaccaacagugggagcuugguuagaguuguagcugcaggugaugggcucugugcugcuguugacauugacgugagggacugccauaaugcgucaacaucgacaagcgcuuguuaccaagcaggaugcgugguacaggcugaguuuuauuaaacagaugucuuuaacugguaugaaugauuuuaauuuuuucuuuguuugagauggagucucgcccugucgcccaggcuugcgugccuggugacuucucucaccugggcccucaaugccagaccagccuucccaggaugauuccauccuuuccaucccugcaagggagcuugaggcccuuucccuuucaguuugauacuguccuuccaaguuaccuuucuucauguuggcacgagagcuuugugccacaccaugcccuuucuggaugcuguagugucuggcucuuccucugucucugugacccucuucccuggugaagcuuugaccuuggcuucauccccuccagaugaccccugaugguuagcucagccugugguggcuccagagcccucauugagugcauccugacacgaacugaacagauuaacuauuuuuugccuugccaacagcauuggaaauuccuugagugugggaccuggacucauagcucuaugucucuuauaguucuuagcacaauaucuuggccuagaugaaguacauaauaauuauauguaggguuguggaaagcagugcuggcuuuaauuaaagccugccaugguuuuguccaucagugcugccuaaaccguucugaacuucucauuuugaacuuuuuucccucacagcuugugaugguugauuuucuuuuugagacauucauuuauuuguuuguuuauuuggcagggucucacucugucacucaggcugaagugcaguggcgugauuguggcucacugcaaccuccaccuccugggcucaagcgauccucccacgucagccucccaaguagcugggaccacaggugugugccuccaugcccggcuaauuuguguaauuuuuuguagaguaaggguuuugccauguuguccaggcuggucuccaacuccugggcucaagcgaucugcugccuccgccucccaaagugcugggauuacaggugugagccacugugccuggcccugagacauuuauuuaaagacaaaggggaguacaggcuagagaacagaggggaauagaauagcagccaaggcauaauuaccucuaaaccaucaccccauaagggagauguucgccucaacuuuaguaaugacucucuuucuagucuaggugcagggcuguuaauagaggcccugugauuggguuaagggcuugagguacaauaacucuguuauuuagggcagugaguccuuggagaagaugcuuuaccuucuuuccaagccccaugucuccuuauuuugaggguguuuuuuuuuuuuuuucuugagacagucuugcucuguugcccaggcuggagugcaguggccugaccucggcucacuggccugaccuuggcucacugcaaccuccgccuuccgaguucaagugauucuugugccucagccuucugaguggcugggauuacaggccugcaccaccacaccuggcuaauuuuuguauuuuuauuagagauggggcuucaccauauuggccaagcuggucucaaacuucugaccucaggugaucugccugccgcauccucccacagugcugggauuacaggcgugagccauugcauccggccugagguuuuuauuuugagaauauuucaaauguacagagaguugcaaggacaguaaaagcacucaggcauccucuucccugggauucaccagcucauucucacuuuuaccaucuucccauacucccugggggccuccuccuucugggcuucguuuccuuuuauuuguuucugucuuuuuaauuuuaauuuuuuuuuaacuagcccuucucuuuggcaggauuuguucacuuuuaauccuuggccccagcagcuucucugagcucugccuaugaaucugggggagagauaggggcucacacaagagugaagugugagcuggagggcugaaggggaaugagggacaucugggccaaaggcaggggaccagcaaggcccccaccccuggaacuucuguucuucccagccuacguaccccuugcuucuucuuauguuggugggcucugggggcugggugaaagcagugcuuguagguuaagaagugacucaucccacgugcccgcugcccuucucuucuguucuuugcucuuuccaagcuuccuuucaguccuccucaucagacaugaccuuugaggaagugaugagucugcuaugugugagacagagccccuguugugaaguagaacucaggguucguccucagaagccucggugggucaccauacguccugcaagugcugucagucugcuuugauucgugugagggagaagucccugccaagugcucuguaguaggcauucaggccaaccaaagaacagggcaggguccugaggcacaggcucagagcucuugcuuauuucaugggguguuuaaauugagguauaaucccuaucacagugaacgacacgcauacuuccaaucuugagugugccaccagagaacuguugauacuccccagaucugcacccagccagggcaaacugugcaccacucuucugacuuccauggccagccgagacauuuggaaucucugugcaaucacacucugugccaucuuuuuuucgagacagggucucgcccuguugcccaggguagagugcagugguacaaucucggcuaacugcagucucgaccuccugugggcucaagcaaucuucccaccucagccucccaaguagcugguacuacaggugcucaccaccaugcccugcuaauuuuuguguuuuuuguagagaugggguuuugccauguuucccaggcuggucucgaacuccugggcucaagcaauccaccugcuucagccucccagagugcugggauuacaguccucugugcaauugugugcaucaugugugaaauuuauccucauuuauccucacaggcagcaguuguucuauuuuuuuuuuuuuuuuuuuuuuuuuugagauggagucucacucuguuacccaggcuggagugcaguagcacaaucuuggcucccugcaaccucugccuccuagguuccggcaguucuccugccucagccucccgauuagcugggauuacaggcacguaccaccaugccuagcuaauuuuuauauuuuuaguagagacuggguuuugccauguuggccaggcuggucucgaacuccugaccucaggggauccacccaccucggccucccaaagugcugggauuacaggcaugagccaccaugcccagccuguguuuuuguuuuuuuugagacugagucucacucugucgccuaggcuggaguacaguggcgugaucuuggcucacugcaagcucugccucccggguucacaccauucuccugaguagcugggacuacaggcgcccaucaccacacccggcuaauuuuuuuuuuuuuuuuguauuuuuuuuaguagagaugggguuucaccauguuagccaggauggucuccaucuccugaccccgugaucccccuaccucggccucccaaaaugcugggauuacaggcgugagccacugcgccuggccuuauuuauuuauuuauuuauuuauuuauuuauuuauuuauguauuucugagacagagucuuucucuguugccuaggcuggagugugguggcucaaucucaccucacugcagccucugccuccaggguucacaugauucucccaccucggccuccagaguagcugggacuacaggcgugcaccaccaugccuggcuaauuuuuguauuuuuaguagagaugggguuucgccauguugggcaggcugguguugaacuccugaccugaccucaggugauccacccgccuuggccucccaaaauacugggauuauaggcgugagccaccgugaccagccuguucuuguuuaugacguguuauuccauggaggacucuguuccagauaacucuuuuauuuugugccuaaugaacuuugguguuaguuccagauguuggcuacaugaaggcaaccccaggaauggcuuuggucaugucuucugguaaauauaugcacuuaauucucugggcugugcaccuagaaguuaaauaaaggacugggucagaggaugugucucuuagcauguucugcugaacaguguucccaagugguaccaguuuacguucccaccagcaaaaugugagggaguuccacuugcuggacauccuugccaacaccugguauugucaaggaaccugucuguaacaggcacucucguugauuuugaaugcacgcugaaauuuacugggugcagugacaguaggaagggaaaggaugauuaaaaaaagaaaaaaggaauggaaaggcugaucuaggagggaggaagcucauaaggaaauaagugguaggauuuggugauuccaugugugaaugcucguauuccgugugcaugcguauaugagcuugcaggagaaagggaggagggaggcacugguaugcacuccaccaguucuccugccacagccucucuacugaucugagggcuggguguaaggugaugauguggggagugggugugggugaaauuuccaacagucagugggagaugggggaagcaaaccugggaagagcagccugcugcaggagcaagugggugggccguccuggaggcuggaugaaaccugucugccuagguggggauggcagaaguggcagagcagagaacuccagagcagggcuguggugggcagagcagaugugaaggaagacugugggaugagaggauggggcacgguggagccccaucagccuccagucacagcagccccggucccgucucucccuccuguuuuggucaguaccuucaggacuuguggguguaguacuucguuccauuccggauaacauuguagaagacugaaaaacaggaagguguuuuccauacucucuccagagcuggcuguuacugacauauugauauauuuccaccagucuugugugugcuuauagcuugauauguaugcauuuuaaauauguaaauauauauacacauguauuuuuaaagugaaacuaggcugagacugugaguucaguuuugaguuauagguuucccauggcuuagguuguguucucucccuggauggagucuggcugggaccugcaugcucacagcccagguucacaugagguguggaucaugcacaaucaucccacgggcuugagauaagcauuugacuuccuuuuuuuuuaaaaaaaaaguucauuauggacuuuuucaaguguucccagaaguagagauaauagaaaaguggucucccaacuacuuugagaguuagcaacauauggccaguguugcuucacccacccuuccucaucaccuccuggacuauuuuaaaucacaucccagacaccagaugauuucaacugugaguacuugagugcagaucucuaaaagaucgagcuuccccacccccaccaaauaccacagagccaugugagaucagcauuuggguuggcagaucuccuccuugccacaugcuugccugguggugaaugggacacuuucaggcgagaccuaggggagccccaggccagcaccaggacagagaucucgaggccuuuccaacucugcugguucuucagaagucaaaccaacagauuggaguaugugaaggaagcucguguauucuucugaacuagcuuagacaacaguacacaguuugaagggcagcagccuuuucugcagguuaguucuuucaaugaucuuguuuacugggaguugagagaccuugaggauagaggcaagaaagcgucaucaagcagcccagagggguguacaguguuugaagucuccuguauugguaugauucgagauuuucauucugcaggaccaaaauacccauuccuacauguggguggagaguuaaauucugaaguauauauuuuuaucuuguuaaaaaaacacuuuuauguuucuuuaaaaaguaaaagaaccagaauguagaaguuucaguaaaggaaaaaguuacaguuuguuugggauacaguuugacaaaugugcucccagcugccugagagauagagaggccagauguuugcuuugguuacauugaugacugaacaaucgguaucucaucauuuccugccuuagagaugaaagcaccugggcacuggggcaguaaauugguugcaggauuggaagaaguccaaggacagugugggaugccacccuguagcugucuagagaccuagugaaggucagaaggcugggugagaacaagcccugcacugauggaggacagggaaggggcuuuucuggcugggaguguggugaggcauuugagcugcagccagaaggcaccucucagauugguggggcuuggggugggggugggaggaacugcuuugccugugccguuggccucacucauccugaggucccuucaaacuccauccauacucugacuguggggccacuugcagaaggaauauguggcagguuuuuuuuguuuuguuuuguuuuuuguuuugagacggagucuagcucugucacccaggcuggagugcaguggcacgaucucggcugacugcaaccuccgccucccggguucaggcgauucuccugccucagcuuuuggagucgcugggcuuacaggcgccugccaccaugcccagcuaacuuuuguaauuuuaguagagacgggauuuaguagagacgggauuucgaacuccugaccucgugauccgccugccuuggccucccaaaguccugggauuauaagugugagccacuguucccuggccuguggcaauuuuuugagacgcuccuggggguccaaauugcuaauagaggagaaacuuacugucccuguguugacugagacaggaagguuuagauaggugaaaguggucugggcgcaguugcucacaccuauaauccagcacuuugggaggccaaggugggagaaucgcuugaugccaggaguucaagacuagcuugggcaacauagugagauccugucucuauaaaaaauaauuuuaaaaaauuagcuaggccuguagucccagcuacucgggagacugaggagggaggauugcuugagccuaggagucggaggcugcagugagcugauugcgccaccauacuccacccugggcaacacagagagccugucucaaaaacaaaagaaaggugaacaugaguuuuuuuguuuuuuuuuugacauaguuuugcccugucccacaggcgugggccaccacgcccagcuaauuuuuguauuuuuaguggagaugggguuucgccauguuggccaggcuggucuugaacuccuggccucucaagugauccacccaccucggucucccaaaguuuugggauuacagacaugagccauugagccuggccaaacaugaccuuucucuuuuuuuuuuuuuuuuuuuuuuugagacggaguuucacucuuguugcccaggcuggaguacaguggcacgaucucagcucacugcaaacuccaccucccggguucaagugauucuccugccucagccuccugaguagcagagauuacaggcaugcaccaccacgccuggcuaauuuuguauuuuuaguagagacgggguuucuccauguuggucaggguggucucaaacuccccaccucaggugauccaccuaucucagccucccgaaguguugggauuacaggugugagccccugcacccggccacgugacccuucuuaauagcuauuguucgcugaguauuucucuacgacacucuuuaugugcauuuugucauuuaauuuuaauuuuaauuuucuuuuuuuuuuugagacagggucuuacucuuucacccaggcuguaguguaguggcacgauuuuggcucgcugcagcuuccgccuccugggcucaagaaauccucccaccucagcccccgaguuucugggacuacaggcaugcaccacuaugacuggcuaaguuuuuguauuuuuuguagagaugggguuucacuauauugcccaggccaaucuugaaucuugaauuccugggcucaagcaugagccaccacacucggccucauuuaauuuuuaauuacuuuaaauuuuaucaacauaauauaucacauaaacuguaaaaagacaagaaacuacugugguucccauucugccaguucuccccagagguagcaacugccuuuacaucugagcuuucuuccggcauauaccucugauucuagguaauaggcacaugcugcuuuugcaacuuggcguuuuacaaauuauguuggcuugcucuguagcucccuuccaucgccauuaucucugcuucuccucccucauucuuccaguauucuacuuucugcauaaaucgguaaugaauguuuacauuuucugccuacacaaaugauauucacagcugagcauagugguguacugcaauugcuuguuauuuuuuuccuaggaaagaauugccuuuucaacacuaugcccaguuuucuguguaucuauucuuauucuuccuuuauuuuccgguugccucucaguacaguuaucuucaggcucagugcuagugagcugucaguuucaguucaaaccccuggccucaagugauccauccaccucggccucccaaaggaggugggcggugacccucuuggaccucccuucuggaacccucuaggcaguggccgcagguguggugugacagcccucagcgugcuugucugcccagacugggacuguugucuuccuuuguugggucccuuguuuucuauauccugugucucauccuuugugauuuauucccucauucugccagcuuccugagaagggacuccugggaauuaacuuucuggagaccaugccaguuugagugcaucuaggcccccuggugggacaugcuaacuggggaauuuaaaaugauguuacacugcgcugcccuugugcuggcuugugcuucugucuccugaggugcuagcucucagccucauaugacuugucuugaucccuaaacccaaguccugcucuacuugggaaguuccuuugagucauuucaggggaaucucacucccuacacuuccugugcuggaguguuuaauguucacucuuugggccucuaguuuuaucuuuuaucuccuguuuucuaucucuuuuacuuuuagcucuccucucuaagugauuuccucaauuuuuucuuugaccuuucacugcuaacaugcuuuuauuuccaagaacuccuucuuuuuccuuuuuuguaaucugacuuuucccuuuuuauagcacccauuccuguuaaauggauacaauguaguauaauauuuauauauauuauaauaaauucuaccguuuuuuuugauaaauuuucacuuuauugcccaggcuggaaugcagugauguguucauggcucacuauggccucgaacuccugggcucaagugauccucccaccucagccucccaaguagcugggacugcaggcaugcaccaccacuccuggcaaauauuuuuguuuuucguagagaugggaucuugugauguugcccaggcuggucucaaacuccugacuucagcuggacgcaguggcucacaccuguaauccuagcacuuuugggaggccgagggcaggcggaucacaaggucaggaguucgagacuagccuggucaauauggugaaaccccaucucuacuaaaaaucaaaaauuagcugggcaugguggcgcgcgccuguagucccagcuacucgggaggcugaggcagaagaaucacuugaacgugggaggcagagguugcagugagccgagaucgugccacuggacuccagccugggcgacagagcuagacuccgucucaaaaaaaaaaaaaaaaaaaaucaaacuccugaccucaagucauccucucgccucagccucugaaaguacugagauuacaggugcgaaccacugcaccuggccuaauaaauucuacauuuccuucuucuugcugaauuucuguuaccgcuaaauuacucuuuucuuguggggucuuuauuggccauguuauggcgucuggcugcccuuggcugguugcucacucugagagggacccuccaaagccuaggagucucuuccagcacguggagcuugucgacugggaacuucauugaaggcucaucuggcugcagauucugaguccuuccuccagaacaaugguccccaaccuuuuuagcaccagggaccgguuucacagaagacaauuuuucuacagaccggcagaugaggaugguuucaggaugaaauuguuccaccucagaucaucaggcauuagauucucauaaggagcaugcgaccuggaucccucacaugcacaguuuacagugggguucgugcuccuaugagaaucugaugccaccacuuaucugacaggaggcagagcucaggcaguaaugcuugcacacccucugcucaccuacugcugugaggccugguuccuaacagcccacagaccuguacuggucuguggcccagggcuuggggacccugcccuagagcauggucuuccagacacugggcugugggugaagaccuggcugccagcaugcugcucacugcgauggaggaggcugaugggccagugggucucggcaguuagcgugcaucgaucuagucacuuagaccagagcacagaugaccacacaacccaccucucucaguguccuaccugugccuuuucaacuggguggguuggcccccuaguccagugacuauccguuucaugcuuuuccagagaguaaaccuccuguggucaccuggugcuggaguagcuacccacaguguaaaguuggggagugagggaugcagggauaucuuucacccucugucccagagcacuuggugcagccuggccucaaccuggcaaagaccuagggcugucacugggugggcgcacccccuccucacuguuacuuaggacucugguuucuugguccucuugcuguguacguuaccacugggccaucagcuuuccagcuucuaaaaggcuguugaggccaccauuuccauucuuccugguuuuuuuuucugugguuuuagucagguuuuaagauggaagggaauuaaaugugcaggcuuuguuccucauuucaacuuggagguucauaucuguuauuuauuuauuuauuuagagacagagucucacucuguuacccaggcuggagugcaguggugcuaccuuggcucacugcaaccuccaccucccugguucaagcgauucucuugccucagcuucccaaguagcugggauuauggccgcacaccaccaugcccagcuaauuuuuauauuuacguauauauuuuuuugagacagaguuuuacucuugucacccaggcuggagugcaauggcuugaucuuggcucacugcaaccuucaccucccagguucaagugauucuccugccucggccucccgaguaacugggauuauaaugcacgccaccaugccuggcuaauuuuuguauuuuuauuuuuuauuuuugagacagaguuucacucuuguugcucaggcuggagugcaguggugggaucuuggcucauugcaaccuuugccucccggguucaagccauccuccuaccucagccucccgaguagcugggauugcagcgcccaccaccuugcccuuuuguauuuuuaguagggaugggguuucaccauguuggccagucuggucucgaacuccggaccucaggugauccaccugccuuggccucccaaagugcugggauuacaggcgugagccacugugcucagcuaauuuuuguauuuuuaguagagacguuucaccauguuggccaggcuggucucgaacuccugaccucaagugauccaccuaccuccgccucccagagugcugggauuacaggcgugaaccaccacaccuaguccaaaucuuuuuuuuaauaugggaaaaucuuuuuuccuuuauagugucugcuucuggugacaugcuuaggaaaccaucauccugauauuguauaacucuccuucuguugucuugugguccucugugauuuagguuuuuaaacacauaggguaaagggucccacauacaagcugugggcuccugucccaggugggcaagcaggcugcacacacaggcagcaauuuacugggaggcuucuuggguggggugaaguggagcugccaaaaauuuauucugcccuaugagaguucacuugauugauagauguuguguuucucaaaauuagaaaauuagaagaaacucacagaaguuuccuucgagcagaacauaaaucggcugagaggaaucauccugccccccugaggucaggagggugaaucugugccccagggaggaacgcaccuuccugcuuuagacaccagcagaggacagagaagcuggcuguccugggaauucaugcccucauucagcaaugggaaagcaguuggaccagggaagggggccuggcaguguggcagggggagcagugguaaagaggguggggucaggggagaggccucacugagaggggagaggguccuuggugggaaccagggcgguuguggaaggaagagucagggcguggagcagagcagagcgggaguugggguggggaggccaguucaugccucaucaacaugccugugugaguguccuucuugcgggcgguggagcuggccucaggguacacugcaggugacucagagcuccaaugggaggguggcucugccugagggagcugcacaugcucauugggccaucgucugcugaggagggggcaacaauaaccucaacacauggcggagguguuuugggaugcauccuauugcacauuugggcagguuguugccugacuuauuucuuuaacgcauaccuagcacuuccuguauguccagugccuuauaauauuaacuacuaucauccucagggcuacccgugaggucggcacuguccccacccuuugugcaaaggaaggauagggaggcgcugccagauggguugagggcagaccggggcagcuugccucaggccucccuggccuuagcaggcuuuaaguuugaugcccugugcuccuucccuaggaagcucaguuugccaguuuuuugcuuuaucuuagucucauucagauuacaaggacugggacuggacuccuguugccaguuucucaauuuggaauaggaaggaggugaggaacaacaggcccaugcugggcagaagcccugcagaccaggccaacagugggccucuccucacugccuggcccugucugugcaccuucguccuggccacagccucucagagccccuccuuuaugaagagguuacgcuuuaggggagggagugccucucccaagacccagagcuggugaguggcuagguuggaauuugagcccaggucccuccuccccugucugcuuccugccaggcccagcugccugccccagcacacgccuucucccaggcacccuggccuccacugccaggacgugccuguuugaggccuggauucccccauggcugccacgcugauucuccguucugcacgucgugucccaucaaaaugcaugacaguaccacuccuuguguuaaaaagagccaguuauugugccuggcagugaugacugcccacugcacacaaaaguggacgccguugucucugcucucaggguguucuuaguauaguggggcuggcacacagaaaccagagauuccuccaggaagugccacagacaugggugagguggcuacaggguuucugugcagccgacagcaggggugccuggguggaagcagggugggaggcccuaacaggccugaugggauagucaggcaaugugccagguaguaggucaucaucccuggggcccuggggagaguguguggggcaggcgcaggagcaggcuccucagugggcuccuggacaggcugccugcucugcuggugaggagcgaggcucaaagcaagcaggggccuggguugcuucccacacucaguggcaguugcucacuggcagucaugugaccuggggagcuggcgagggcguggggguaggaaugggaacgggagacagaggcccuuugggaggaauugccacagaugcagugggaguuggggcaaagauuugaacuuuggagaauuaaagguggcagucagaaagugaagggaguucccaaguuucugggaugggcacuuggugcugggagaugaagacacgaagagcuuuucuugauguaucccugcuggcugcucaggcagggucgggcaaugccauuaagacacacuguguucugggaacaguucuggacaguaaggacauccucagaccccuuagugggggagcuccaagggccuguaaugaugaaucgguccccugggaggcuucagucuaagcuagauaccaguugaacccugacugaguacacagacauagcuauggcaaccagcuagaccauggccaaaggcagagcauuggagcccaguucacagcaagggacugugugcucugagccgguaacaguccuuguguucagaggucuggcuggucgcaaccagggaguggcccccagcccccuuccucagcuagagcgagcaccacccaggcagccuuggguucuuugguggccgccucauaggccuguacuguuugugaaccuguugcuuauguuggacaggacuguggcaggacagccaucaagggucuucccuugugagcugacaccagucugcucuuuguccuccucuggcuggacaggcccucgucuucccggcuugcuugugugggggaagagcucacugugacauguggguucucuguucuuugucucaggcugugcuccuuacuccauguugggggcugucuccuugugugauaguuuccuuucauuucgugacaguggcucgaaggguuuuguuuucaggagacagagacugaggaguagccauucgggucuggcugcucaggaaggcaugcuggggauggcagcagagcccagcucagggagaucagaagggggcuuugggagcagccagugcuguucugaaggugggccuggguccugccugcagccucccgcagcggguguguuaggucuaagggaggaaggaaggggacuugaccucagcaggagugugaaauggguacccuccuggagucaauguccaggcaggggaugccucugaaaagcgccaggccagcuggagaggaaagggcaggcaucugcagggaagugugggggauuagcugcagaguuccuggguucuuuuucgcuuugucucuauuuugugacacuugaucuucaaacuagaaacaggagcaaagacauuuucaaaaauacaguugucagaacugcaaaaccacacagggucuguuacuggccaccaaaccugcugggccucccuggguggaugcugugggagagaugugggagugacauggcacagugcugcuguucugagcgguagccuugcuggaggagcgccuugccggaggagcaccuugcuccuuggccccacucugacccuccgaagcucauguggaacuggacauuuaccccaacucgguuuccugguguuggccugucaagacuugccuguuucuggccuccagcuugguccaugcuccucaggcucugaguagcugacggugcccacaguguccaugucaucugugacauuacccaggacaggacagggcccgucugccaguacauccccugguguauggugccaccuugccuucagcucaccaagcauauuucuucaaccuggucaucccaccaccucagagcuauugcacuaagcuguguuucuagaucuugucucucugacugugccaggugucucugcugcaccaagacagugucugucuggggccugccagucugcugacacucucaaaaacggccaguagcagcucaaaaggacugcuuuuguaucaaagccuggcuuugcucucugaucgcugcuggugggcacagagcccaucuguguaacugguugucacuccccagacucuucugcacccuucuuccucucugacuccuggccacaucugccacccacagccuccccacuccuuacacagccagccuccaggccguccugcuuggccugcaaaugcuccccugcuguuucuacugcucuucccugagucucccuauuggucccagugcuuugggaggccaagguggaggaucacuuaaggccaggaguuugagaccagccugggcaacaaagcaagacccugucucuacaaaaaaaguaaaaaauaaaaaaauuagccaggcgugguggcgcaugccuguagucccagcuauuugggaggcugaggugagaggauacuugagcccaggaguuugaagcugcagugagcuguguuugccccacugcgcugcaccugugagagagugagacauugucucaaaaaacaaaagaagaaaaagaaaaaaggaaggugggaagaacaaguaugccuuugaagggcauaccugccuugaggggcacagaugaggcaaccuucagaaaacaggccugugcagccacuucuaucagaaaugcucacugacuucuuggggccuagcagcuaucgucucagccucuggguguggagacccugccccaugcuaaccugagagcaugaguacaggguccucccagcccacccaugccucgcuuccccaggacucugacccagugccgcgcgugaguugguugucauuauccuccuggauuguuaacucucucaucuuuuguggcccuggugaccuuucuuacuugucuguuccacaccuggaugccuugugagcagaaaccccuugcugccuccucgccucccuucaggcuucaggaagcagacagggagguaggaacuccaagagugcaggagucucauucugucgcccaggcuggagugcaguagugccaucuuggcucacugcaaccucugccuccaggguucaagcgauucuccugccucagccucccgaguagcugggaccacaggugccugccaccacacccgacuaauuuuuguauuuuuaguggagacaggguuucaccacguuagccaggcuggucucaaacuccugaccucaggugauccaccugccucggccucccaaagugcugggauuacagaccugagccaucgugcccagcccaagagugcuuuuugaaucuagcagggugguaggucaaugucauuuuguuuuucuuuuuacauuaagacagauguaugcaccucucagcauuaaaccuccuuucugugaugucuuuaagaaucacagucauauugcuguagccccgucuguacauuccuucaguuuccugagguuggcugguugcuguuuggaguggucagaaugcuuucuagcacgagcuggacugggccuauucaauucacucagaggcaaggccccagagcccugacauguuugcuuguuucuuuuuucuuuugcuuucuuucuuuuuuuuuuuuuugagacggagucucgcacuguugcccaggcugaagugcaguggcgcaaucuccgcucacugccagcuccgccucccggguucaugccauucuccugccucagccucccgaguagcugggacuacaggcgccugccaccaugcccagcuaauuuuuuguauuuuuaguagagacaggguuucacuguguuagccaggauggucgugcucgccugaccucgugaucugcccgccuuggccucccaaagugcugggacuacaggcgugagccaccgugcucagccugcuucuuucuuucuuuuuuuuuuuuuuuuuuuuuuugagauggaguuucgcucugucacccaggcuggagugcaguggcgcaaucucggcucacugcaaccuccaccucccgguucaagcgauucuccugccucagccuccuuuguagcugagauuacaggcaugcgcaaccacacccugcuaauuuuguauuuuuaguagagacaggguuucaccauguuggucagguuggucuugaacuccugaccucagaugauccacccgccucggccucccaaaguguugggauuacaggcguguggcacugcaccuggccacuuguuucuuuaucagcaagcccagggugggaggccaggcaaggaagagacccaucccacuggcaagaaggcaggcagugagcacaccagagcaguccaccccugggagccacaggccaggccuuucuaacagauucacacuuguuuuugucuuucugugugugagugugggagguggggguggggguggguggggcagcaugugcugcauucgaggggucuccaccuuaacugauguacauggcucuuuauccccguggagcagcagugugaugaaaaacucuucauaggauucuaucucuuaguacaaaauuguugguaaauggguuuuuaaagauauuuuucacauuuauguggucuuucucuucuugucucuagcuagaagugaaguuggagcuugucucuuugaucccacauauaggaccugcauugucccacauagggacagacccuugccuugggagggacugagagaugacuucauguggccccuucauuuuauaggaguaaucgagucuagaaccagggugcuaccaucuggcagaguucauggggaacgcaggccacucagagagcaggaaauagaggccagcuggccacccaguagucuaaugcguacuuccuugauccugaacugguugugagccaucccuaggggcaaccccucccccgccccgucccuucaugccagggcucucucuuugcuucauggcgaccaccuuuccugucccuuuuuucugaucacccugcucaguggccugucauugcucucuguugagugccccuucccauaugccucuccuggaccucagccaggcuggugugcuggcgauagcaccuugucaccaggggcagcugcuaugcagggccuguuggccagggcccugcagcgguggagucacuggugugugcaaacgucucuucuccuuuuguguuucagcgaggaugccaugaggaaagcugguguggcacacaguaaauccagcaaggauauggagagccauguuuuccugaaggccaagacccggguaaggcccuaguaaguggagccacucuggcagagagacuuggagaggagagcaucacagacucuggaaccccucuguuggguguccuaggguguagggguggggugguugcucaucgauugaucacaggcacaguugguuuugccugcagcagucuggguccuccuguguguccaugguacagggagggcacuuggguugcaggcccagccucuggccccagaccucacugccgucaccuuccaucuguggucagccccugugaauccuacaggaagcuugcucaggccccuagcugguccuguggaagggaucaaugccgugagcaagaaccugguuuguccucagccccuccuagggguccuuaccuaagcccuacagggcccugaggcaugggcccagaagcauuccuguccccuuuugcuaagugaagaaggugaugcuuaucuagaacucgccacagguggaguggagaagaaggauuuccacuauaugugggcuuucucccuggguggggcaccacacugagggcuuuaugugaccaccuccuuuaaucugugugugcucccugggacagaaccguuuuacuagaaaugaacaaaacacauauucacuugugugcacgugugugugcaaggcagagcugcaagagcacagggacugaggugggguagagugggcucuguacuauggacacgugugacugaagugggauagagugggcucuguauuauggauacgugucacugaggugggguagagugggcucuguacuacggauacguuugauaagcuuuuucuuuuucuuuaagagcuuuauacgguucacccuuuaaaguuuacauuucaguggucuuuaggauauucacagaguuguguggccaucaccaaaaucuaauuuuggaacauucauuaauaaauaaaaagaggugcagcuucccuguguugcccaggcugguuucaaacuuuuggcccuacgccauccucuugccuaggccucccaaagugcuggggucacaggugcgagccaccaagccuggccuaauuuuagaacuuuuuuuuuugagacagggucucacucuguacccaggcuggagugcaguggcgugaucucagccugcugcagccucaaucucccgggcuuaggcgauccuccuuucucagucuucugaguagcugggacuacaggcaugugccaccacacccggcuaaguuuuuuauuuuuuguggagacgaggucccacuauguugcccaggcuagucuugaacuccugaucucaagcuauccccacgccuugcccucccuaaaugcugggauuacaagugugagccaccaugcccagccuucaacauuuuuuaaagaaacuuuauaccuguuagcagucacacucccuuuuccuucaacccucagcuaccacuuauacuuucuacugcuguagauuugccuauucggaauuuuccauauaaauauaauuguacaacauauggguuuuuuuuguuugugcgugugugugugugacaguuuuccucuugugcccagguuggagugcaguggcacaaucucagcucacugcaaccuccgccuaccagguucaagcgauucuuccgccucagccucccaaguagccaggauuacaggugcgcaccaccacacccgacuaauuuuuuguauuuuuaguagagacuggguuucaucauguuggccaggcuggucucaaacuccugagcucaggugauccgcccgccucagccucccaaagugcagggauuacaggcaugagccaccgcacccagccacguacaauauauguuuuuauuuugcagcuggcuuauuucacuuagcauaauauuuucaagguucaagguccaugaaccauguuugguauauacuuuauuccucuuuuguuuuuuuuagauggagucucgcucugucacccaggcuggagugcaauggcacgaucucggcucacugcaaccuccacccacuggguucaagcaagucuccugucucagccuccuuaguagcugggauuacaggugugugccaccaugccuggcuaauuuucguauuuuuaguagagauggguuuugcauuggucuggggcuauguuggccaggcuggucucaaacuccugaccucaggugauccaccugccuuggccucccaaaguacugggauuacagacgugagccaccgugccuggccaacuuuauuccuuuuuauugucaaauauuccauuucuggauggccauaucacauauuuuauagccauucguuaguugguggacauuuacauaguuucuacuuuuugguuauuaugaguaagcagaacaauaguuaauguauaaauuuuugugugggcuguguuuucauuucucuuggguauauaccuagggguagaguugcugggucauacccuaccucuguauuugaccuuuugaggaauugccagauguuucccaaagcaacuguacuauuuuaaauucucaccagcagcuuaaaugagguuucaauuucuccucauccucuccaauacuuguuauugucuauuuuaauuguagccauuauaaugggugugauuugcauuguuuugaucugcauuugccuagugacuaaugauguugagcaucuuuuucaugugcuuuuuggccauuuguauauuuucuuuggaguaaugucuauucagauccucuguccauuuuuaaauuggguuguuagucuuuuuauuguuggguuguaauaguucuuuaugcauuuggauauaagucuguuauuaaauauauaauuugcaaauauauaggggggauuuuauuuauuuauuuuuauuuuuguuuuuuugagacagucucgcucugucggccaggcuggagugcaguggaaguggagggaugcaggggguguuagugaugcauuguaaucaucccggagagcaggacaccucucauaagagguuuacccaaggggggcuguggaaagggcuagaaauugcuccuggaggacguggaaagccacauaagguuuuugacagauuagggaaaaggcugugccacucuuucugaagaugacaguguaggcagccuuuccauuuugugccaaaaauaaaauuuuaaauacauaaaucacaguaguuucuaggacaacuggguaacuacauacaaaauauugagguugagccccaacuucauacccuauacaaaacuuaacucaaaauaaaaaacaccagccaggcaugguggcgcgugccuguaguccugccuaaucgacaggcugaggcuggagggucacuugaucccaggaguuugagauuacaguaagcuaugauuguaccaacauguuccagccugggugacagagugagacucugucucuaaaaaacuuuuuaaaaaauuaacucaaaaugggucaaaaaccuaaauuuacaagcuaaaacuauaaauaucuuagaagaaagcagaggcguacaucuucaugaccuuggauuaggcaguaguuucuuagauaugaugccaaaaaagcacaagcuacaaaaaacguagauaaauuugacuucaucaaaauuaaaaacuuguacaucauaggacacugucauaagagggaaaaacaacccaugggaugggagaaaauauuugcaaaucacauaucagguaaggguuuaauauccagaauacauaaagaacuccuacaacucaacaacaacaacaacaacaacaacaaaaagcaacuaaaaaauaggcaaaauacagccaggcgcgguggcucacaccuguaaucccagcacuuugggaggccgaggugggcagaucacgaggucaggagauugagaccauccuggcuaacauggugaaacccugucucuacuuaaaauacaaaaaaaggaaaaaaaauuagccaggcgugguggugggcgccuguagucccagcuacucaggaggcugaggcaggagaauggcgugaacccgggagguggagcuugcagugagccaagaucaugccacugcacuccagacugggugacagagugagacuccgucucaaaaaauaaauacauaaauaaaauaaauaaaaauaaaugaaauaaaaaauaggcaaaauacuugaauaaaccuaucuccaaagaagagauacaaauggccaacaaccaugugaaaagaugcucaacaucacuagucauuaggggauugcaaauaaaaaccacaaugagaugccacuucauuuccauuauaauggcuaugauuuuuaaaaaagacaauaauaagcguuggcaaagauguagagaaauuggaauucucuuucuuuuugagacagucucgcucugucgcccaggcuagagugcaguggcacaaucucgucucacuacagccuucgccucccaaauuccggugauuuuccugccucagccuccuggguagcugggacuauaggcacacaccaucacacccagcuaauuuuuuuuuuuuuuuuuugagauggagucucgcucugucgccaggcuagagugcaguggcgggaucucggcucaacgcaaccuccgccucccagguucaaacaauuacccugccucagccucccaaguagcugggacuacaggcaugugccaccaugcccagcuaauuuuuguauuuuuaguagagacaggguuucaccauguuggccaggauggucucgaucucuugacuuugugauccacccaccuaggccucccaaagugcugggauuacaggugugagccgcugcacccagccaaugcccggcuaacuuuuguauuuuuaguagagacagggucucaucauguuggccaugcuggucuugaacuccugaccucagguggucuacccaucuuggccuccccaaagugcugggauuacaggggugagccaccgugccuggcagagaaauuagaauucucauacauugcuggagagaaugugaaauggugcuguggaaaacaguaugacaguucaucaaaaaauugaauguagaguuaccauacgacccagaaguuucacucccagguauauauccaagagaaaagaaaacauguccacacaaaaauauauacacaaauguuuauagcaucauuauaacaucauaaauagccaaaaauggaaacaacccaaaugucuaccagcugaugaauggauaaacagaauguagaauauccauacaaugaauaucauguggccacacgaagcaaugaagggcugauacaugcuacaacauggaugaagcuaaaaacauuacauaaaugaagcagucacaaaggaugacauguugcauuuuuauaaaauguccagagaauacgaagaucuauagagauaguguauuaguuucccauggcugccauaacaaguuaccauaaaguuggaggcuccuaucucuggguccauggcucugacuucugagcccaugucucugcccucacuuucuuaaaggguagcacauguuugaggcugcguaguuuuaucagccuauuccugcuucuaaaauuuugggaguucuucuuugauuuugccuagucuauaaacuuucuacuccaagcuggcaguguuucugcugguagaacauucucaaaauccuuguggaacuucuacauauaugauggaauucauaguauuagaugagguuucuccacagaucuuuccuagauaauuucaucucucuuccucacuucugugagaugauugaggggauucaugagucccauguuuaaucucuuuggcacuagaaaaauuuggaagauaugccacacccuuggcauucucuacagaacacacuuuccuaacaguaaaucuccuaguuuuagcauuuugguuuuuuccaaucuaaauagccugagaauuucccaaaucauuaagucuagauuccuuucugcuuaacaguucuucccucaauuucucucucuucuuuguguguguguguguguguguguguguguguguguguguguauuuuuaaaauucuuuuuauuguacccuuaauuuaucucuuucauguugcuuuuuuuuuuuuuuuuuuuuuuuuuuggagacggagucucacucucucgcccaggcuggagugcaguggcgugaucucaggucauugcaaccuccgccuccuggguucaggugauuauccugccucagccucccaaguggcugggauuauaggugcccaccaccacacccagcuaauuuuuguauuuuuaguagagacaggguuucaccauguuggccaggcuggucuugagcuccugaccucaagugaucugccugccuuggccucccaaagugcugggauuauagacgugagccaccaugcccggccuccucuugcauuuuacuacaagcagaaagaagaaaccaagcugaguccuuuuuuuuauuuuuuugagacugagucucacucugucgcccaggcuggagugcaguagcgcgaucucggcucauugcaacccccaccucccagguucaagugauucuccugccucagccucccaaguagcugggauuacaggugcccaccaccacgcccggcuaauuuuuguauuuuuaguaaagaugggauuucaccauguuggccaggcuggucuugaacuccugaccucaggugaucugccugccucagccucccaaagugcugggauuauaggcaugagucacugugcccggcccaagcugagucuugaaugcuuugauuggaagucugcucagcuaaaugugcaaacuuauugcuuaugauucugccuuccacacagcuacaggacacaauccagcuaaacuuuuugccauuauauuacaaagaucaccuuugcucuaguuuccaguaacauguuccuuguuuccuuuguuucuuuagaaucaccuuuaauuuucauguuucuaacaacauucuguuuuugauaguauauguauucuugaagauaauacagacuuucuguaucaaguucgucauuuccuuuaaggcagagucugggugacagucuuuaacauccgcauuucuacccacagccuguucaaggaaaccuaggccuuuucuaucaugcuucucacaauucuacuagcccuccuuuguuauugaguuacaaagccacugccauauuuuuaggcacccuacuccugguaacaaaauucguauguuuccuguggcugcuauaacacguuacuacaagcuugguggcuuaaaagaacagaaauuuaggccgggugcgguggcucacgccuguaaucccagcacuuugggaggcugaggcgggcagaucacaagaucaggagaucgcaaccauccuggcuaacauggugaaacccccgucucuacuaaaaauacaaaacaacuagccaggcgugguggcgggcgccuggagucccagcuacucgggaggcugaggcaggagaauggcugaacccgggagguggagcuugcagugagccgagaucgcggcacugcacaccagccugggugacagagugagacucugucucaaaaaaacaaacaaacaaacaaauuuaaucucacaguuuucaaggccagauguucaaagucaguaccauggguaaaaaucgcaguggcagcagggaggcuauaggagaggaaccuguuucuugcaucuuuuagcuuuuggucacugcugguacuccuuggcuuguggcuguaucacuccagucuucaaguccagcaucacgagguaaauacauucucuguauuccaucuucacgucgccuucucugugugugugaacuuuccuucugccucccucuuaggaggauacaugcaauugcacuugggguccacccgcauaacccaggauagcccuccaucucaagauguuuaacuucaucauaucugcaaagaccuuuuucucaaauaagguaacauuuacagguuccagggaauaggaccugauuuaaggacuguuauuuagccugccacagacagaaaguugauuauugauugccaagggugcuguagggaaauggaguuuucauuuggagugaagaugauguucuaaaauuaggccaggcacgguggcccaugccuguaaucccaacacuuuggaggccaaggccaguggaucacuugaggccaagaguuugagaccagccuggccaacauggugaaauccugccucuacuaaaaauacaaaaaucaguagggggugacagcgcauaccuguagucccagcuacuugggagggugaggcaggagaaucacuugaacccaggaaguggagguugcagugagcugagauggugccacuucagccugugugacagagcgagacuccaccucaaaaaaaaaaaaaaaaaaaagaaacaaaaugcuuuaaaauugauuuugguaaugcugcagaacucugaauguaguaccaaaaaccauugaauggcauguuuuaaaugggugaauuguaucucagccagccuauuacauauauuuuuaauggaacgagugaaaaugaugaauaacaggucuguuuucccuugguggccaggucagggccgugugguuuccuuggguggggggcacugcuggggcugccuugucccuacuugguuucugaugguguguccugugggcuggggccaaggucccauggggcuauggauacuaucauggaaccacucuuucuggaauuugaugguauuucaaaaucuauuaggaaaacucugagacaugaaagcacagaggcgucauauuccucuaaucuggagucagcaguugcugugguuuggugacuuuucccuuggcugucucugugucccuccugaagugucgagggcacauccccacccucaggguuguaucucugcugagcaucuccacacuggccugugcuagggccccaccugacaaucacauggagucacuauugucaucaaugggaaggccucuuucaaguuucaacgcuuuuuuccuaauaguuggcuucuuugaaucaggauccaaacgagggucuuuucuccccucuggccccucccagccuggugaaggagcagcccagcuguccugcagcccuccccaugggcucugaugucucccaagcugcugauucauccugccugcccccuccuucuuaugaacugggugcuaaaucggagagcagagagggugccguggucuuuuagcaaaaauauauccgaaguauugccuuaauuuguauuucugggcaucuugauauucccauaagaccacaauuuggagguuuggagagcaacaacagccugacccuuguaaagcuccuauuaucuuuccgaugguuucaucauuuaauuagggcuuguagacuaauucuggcuuuucucccacauucguuacauggaguuuuuuuuguuuuuuuuuuuuugucaagaaagguuuucuuucgucagccagggcuagaugauuguuugaaacccuguguguucaggaccuccaggaaugcuguuuuucugaucuuuccagucuaaggaguccccccaagggccacagauggguucucuuugagugacauuuugagcucagggcuguguaucugggguguucugguccauugcugucauucauuuugaugcuuagauggucccauccucaucuagcaggagcuccugugucucuuggggcccucacacaaccucuuuaguuuuucuuagucugcuggcauuuagacccagauuggcugcuccucuagggagugaacccuggggacuucugccgguaaaguggcauuuggagcaugcuacgugggcgcuggucuguucauugcuuugggccuuucagugaacagaacuaagaaaaaacauguuuuugaaauaacagcaacaacaaaaacccauaauuuuacacuaauauuucuaauucaaauuuaaacuuauauauaggguuuuuacuucuuucauuuuaaacaugugucuuuucuguuacuaugaauaucuugguuucuaauauuauuagcauacuugguugcuuuacuuuaaaaucauuucagaauaaacaguuuauauuaccacugauaacaaaagguagacuaaacauuuaagauuaccuugaaguucuaauuguccuuaaaauguaucccuuuuauugagaacauuuugcuuuuuguuucauuuuuuuaaaaagccucucaaaagauuucuuuucucuauaugauucugccaccaacuuaauauucagcucauuuguuuuaguuuauuuggaauguuuaggaauuggaccuuuuucuuuagauuugcuauacuuuucauuuuagaaaaauauuuuaggcuggcuacagugacucacaccuguaaucccaacacuuuuggagguuggggacugagcaaaagacaagccggccaacauggcaaaaccgugucucuccaaaaaauacaaaaaauuggccaggcgugguggcucacgcuuguaaugucagcacuuugggaggcugaggugggcggaucagaaggucaggagaucgagaccauccuggcuaacacagugaaaccccgucuccacuaaaaaauacaaaaaauuagccagacgugguggcaggcgccuguagugccagcuacuugggaggcugaggcaggagaauagcuugcaccacccgggaggcggagcuugcagugaacugagauugcaccacugcacuccagcuugggccacagagugagacuccaucuaaaaaauaaaaauaaauaaauaaauaaauuagcuggacaugguacugcaugcauguagucccagcugcucaggaggcugagguggggaggcucacuugagcccaggaaguugaaacugcagugagcgaugaucgcgucacugcacuccagccagggcgacagagugagaccccaucucaaaaaauauauauauuuuuuagagaaauaaaauucacugaguugccccugaguugcccaggcugaacuccuggguguaagcaauacuccuacuuuauccuuccaaguagcugggauuacaagacugugccacugugccuagcuuugauuuguuuuuuuuguuuuuuguuuuuuguuuugagacagaguuuucacucuuguugcccaggcuggagugcaguggcgugaucgcggcucacugcaaccucugccuccuggguucaagcaauucuccugccucagccucccaaguagcugggauuaccggcaugcgccaccaggccuggcuaauuuuuuuuguauuuuuaguagagauggaguuucaccauguuggccaggcuggucuugaauuccuguccucaggugauccuccugucuuggccucccaaagugcugggauuacaggugugagccaaggugcccgacuugauuuggcuuuaucuucucaauaguaaaagauuuaugugcuucugaagugaaaacccauaacacuguggauuuagagagggcacauuuccagcccaguuccugauacuugcuggguugucgauuuucaauuuugguguaucuuuccaguguuucucauggcagauuuaagcaaauauguguguuuacguuccacaggucuuauauaaaagguguaugucaugcaguguauguggcacggagcacguguuucuauccuuucuccuuccuuguguucacuccacaauauguugugaggcacuugugcaagauuuccacaugucaagcaaguguggaaauucuaugaagcuuuuaacuuuuugagguggggucucacucugucgcccaagcuggagugcaguggaguggucacagcucauugcagcauugaucucccaggcucaagccucagccucccacuuugaggccacuggcgugugcuaccacaccaggguaauguuuguuuguuuguuuguuuuguagagauggugucuuacuauguugcccaggcuggucuuaaacuccuggccucaagggacccuccugccuuggcuucccaaaauguuggaauaauagaugugagccuccacgauuggccucuauggaguuuuuuaagguuucuguuuucuuaucuguaaacuggauguguuaguaguaccugccucugggugguugggagaaaucaaggcgauaaugcaugugaauugaugacuccugugucuggcacuguaaagugccaagugcuagcuguuacugucaugauguucauuguuuaugguuuguaauacucagccucagguacagcuggacacuuauauuuugauagccagcaggggagcuggagcagaccaagugaagauagggaguuuccugacucuuuagcccuuuuuucugcagcaguucuaggggaguuggugugcuuuggagcagaaaggggcauaauaaucuguccaucuggauggggguggggguggauggugaggagucaggagugaaagagcccagccagggggaucagaggcgcaguuucagauccagggcuuucuccccuggaaaggaguuguugugguugacccauugcguucagccccuagauguuccuagauaaaccugccuuugggggaauguaggaaguaucaucgcccacaagaaagcuccuuggcuggcagcaugacagcuuccugugcuuguuucucacaucaggcguccccucccuccccgcuccccacuaagccuccucacgcuggucugguagcagagcuggagcagauggcaguggcugcgccuacugugggucaggaguggugcugggcacugcaggaugaugaugccugcccacugcauuccaggugcugggcuggcagugggucuugcucagcccugguguuaugcagaagggcuuuggugacaugguccugagccuuguuugagugucuuaugucuaaguaaaaguaucuuguugcuuuugaaaccuacuuccccuuguuuuaccuuuuauggauguggagaaaacaaauucauuuaaaguaucgcagaccuaaaaaaugguccagggccuuaggagcugugagguguugaccuggcuggcccccaggcccuucuccccucauacauggccaccuugcuucuguuccugaguguccucagguucccacaccuccauugcccccauucucauaccacuguccuucagggacaggcugccugugggcccccuucacacgcacaucagcuuuccuaucaguaauugauggggauagccggaagcugggcguguugacagaacugccuugguguccccuuguucuggccaggccucgcugcuuaucccagcuuuuccucuccccugggccuuucuucuucauguuguccugugcuaauuccccgagcugaaaaaaagaagugggguagaguuuggagauagaugugggaugauaaagauuucaaaagugucuuuguauuuuuacacucaucugagaccacuuuucaucauccuucccucugcccugccaucuuaugaguguaguggauggacucugagugucacagugacucaggaggaagguugggugagcagggcacggagccggggcuuugccccuuccaggcugcccugccagaaggaugggcacuucagcagaagacaaggaugcuucucugaaauaagacuuuaccucagacauccguguauugaccacaagaccaacucacaguagugauuucccugaaacacuugggagugaguguccuuggggccaaagaggacaaugggugggaggcagccccugccagacaaucucagaaacacagcagcuugcauauagcgggccuuggcagccaguggccuucaccucaccugagagugggcuucacccucugccuugccugugcguaaauggagaugaacacagauucucccggaaagcgcagccaggggagggccgcccagauuuucagcagauacugcgucaucagugaaaaggcagcaacaggcugggcugagaaaugaaagcccuucuuuacagauagugcaaagacacagcggcccacccacggcugccucugacaggccuugugcccucaggccagcgccucaucacccccaaccugccuguccccuuugugaugaagagagggcacucaagauggcucccagcucucucagcugagugccuuuccaucaggggagaggaguggccguuggaggcucucuguccccuucuuguuucuuugugccuguuauuggccagccuagcugagcacugacggcucucuuccgagaggcggauuccagaggaggccgagcaagcgucugaaucugccuugcaggaugggcuucagcucggugccagcaggcgagggggcgggaagggggaguccgaugacugcgcuucuucaucugguauuaaacugcuuccuguuuuuacuuuuaggacgaauaccuuucucucguggccaggcucauuauccauuuucgagacauucguaaguaagauuuugcauuucuggguuguugagaucucugugagaggccagcccugacgcugccucggcagagcuuucugggcaggccguggugccugagucagaaggucugugucaccucacuugcuucugggaaguucuucacugccuugcauuugacuccagaucccuccauccucccagagccuuggccucaaaaaugcugauucuagcaucauggaaaugcuguccucaaaguggucuaaacggguugcugcuucacuugcucacuuaaucucccuuuucauagggcuguuguuuuuacuucugggaaguucuguuuacccuggaacagaaacucucuucccuaaaaguugauuuuauugacccauggaggccagagacacuuaggcauauuuucccuccagacuagaagcuucugaggaggaccuccugagucugcacccuggcucccugcugugcugagggcccccguguuaaccucacguugugccuccucugauucagagggcccagugugguucugucagccaggcaguggccccagcucuacagaaaugaguugucauugcauccuagggccagggucuucgugcuuguguguguuacguggaaguauguggacaccaaguguuccuggauggccacagccugcgaaggaaacuggggccagcagcugcucuguguuuucagccaacaauggcuccugcccacugccgcugcauaaccaccagaggcaggcuucucuugacacaggccugucguuggagcaugugccuggcgaguccuauuucuauuccccuguggguuagggacaggcagcuguaccuucaguguguugcugggucaaagggagacauugagcacuccagagccugguagguuuugcuucuuuccacacuaacuuuucaccagaauggccagcaaagugaacuucacugaucucacucucugugguguuggaaagucacugggauguguaagaggagaaggagcagcccagaugaucuggcccagaugcgcuggcagacuccgcauguucugcuuucagggacaguggccuggcuggugcacacaguccuguggggcucaugaggucaugggaagcagccgagcaggaggcucagggccccaugacugcuacagaaguucuccgcugggcacuggggucagcuggacuggcuuccagcuggccguggacagccucaguuuccucaucuagguaacagagacacugccucaccagagugggcugcaaagggaggcagugucaagucuuggcaccacuccagccccgccguggguuccuguaguguucuauuauuuguuugcucagggcugagcugagacucuggaccugggaaaaaggaaagccagaguaggcccaggguccccaaccccagagugcuucagccuugggggcagcucccuaaggccccagguugacccuggagcuacucugcacccucugcccccaggucucuuguggggucagcgcugccaagaguagaaacacuucccccaguaguggggaguacuaggagcuccguggggauuaaggcuugggcaaaugccuacagaacugaccuacccauggaaauaugugguuauauaaaacuauguuuacuuucguuuuuuuguuuguguuuucauauagauaacaagaaaucucaagcuuccgucagugguaagaguuuucccuuuugaguuaaaguuucucccaacuuuggauuugagguggcaagaaugacauagugcaugccucaugugccuggguuaaccugucacuagaggagaaugcuugcggagagaacucuggagggaggaggcugaccagcugugcccugaccucuccagccuucgucuuccugcagacugugaagucgcaugauccuccccaucccguuucacacaaaugcugccuuugcccagcaaaaagauaaacacucacaaagcuauuaagacauuauccaaaaguguugagcucucugguagagaauuauuaugcuguuuucaguguaauaauauguaguagcauuucugagaaaaugcugugaauucacuuuuuuaaguuacaaaguuucuuuguaaauuuagaaaucuggcugggugcuguggcucaugccuguaaucccaacacugugggaggcugaggcaggcagaucaguugaggucaggaguucaagaccagccuggccaacaugguaaaaccccaucucuacuaaaaauacaaaaauagccgggugugguggcaugcguuguagucccaacuacucaggaggcugaggcaugagaaucgcuugaaccugggaggcugagguugcagugaguugagaucgugccacugcacuccaaccuggaugacugagugagacuccaucucaaaaaaaaaguuuagaaauccauauuuuuaaauuucagcguuuaucacaugaggggaauucugucaauucagccuuggucucugcugacuaagcugcaagggaagggguuuaacagauccaggcuggccaacugcauucugccauugggaagggagugcacugaccucacaggcugcacgccacugucugcccugcccuagacaguagagcuguacaugccagcugucucugcccaugugggucucaccucucagccaggacagggauucuuggccaacuggggcugagcggcagcaagggcauguggccagaacaucugggccccuuggcauuggagcaugggguccuggguaccacccaguuguguggcauggcgguccugccaggacauaccugucuguggguagcuguuugcugugaaguccacacuguugugacaauggcauccuuguccuugguuguggcauugcucacugagcugcugaccuggugggcuugggacauuucuccucagugcucuguggagcccuccucugcaccccuaagcuguucuggcaugguggcccugcacacaggggcccaggcugaguuggacucugcaacagcacgaguggagcugugugugccuguggacuugugcccucccugggagagcguccccuggccacuguguuaccgcuugcucagaagggcccaucgugcuuuguacgcucacccagcaggagggcuggacagccaggagaggcagggguugccaccugcccucaaggccucagcccaucuuuaguguaucugcaggcaucagagaggucauuugucccuuaacauuaggacucugguccaggccaggcuagagguaugggucaugcagugaccaacacaccuggcguccuagccauucauauuugggagucuccaggagccuagucucuuacugcuuggggcugugaggggauugagccuguagguaggcgagaucugugcucugugagccuuacgcccuuugagccauggucagucugguaggcccuuuccugagaagcucugcccuuguguucccacagauccuaugaaugcacuccagagccugacuggcggaccugcugcgggagccgcuggaauuggcaugccuccucggggcccgggacagucucugggcgggauggguagccuuggugccaugggacagccaaugucucucucagggcagccgccuccugggaccucggggauggccccucacagcauggcugucgugucuacggcaacuccacagagugaguaccacacuucuuggaggauuugccgcuuuccuugcaaacgacaacacauuuuauuccugugcuuaugaugguaucaagaaaagcauggagaagcuccaaaucgcucugguuuuuuuguuuuuuaaaucuuuguuguauguggagagaaaaggcuuccaauuuucguugagcucccagaaggguuaagugaugcugggcccuccuccuccuccuagcccugggcaggaggguggggauggccugagacuccauccaaagguuuguguuuuguggcugaaauagauacaguguguuucagaggguucucagcuacaaggcagggcugagugccagcaaccacaacuccacugucugcccgagcucugggcaccaucucuucuagugcugcccuugccccuuggucaccauggguguggcuugcagccauauuaucuucuggcuuccuuucugugaaggagacucuguguccucuccacacggcugcuguggugggaaacugggcugugaucagguguuauaggugaaccaaagcugcucuaaaggggaggcaaagaaccucccucuucuuuccaggaccugucuuuugagacggggucucgcucugugggccacauuggagugcaguggcacaaucacggcucacugcagccuggacauccugggcucaggugauccucacaccacagccuccaaaguagcugggacuauaggcucacagcaccgcgcccggcuaauauuuuguauuuuuuguagagaugggacuucaccauguugcccaggcuuaucuugaacuccugggcucaagcgaucugcucaccucggccucccaaaguguugggauuacaggcgugagccaacgcgccugcccuuaggaccuaucuugauguauccuugagucccaucaacauuucuuagagugugcugugcccacugcaaagugcuuuaguguuuuuuuccccuuucauguaacuuuuuauuuuuaaaauaggagucacaggaaguuguggaauagcauagagaguucccacaugcccuuuacccagcucuccccaauaauaguaucuuacauagaacauugucaaaaccaagaaauuaauguugaggcaguguaaucaccucaguuagagacuuagcuuggacuucaucaguuuuuuuuuuuuuuuugagacagaguuucacucuuguugcccaggcuggagugcaguggugugaucucagcucacugcaacuucugccuuccgaguucaagcaguucucuugccucagccuccgacuaccugggacuacaggcgccugccaccaugcccagcuaauuuuauauuuuuaguggagaugggguuucaccauguuggccaggcuggucucaaacuccugaccucaagugaucuucucuccugagccucccaaagugcugggauuacagacgugagccaucacgcccagccgacuucaucaguuuuuuuacacucauucuugggcuacauauauggguauguguaggucugugagauuuuaccacgugucaaaucaaguagccaucaccacaauuggcaugcggagccguuccauuaccaccaaccaacucucuuguguuaccucucagagaucgcgcccucccuccagccuuaagcagugacaauugcugaucuguugugugucucuguaguucugucccuuugugaauguuguauaaauggaaucauaccauaugugacuuuuugagauuggcuuuuuaaauucaaucugauacccuugagacccagccagguuuuaucaguaauucauuccuuuucaucacuaaguaguguuccauggaacggauuuuccacaguuugcuuauucauucacccaugaaggacauuuggguuguuuccugcuuuugcuuacuauuaugcaaacaaagcugcuguggauaucuguguacaggcuucagugcuucaauauauuuuugucacacaucccucaugauaacccuaugaagagggcagcaucgcccccucugcuuugucaguguagcagcugcuaaggagaacuggagucacaccccaggccaagagcugggaucgaagcugcugccugaccccauccucacacuccuacccuauccugugucagguuuccucuucuuuggggccauaggcauccucauuucuacccacuccugcucuggaaucuuccuccaucccaagccaccuucccuucucauaccuuaauucuccucuuacuuccuguugucuaacucucagcacgugcugguuuccucauccuagaacaaucugccugguucuucgucccaagcucucauuaccucacuauuuuuagcacaucagauaaguacaccagcuggguuuagggaggacccacagaagugccggcucaaguuccuugucacguucuacucuuguguacuuggugcauuuuuuuuuuaaucaugagcuuauacuugauaauaaauuguuuuuaaauguaugaguuuagaaugcucacaugaguugccuugucaucccacuucagagacuuugucuuaaaccaguucuuugucagaaguucaguggugaagcuugauauccugcccacgcccuccccagucuggccuuggcccccacauccuguuuuuagcuuccaaggggacuggucuucuguguggcacuaguugaaaguuacagugggggcugggcacgguggcucacgccuguaaucccagcacuuugggaggcugaggcgggcggaucacgaggucaggagaucgagaccauccuggcuaacacggugagaccccgucucuacuaaaaauacaaaaaauuagccgggcguaguggugggugccuguagucccagcuacucgggagacuaaggcaggagaauggcaugaaccugggaggcggagcuugcagggggcgagaucgugccacugcacuccagccugggcaacagagcgagacucugucucaaaagaaaaaagaaaaaguuacaguggauucucuacuucaggaucuuguuaccaccuuugucagaggccaacucucccugcccuucaccacuugccucccuggucucccugaaacuaguaguguugucugaugggcauuugauaccccuuccugacaccuuucccaaagacuacugcaugauuaaggcccuuucagaucuucaucuagugccaccaagaggacagagccugggucagagguuuugccagggacucucaaaggguaggccaggggacauugugauaguuuucaggugacccagguuagucggaaaaggcugaaacugcugguuguuccuauggcuggggcugcaguacagaguuggaagcaaagcuuuucacucugcgcauuuuuguuucucaugaguuuuauaugacgugcauguaaagccgacuuuaaaaauaauuucuacugccaguugugugauggacuggggugcugaggacauguucuccuccuggauaacuagguucugguuaggaugcacuuuggaaugcuggccugcagcaguuggggaggcuuuguccuccugagccucagcugcugcaaggugggggaagaaagcuugggauuccuguagucagccaggauuugugcuggguccugugucaccccccauaccccccagaagcaggugcagauuggagcaggugcggauuggaggaacauguccccaguguaagaccugugacaguugcacauuaaggucaagcaaucagcauacaaagaucaccagccuugaagggaaggagagacaccaugaaggugaacagaaaaaauagacacauguaggcaugcccagugaccacacacacaggaacuguuaguuaugggccaugggguauauaaagaaauaaaguggagagccgggcacaguggcucacgacuacacuccuggcuacucgggaggcuaaggcagggggauugcuugaggccaggaguuugaggcuauggugaacuaucauugcaccacugcacuccagccugggggauagaacgagacaccaucucugaaaaaauagaaaacaaaaaggaaaagaaagagcagaaauucaaaugaaaaagcaucaucaggagcaaugaagcagauuugaaacggaaccaaaugaaagcuguagaaaugagcaauauaauuauugaacgaagaaaguggaugaaugaacagcgcauuagauacagcugaagaaagaauuuguguaauagaagcuacauuugaagaaauuaucuagaauguagcacagagaagagcacauggaaaaugugaaagcaaggguaagaaaugaggauaagaucagaaauucuaauuggcauccaagcaaagccccggaaggaucaaauggagagaauggaagaaaacaauaugugaggggauaacuacugagaaaagcccaucuggccccaaccaaguuagccaucucaucugcugugagacugcagagcaccaaaggccagaggaaugucuuagaaauaggcaguuccugcaaaggagcaaugaguacacucagcaguagagucagaaagguaauagaauauuguuaaagcauugagaauagagcugccagucacauuuguaugccagcaagacucaaggauguggaaagcaagccauuuuuagauaaaccuagccuuagagaccaucacuaaaagauuuucuaaaggauauaucuuuuuuuauccuuuuuccaauaagccuuuugcacucuuagauauauucuuuuguuuauccuuuccucuucccucucaggugauacaagguaaaaugggaaaagaaacguugagcauaggugauaguaaauguguauaaaucuaaagcagugauucucacccagggugacauuccaccacaggggauauuugacaaugucuggagacauuuugggaugucacuacugugggggugcugcuggugcguaauggguggagaccagaggugcugcuaaccaucuuacaaauacaggucaguccccccaacaacauagaaucaucugggucaagugucaguagugaaaagguugaaaaucgcugguguaaauaaaaauuuaccucuguaaaauaaaacagucaggcuaaccuccauacagacuugccacauuccaagcacuauuucauuucuuuucuauuauuauuauuauuauuauuaagauggaaucucgcucugucaacaggcuggagugcaguggugcaaugucggcccacugcaaccucgaccucccagguucaagcgauucuccugccucagccucccaaguagcugggacuacaggcgcgcgccacuacgcccagcuaauuuuuguaucuuuaguagagacgggguuucaccauguuggccaggauguucucgaucuccagaccuugugaucugcccuccuuggccucccaaagugcugggauuacaggcaugagccuccgcgccuggccuauuauuauuauuuauagagcuagggucuccuuauguugcccaggcuggucuugaauugcugggcucaggcgaucugcucugccuuggcuauccaaagugugagauuacgggcaugagccacagcacccaaccccagggacuauuuugaguguuuuacuuacauaauagauuauuuaauucuuaguccaguguguggaguagguacuauuauugcauuuucuaacagggaaaacuaaggcaaugagcagugacagaguugagguuuugaguccaggcagccuagcuuggaggcuguaucccuagccucaaauccauccagccucuuaauagaaugucugcugugaagaguuaaaauagaucaacaaaauaugaaauaaaugcaagucagcagggagauagagcgugaauaucgguucugucggguacauauaaaaccuacuuuaaaaaguaguaaauuugggaaaugcuaaaauauugaugagguuuauacuuuaaguuaaauaugcaugauaaaauugaaaaauuauugcuaaaacaauggaaauaauucauaaaauuuaagaucaauagaaaaaauaggauaaggcagaaauccagauaauacaaaguucaauccaaucauccaacaaaaaugcaaucaaaaaagacaaagaagcuuagaaaaggaaagacaaaggccgggcgcgguggcucaggccuguaaucgcagcacuuugggaggcucagucaggcagaucacgaggucaggagauugaggcgauccuggccaacauggugaaacgccgucucuccuaaaaauacaaaaaguuagcugggcaugguggcgcaugccuguaaucccagcuacuugggaggcugaggcaggagaaucgcuagaacccgggaggcggagguugcagugaaccgagaucacgccacugcacuccagucuggcgacagagugagauuccaucucaaaaaaaaaaaggaaaggaaagacaaauauuaauagaaaauaaguuuaaaaauauaaguaaucauaauaaaugugaguggacuaaacuuuucugcugaaagauaggaaaugugagaacaaauggaaaugaaacagcacaguuguuuuauuguuagaagaaacacacaccuacaauaaaacaugcggaaggauuuaaaaauaaaagaugaagaaaggccaagugcaguggcucacgucuguaaucccagcacuuggagaagcugaggugggaggaucacuugagcccaggaguucaagaccaaccucggcaaaauaggagacccccaucucuacauaaaauuuaaaaauuaccuguagguacacuugagaugcugagguaagaggaucacuugagcccaggaggucaaggcugcagugagccaugauugcacuauugcauuccagccugggcugcagugagacccaaucucaaucaaucagucaauaaaauuagcugaguguggugguacacaccuguagucccaucuacuugugaggcugaggugagaggaucgcuugcuugagccuggaacgcugagucugcaaugagccacgauggagacacugcauuccagccugggugacagagcaaaaucccgucucaaaaaagaaacaaacaaaaaaaaggaugaagaaagauguauugggcaauuacuucaauuacaucucuuuguuauugauaaacagaccaaaaaauucauuuacagaaaauuugaacaauguaaugaacaacuuaauuuaagcauaugauggaacaauauguuuauaaaaauaaaucauaaagcaagcuucaacaauuucagaaaauuuaaaaguauugucauacuuuuuguuguuguuguuuugagacagagucucacucugucacccaggcuggagugcaguggcgcgaucucggcucacugcaaccucugccucccggguucaagcaauucuccugccucagccuccugaguagcugggauuacaggcacgugccaccaugcccgcuaauuuuuguauuuuuaguagagauggguuuuugccauguuggccaagcuggucucaaacucgaccucaagugauccuccugccugagccucccgaagugcugggauuagaggugagaaccaccgcgacccgccggucauacauguuuuaugaaugucaaauaaaguuagaaaucugucacaaaauaaauuaaaaauuuuuuacacuuggccaggcacagugacccacgccuauaaucucaacacuuugugaggucgaggcaggaggaucacuugaacccaggaguuugagaucagccugggcaacaaagugagacugucucuauaaaaauuuuacaaauuaguugggugugguggcaugcaccuguaguuccagcuacucgggaggcugaggcaggagggucacuuaagcccaggaggucaagggugcagugagccacgaugguaccacuucaguccagacugggcaacagagugagaccccaccucaaaaaaaaaaaaucuuacacccaucagaauugcuaaaaugaauagugacagccucaaguguuggugacagagaaacugaaucacucauauauugcuggugagaauguaaagugguuuuaccuucuuucaaaaugaaauaugcaacucagcaguuacacucuuggguauuuuuccuagagaaaugaaaaccucgcauaaaaacccaugcacgaauuuuaacagcagcuuuauuugugguagcccaaaucuacaguuacccaaauguccuucauguagacgguuaaacacacugugaggugcuuguaccauggaauacccuggcaguacuguugcuagaacuacaaccuguaugcugaauguaaaaagccgaucccaaaaagguucauacuguaugguuccauuuuugaaauauuauguauaauuuugaaaugacaaaauuuuagaaauggaggaugcugcagugguugccagaguuugcgggucaggguugcugagagagguggcaacacgagggauccuugugguguggggacuguguaguguauugacugguggugacugaacccacccaggugguuaaauuguccagaacuuaguacacacacccacacaagugagcacacaucgugguugugauaccuuguaaguuuguagaauguuaccauuggaggaaacugggcaaaguauacaaaggaucucucuauauuucuuuaauacagcuuuauugagacauaauucucauuagcauacaauucacccaucugaagugcuccacucgguagguuuuaguguaauccacagaguugugcagccaucagcacaauuuuagaacauuuuuauguucaccccaaaagaaaccucaccucagaaaaucuuguaauugacuguucauauaagcaguuuucauaauagccacaaaguagaagcagcgcaaauguucaucacaggaaaucgguguaguagaauauuauuuggcgauaaaaauaacacagaaaaacugauaacaugccacgacaugggcgaacucguaaauauuaugcuaaagaagcuagucacaaaagagcacauguucgaugccauucguacaaagaguccggaaguggccaauccauagagacagagaggagauuacugauugccagagucuaggcuucuuauuuauccaaaagacuuaguugucccuuuucuuuugucuuugguuauuauagaguaacucaugauaggaaaucccaaaaucaacacaaaugcuacuucguauucuaucuuucugucugugguaaauggaacguucagauuccagcggcagccguggcaguggggcuuuugcuggcuguuuugucccuugcugugcagcccugcagcguuucugggaaucugcccuguggacugacuggcgacucuggucuuuucucagcccagcugcagcuccagcagguggcgcugcagcagcagcagcaacagcagcaguuccagcagcagcagcaggcggcgcuacagcagcagcagcagcagcagcaacagcagcaguuccaggcucagcagagugccaugcagcagcaguuccaagcaguagugcagcagcagcagcagcuccagcagcagcagcagcagcagcagcaucuaauuaaauugcaucaucaaaaucagcaacagguaccagguccccuguuccugcucuuggccucccuccugcagcgugagcccugggcuggcaucagccacaaugcugggugcagugcccggagccagccgaggguucucuugacacgugugccugcccuuuuccaugggcuucucaaaaagucugggacaaggccgggcccaguggcucaugccuguaaucccagcacuuugggaggccaaggcaggcggaucaucaggaguucaagaccagccuggccagcauggugaaaccccaucucuacuaaaaauacaaaaaauuagcuggacaugguggcguacaccuauaaucccagcuauuugagaggcugaggcaggagaaucgcuagaaccugggaggcggagguugcagugagccgagaucgcgccgcugcgcuccagccugggcagcagugagacuccgucucaaaaaaaauaaaaauaaaaaaggaaaacaaaagucugggacaggcaggagaaacaggcccugacucacuaggaagguucugugaucgagcccuuccauuugggcuugggcaucuggcggugggccuccuguguaguucaggggcugcgagggauucaaacaagagugagcugaagcaagaagugagacgaacacucugaggcuugggacuacuugagccauugugggccauuuuggcugaggacacaugugccuccuguuuaccucugugucuuggguucugggcucaguguuagucgaccuccagcugguguugcaugaggugauggugaugucauguuagcagcacugcuucucagaaguuguucagcuucccaugguuuccauagagagucuagacguguuaaacaucugcccucacagcaggucuugguugggagaggaaagccccaaagggccccaccacccucccaccccuucaggccucagcuagcugggcuucucuggaucuuggcaccccucucccagagcugacagugcaucugcagccacacuuuuccuucuccugcugacaagcagaccuugaccgucaccgugaggcucaugccacugaccuauaggggcaaagcaagcaucguugcagaggcuucagaaaucugcaguugccccagcuuuuauccuagcuuccauggagcuguaccuauuccuugucaucuuuugcugaaguuucuagguaugcccuuugaaccauccuaguggaaugguagaccagagcccaggcacacacuuggugccuccccggugucaggaaggcagcugguguuggccucggggggcccagagccuuucugugggagaugugccccuccccgugugagugagaggucagccugucagcccaggaaggccuuuuuuuuuuuuuuuuuuuugagacuuuuuuuugccucuuacucuguugcccaggcuggagugcaguggugugaucucggcucacugcaaccucugccccaccaguuuaagugauucuccugccucagccucccaaguagcugggauuacaggugugagccaccaugccuggcuaauuuuuguauuauuaguagagacgggguuucgccagguuguccaggcuggucucgaacuccugaccucaggugaucugcccgccucggccucccaaagugcugggauuacaggcgugagccacugcacccagccaggaaggcuuucuugauggcucugcagauggccaccugggcuuccugaggcccagacugucacagggaggagcuggugccacagaggcagaugagugauaaccgagugcugcuuguucugucucuagauacagcagcagcaacagcagcugcagcgaauagcacagcugcagcuccaacaacagcaacagcagcagcagcagcagcagcagcagcagcagcaggcuuugcaggcccagccaccaauucagcagccaccgaugcagcagccacagccuccgcccucccaggcucugccccagcagcugcagcagaugcaucacacacagcaccaccagccgccaccacagccccagcagccuccaguugcucagaaccaaccaucacaacucccgccacagucgcagacccagccuuuggugucacaggcgcaagcucucccuggacaaauguuguauacccaaccaccacugaaauuugugaguaccuguggcccacaguggagcacaugcagcccguggcucugucagcaguaguuucuaggcucuuuggcuagagauagcauauccuauucuucaagugcugagacuucaggcagcccccaccccuugccagcccugccgacucuagcauggcucagcagggaagcauguguuuugcauuuuguguucugagagcugcuucugcaccccgcacaggguacugcugcugcuacuggggcaccaagucgcauuccaagcaguguggcugauugcagcaguucugugggcccuuucagggugugagcacuucgacugaugagcaccacaugaaaggaugugccagcuccgucagugucuggugguuugccaacuacucagaguuaauguucuaagcaaauaucuuuuuuuuuccuuuacacucugccaagucucaggagaacaaaguucauuacuauauuuuugagaggaguauuaauauaaaauacuguuauuccuaguuucauuuuguaucucugcacaaagccagucuacucagugacaggcacagaggacagaguaugaucaccaggaugaagguagcugcaucaaggggccauuuggacaacucuuuggcucccuugguuuuuguggccuuuucuguuugugauucaugaguggaauggggccugaggcaagugugggggugaacaagaggccucauaggcagacuggaagucuaggagaguugugaggagcagauaugcucacucaucugucaccugggagucgacacacugccugaccccggggacugugcagacugaaacccuugugugcugcaugguggaaugugcccuggcaggguuugcccuaguggcuuggagaugucuaaggaagagcccgcugcauguuggaaugugcccuggcaggguuugcccuggugacuuggagaugucuaaggaagagcccccugcaugguggcgcgggccugucucguccuucuggaggccccuccaugcaguggcuccacaguugccccuuuugcccaaguuugccccccacccccacuuuuuucuuuugaagacagggucucuguuuuccaggcuggagugcacugaugugaucagaccucccugcucaagcgauucucccaccucagccucccaaguagcuggggcugcaggugugcauccccacaccuagccaaauuuuuguauauuuuguagauaugggguuuggccguguugcccaggcuagucuugaucuccugggcuuaagcgauccacuggccuuggccucccagaaugcugagaauacagacaggagcuacuacgcccugcccucugcuggccggcuaacccagcuuuccuucaaggaaucaggcugagugaagcucuuguggaccaucagcaugcuuggcccagaggaugagcaggcuaggcuguaagcucugcauuggaagucgucagugcuugugauagcuggugcugagggauguguggagacaucccagugggagggccacauugccacuugccagaauuggauuugagcuaaugggauccuagauggccaguaaggugacaucacagcacaugaggucaugaaagucccauuccucaccucaagaaaggcuccauuuccuaagcuuccacaggaagacuaggcucugcucucugacccaggugguuccaaaucacauucucucuuucucccucaagguccgagcuccgaugguggugcagcagcccccagugcagccccaggugcagcagcagcagacagcaguacagacagcucaggcugcccagaugguggcucccggaguccaggugagggccuggggguggagggcuccauagucaucagcaggugcauguucaccugcgcauguagugcuacagugaggguucugguuggauuaggggcugggggcuaaguugguaaagcaggggcuucucucccccuugcacucugcaagacaccccuggaguccuuggggugggcagcugugcuuggucaugucuaggacccaccagccgcauagugcgugucguuuccagcuuugcucgggcauccuucauuaucccucuuccuugccacucugagugacucugggaacauguaucagagaguagaaggcugcaguuuucuccucaccucucaucuuccauuugagagucugaguacagagcugaccaggguggagggcagcuuucuagacacucggaagcagaugggagccacaugcagcaggagcgugggagaaggcauccuggugcucgccugcacucagggacuccggcgcuguguggugagaagcgugccacucccacauugcugagcuugcuggugugucacauguguggaaugugugugugucucugugugucacguguuaguggaaugcagauggccuugucuggccuccuaguguccugggauuggaggcccaggguuucuguaccuuuuccuauaaccccuccucuccuucuuguggggagacguacagucuggggcuucaguuuuuccucuuuucacaugaugguggaaacacuguugguccugacucggaaggggcguuggcuuuagaaagagucagaaugugcuaguugaugugguaagacuguggcugggucccagcccacagcuggcagugcgccugcacuuugcugucgucuuaaggguaccuggccuugugguuuucugcaggccugcugggcgcagcgccugggugcacagugccucguggcaggcuucaucucacgcuuggggggugcucaguaauguccuucauggugccugcuaccucuuuuaagucccugggaagcugccugaggagggaaucugagguauuuggcugcagcugagguuagcauccuaccuuggcagggcaccaaaugacuuggggccaggguccccaugucacauucuuacuuagauggagcccuguaugaaacacaccacagaacucacauuuacuuacagcugggggaggcugaccacuucgugugaugagguuggaggucucugccaccucccugugugucucggcauguccucaggccucgugggggggcucccuuguccuggucucaugcagaggaaggacgugguguguucagagucagcuuagugguggcacauagugacugcccacccaguggaagcugcuaccuuugccucuuuggaccaucgauccucuguucaggaccucacuuccuggaaacuuuuuuuauuuuuugagauggagucuugcucuguugccaggcuggaguacaguggcacgaucuuggcucacugcaaccucugccuccuggguucaagugauucuccugccucagguucccgaguagcuggaacuacaggcgcgugccaucacaccuggcuaauuuuuguauuuuuaguagagacaugguuucaucauguuggccaggauggucuccaucucuugaccucgugaucugccggccuuggccucccaaagugcugagauuacaggcaugagccaaugcgcccggcuggaaacuucuguaccgcaggucaagcccagcaggaaagugagaacugcucuuuucuuuauuucuuucugucuuuuuuuuuuuuuuuugagacagagucugacucugucauccaggcuggauugcaguuuugcgaucucggcucacugcaacuucugccuccuggguucaggcgauucuugugccucagccucccaaguagcugggacuacaguugcacaccaccacaccuggcuaauuuuuguauuuuuaguagagauaggguuucaccauguuggccaggcugguucgaacuccugaccucaagugauucacccgccucagccucccaaagugcugggauuauaggcaugagccaucgcacccagccuagaacuucucuucucuucucuuuuuucucuuuucuuuucuuucuuucuuucuuucuuuuuuuuuuuuuuuuuuuuuuuuuuuuuugacagagucuugcucucucaccuaggcuagaguggcuggagugcaguggugcaaucuuggcucacugcaaccucugucucccagguucaagugauuguccugccuuugcucccaaguagcugggacuacaggcaugcgccacuauauccagcuaauuuuuuuuuccucuuguauuuuuaguagagaugggccaggcuggucuuaagcuccugacuucaagugauccaccugccucagccucccuaaguguugggauuacaggcgugagccacugugcccagccgaacuuuccuuuucuuuccauuucuugguauuuggaaagugaauagccauggagcagccaguguuuucagcuggugcaggcccagcugguauguucguuaggcuucuagcucaaggaaguguccacucugcagucucacuggcaucccaucaccguccagaagcaggaugccagcugugugugcucauggcccaugcugagccuguccuugggccacuggucuuccugucgguuucuccaccccuuguuucagguggagguccccgcccgacuggcacaggaaggaggauggagagugguuaccacugugguucguugcugagugaguuugauguuuuaaggaucauugcccaccugcccuguggcaccaugugcugccaugcaggggauucccaagugcuaguggcagaggagccuuguaguuucucaaaguccagcaguggguagggcguaucuaugaggugcuucucaguccagauguggcaccuugaaauucuguaacccgcauucugcugguuuucucucagagcuuggucuugccuuguugcaagcagugcaguuucuugggggcuaauugggcacccucacugccuuguuccaccaauagcagcgcccccugcugggggauggggaggguugggcacagcaagcccucugaggggccaucuggauucaugaucuucuuuugaaacuugaauuggcacagugaccagcugaggcuacgguacucugaucuaaaaacuuuaaaaguaugugugguaacuguagaacccagaaaguggagaggaacagaaguaagagaaccauuccaugagagagaaggucugguguccuuucugguuguuucccauagucaaggucaugcuauccugggguuuuuugugcagcaucuuccacaucaauaggggaugaaauguucuccuuuaauuagaaagcccuggucggcacgaaggaacucuugucauaccccucugugaaugucucuugccauccucaguuaccaucuuguucuuggaccuuguaauaauuuccgauuuuuugcuauuaccagugacacauaucuugaugucuuagauuguuccuggagcugauggaggugagugaaugguucacuuugagggccuucagaucugaucagccacccucuaaccaggaggucagagaugcagauuggagcuccccuuguguuguucacacaguggacaucaggacguggugaccacguguugcagcuuuguauguaugagcugccgcgugcugcggaaacaggccucuugaguucaugaaugaaauucugggauugggggcccccaugcaggcagcccuccaugcccugucucucaagcccaucuuagagccgaagagaggcgcccugucaggcccuugcaguacugugguguuggaugugguaaaggguagccugggacugaguauucuagaaaaauugcucagccuugugcugugcacaccugguucucuuuccaguguuauuuauguagcugagaagggcaaugucacccacaaggggauuuagcaggacacagcagacuucuuuuucuccccuauaaaaccaagacaugcaggcacaguggcucaugccuguaaucccaacguuuugggaagccaaggugagaggaucacuugagaccaggaguucaaaacuauccugggcaacacagcgagacccugucucuacaaaaaaauaaaaauaaaaaguuagcugggcggaguggugcgugucugcagucccugcuacucgggaggccgaguugggaggaucgugcaagcccagggguuugaggcugcagugagcugugaugacagcauuacacucuagccugggagacagagcaaaacucuugucucuuuaaaaaagcaagaaacaggacagaaugcaucucauuuucuuuuuuuuuuuuuuuuuaaagacagagucucuugcucugucacccaggcuggagugcaaugguacagucucagcucacugcagucuccaccuccuggguucaagggauucuccugccucagccucccaaguaccugggauuacaggcaugugccaccaugccuggcuaauuuuguauuuuuaguagagacgggguuuugucauguuggccaggcuggucuugaacuccucgccuuaagagaugugcccgcuuuggccucccaaagugcuggaauuacaggcguaagccacugugccuggccaugcaucucauuuucaaacagucccuauaccuuugucauuuaacguucuauucuuuuaguaugugaaaaccaaacucuaauuuacaagucacaaagaauuauccaagacagacucccauuguggacauguauguggcauugcugauucacagcuacuguacugaagccuuggccacccuggaggacccucucucuuuuugcuggacccuucugcacagugacugcaguagggagagucagaccugggggugggggagagguuuuuuggauuccucucuggguagauguguguugggaaguagugaaauguugauagcugccuggcucaucugauccaguaaacauaacuggugcguuuggguugaaagaaauugggcuuuccuuaucaguucucaguuauaagaacaucagucagcaguacauuagacuuaagcuuugcauuccuugcguuuuuuuguuuguuuuucucuuccuggaaaaaaguuugcuucucucauaccaucugacuuacuuccaggcuuuucucccuuguggaacgagugccguugagcccugcugcacucucagacgggcuccuccgaagugccgcagguggugguaaaucgacucucacccacuggggucgcuccuucgugucuccccccggucgguucaucuguugcucuggcugcaggaggaacgagugagcuucuggucggcgucugccaugccgugucaccccggcuucuggcaccuccugugcgugcccaggauugugaaugugggccgugugugugaggccacgggucucccugcagccacucuccugcuggagcucuguuacuggcaccugucgcugccugcaccgaaggcuggcagcaccuccuggagcuugggacccagagcacagccucccaccaugagauguguuguuuuucuguggaucaguccuccuuucuuucugagccuggcguguuuuguucuaguuuguuaccguccuaagugccuguaggcccugcucuccagggacgagacucgggcucuacccccaacucagaacccagagcaagaguggucgggcccgggcccacaacagugcucagcuguccugcugccuuuguaguucaagaaguguccauugaugaggggaaugguccuggcucaugcuggaguuccugacucgcaucccuguggagaugaacuuccucgucagggcggaggccugccaagcaguccccccaggcuucucuugcucaccuuugcccauuuuuauuacgaaagaaaaccaguuccuugauagauaccaggaccaucagccucaggccuggaggaggagaggaggaugauuuggguucgggcuguaagaggugugccacugagaaggagggaugcugugagcaggcuuaacugagcucaugguucagugggaguugaguguucucaucacaggcuuugguggaauguacucuugacaucuguccccaggagccuggucuccagaaacaccagcucaggcccucaaggucuggcucugaugguucugugggcuauaggauucugaucuguuagcgagguguguucagaaguguguugaggacaccagugcaggagagcaaccaguagaacagaaaggucuggaagcagcauucuuggcaaaucuucuagauucccaaugcccagacagaccuggaggugcugugggcuugaacauguggguggccuccccucccaggcugccccgagcugcccaagcuuuccuugcccuggugcuccuucuugcagaggcuacacgugcccucuccaccugcccaggcacugaguuucuuuguugcgaucaccuugucuguugucccucuguccucaaagaugaucacggaagccuuggcccaaggugggaugcacauaagagcccgguucccgccuaccaccgcuguguccgccaucccgucaagcuccaucccuuugggcagacagcccauggcacagguauuuacggggcagcgcccagggcacggcugggagcucggggcguccucugagcgccuuuguaaagcgcaccugucauuaucaucgccggugacuucuuuuaugguggcuuucagagugccaaacccacagucccuuuuuuuuuuuuuuuaaaugaagccaagcccagcuugugcuuguugagaggauaugaauaaauaucugggucuuuucagcuuaaaauaguuauacuguacgcauuuucaugguaaaaauaaaacagcagcuaagcaaaaguuuugcuuucuagagcugugcuaucuaauaguguagccacuaagcauguguggcuguuuacauuuaaauugacuaaaauuaggccgggcacaggggcuuauggcuauaaucucaacaccucaggaggccgagaugggaggaucacuugaggccaggaguuugagaccagccugguucacauagcgacauacuaucuccaauuaauuauauacauuuuuuaauggaaaauauauauauaaauguauauauauuuuaaaaacaaaaaaaaaaccuaaaagucaacuaaaauuaaauaaaaugaaaaaaugcaguucuucagucgcaccaaauaaauuuuaagcccucauuugcccacagggaagcuaguggcugcugcaguggacagcacagacuccagaacguggccaauguggccaaagugguauugggccaugcuguuguagaguuugauguguagaguguguaauuuguaacacagauccccuuucuagguagagguagacuucuguguacauuaugcuuuucagagacaggaauucccggcuucuuuuauuguaugaaauuuggaauuacuccauggcauagucauuuuuuuaacaaauaguuaccacaugcauucugugugccaggcacuaugcuaagauucugagaauaaaauuaugcugaaguucucucaucauacaggcuuuccauuuuaguggguuugucgugaaaacaucaaauuugccaaaagaacuuuacaauucaguuucuguuuuaggggaaaugccucuauaauccuagcagacaguggucccuguccaucccugaacgcccaggugcaggcacugccaccacccuggcuugugcaguggcgucucugcagcucuguucuacacaggaagaaguggaggcugagccaggauggcccuugguccauguggccccaagccuggugccacacaccacacacugccaagaaaguggccugggcccccacuggggcauguuuagcuuuugccuucccugcauacuaacccccuggguuaccccagaugugccauucacauaguuacugacuggaacuuaguuucuuuggcagggacuuccuuuuuaguaguuguugaauuacagcgggaggaagugccuggaaucugcugguagaaaggcuuuggugaaagagcucuccagaggagcggaaguugggggucaggaauuagguuguguggcugugguggaaaggaggccagugugggcagaagccagggugcaguuccccauggccuggaggcugugaguuccacgaccugcucacaugcugcuggugucuccuugacuagaccccuuuggguucugcacucuugucugcuaaaacugcuucuccuccuuucccauagccucuggcacaguauccacuggguucacagaaucagguuggguugcuguauguggaggaaugacuuuaguagcagcauguaggacugauuuuuauaaacacaaaaaguccccaauguuuucagugugcgauaugugccaggccuugagcuaagcucuuuguguacagagccucacuguuucuuguuguagcaggucauaguuugagcauuuagccccuuuuacagacuaagagugcccccagggagccaccaagucaggaucgagggcucaagugaaacccuuaugccuuggccucucagcaggauucuucuggaaacuccucacuccccuuccugcugggcugaugaccuggcuucuccuucuuguuuacugggcacuccugggugggcucccuccaugcccccacaagaccaggcucuguccugggcuuuggcuugcccauacucuguugugggcuggccacuccccacacccagcugcugguguuuccaccuagacuucucacaggcagccccucccucccucccucccuccuucccaccaguucccaaacccacucagucuuucccuccccagccuucccuggcccuuagauuaagucugcccugaguuaugccagcuaauaggucucucucucucuagaagcuuccaacccccaaaggcaaggagguaagguggagcagaggaaggauagagaaauauaugaugaagcugaaaaaguuauugccuuggaauaaaugccauggagaauucugguuuguccucauugcacuguguggggugagagcgcucucaugggaagaugcuggcuaacugcacacagauuuaaucaccaggccccgcccauucgcacuggcagugagaggcacaccccugaaccuuugggguuguucacugaggacaaacgcggcagcauuuagaaaguauuccucgucccggcaguagacaaaagccacaggauuuauggaaagaggaaggaaggcacagaacuggggcaagguucugguuuuguucuguuauuuuguugucauuguuacuguuuguuuuucuuuuuuugagacagagucucgcacuugucccccaggcaggagugcaauggcgcacuccuggcucacugcaaccuccaccucccagcuucaagcgauucuccugccucagccucucgaguagcugggacuacaggcgccugccaccacaucuggcuaauuuuuguauuuuuaguagagaugggguuucaccauguuggccaggcuggucuugaacuccuaaccuuaggugauccgcccgccucggucuccaaaacuguugagauuacaggugugaaccacugcgcccagccuuguacuguguuuuuaaagcagguuuguucaugcuuguuagcugcaagaaaggaaacuggaaggaguugagggagggagaaaagcgaauagagggacacccuggaguggaagccucccuacugcccaggcagcugcucugcagcccucucugguccuggccuuccccgcagagggcccuccccagcucagcccucuacguccggcugcaguaccaggcucuugguacagucucccacaccuggcugugggccagccuuggggacgugaggcaugcugggccccguguaccaagggcauucaccugaccacaccagguggcuccagaggugugccucugcuuuugugucaguaucuuucaauccagucccuuccgagaaaaagagagcuuaucucaggaacguaucuguugaucucaccaggaauugccccacugugucccaucugagcucucaggggccagaaccugcugucuccaguguguccagauggccacucuguggccacugucccuccagccacuugcccucagcagucagcaggacacagucuggagacuacacugcccauuugcucuugcucuuuccuuguggcaacaaauuagguccaagaaaacagguggagcugaaagagggaauguacgugccccaugggcucuucuccagagggcagggcccaggcucccucccucugucuugacggcucauggcugcaucuuccuguuacggugggcaugccucacggacucaggcuaccaggucaagcaggauucugugcugggugcauucuggacacagugcucagcacgggggcccaggggguggcauggcccaugccacaauccucccuuggcagauguaagcaggcagugucuuucucacuaggggcuuguccuuugacuagagaggcacuguugccucccuguucccugcuccaaucccagaccugacaugagaccaaggacugggagguuucuuucucgccucucuggcugccuccccagagccuagagccugucuuuggaugagucuuugcaggggcugcuucucaucccaggugcuggacuuggacugcccaccacugacaccugggcacagggccuggcuuccugcucucgugcucuuggaaaugaaugggugcccuucauuuguuuuucuucccacuagaaaucucccugccucccauccucugggcucugcuggcugccagcugccagggugagacccguguuccacugcacccuggggagugccuccaggggacacacugagugccggagccaggagcaaggaacgguucccaguaugugggggcggggguggggaucgcgcagugccgccagccuugccugaggguuccucugugagauggagcucccuggaccagccuuuuugcccucccaccuccucucuggcccacucgguguccaccugccuucagcuccaggcugcugugugggucccuuucccagaaaugcaguucaggccauuguugcugggguggugguguugcugggguguugauguuuagcgugccugagcucccuucaucacuaggaugaccuugagcaagucacuucccucugagcucccuguucccaaccugugacacacaggugacagguggugugcacucagaaacuccuucccuaggaugugugacauucuuguccuggggccuuugcuagcugugacacaccggcgcccgaccucucuggcugccucccuaaugccaguugugucuucagaugagucuuuggggggcugcuucucaucccaggugcuggacuuggacuguccaccacugacaccugggcacagggccuggcuuucugcucuugugcucuuggaaaugaaagggugccccucguuuguuuuucuucccacuagaaaucucccugucucccauccuguaggcucugcuggccaccagcugcccugaccuggggcagcugaagaacugagauagaccuaaguucugggugggugcuuggaggccccacgggcguggcuggugagauugccgcuucagggccaaagugggugccgggcuuccugagguucgagagcagaugagaacucuugaguggcaaugagggcugugugguggccuucucugcuuggcagccucugcccagccugcagcugccuugcuccucagagaagcgcugagcuuuaggccacagaaaagagcugaccaucuucuagaagggacagcugcucaggcacaggcgccucucuggaagaggcagucagguagaggcaaggggaggggcccugaccuucaagcaggaagagaggugagcuugugagacagcuuucuggggugcagguagagaguagcagcaagucaagcaugggucagaaaaggcagaguugggcugagcauggggcccagagucuuugcuucccacuccucggugccgucugugguucucuguauggaauuuucuggccuugggauuuuguugacaccuggauaagucuagaacauguguuccggugucugggacaugcccuuacuccucuucagcuagggcucugugcaccccagcaccgugaaugcacaggacuuuggugggagaaaucucuguacuuguucaacucagcauuuagcaaaugaagucacaucaguccccguuucugaccuugcuaaccuuugcgagaaucaccgcgagccauuuugcuccauuagguagagugaugaggcccggcaggccgaggcuggggcuccugcacucugucccuccucucccaggcagaggugucuugaccacaaagcagugggaacaguccauuccaucgguugaugucccacugggccaguggcuuuggauagggaccucugacccagcugugcuggaaguacccuguuguggucacgcucugugccuuagccccccacccccuggucucccagcacacgugguucaggaacggccugcacccagcaucccuugcagcacugucaggcacagcccauggaacaggcaggacagaaagagcauuucgcuccaggagcuugguccacguggugcugaaagggcagugccacccugcccucugcugccuggugggguggugaggagggcagcauucuguuugugggcucugggccugguccccaauuuaaggagcuuagaaagcagcuguccuaucccaguacucacagcacugugguggaagugcuugggggguggugugagccguggcccgagacaggcguucauggccagagugccccaggagaagcacugaguuggucuacagaaauggaugguccaggggccuggcuccuaggcagacugugaggggaugcuuggcaugcaggggguugacuagggugugggaaauguagcagggccuucaggguucccccagugugacaaggcaucccucuuugcugagagucccucuaggggaggccagacgcccagggcuggcaggcagcuguucuccccaucaaagcagccaucugugcuccaccccaggaagguguggguguuuuacauaugcuuaucccugaugccuggguggugugguuucaucccuagaguuuacggaugaagacaguggugucccuggugcagacacuggggugauugaucuuauuugugucguggccagcaaggccuggggagcagagcaacagccuugcuuugcauacacacagggccucagaggacucaggugcacaccugcauggcagaaccaggcucugggcccaggugucugacacugaguagcucgccucucccaggggcgcuggugugggccgaugcaagugccaccauggguguguguguggcucccugggccaccucacuccaauuaagcagguccaggugggacagccugggaccagcccugcagcagcauguguuaaccacaacagauggcuguagccaccaggcuuguccuuggugcagucagccugggggcugcgggggcuuguggaagcaugugggaagacggucccacuggucagcagagcaggguccucaccgacccacagaggagcaugucacaggacaggcaggcgugucagggaaggccaggcuagugccagccaagggcauugccucccagacugcccuuuuccucacacucccacgacacagcccucaaagccugugccccugugggucccuggccaaggagcaagggcugcccugccugggccccccccgccagccccuuggucaccucaugcugugugccaggcugggggagugugccuguguguauguccagguggcauuuggaugaagacacagguguguggugaggcugugcgggaggaugggccuaugcgugcggugggcaggugguguggaggcaggcgggcgggcguguggcagcgcgccggcugagccccuccacuuccaggucagccagagcagccuccccaugcuguccucgccgucaccgggccagcaggugcagaccccgcagucgaugcccccucccccccagccguccccgcagcccggccagcccagcucacagcccaacuccaacgucagguaggccuggccuggggugccccuccccaccuggcccucgaggcuggcccugccuggaccccggcucacauguuucucucacuuggcugcagcucuggcccugccccaucucccaguagcuuccugcccagccccucaccgcagcccucccagagcccagugacggcgcggaccccacagaacuucaguguccccucaccuggaccuuuaaacacaccugguaaguugggccugaggugcuaaggucacuccucaccuuuaugaggccucagcucauacugggugugcgagcucuggggcccucagagcucaaguuccccacccgagggucgagggcuguggccucacccgccuguguccugcagugaaccccagcucugucaugagcccagcuggcuccagccaggcugaggagcagcaguaccuggacaagcugaagcagcugucgaaguacaucgagccccugcgccgcaugaucaacaagaucgacaagaacgaagguaggcugcagccagggcaggggccugcacccuggggacaccaccaggcuugugucuuaguguguacccucuucugucccagacagaaaaaaggaccugaguaagaugaagagccuucuggacauucugacagaccccucgaagcggugagcuuugcccacagcccacggaggguccacaagggcacagauagcccagccauggaugggcacuuggugaugauguggguuuaacaaaggcaccaggcagcucuuuggacccuggccagaggccuccaaggcuccacucuggugugugcuggggcuucaagcccaggcuucaucuuggcccaugcccagccuuugcccuauuccuggcugcugcuguggcccucaugcugggccaucacagccagaccucauccagucagcagccaggggcccagcuugcaguggccugaccaucagcuggcccagaugggccugagccugaccuggaguucugccccugacuugcuggugaccaugggcaggcgacugcaucucaguuaccccauuuguagcccacguguguugucaugaaaaugaaacaagguggcgcuggugagaagcagguggaaggcagggcugcuggccacaggcugcugugaggaucagagcucgggcaguaccuccaaacugcaugggcauuggcauauaccucccuuucaccucaacucaggcuaucccccaaccccugucuagaagggucucucuguucugcuugucuggauagaaugccagucacuauugggugguccuccaggucuucauggguugauccuuuguuaggguuauagggaugaguggggcagggacuggccuacaugacaaugaggcauucacagccugaucaggggccuggccacugucccuucucuugacccaucaccucacucugccaaccagggacaagcagcuccugggguugagggcugccugccuucaacucugggucugggaacagcuggucaacugguaggagcuccugcagagguuucugauggcugaggcccaguggcaguaguugggauccugagccugagaacugccaugucuuccacucuuucagcccaaguccucucucucugcagguguccccugaagaccuugcaaaagugugagaucgcccuggagaaacucaagaaugacauggcgguggugagugggaugccagacaccccuaggggaaccagggcucuccuaagagcuccugggagugcugcugagagggccuucaaggucagggcaucugggcgggggccgggccugaccuuggacccugcccacgaggcuuccuggccaggucugcugugcugggugggaacaugggagaagucacccucugucuacggcccccgugggugccuccuucacccauuucagaggaggcagggacuguagggaggauaggcugugggggugggggauuauucccaggaucagccaacauugucugcacaaggguggaggcugugagagaggccucgggaaucugacugugagugaccaugggccuggggugugaaggcccccuaaauggggaacccucgggucccgggcugcugaccgugcccauccugucuccagcccacucccccaccgcccccggugccaccgaccaaacagcaguaccuaugccagccgcuccuggaugccguccuggccaacauccgcucaccugucuucaaccauucccuguaccgcacauucguuccagccaugaccgccauucacggcccacccaucacguauguccagcugggcugggcuuugcggagggcggccagcccugggccgcgugugccagguguggucaccaugccgccuccccagggccccaguggugugcacccggaagcgcaggcuugaggaugaugagcggcagagcauccccagugugcuccagggugagguggccaggcuggaccccaaguuccugguaaaccuggacccuucucacugcagcaacaauggcacuguccaccugaucugcaagcugggugaguguccagagggccgggacuggugugggaaagcaggcccugaccgcagccccaggacucugccauccaagccagauggcacagcgcccagaacccacccuguguucacgccccgccaggcugucugcucuauccucacacacaccgggcuccagacagccuggccaugccucaguccccacugccagagcccgcacacucucaccuccccaacacagauguggcuuugcuugccugggcccuagggaggugguaggcaggaccucugggcacccaucaaugcagagcacuccaggcuucacguuuggaaaucugagagucagagagaccuccuccaggcuuugccacaagcuucaccagaaccucccuggguguggaguccuguuccagagcagggcugugaggcagggcaggccggggcuuguccaggucacagauagagccuucuguguugcagaugacaaggaccucccaagugugccaccacuggagcucagugugcccgcugacuauccugcccaaagcccgcuguggauagaccggcaguggcaguacgguagguagacccagaggagcugucuggggacccagggcaagcaggggucauuguggaaaaccaggcuuccacugcagcagggacagccucugugugcuccugccccuccccagcucaggccccucccuccccucuucuggcuccuccugcacagacagcagcggguuuuccaguggucgccugagagaaaagggucucugcucccacugugucccuucgccccuucaacuugugucacgucagcuguccagggugguuguguucagugggugaggggugaguaagcccauggcucagggacaguccccgcucuucccagaggccacuagcuucccagaggccacuaccuuggcagggcugccagguuccacugguagcuugggcacacagggcccaaucugggugcuguggcuccagagagaaccacgguggcagggggcagucucugagcccagagcuggcacacagcagagcuggcacacagcagagcuggcacacaguagagccaggcuggguccccaagguuguuagaggcagagcccuagauccuguucagauuugguucucacugacgaugaggcucugggaggagagcccaaaggccgggcagcgugcaggacacaucaccuccuggugcuucggcccgcgccuggggcuaccccuucccagagcacugccgggugugccaggagcgagcgcagcgccggccgccuuagguucacgcccacugcucuguugcagacgccaaccccuuccuccagucggugcaccgcugcaugaccuccaggcugcugcagcucccggacaagcacucggucaccgccuugcucaacaccugggcccagagcguccaccaggccugccucucagccgccuagccaagacugcagggauggcccgcagccucaucggggccaaggacacacgccuccugucagacacuucuagguguuggcuuccuuagagagccugggguuagguuagcuuuccugcuuuuaucuucugccuuggggaccugccaaacgaaaucccacaccuguacagaacugggauaggcgcaguggagcggguugcuuggggggcguuggccgacuucuuagagaaggcccuccaugugacuuccucccaggagccagaugcgauccucaggcugcucucaccguggccuguccacgguccagguccaucucagcagcgugagggugcacucaggguguuguuagagcgucucgugugugcuagacgcaccccuacucguuccuauagaacacagaggacauaggaaacccuuaaaacacacaugggauucucuggucacaguuuuggguucaggcuaugcugcuuugggcagguggagcaccccccgaggaagccugcaaguccagggcacaggcugccuuuuggagggagggcuggcccauaggugcugcuggcuccccgccaccagcugggccucagcccucacggcauuccugcugagcaccguggggcacccagggagcaggggcgucagggauccugcugccggcaccccugugccgcuggcaugagggccguguccccacugugaaggaugaagagcaaggcccucaggacccguguccucagagcaccacacacugagcacccagagacagcgggccuggcagcgggccgggccaugcagggagcgccucccuauguugccugccacucugggcaccggccagcacccucuggugagaagagguccccccuuuuuaugugcacuaccccaccaucugugauuauaauaaauuuauuauuccuguguuugucaguuguuca

SEQ ID NO: 192612 - RNA, 54365 nt, Homo sapiens
acgugacggcccaggcccccgccccgccggcuccucucgcccagccucccgccucgcgccucccgccucccgccucccgccucccuccagcugcgagugcggccucggcuggcggcggcaccaggucagcugcgaggcgugagccgaacgggccgggcggcagcgaacgcgggggucgggcggcaagcaggcaucgcugggccggggacaagcuagcggcgcggaguccgaggggcgcgggggcgggcgcgggccggaggcucgggggcggcgaccugaggagagcccgcggccugacguggcggggacgcggccggcgggauccccgggcgcgggcgcguaggggccgggaucuggcgcucggccaggggccagggugcgaggccuccucagcgcggcugcuggcgcgccggccuccuggcacccgggcgggcccuguugccugcggcagguccgaaugcggccuuccuggccgcgacccuccgcgcuggagcgggcggccuugcaacaggcgggcgauuuggggccggccugacgagccucaguucccucgaucgggcccggggacugcagccguaggagcccagccuugccagcucucccgguuuccugagaggagccggagaucgcgcugucagugcaaaaucaccagagcgcgaagcgucggcugccaguucugaccauuuuagauccggugcgggccgagccgaguggaucuggggcgggcagcggggcaccgccaccuuccgccugggcuccucacugggcgcccucgcuccggcccuccgcggggccgagugccuccaagacggcucccugggagauucuuccagagcgcacccuuuggaaggcugccccgcugggaaucagcacccacucccucuccucuaccgcagccgcccccuuugccuuuguggccgaccuugcuucaugcugccaaggauugaguuucuuugaggggauacugcucguucgggggcccuacagaaggcugaggguaucuacucaguaaaaucguaccgaacugaaaguuccucugaaaugauuuugacucugccauccaucacuucauaaaaauucaucuuguauccuucaguuuguagcuauguggcacauuaagcuuccuuucuucuccccacugaaacuucgaacaguacaaaacggggaacuuggcuugugaugacuaaaauuggggauaugagacugggggcgggcgcgguggcucaugccuguaaucccagcacuuugggaggccaaggcuggcagaucaccugaggucaggagagacuagccuggccaacauggugaaaccccgucucuacuaaaaauacaaaaauuagcuggguguggugacacgugcuuguaaucccagcuacucgggaggcugagguaggagaaucgcuugaacccaggagaugaaggcugcagugagccaagacccuaccacugcacucuagccuacaccauauagugaaaccucuucucuacaaagaaaauuugaaaaauuagccgggcgcaguggugagcuccuguuguuccagcuucugaggaagcugaggugggaggaucacuugaaccugggagcuugagacugcagugaaccccaagcugucucaccccagauagccaggacuacagguguacaccaccaugccuaguuaauuuuuaaauuuuuuguagagaaagggucgcgcuauauugcccaagguggucuugaacuccaccuaccuggaccucccaaggcacugggauuacaggcaugagccaccaugcccagccuacuuugcacuuuuuuuuuuggggggggggcaaagucuggcucugucgcccaggcuggagugcaauggcacaaucuuggcucacugcaaccuccaccuccuggguucaaucgauucuccugccucagcuucccccuuccucagccuucccaguagcugggauaacaggcaugcgccaccacgccccacuaauuuuuguauuuuuaguagagauggggcuuccucauguuggccaggcuggucuugaacuccugaccucaggugauccucccacguuggccucccaaagugcugggauuacaggcaugagccacugugcccagccuacuuugcacauuguuuuuuuguuuguuuuuuuguuuuugagacggagucucgcacugucaugcaggcuggaaugcaguggcgugauucuccugccucagccucccaaguagcugggauuauaggcaccuaccaccaugcccggcuaauuuuuuuguauuuuuaguagagaugggguuucacuauguuggccaggcuggucuugaacuccugaccucgugauucauccgccucagccucccgaaguguugggauuacaggcgugagccacugcgcccggccacuuugcgcauuuugacuguugccuaauguucugucagaucacugugccaugacaucuguucuccugaggguggacguuuuggugauuuaaaaccguauagaugugguuuuaaauguuuuaaauguugcacccugugcugugcuccuucccagcagagaauugauucauuuuucagcauaucccccuuagccccuagcuaaguuucuuaaauuggacuugguaaaugugcuuugccugcccauggaagaugucuuucuguuuuaccguacuuguuuuugcaguauggguuuagggaguagcugccauuuaucccuucccaagagagcagaggcacuacuaugcucacggaaggugaggauccaccugggggcuugaugucuauugggguaguuguggaggucacccucagagaaggaggcccucuugacucugcgguggucaugguggugaugagaaagcugaggcguggguauaugagacaagugcccagagucugucauuagcaagugguacagccagccaugggggcuuuugagauguuugugagauaaaaccucaccccucaagaagccggaaucuccuugucguggguaaauaggcagguuugggccgggcgcgguggcucaugccuguaaucccagcacuuugggaggucaaggcagauggaucaccugaggucaggaaugcgagaccagccugaccaacauggugaaaccccauuucugcuaaaaaugcaagaaaauuagcugggugugguggugcacgccuguaaucccagcuacuggggaggcugaggcaggagaaucacuugaaccugagaggcagagguugcagugagccaagaucacaccacugcacucuagccugggugacagagcgagacuccgucuaaaaaaaaaaaaaagggcagguuugaaugguggggcauauuugucauguucucuguacaaugauagagggagaaguaaucgagcuagaccuugaccaauaugggacuaugagagacagaauggccuagaugggugacuaaagguguucaggggaugacagguaucccuuuuggacuaaggacugcugauggggcugaguagguaaggcuugaaggagagcagccuggggaggaugagacaagagguagggaaacugguaggggcaucacugcuguggucugacccagagugguggcccuggaggaguggaggguggcugucugagauggaggagaggugaaggaaucagaacuaguagguucauagggcacauggguuagaaaggaaaaauauuaaaacagugagguuuccaagauggaaaugguagcuuugauaguaaaauuagacaaguuggagggcuacuagcuagauuaggcacugagcuguaggugaaacugggaaugugaaccacugggaaagaaggaugggcucgagcagggugugugggaugaaagagagaggucagaaaagggagaauuaucauagagcagaguuuccaggcaagagaauccuaagugagagguggucaugggguauacaccuuggcuguggccaucucuggggccuuggugagaaagaugagccagcccaggagggggaaaggaauggguggguggcuggauagaggucccagguccuggaggcagacucaggggcaggcacagauaacugaguguguuugaugggaagcaguagagcauccaggggaugggguuggggguggcccugagccucaguagugaagagagagaccucuucuuuuuggcaaguuuuauaucagcauauauuuuucauuuuuucuuuuaaagauauauaaucaugugccacacagugauguuuccgucaaugacagaccagaccacaugaaggaugguggucccauauuuuuacuguaccuugucuguguuuagauacacaaauuccauuguguuacaguugccuauaguauucaguacugugauauugugaaauauauauuuggucuugucucauuucuuggcauacaacuucuaaaaucuuuggacuuuccagagugaugccuuuuuguaugcuggccagcagccccuagguagcuucaggaugggggcuggugacaggaaaggccaaggcaggcauaagaggguugggacuuucagccucaccucucaaccuccggagaggggagacaggcugaagauuaaguucaucaccaauggccagugauuuaaucagucaugccuacauaaugaagcuuccauaaaaauucugaaugacuggguuuggaaaacuucuggauaguugaacacauggaggcuccuaaagagugauguuccuggagagggccuggaagcucugcaccacuucccacaugucuggccccaugcaucucuucaucuguauccuuugcaauacccuuuauaacaaaccaguagacaugaguauuuuccugaguucugugagucgcucuaacaaauuaguugaacccaagaaggggaucuugggaacccaauuuauagccuauuggucagaagcacaggugaaacaaccugggagacucagcccucaaccugugggaucagacacugucuccagguaguguuagaguugaauuagagcagggguccgcaacccccaggccucagaccuguaucagucuguggcugguuaggaaccagguggcacaacaggaggugaguggagggugauccagcauuaccaccugagcuccaccuccugucagaucagagguggcaucagauucucauaggagcacaaacccuguugugaaccaugcaugugagggguccagauugugugcuccgaaagagaaucuagcuaaugccugauaaucugagguggaacaguuugaucccgaaaccauuccccgaccccguggaaaaauugucuuccaagaaaguggucccuagugccaaaaagauuggggacugcugaauuagaagacacccagcugguaucuguggcagaauugauugcuugcuuguuaauggggaaaaacccucacacauuuggucacagaagucuccuguguuuguuguugugguauaagaggagaggaaaaacaguguguuuuuuucauucagaacuacaguaacaugcuguacaaguauguagcuuaggagcaauuggcuguaccuuauggccuagauguguaguagucucuaccaccuagguuuguguagguguacccuuugauguucacacacugaggaaauugccuccagcgauauaagucucagaauguauccccaacauuaagugaugcaugacuggagguaauuggagaauaaacauauuuuggggagaggaaaguaggaugaagugagguggagaagacagauguucacaucuuguagcugacugugcugugccuacagagccugcagcuuggccaugccucacagugugggacuggccacucccugaccugaacagcuggcuauccacagucacuuuugguugcuccauggcaaaagugcauuugcaguagguucauuuuacugauuagguuuuagaggcuccaauucaaaucaguuugcgguuuuugaacguacugacucaauuauuagaagauaaucuuuaauuuaaaaggcaaugcagaugaauuuaaaugcaucagguucaaucacaguuacugugcuugacucucagaauuucaguaaaggaaaguaggcccuggaaaugccacccccuuggcacccaccucccagacuccuggcugugugucuccugaccacuacucaggucuugccauuuuuaugcauccauuacuaugaggaagaacccaauuuuguucauucaaugggagggaggaagagcucuugagaaccuggugugugcuuaugcuucauguucauuguuuuaccaauuuuagaauaccccaaugggguagguacuuuuaucucucuuuuuaaaauuggggagcucgaggcucaguuuggucauguuguaagucccuguggaguugggcuccaacccaggucagucuguuucccaaaacccuucuguuugacuuugccgcugaagaagauacaaugagaugaagagucuugggcaugauggcacacaggucaucaggaagaaggccaucaggaaguuggacuagaggugggaggggagaaggaauuaggggauuuggaaauagagggaaaacaggugagccugagggaggcacaggagcaaggggagcaacagagcuggccagucugugugugguggggcugaugccugccugcucaccccuguccccuguuuugccaacugucaggccacaguuguaagggaucuuguggcugucaggauggcagaggagcaggaguucacccagcucugcaaguugccugcacagcccucacacccacacugcgugaacaacaccuaccgcagcgcacagcacucccaggcucugcuccgagggcugcuggcucuccgggacagcggaauccucuucgauguugugcuggugguggagggcagacacaucgaggcccaucgcauccugcuggcugcguccugcgauuacuucaggugaguucacuagagcuguuuguaagaagaauaacaaagguaauccuggcucugcuaguaaagguacuggcggugacaguggcuggucuccugcucaccucagagccuccccuacuccuuguggcuaugacuuagucaacaagugugagagacagaagggggucuuagaguucauuuuucauucagugauccuguuucuugggcuuugccuccucuucucuucccucucuucucuuccuuuucuuuuccuuuucucucucuuuucuuuucucuuuucuuuccuccuuucucuccuccccucccuuaccauuccuccccuccgucaguaauuauugcuguguaugcaucaccuucuggcucacaccucucaucccucagguguuagccucuggcccucccagugagcucuguggccccucugggguuucuuauggccuccuucgugaccccaucccagcacuuggcacagugugaggaaccacuggcuuaucugucuuuuccacuggguuggaaucugucucuuaucccuagcaccugacaugguuuucacauauucaaacaauacccauggcuuaaaugaauaaauuuauguacacagauagcagaucaauacaccauuugcccuguugucugcacugcucugcacucaaggaggugggugucaccacccuuauuucacauagguggcaugagccugagaaggacugagggccacucgugguccccagcaagguugucaugggacuccaagccugagguguuccauucuagcucugauucuguucaaucauuuugucuucaaggcuuaguuguaguucucucucucucucuuucucuuuaucucucucuauuuuuuuaauuaggaacuaucaagcaaaauauguaugguuuaagugccuucugucuccaaaaggaguuuuggagaaugugacccagugguggcuuggugcagauguguccaggagcagcagaauucuuucaguucaccagggaaauucagcugaggccuuuaauaagcauuaagauaacauacaggacaguggguaggguagaggagcugagggcccccugcaggggacuuaggaccuguauaggagaggauggccagaggcuguggagccuaugggauccccugggcucacccucucagcccuucuugauuuagugucauaccacucuuucugaagaugacaguguaggcagccuuucgcuaaucugucaaaaaccuuauguggcuuuccacguccuccaggagcaauuucuagcccuuuccacagccccccuuggguaaaccucuuaugagagguguccugcucuccgggaugauuacaaugcaucacuaacacccccugcaucccuccacuuccauugggaaggggagcgggagaguggcaacauuauuggaagagcccagagucauuucacagggggguguguguguguauguauaaauaagaaauagaggccagucacgguggcucacaccuguaaucccagcacuuugggaggccaaggcagguggaucacuugaggccaggaguuugagacuagccuggccaacauggugaaacccugucucuacuaaaaaaaaaaaaaaaaauuagcuggguguaguggugggcgccuguaaucccagcuacuugggaggcugaggcaggagaguugcuugaacacaggaugcggagguugcagugagccgagauugugccacugcauuccagccugggugacagagcaagacccuguuucaaaaaaacaaaaaagaggcuggauguaguggcucacgccuguaauccuagaacuuugggaggccgaggcggguggaucaccugagauuaguaguucgagaccagccuggccaacauagugaaacuccgucucugcuaaaaauacaaaaacuagcggggcgugguggcacaugccuguaaucccaguuacuugggaggcugaggcaggagaaucacuugaacccaggaggcggagguugcagugagccuagaaagaggccaggcuugguggcucacuccuauaauuccagcacuucgggaggccaaggagggcggauaacuugaggucaggaguuggagaccagccugacccacauggcaauacccugucucuacuaaaaauacaaaauuagcugggcgugguagcacaugccuguaaucccagcuacucaggaggcugaagcaggagaauugcuugaacccgggaggcggagguugcagugagccgagauugcgccacugcauuccagccugggcaacaagaaugaaacuccgucucaaaaaaaaaaaaaaagaaaagaaauagaccauucccaaguguuagcauguuuauuauuuguuuuaguuacuugugaaauguuaaaaugauaaaggacuauuuuuuucccaguaugacugguaaauaugugugagaggcuuguaauauuugauaugggcaaggguagagagaagggcauuuaggggugggcuggcccauaguuuagggcccugcaguuguauguugggugucuaggugucauuccugugggacgaugcacccagugcugagacauggugcaggacagagccuuucuguguuauccaauggagcuacuugcaaacugggcaguguggugugucuacugauagggagugaaaaaccucaggaccugguggaagaugaucccaaccaugaagaucuggaaggaucuugcugcaccguggggacucagcaaagggcaaagggagagggaggcugaauuucuucuguuuacugcauugucugaauuauuuuacaaagaacauaaauuucuuuuuuuuuuuuuuuuuuugagacggaaucucacucugucacccaggcuggagugcaguggugugaucucggcucacugcaaccucugccuccggguucaagcaauucuccugccucagccucucgaguagcugggacuacaggugugcgccaccacgcccggcuaauuuuuuguauuuuuaguagagacaggguuucaccauguuggccaggcugaucucgaacuccugaccuugugauuugcccuccuuggccucccaaagugcugggaugacaggugugagccacaccacgcccagccuuuuguuuguuuguuuugagauggagucucgcccugucccccaggcugaagugcaguggggcaaucucggcucacugcaaccucugccucccggguucaagugauucuccugccucagccuccugaguagcugggauuacagacgugugccaccaaacccggcuaauuuuuguauuuuuaguagaggcgggguuuugccauguuggccaggcuggucuccaacuccugaccucaggugauccgccugccuuggccucccaaaguguucggauuacagacgugagccaccaugccuggccucuucucugccuuuucuguccuguggaaauuuuucuucuuuggcccaccugagaugccuccuccucuggagagcuuucccuaauugucccuugcuguuucccagguggaggaaucucaguuuuccugaagggcagagagcuguacugcccugcugcaggaagccuccugugcucuuucuguguacucuguacaugguuuaggaauuggauggccagacugcauuuucuuuuuuugacuuuuguuaauaacuuuucauugcacacuuacuuuggcuccccugacccuacacccaccuuguaugcuuuaaccuuguaugcuucugaggugguuucuccucuccuccuggacccuuauagucugaagagcccaaaggcucuguccuuuuuauacaaccuccaugggucaccucgucccucccuuaguuuucauuccaucugugaauuauaaaagacugcuuagcugaacucaaugucuguuacuuuaaaaguuuggauacaauugaugauuuuauuuuuaaaaaauuaauagcacuuuauccccaaaagagagagaaaguuguauuccccacaaaacacaaagcccagauguuuuccaggguaggugugccuuuuaugaaaagacuccaaugccauuuaaauuuuuucagagcaguuucagaaaaagaaaaaaaaauuuuuuuuaauuagcugggcaugguggcguggccuauagucccagcuacuugggaggcugaggagggaggauagcuugagcuugagagguugaggcugcagugagccaugaucaugccacugcacucucgcuuggaugacaaaguaagagaccucuuuucucguaaaaaaaaaaaaaaaaaggcugagcacaguggcucacaccuauaaucccagcguuuugcaaggccaaggugggcagauuguuugagcccaagaguucgagaccagccugggcaacgugacgaaaccccauguuuacaaaaaauacaaaaauuagagcuggucacaguggcucaugcauguaaucccagcacaaugggugcccaaggccggcagaucacuugaggccaggaguucaagaccaguguggccaacauggcaaaaacccaucucuacuaaaaauacaaaaauuagcugggcguaguggugcacaccuguaauucuagcuacucaggagggugaggcucaagaaucgcuugagccugggagguggagguuguagugagcugagaucgcgucacugcacuccagacuggaugagagagugagauucugccucaaaaagcaaaaaacaaacaaagcugggcacgguggcucaugccuguaauccuagcacuuugggaggcugaggcggguggaucaccugagguccagaguuggagaccagccuggccaacauggcgaaaccccgucucuacuaaaaauacaaaaauuaggucaucagcaaagccugaguccuguccucuugcucuccuccccggacagcaugagcuucaccacucgcucuaccuucuccaccaacuacuggucccugggcucuguccaggcucccagcuauggcgccuggcuggucagcagcguggccagcgucuaugcaggcaccgagggcucugguuccuggaucuucgugucccgcuccaccagcuuccagggcugcauggggucugggggccuggccgcggggauggcuggggaucuggcaggaaugggaagcauccagaaugagaaggagaccauacaaagccugaaugaccgccuggccuccuaccuggacagagcgaggagccuggagaccgagaaccggaagcuggagagcaaaauccagaagcacuuggagaagaagggacccagaucagagacuggaggcauuacuucaagaccaucgaggaccugagggcucagaucuuugcaaauacuguggacaacgcccguaucuuucuguagaucgacaaugcccgucuugcugcugaugacuuuagagucaaguaugagacagaacugcccaugcacuagucuguggagagcgacauacaugggcuucgcaaagugauugaugacaccaaugucccucagcuguagcuggagacagagaucgaagcucucaaggaggagcugcucuucaugaagaagaaccaugaagaggaaguaaaaggccuacaagaccagauugccagcucuggguugacuguggagguagaugcccccaaaucucaggaccuugccaagaucguggcagacauccaggcucaauaugaugagcuggcucggaagaaacgacaggagcuggacaaguacuggucucagcagauugaggagagcaccacaguggucaccaugcaguccacugagguuggaacugcugagaugacaaucacggaguugagacguacguccaguccuuggagaucaaccuggacuccuugagaaaucugaaggccagcuuguagaacagccucagggagguggaggccuucuaugcccuguagauggagcagcucaaugggauccugcugcaccuggagucagagguggcacaaauccgggcagagggacagugccaggccuaggaguaggacgcccuggugaacguuaaggucaagcuggaggcuaagaucaccaccuacugccgccugcuggaagauggcgaggacuucagucuuggugaugcccuggacagcagcaacuccaugcaaaccauccaaaagaccaccaccugccagauaauggauggcaaaguggugucugagaccaaugacaccaaaguucugagacauuaagccaccagaagcaggguauccuuuggggagcaggaggccaauaaaaaguucagaggucaaaaaaaaauacaaaaauuagccagguguuguggugcaugccuguaaucccagcuacuugggaggcugaggcagaaguaccgcuugaaccugggaggcggagguugcagugagccgagaucgcaccacugcacaccagccugggcgacagagugagacuccgucucaaaaaaaaaaagaaaaacaaacaaacaaaacaaaacauaaauuagccaggcaugccuguagucucagcuucuggggaggccgaggugggaggaucacuuaaaccuggggaggucaaggcuacagugagccaugaguugugagugugccacugcacuccagccugggugacacagcaagaccuugucucaaaaaaaaaaaauugguuucaugcuagggaaucugucuuacuaguuacaugccagggaaucauggcauuccaucaauucaugacaacccaacauaucugcauacgugucuauauagcauaucugcagacauggugagcaggcaugugauaacauucagcauccauucucacaguuaaaaaguuuuuugagcagggcgugguggcucaaaccuauagucucagcuacuugggagaauaggccggaggauugcuugagcccagaaguucuggguugcagugugccaugccaacaggguauccacacuaaauuuggcaucaauauggugaccuuccuggagcaggguugccuaaaaagaggugugaaccggcccaggauggaaauggaccaggucaaaacucccaugcuguugaguagugggaucaugucacugcacugcagccuggacaccauagcaaggguccaucucucaaaaacaaacaaaaaccaaaaaacuuuuggggcugggcaggguggcucacaccuauaacccuagcaccuugggagacuggggugggcagaucaguucaguccuggaguuugagauuagccuaggcaacauggcaaaacccuaucucuacaaaaaauacaaauauuagcugggcacaguggcacacaccuguaguccccacuacuugggaggcugaggugagaggauugcuugagccuggagguugaagcugcagugagccgagccaagccaagauggucccacuacaguccagcuugcgcgacagagcaagacuccguuuacaaaagaaaaaaaaauuuuuuuuuaauuuuuuuuuauuuugagauggagucucucucugucgcccgggcgggagugcaguggcaugaucccugcucacugcaaccuccgccuaccagguucaagugauucucccaccucagcuuccugaguagcugugaguacaggugcaugccaccacacccggcuaauuuuuguauuuuuugaaagagacaggguuucaccaugucggccaggcuggucuugaacuccugaccacaggugauccacccaccuuggccucccaaagugcugggauuauaggcgugagccaccgugcccggccuauuuuuaucuauuauuauuuuuuagacuaguuaagugcaguagugagaaggggggacagagacgaaugaguuugaucuguuacugacuaugaacaaucaacugaaauaacucagcuaacuuuggcccagccaaacgucuuaaagaaauguuuggcguaggccgggcgcgguggccaacgcguguaaucccaguacuuugggaggccgaggcaggcggaucacgaggucaggagaucgagaccauccuggcuaacauggugaaaccccgucucuacuaaaaauacaaaaaauuagccgggcaugguggcgggugccuguagucccagcuacucgggagguugaggcaggagaauggcgugaacccaggaggcggagcucgcagugagccgagaucgcgccacugcauuccagccugggcgacagagcaagacuccgucucaaaaaaaaaaaaaaaaaaaaaaguuuggcguaaacucauuaagccacggaacccacccaaaacucaaaauuauuuucgaggcuaauuauauuuuuuauccuagugugagucuuuauacuuuuuuggggggcauauuaagguguuugaagaggaggcaccgacccagaucccgugggauauaagauccuauguggcauguguacaguauuucucacguuggaaccuucugaauucuaaaauacacuugauuuaaagaguuuggacaagggaucgaggaccugaacaagcugacccaagaaauauuuuucucccccaucucacaccagaggcagcauacugguuugccauucuguaccugugacauccuggaggucccaggcaccagcaguagagauggcccucacucucugugcuguggaguguuccgugcugucgauguccucuauuuauuuggucauuccccugcuacuggguacuuggugaacaauuuuuuaaaauugugguucuaaaauaauaaacacaaauaacacuuaccaucuaguucaguaauauuacgauuauucacauuauuacgaaacagaucuccagaacuuuuuuaucuuacaaaucugaaacucuauacccacuaaaccacaacucccuuuucuccuuuacccccaggcccuggcagcuaccauucuacuuucugucucuaugaauuaaacuauucuaaguaccucauaaguagaaucauacagcauuagcccuuuaucacuugcuuauuucauuuggcaucguguccuuaagguucauguguguuauaacaugugaccugauuuccuucauuuugaaggcugaauagugugccauuuuauggauauaccacauuuuguuugucuauucaccuaucaagggauacuugguuugcuuccaucucuugucuauuguguauaaugcugcuaugaacaugggugugcaaaugucugagacucugcuuucaguucuuuggcuauauucccagaaguggaauugcuagaucauucuauugacaauuuucugaggaacauagcaguugcaccacuuuucauucccaccaacagugcacaaggguuauaguuucuccacauccuugcuaaagcuuguuauuuucugguuuuuuguuuguuuuguuuuuugagacaggauuuugcucugucaccuaggcuggaguucaggggcaccaucauggcuccaccuccugggcucaagcaaugcuucugccucagccucccaaguagcugggacuauaggcaugcaccaccaugccuggccaguuuuuuaaaaaaauuauuuguagagacagaaucuuacuauguuucccaggcuggucucaaacuccugggcucaagcaauccucccaccucagccucccaaagugcugggauuauggacaugagauuauagaugugaaccaccauauccggccuacuuuuuguuuguuuguuuuguuguuuuuuuauaguggucauccuaauggauaugaggugugaacaacuuuuuaaaacuuuuaagucuuuauuuugacauaauuccugacuuacagaaaaguaguaauaauuuuuuuuuaauauauuuuuuuaaaaauuggccaggcaugauggugcaugccuauagucccaacuacuugggagguugaggcagaagcaucacuugagcccaggagguugaggcugccgugagccaaaaaugaauuuuuuuuuuuugagacagaaucucacucugucgcccaggcuggagugcaguggcaucaucucggcucacugcaaccuccaccucccagguucaagcaauucuuguuccucagccucccaaguagcuggaauuacaggcgccugccaccacacccagcuaauuuuuguauuuuuacuagagacgggguuucaccauguuggccaaguuggucucgaacuccugaccucaggugauccgcccaccucggccucccaaagugcugggauacaggcaugagccaccgcgcccagccccaaaaaugaauguuuaaagaauuaaguuugggaggcugggcaugguggcucacgccuguaaucccagcacuuugggaggccgaggcgggaggaucacgaggucaggagaucgagaccauccuggcuaacacugugaaaccccgucucuacuaaaaauacaaaaaauuagcuaggcgugguggcgggcgccuauagucccagcuacucgggaggcugagacaggagaaaggcgugaaccugggaggcggagcuugcagugaaccgagaucaugccacugcacuccagccugggugacaaagcaagacuccaucucaaaaaaaaaaaaaaaaaaaaaaaagaauuaaguuuggggcgggcuugguggcucaaucccagcacuuugggaggcugaagaggguggaucaccugaggucgggaguucaagaccagccuggccaacauggagaaaccccaucucuucuaaaaauacaaaauuagccgggugugguggcgcaugccuguaaucccagcuacucgggagacugagguaggauaauugcuugaaccugggagcuggagguuguggugagccgagauugcgccauugcacuccagccugggcaacaagagugaaacucugccucagaaaaaaaaaaaaaaauuaaauuugguaaaauuuuuggugaaaaagaaaaacaauaaaaaggagugacuauauauuuuauuuuucuuuugggcucuuuuuucucucugauuuuuauuuugaaauauuuaaauccuacagaaaaguugaaaguuaaguauagugaacaacugugcucuuggcuuaaauucaucaguuaacauuuugcauauucacuucagaguaaguuauagauaucaugacaauuuaucucuaacaacuucaguucgccucucuaaggaugaggagauucuuugacauaccuguaauacuaucaugauauaagaaaauuuaugauugagccauguuccauggcgagugcuuuuagucccagcuauuugggaggcugaggugggaggaucacuugagcacaggaguuuaaguccaacuugagcaacguagcaacccugucucuaaaaacauaaaaaugaaaaagaaauguguaaucauucuauaauuucaucugacauugaguccacguucagauuuuccuaauugcacccacaaugucucauaucuucuuucuccucccuccauucaugauccaugcagugaacuuuuuuguguuguuuuguuuuuuaagagacagagucucacuuuuuugcccaggcugggcaauggugucaucauagcucacugcagccucaaaauacugggcucaagcaacacucccaccucagcauuucaaauugauggaauuauggaugcgugccaccaugcccagcuaauuuuuuuuaagagauggggucuuucuguguugccccaucuggucuuuuuuuuucccuucuuuuucuuuuucuuuugaggcacaguguugcucugucacagaguaguggugcgauaucagcucacugcaaccuccgccucccagguucaagugauucucaugccucaaccacccaaguagcugagauuacaggugugcaccaccaugcagcuaauuuuuguacuuuuaguagagaugagguuucaccauguuggccagacuggucucgaacucuuggccucaagugaucugcccaccucggccucccaaagugcugggauuacaggugugagccauggugccuggcugcccagucuaaucuuaaaguccuggccucaagcagucuuccugccuuggcccccgaaaggauuauaagauuuuuuuuuuucuuaaaaugguaaaaguuuguguccggccagacgugguggcucacaccuguaauccagcacuaugggaggccgagguggguggaucacaucaggucaggaguucgagaccagucugaccaacauggugaaacccugucucuacuaaaaauacaaaauagccaggcgugguggcacaugccuauaauuccagcuacuugggaggcugaggcaggagaaucgcuugaacgugguaggcggagguugcagugagccgagauugcgccauugcacuccagccugggcaacaagagcgagacucugucacaaaaaaaaaaaaaggccgggcgugguggcucacgccuguaauaccagcacuuugggaggccgaggcgggcggaucaugaggucaggagaucgagaccauccuggcuaacauggugaaaccccgucucuacuaaaaauacaaaaaauuagccgggcgacguggcgggcaccuguagucccagcuacucgggaggcugaggcaggagaauggugugaaccccggggggcggaaccugcagugagccgagaucgcgccacugcacuccagccugggcaacagcaagacuucgucucaaaaaaaaaaaaaaaaaaaaaaaaaaaucugugucaauccaagcacccacacccugcucagggcgggcagugcuugaaauguugccaucuccacugcugccaauauagucccagaggugccagcagaagaaucagacagaaguacaugcacgagcacaguccuggaaaguccaggagagccagacagaccacuguaaagagcaugggaaagugccccgagggcuuggccaugcauggagugaaaugucugggaauaaauguaacaaauaugugccagaucuguaggaagaugacuuauaagacuuccaaauggacccagaggauggcuggacaguuaaaaagauccacuguguccauuauaaaaaugcuauuuaucucuacauuaaccuagauguuuaacauaacccccuaaaauaccaagaggguuuauuuggggcaauuacagaaacuugauucuaaaauucaaauguaaaaagcuagcaguggccaggaaauugucgaaaacaaaaguaacgaaaggagacuauuccuguccuaugugauaaagauagccucaaaaauuagaggaaggggcugggugcggugacucacgccuguaaucccagcacuuugggagcccaaggcaggcggauuacaaggucaggaguucaagaccagccuggccaacauagugauaaccccaucucuacugaaaauacaaaauuagccggguguggugguacaugccuguaaucccagccacucgggaggcugggaggcaggagaaucuccugaacccgggaaguggagguuguggugagccgagaucgcgcugcugcacuccagcuugggcaacagagugagacuucgucuuaaaaaaaaaaaaaaauuagaggaaggagggaagacgacagaguugccaucuagaaaaacaaaguuggacccuugcuucauaccuuauaccaaaauaaauuacagguggaucaacaguuuuaaaugugaaagauucaauaauaaaaacacuagaggaaaauaucggaaauguuuucugaauaaucucagaaagaaaaagccuuucuaaguuugacacaaaacucagaggcaaguaaaugguaaauuugacaacauugaaaacgaagauagguugguccgaagguagugugaguuaccucaguugauuguucacagucacagauccaacuccagguucuacuuuuucaccuucucacuacugcaguugacuagacuuguuuaaaaaaaaaaaaaaaaaagacaaauuucugcauggcaaaaaagcaauacaaaaucaaaagaucggggaaacuccucaucaaagaaagggcagauuucuucaaauugauaagacagucuaacagaaaacugacuaagaaucugaacuguucagaaaagaaaauggaaauggcucuuuaacauauaaggagauuuucuguaccuuaugugauaagguuuuucccuuuugugguggugaguuagagcuggugucuuccuggguuggggguagagggugcaggcaccaggcccugcuaucaggaaugauauaaaaacagcaacuugacaauacuaucaaaguauaaauguauguaaacccuucgacccagcaacuguauuugugggacuuaauccuggcauaugcauacucagcauguuguaagggugaggauguucaucaugugaaauaacuggaaauuacaaguaaccuaaauauaccccuguagaaauggguuaaagaagugagacagcuggcugggcgcgguggcucaugccuguaaucccagcacugugggaggcugaggcggguggaucaccugaggucaggaguuugagaccagccuggccaacguggugaaaccccaucucuacuaaaaauacaaaaauuagccgggcaugguggcgcaggacuguaaucccagcuacccgggaggcugaguuuggagaauugcuugaacccgggaggcggagguugcagugagccgagauugcaccauugcucuccagccugggcgacaagagcgaaacuccaucuuaaaaaaauaaaauaaaauaaaaaaagugagacagccuuugcaaagagugaggcagucuugcguacaugggcauggaucagucuccaagcuauauuguuaaguaaaaaccgggcugggugcaguggcucacgccuguaaucccagcccuuugggaggccgaggcaggcagaucacgaggucaggagaucaagaccauucuggcuaacacggugaaacccggucucuacuaaaaauacaaaaaauuagcugggcgugguggggggcaccuguagucccagcuacuugggaggccaaggcaggagaaucaguugaacucaggaggcggagguugcacugagccaagaucgcaccacugcacuccagcccaggcaacagagugagacuucgucucaaaaaaaagaaaaaagccaagugagauguggaauaugacugcccugaggauaguguggcccugggaggggaacugacugauggucugggagcagaggcaaggggacuuucaccacaaccuauacuguauuuuuuuugugugugugacagaguuucacucuuguugcccaggcuggagugcaauggcacgaucuuggcccacugcaaccuccgccucuuggguucaagcaauucuccugccucagccuccugaguagcugggauuacaggcaugugccaccaugaccagcuaauuuuguauuuuugguagagaugggguuucuccauguuggucaggcuggugucgaacucccaaccucagaugaucggccugccucggccucccaaaguccugggauuacaggcgugagccacugugcccggccuaaccuauacuguauuuuaaaucugguagcauguauauguauuaccuagucaaaaaaauaaauaaaauguaaaaauagcuucucuuauaaucuucauguugcugucauauuuaaacuucagccccaguugccagccucuuaccuccaaacaccuaaucagugucuacacuuggagguuucacagguaucucacacugaucacacaaucacgggacucccagcuguccagauuuucuuccaucaguaaaggguccucuucggcccagcagagggccuugaguccucccagguccuccuagauucagucugucaguagguucucugugccgugucccaggguagucucagcuacugcuuucuagcugcaaugcccuccccagggccagggucacccuuggccuccaggcccacaggaaucucaggccuaauuggucuuccaggggcuccuccuccagcaccugagucggaaagccagucaguucacaucacucuguggguaaauuccucaagagcaucccauaaugcucagauuucaaucuggacuguaccuacccuagagguagggggaccuggcuccaaggccugccugcccaucccacuuucugcucacuucgucaucaucuuggcugccuugcaugccaagcucugccuugccccagaacuuguacaccugucuccuucaccuggaacucccuccccggcugccuacacccucucagccuuauccuuaggucucaguuccucagauggggcuuucccugcuccuucucaucauuccaccuaccccucuucuaaccagugacucucaggucagaugcccugcuggguuccuucuuagcauuuauuuauauauguauauauguuuuuugagacagagucuugcugugucacccaggcuggaucgcaguggugugaucucggcucacugcaaccuccgccucccggguucaagcgauucuccugccucagccuccugaguagcugggaugauaggcgcccgccaccacacccagcuaauuuuuguauuuuuaguagagacgggguuucaccauguuggccaggcuggucuugaacuccugaccucaggugaucugcccgccuugcccucccaaagugcugagauuauaggcgugagccaccacgcccggccaauuuuuguaauuuuuguagagacaggauuucaccguguugccuaggcuggucuugaacuccuaggcucaagggaucugccugccuuggccucccagaggguugggauuagaggcgugagccaccgcgcccagcuauuuuaccaguuuacuucacuauaacuccuuuugcucuuuguuuuuuguuuuguuuugcuuuuugagacagucuugcuuuguugcccaggcuggagugcaguggugcaaucuuggcucauggcacccuccgucucccagguucaaucaauucuugugccgcagccaccaaaguagcugggacuacagaugcacaacaucaugcccggcuaauauuuguauuuuuaguagagacgcgguuucaccaugugggccaggcuggucucgaauuccugaccugaagugauuugccugccuuggccucccaaagugcugggauuacaggugugagucaccgugccuggccuccuucugcucuuugaaugauacuuggcauuugguaggaacuccauaaauauacauugaaugaaaugacuuuuauuaguuucccauuaauuaauucauugcuuugaaaugugcucuggaguugcuacugcuccgauccaggaacugcacugaugaacacagcagaagcaagcugcuuguggccucaccucccgaagcucacaugggacuccuugggcccaugaaaagggaaacaggacaauuuccaggauggcugcccagacuucgucaggauccuuuugugggauggcucaugcaugcacacaguucacucagagcacagagugggucagcccacuaccagggcccugccaccagcgccagguucuucucugaaugcugucacucuuggcaacaugggcuuaagucccuguugguauaacuccauuuucuugugucuucacuuugcagaggaauguuugcugggggauugaaggagauggaacaggaagagguccugauccacgguguguccuacaaugcuaugugccaaauccuacauuucauauacaccuccgagcuggagcucagccugagcaauguacaagagacacugguggcugccugccagcuucaggugaggcaugucucaucuagcaaggcagacccacacccaggugggguucccugagaugcccaugaugccugccgggcacuagcauuggcuugaagaugggucaggaaugugaggagaccaagcagugacgaaggccaugaaguggggaagacucuggaguuguuccuggagcucaagcagagccgcucuagacaccccaggccucugccuuugcccucuucucuauugcugguuguuuccccacugucugagucucccugucauugaaagcauccugcacauaagcagguaggcugacccgaggcugcauguggacguccugugugcucuggggucuggcaauggggagcauccaccagcauugcugccagggcccuuccugccuguccccucacugggccacuucagucucuugaaaacuuauguguuuuguuacugaacuuuaucuaucuauuugucuguccauccauccauccauccaugcaugcacgcauccauccauccauccaugcaugcaugcauccauccauccauccauccauccauccauccauccauccaucuauccauccauccaugcaugcauccauccaugguggcaggcauccauccauccauccauccauccaugcaugcauccauccauccauccauccauccauccauccacccauccauccauccacucauucaauuuauuggagacaagcucucucucucuugcccaggcuggagugcaguggcacgaucacagcucacugcagccucaaccuccugggcuccagcaauccuucugccucagccucccaaauagcuaggaccuauaggcaugugccacuacaccuggcuaauuuuuaaauuauuuuuauagagauagaggcuugcuuuguugcuuaggcuagucuugaaccccuggccucaagugauccaccucagccuuccaaaguguugcgauuacaggugugagccacugcgccuggccuauuuuuuuuuuuuuuuuaaagacagggucucacucuguuacccaggcuguaaugcaauggcaugaucauaguucacuguagccuccaccuccuaggcucaagugguccucccgccucagccuucugaguagcugggacuaaagaugcgugccauugugccuagcugauauuauauauauauauauuuuuuuauaggaauggggccuuguuauguugcccaggcuggucucaagcuccuggccucaggugauacucccaccuuggcuucccaaaguucugggauuacaggugugagccucuguacccaaccuguuauugaacuuuaaguacuuguuuuccugcagaauucaaaaaguuuucugaggcuuugacagugugacuuauguuuuggaugauuauucucaguggugugggugcaguuacacgggacugggccugcaggugccuuugagcuaucaggcagaggccugauaggaguugacagucaccucuucccacauuucuuaaaagugaaacaaaaugcuaugcuaaguucaucauucugaccuuucuucccaugagagcagguuugacgcaauuaaaaaaaaacaacucaagucacaggaaaaccaaccuguucgggggcauguggaggugccaccccaugugacagggcccuggcagccucccugugcccuguucucagauugguggauaggaccuggaugcuggguggguugaucugagaugacugacuugucucaccauaccugcauggugaguagauggaguuggcuuuuacaacaaaagaauuucccccuguucuuuuauuuagagaucucuucuguccccacaucccugucauuguugcuuugggaacccucauccaauucuccacccuggcagcaguuaacuccugauucagcugccucugaaacaucucccccagcauggcucagguccagcuguccuaucuccuccuccacaccugccacucucccggagcuccccugucagucccccugcucuguguguccugugaccauccugccaguucccugggcucaaccucaguggcuccuugagcccguccaccuucuuaauucccugcguccaugugaggacaggucauccuucucgguauugcuuguagccaucucuguucuguguuuccauuuccuucccuuuugccuggccuccaucuguauguuucugccauuucuuucuucucccugcagugaucacacacacugaaaccagaucaucuuucuaacaucacuuucccucucucaccagucagcuuggaggccugcagucucucucuguugguuuggccagugcucccgacagcccugggucaucucccccagugccucagaggucaucucagaggcagcagccuaucuuaguuuuuuaacauaucaggcuucugggccaggcuuggagguucaugccuguaaucccagcacuuuuggaggccaaggugagaggauugcuugaggccaggaguuugagaucagccugggcaacaaagcgagaccucuacagaagcacuuuaaaaauagccgggcaugguggcaugcaccuguaguuccagcuacucgggaggcugaggugggagaaucacuugagcccaggagguggaggcuucaguaagcugugaucaccacaccacuacaugccagcuuaucucaaaacaaaaaacaaacaaacaaaaaaaaacaggcuucuucacaauauuguuuuauagcagguuuuacuuggcauaaccaugucaaguccauaggccuguagaaucauguauguucacauagcuagugacuuuuggaggcuucccccauguguugugcccugcaguaggccugggaccagauucuucacgguguccccagaggccugagucugauucccaguaacacuguccuauuggguuaccccaagcaaaugcagucccuucugugagccucguauggggcuuuugcacauccugagcccaggcugguuccucugugagauuucacugaacagaaggcccacugcucuaaaaauaggacugaaaggagagucagcaggguccucucaaggagcugcugcugcccaggcuucuucagggcuguuugugcucacauucugcccaaaacuuggucuucaggacccuggcccaugacaaaccagaauuuuaggaaaaccuaguaguuugggaagaaguggcaaagcagaagacuggcaaaaagggaaaaaagaaggucaagugaagcuggucagggccuagcaaagcaccauggggauaccucauguagggcacauaccugccugacauuugguaggucucauccagcucuuagcaugucaccuugcaagcaauauuagaugucuuuugaauuuuaaaaaaguuauaguuaguguuuauugauaagcuuuaaauaccuuggccgggcgccguggcucacgccuguaaucccagcacuuugggaggccuaggcgggcagaucacgaggucaggagaucgagaccauccuggcuaacacgaugaaaccccgucucuacuaaaaauacaaaaaauuagccgggcgugguggcgggcgucuguugucccagcuacuugggaggcugaggugggagaauggcgugaacccgggaggcggagcuugcagugagccgagaucgugccacugcacuccagccugggcaacagagugagaccccaucucaaaauaauaaauaaauaaauacauaaauaccagcagaauuauuccauguguaaugguuaauuuauugaugauccuggauaagccagguauucccauuuuuagagaaacugauuuauugcauugaacacauggcuggaguugguagcaaggggguucccacaagaggggaccccacagcauccugaaauggagccguuuugggauuccaaagaaagaagcaucaaacaccagggugaucuggccagagcguuuauuaggggaacuuauguauagagugauguagcauguccucaagacagacaagggaaaagagaggcuuuacccaggcuugcccacagaguggguuaguguauggaguuucuaugaggguuuaaggaauuugucucagggccagaaccaguuuuuccuucaguguuuuggguaacaaccuugaugccuuuaucagugccugggaauguucaagggccugguuuggguucaagccugcugggagaaccugcagcugucugggucacagagaggucaagguacucgucauuuucaaucugaacauggaaagaaaggaggugggcacuggggggccccacugaaacucuaaaauccugcuuuccuaaauaauuuaucaacaccugguuuguucucccaggcaguuuucccuagggcccuucccuuugucuccuauucucccaagauuugguugucuguucacaggguggccuuuaacagccugcugguuguggccuuguucccaccucccuccagugucauucucucucuugccguccuuucaaaccacuagugcuuccccauggcugggaaggguugauauggccaccugggagccccugcacuuacuggagucaagugggucuugacccagcugggaaccucaagaacccugagucagggaucacuugagcccagaagcuugagacuucggugagcuaugaucuugccauggcacugcagccugggcaacagagcaagacccugucucaaauuuuaaaaagaaaaaagaaaaauaauucuaaaucagguuccuggguggguauugguuaggugucugagaggcucugagcacuucuagggaaccaggguggauguucuggcgggggaaaaagccagguuuguuucuggucccagcgcuuuuggagaggcaggcucuuccagagaauccuaggguagggauggggauggucuuagguccuuuccaaaccacagauauaugacacagugaccauuugugcugcuuccugcuuuucuggagagccaguacuucuuuuuuuuuuuuuuuuuuuuuuuuuagacggagucucgcucugucacccagguuggagugcaauggcgcgaucucggcucacugcaaccuccgccuccuggguuccagcgauucuccugccucagccuccugaguagcugggauuacaggcgcgcgccaccacgcccagcuaauuuuuguauuucuaguagagacgguguuucaccauguuggucaggcuggucucaaacuccugaccucgugauacacccaccuuguccucccaaagugcugggauuauaggcaugagccaccgcacccggccgagccaguacuuuugaucuaagagggaacugacauauaucaaggguccacuccuaugugcucucucauuuucaucauguuccucuucacuuuaaugauccccguuuuauagaugaggagacugaggcuuagagagguuaaaaacauucuguacgggaggcugaggcaggagaaucauuucaacccgggagggggagguguuagugagccgagauucugccacugcacuccauucugggcaacaagagcgaaacuuugucucaaagaaaagcaaaacaaaaccaaaaaaaaacaugcuguauauccugucacccaguauguuuccaaaccaggacuuaaaccuagucugcaguaagccccagucuccagugugucagaaaaggucggggacaauuaaggaggacuucccuucugcuuugccuggcccacaacagcccguauuucugccaucauucucucucccacccccagaugcuguucaccagcccaggcuugaaugggugucauucucucugcagaucccagaaauuauccauuucugcugugauuuccucauguccuggguggacgaagagaacauucucgaugucuaccggcuggcagagcuguuugacuugagccgccugacugagcaacuggacaccuauauccucaaaaacuuuguggccuucucucggacugacaaguaccgccagcuuccauuggagaaggucuacucccuccucagcagcaaucgccuggaggucuccugcgagaccgagguauaugagggggcccuucucuaccauuauagccuggagcaggugcaggcugaccagaucucgcugcacgagcccccaaagcuccuugagacagugcgguuuccgcugauggaagcugagguccugcagcggcugcaugacaagcuggaccccagcccuuugagggacacaguggccagcgcccucauguaccaccggaacgagagccuacagcccagccugcagagcccgcaaacggagcugcggucggacuuccagugcguugugggcuucgggggcauucacuccacgccguccacuguccucagcgaccaggccaaguaucuaaaccccuuacugggagaguggaagcacuucacugccucccuggccccccgcauguccaaccagggcaucgcggugcucaacaacuucguauacuugauuggaggggacaacaauguccaaggauuucgagcagagucccgaugcuggagguaggacagggugcuagcuggucccuuugucuucaggugaugagaggguguggaagucaugggcugagagagcuggucagguuccccccagccuuucacaugagcaucacuugccauuguggaaugaagucuaggugaauucagagaagguggacagcagugagauaagagaaggggacauguggaucgccuucuuuccugcauguccccuacuccucagaaacccacuuacccuggacccuugcucagccucuuugggguaggcuagguugcgagugcauugugcaggaggagacgggaggggagaggagcccacagcaggaaaggcagucggacugggauggagaggaccuaggagcagugccagcugagcagccucgcccuccaucaugcucucucugagcuuugaugcauguuguuucaguuucccuucaccagucagcuuugcucuucucucuuaccugcuugcuaaugguggaacaggcuuccugcugcugugccugagcagcaugcggucuucagcccaggggcgugguaaaggccaacaagcaucaccgagccucaugcuacauuuccgcucugcccugcagucugccacgcacuuggcacaauuuccccugggaagaggcaguuuucccaagagagaguuuuguggacugcugugguccguaggaugcgccuggcuccaucagucacuuaggcugugaucucacaaauccauuucugggcagagcaagggacagugguucaggcccacaagacucagcuaccauuagauuuccagggaccccuccaccuuaccuuggugcaugugagaaaucucccuacccuucaugcugaaagauggagcuguguuggagagagagagauugccaacuauuuccagcagccaugagcuagaugcugacugaguucauguucauguuucuauuuucuggggucagggugggguagggccuggccuggccaugccacuuggaaucaagcauagugauccuggccaaggaggagaaggccauuucucagcgaccucucuacugcuggccccaggaagugaucuccuuuguuaagcugaugagacucagagguuggcaauaacacauugugguuaaauaugaggaagggcagguuucagaaaaaaggaaacagcuaccuucauuuccucucuaaacaaaguugugcccccaguggguguggccacacuagguuuagacuucccuuuggccaaaccuuaaaccuucuuuuuuagggggcucgguuucccaguuggggggccaaggccagaccacccugcugagaguaaccuacagaccugcaaagccaaucucuccagaguguuuuggcuucuggcccuuagcagaagguagagacagcugugugcuuggcaguaaugcuggauguuuccacagagcugucccuaggggggugacagcuugggauucugccugccccuguccucuguccaccugcuaugggccauugaucucacuuucacuuaaaguaggagucugaauuuccccuugugaaggggugugagaccaaagcugaacucuggguaaugcuaauauuagacccuguaaccaauaaccagucccaaacuccugucugagaguaggaucacaauggcaaguggggucggcaagaccugccuugagagaguagguauccacagaguggagguggcaggaaggaccacagcccuacugguuaacccagggauguaucaucucuccagaaugaaggcaucauuaaccuuccaguggacucaaaacuuccagaugaauccuuaauuugaauauucuaagauuugguucuuucucugcuuucucauuucaucagccuuagaacuggugaauucuaaaagcuauaggcuuuuagaauauaaggaaacaagauuuugcaguaaauuaggcuuugcauuuugaggaguuauuacuuaccagguuauaucuuaaagcauuggugcagaaaccgcauauuuaaaaaccuuuccucucuuggagcaaaugguguuugucuccaauauacuacuuuuucucuuucauuccuucuuucuuugcaucuauauuaucugcaucauuccuuguaccuuucccauagccauagcccuguggauuacugaacaccaacuacaugguauaccuaguaguagcugguuacauguugcuaugugcccugacccuacuuaaaauaauaauuuaggcuaugugcagaucaugucaauaaucccagcacuuugggaugcugaggcagcaggaucuuuugagcccaggaguucaagaucagccugggcaacaaagcgagaccucgucucuaccaaaaaaaaaaaaaaaaaauuagcugggccugaugguacgugcuugcagcccuggcuacuuggaaggcugaggcaggaggaucgcuugaguccaggaguuuuagacuucggugaacuaugaucaugccccuguacuguagccugggcaacagagugagacccugucucuaaaaaaaauuuuuuaaauaauaauguaauuuuuccuucggcauuucauggcugcuaauauuuuaaaguaaauuuaauuuuuuuuuuuuuuuuuuugagacagagucucguucugucgcccaggcuggagugcaguggcacgaucucggcucacugcaaccucugccucccggguucaagccauucuccugccucagccuccugaauagcugggauuacaggcgccgaccaccacgcccagcuaauuuuuuuguuuuuuuguuuuuuuguuuugagauggagucucgcuguuuucugcccaggcuggagugcaauggugcaaucuuggcucaccacaaccuccgccucugagguucaagcaauucuccugccucagccucccgaguggcugagauuaccgguguacgccaccaugccuggcuaauuuuguauuuuuaguagagauaggguuucaccauguuggccaagcuggucuugaacuccugaccucaggugaucugcccaccugggccucccaaagugcugggauuacaggugugagccaccacgcccggccauuuuuuuguauuuuuaguagagauggaguuucaccauguugaccaaguuggucuugaacuccugacuucaggugauccgccugccucagccucccaaagugcugggauuacaggcaugagccacccaccgugcccggucaguacauuuaauuuauuuaaaaaauuuaauagacauuaaaacauuaauagucaugaaaauacuuaagucauggaaauauagaagaaaaacagucuacugaauuuuuuuuuuuuuuuuuuuuuuuuugaguuggagucucucugucacccaggcuggagugcaguggcgugaucucagcucacugcaagcuccaccuccuggguucacaccauucuccugccucagccucccgaguaggugggacuacaagcgcccaccaccacgccuggcuaauuuuuuguauuuuuaguagagacgggguuucaccguguuagccaggauggucuugaucuccugaccucaugauccucccgccuuagccucccaaagugcugggauuacaggcgugagccaccgugccuggccacagucuaaugaauuuaacaagaauuccagaauauuuuuguaccaacucuaggguucaugucugaguuuacaauaggaugauacaaaucugaguuaaagugacucuccuagucaguuucagcugcuauaacaaauacuauagauggagugacuuaaacaacauaccucuauuucucacugucuggauacugggaaguccaagaucaugguauuggccaguuuagucccgguaagguccuuuccgucuguguucucacaugguggagagaaagagcuguagccucgggcacuaagcccaucauggggcuccacccucaugaccugaucaccucccaaaggccaugccucccacuaccaucacaauggggguuaggccuucaacauagggguuuugggggaauccaaacaucuaguccauagcaauaaguaaaauuguuuauaucuuuauaugcaaaaauaaagcuuauuuuuauuagaaaaauauuacuugaggacuuauucucauaaaguagaaaauuaauucaauaaagaagaagagggauacaggacacaacagggaaauaagaaaucaguguaacuuuggcuaugucuaaauuauugacauaugguaucacuguuggugucuuuuuuuuuuuuuuuuuuuuuuuuuuuuuuuuuuuuugggggauggaguuucacucugucgcccaggcuggagugcaauggcaugaucucagcucacugcaacuucugccucccggguucaagugauucuccugccucagccucccgaguagcuggaacuacagccacacaccaccaugccuggcuaauuuuuuuauauuuuuaguggagacgggguuucaccauauuggacagucuggucuugaacuccugaccucgugauccacccgccucagccucccaaaguucugggauuacaggcgugagccaccacgcccggcccugugugugucuuuaaauuugaagccacaaauccacaugaacucagcuuaaaaagcugugaggacaauagacucgaaggagcaaacaggagcacauggaggguccuaucucacucugguugcagacacuuggggugcagauggugauugagccagacugaacacaagagaggagagacuuguauauaaaggaggaaggcgcacaggaaaggcagugaacagcaccaucccagccaguugacggggccccugugagugcugugccccaauccuggacugcugguccccugccagaccuucuucuggcuugugccccaggucaugcaggucucagacccugccuucucaggaggccuuuccugaucacugcaagggagcucugcccuccccaggccccgcugaccagcaggucacucaucuucuuaccucccuuucuuucuuucacagugucugucauuauauuaagcacucauuugcucugguuagccuguuuccauucugcaggggaaggcagggcccugaccucuugaggcucccucuggauguagugcugagcacugugccccauccacagugggagaccugggaauguugguagagugaaugaaugauucauugcugguaaucuuacuccuuuguuuaauucauucagcagacagaacauaaucuguccugagccagaggcuacacugaggucuaggaauauagaaaugaaccaugauccaucagaacccccaaguuaacaaggacacuuuucaugcucgucuuuuaugauucuucuugauagcuuuucuaggcaggugauaucaccucauuggacaggugcagaacugagcgaaucccaagagauuaaaacugaugcccaggcacacccagcuagacagggaagagcccaggauucacaccaggucagggagacccagguguguguucccucucuuguuggcccugccuucugaggcuccuguuugcugcauuccugguaggcggcggggaggggcuggccacacugcaggggcugcaggaagcaaaggaugaaacugaucuuuucacuaaccagcauagggcacaggccaaagaaaacuuugguuacucucuugugagccaguugaaguuagacuuguucucuuuggaauaggucuuccucugcagaaauaaaaacacuugucugaaagaggcuguaacuaucugugggcuguugggcaaggacacuucagauacuggcuuugagcucacuggguccuggccccucauggcucugugaucaucucugcuccacauugcaggccaugcucccuguuggugcucagcccaggagcccuccuuggguccuggccagacuccuccacccucgugggccugccgcaaccagucuagugccuuuucucccaugggggucccuggaaucucacacacccugcccuuacagagccugcaguccagggugggaguuaacccuuuccacuuucccagagagggagaccuugaguggaggggaggucaggaaacgcggggcuggcagcauggugggaggaggugaaaguacgaugaccagagccuugugugugcggcuguugacaaagcugaggguaugaugggugcugugugcagggcgugccugagaagaccacuccugauggagugcugggggaaguucaaggcuuggaggccaaugagggggcugauggcacccauccaguggagaggcuguauuuggaggcccuccugagugggagcaaggcuauguggaugaugagaugagguaagugagauggaaguggcuguacgaacagccauugaggcugaggcaggaggauugccuaaguccauaucccaggugucaagaccuugucucuaucaaaaaaaaaaaaaaaaaaaaaaauagcgggcguuguggugcgcaccuguagucccagcuacuuaggagacugaggugguaggaucacuuaagcccaggaggucgaggcuacagugagccaugauugugccacugcacuucagccuaggggacagagagaccucucuccacaaaaaaaaaaaaaaaaaaaaaaaaagagccauuggacagcccagguggacaguuagguggaaacacaggaggcuccuggccauuccuuccaugcugugugguggggagcaccugugcucagguguguaacagccugugggccuggcuguagaucggugugcacugguaugugggguaguuggggaggguucaggcugggcugaggcaaagcagaaaugggaccagaacaagaggugcaagccugcggagcagccucccugccuagucagugcugugcuuuccucaugucucggcacagguaugacccacggcacaaccgcugguuccagauccagucccugcagcaggagcacgccgaccuguccguguguguuguaggcagguacaucuacgcuguggcgggccgugacuaccacaaugaccugaaugcuguggagcgcuacgacccugccaccaacuccugggcauacguggccccacucaagagggagguaaggaagcccucgaagaggggccuucuccugccuaauuuccuuccccaggaugugcaaagagugagaggccuaggugucaaggccugucccaggucagagaaacaggcucagugagcagaauccaugcuucuccagagacccugcauugaaugcauugaugaggccccaugagguucagccaguccaccuggggaggcucaucaaggauccagaccccauugcucagaauugugccccacuugugagucuuacaugcugagaccuugucacaccaccuuggcccuggcaagcugcuuaaaccuuguaguucaaauguggauagaacauuugcucuuugugcagcugagacgagcugggacacuuccagagauguuaaacaggaagggacccugagagcucacuggccuauccucagaccucuucccucuagguccccugaaggguggcgccuuccagagccaagaaacacucuaagguuuuauuuuuuauauuaaauccuauguuugaauauugggacaacuugaaaaaaaaaucacgugcauccuauauaauaccuugguuuauuccaauuugaagauguuuaaaauuauguucauuauggaaaaaugauguuuuagggaggugccucucuuuuaucuuacgacuuugggguacucaggccugguguaacaaccagacaugggaucccagggaaggaacaggccuugcuggcccccuacuuccugggucucagccuccgagaacagggcauacccuagcaguacuagggguacccuagcagggcaccccgcuaguacuggcauagcauuuguggagcaccugcuaugggccagguacaccuuuggggauaaccgagcaccugagaggcagaggaugguauggggggcagguucuaccugcacugccucagggaguuuagcaagagcucuggccuuuguaagccucuuuccaguaucucucaugacccccaauucccccagggacuuagacuuugacuucaggggucagggcuagugucuccucaauggauccagcucuucuuuauccaggucauucacacagcccacacagauuucugucucuugggcagcugugagcugcaagcuguggccugcuccuugcucucagcuucuuuggggagaaggaagccucuuuggaaggacacuccguacccccauccuggggaaaggagcagauuuugcauggagaagaucaggagguccuugagaccaaguggacaaggagggcucuuggguucuguuccaggaaggguguugggggaagccuccuagguggguguugugggaggggcuuagcaguuucuuugucugcggcagcuggggaagcagcaguucuccagcuuggccacagaggggcagccuuggcuuucaaccagcugcaucguggcugccgguguuccuucaugcacgcauucauuccgcaacuacuaagcaccauguaccaaguccugggaauccaguggugacaagaaaugagaaagacuccccacuccaugguguuuacagccuuguaggagaaaccacucuuaaccagaaaacagaucaguaaagugguuacaauuaugguaagugaaaugaagagggggcugaacuggaggauuuccagggagggggcucugguaggaugaaucuagagggacuuuuuggggaauguccaucugaggagaugucaauuagaccugccauuuacagagggaggaaauguuacugggaauguguccucgguucuugucuucuugguuaagacuuuaagcaagagacaugcauuaacgaagauaaguguaaggcaguuuauugcaaaagugaagguacauucugaaggccgagucagagcaggcugcuccagaauaagaucgccccaacuggcaugggaaaccucccuuacaggaggcuuacaugauuauucauaaaugggcgggaagagguguuacucauaagcauguuuuguuuggguggucuucuagcagcgcaugcacuguggcucuacgugcuaguguauuuaucgcaugucucauuagcaucuuaaaucuucacccaggagguguguuuuuuaccacugcagugaacaaaagguuacuuucgaagcaagcaaaacuggggcaaacuauacaacacaggcucccggggguggaaaguuccuugugggguuaguuccuacuugagcuggauaagcuuaacugaaagagggguugggacuuuugaaaccccaggugugguuaacaugucucagaggucauagucccucuggccaugcuaggggcugaggccaaccuggaguccacuucccugcucauaucuaaccaucugccuagucuagcagaaggaccuuccagggcaggagaggggcucacagcuuuuccugagcaggagaggaagcauggggcaugcuuguagaagaaggaagcccaaggaucaagagcagagcaagcgaggcuggcccugggucauugcguggucugggcugaagacagcaguagccugugcuggcacacagcuguggagcuggagggagaugggaggguucagaguguagcguggagguaaacugaucaggcuugcugauggaucagauguuggggaaugaaaaaggauaggucauguuggcagggcgcgguggcucacgucuguaaucccagcacuuugggaggcccaggcgggggggaucaccugaggucaggaguucaagaccagccuggccaacaugguaaaaccccaucucuacuaaaaauacaaaaauuagcugagcaugguggcaggcgccuauagucccagcuacucaggaggcugaggcaggagaauggcgugaacccgggaggcagagguuguagugagcugagaucacaccacugcauuccagccugggcaacagagcaagacucugccaagacuccgucucaaaacaaacaaacaaaaaaccucacaggauugguacacugaauauuacaaaaagccgaugaaagaaauaaaagaagaugugaauagauggagagacauaccaaguccauggauuggaagaguaagaauaguaagaaugucaguucuuucccaacccaauuaauaauacauauauuaauacagaauuccucauauugauauaguauuaauacaggaauacuaguauuccuaucaaaauuucaggaagguuuuuuguacuauuaagggaaaaugaaaauugaagcugagguuuggauauaccccuaggccaacugccuguagccauguaacugaaacuuaagcuuuccucccucagugugauagcuuuacaaagaaagcuuaugcagcuccacaugcacaguagggaacaauauucuuccucauucaugcuuuauaaacuguguuguaacugcugugaauuggggcuucauaccacuuccaguuugggguuuccugguucaugaacucuucuuuuacaugcacaauaagcuuuuuaaaaauuuuuuuauuuuuauuuuuuuugagacagagucucgcucugucacccaggcuggagugcaguggcaugaccccggcucacugcaaccucugccucccugguucaagugauccuccugccucagccucccaaguagcugggauuacaggugagcaccaccaugcccagcuaauauuuauauuuuuaguaucaugaagguuucaccauauugcccaggcuguucuugaaccccuggucucaagggaucugucugccucggccaaagugcagggauuagagaagugagccaucacauccagccuaaaauuuuuuuuuauugcuggucgcaguggcucacgucuguaaucccagcacuuugggaggccgaggaugguguaucgcuugaggucaggaguucaagaccagccuggccaacauggugaaaccccaucucuacuaaaaauacaaauauuagcugggugugguggcacacaccuguaaucccagcuacuggggaggcugaggcacaagaauggauugaacccaggaggcagagguugcaaugagccgagauugcgccacugcacuccagccugggcgacagagugagacugucucaaaaaauaauaauaaaauaaauuucaaaauaaauaaaauaaauuuuuuaauuuugauuugauuuuacuugugacauuagauguaaaugagauuauucugaaauguauauauaaaggcaaaggaacuagaauagcucaaauaauuuugaaaaagaacgauaagaugggaggagucugcccaauuucaagauuacuacauagcuacaguaaucaaggcugugguauggauacagugauagacacauagaucagugaaacagaauggaaaacccacagaccugaguaaauaugcccagucauguuacacaugauuuuggacaaaggugcagaaacaauugaguggaggaaagauaucuuucagcaaauaguacuggagcaauuagacaugcgucggcaaaaaaauggauaucaacccaagucucauaccauauaccaaaaugaauucaaaaugguuuauggaguuaaauguaaaaccauaaaacuucuagaaaaaaagaagaagaaaaucuuuuuuuuuugagaccauugauuuuuaauauuuucuuaaaaaaauacaaaagaaauuaacucuguaguacaggucaguacacuucagggaaagagggaaaaauggaauuucagagcaaagguuguuuagguuaucacauucccacacucccaauacccauaaaacaagaauuucacuccaugacacagaggaacauugaaugauagcucagaaauguugauagcugagguacugaaacuaacaaaaggauuuugguuguccuugauuauucuguccuguaaugaauaaaaucuacacuaaaggacagguaaggaaaacuuauagcagaaaaaagacuaaauguaccaaucacagcaguacaaaccacuccuuggcagaagugugcuucuaaaagaauggggcaguaaucagguagcugaacuacuaggcuacugucacucccaguccauccccaaauaaauaguguggaaguguaauaguguaguaguauuugauucaacaaagaaaggcuuucacccccauucaagguuaacacugccauggcuagaugaccccuggcaggcaauaagaugacuguaaaaucacagguacuucuaguuuauccccaguuauacugaacucccacauuuaugucaucuucucucaucccaacauugguucacucuuuuaugcugucuccagugugaaagaccuuggggaaauaaaaagaucauucaaagaauauacccuucucagucuuccagguuauguaauacuucagugcuguucuagguucacucacauuccaucaaauucaguuuaauucacugauucuaacuucaauucugauauacaaacccugaccuccaaaagaagugucagaugaguaucucucccuugcccccaaaguuuuguggggcucucccuuuuguuucccuuuagaauggaacuguguugccccuagcuaccuguagauuagaaaauguauuuguuccuggaaaaaaaaaagacuuggauuuuaccaaguuuacuuaaauugguaucuuuccaaucaucuaggcuggauauugcucacaucuaguaggcuauacucaccuuaguucuuugcaacauaugaggcacaacauacauauaguacaccaagcacgugguaaguuagaaaugacaggaaagugcuccccaaaguagugggagagguaauguggucucucacauccauucaaugugcauucuuuucccuggaguaucuguuacccacccuucucaggaacaacaaccaggacgagggggaguaugugucaaauaaguacaaucaucacugcacuggugccuguaaucacccugugcacauagugagaaacagacauucuagaaaggauucuugauucucccacuaacuguccacuggacuggucacuagcucuggauggugcuccaacaauggucacuucuuguggagaacacacacaccagcaucacagcgcuggguucccauggaugucacgacuucccagcuguugaugauaggguuguaacauucaaugcuacuuagcagggacuuaccuucauauccugcaauugcauagagucucccccgaagcacuguggccccuacauagcaucguggaguggucauacugguggcaguuguccgggaaucagugcgaauguuguaugcuucaacggaagaaaggugggcuguaccaucaaaucuccccaccacauaaauacggucauucagcagggcuacuccugcaccagaacgcuugguggccauugguguaacauuaguccaguguccuguaugagggucauauuucucaacugaauuuaagauauucaagccgucauauccuccuagacaguggaucacuccacuggccacuacgaguccggcaccuucccgggcugucugcauaucucccagcaugcuccucuggucaauguuuggaucauaccgcuccauacuggugugacgccugcuuccaucaaagccuccagagacauagaucaaaucucccagggugguggcuccagcaagaccucaucagacauucauaggggccacagaauaccagaccccauccucaucugcuguguagucuagacauuccacugaacuaaggcuggaacgaccaucacagccaccaaugacguagaucuggucauguagggacacugaggccacauaacaucucuuacaagugaugcuuggcaaaaagcuccacuccugagucuuggggucauauuucucuacugcaucgaugggagacugcuggcuuccgaagcccccagccaccaaaagcacuucauuggcuccuaggcgagcccuuguccugggucccugcaucugacucugaaguucaggccucagaugaaacuucuuugcuucaucaaccagaucccugcauuguaaaccauaguggaugaaaggcucagcaucuauuacaucugugauauaccugaggguuagcaggggcaucugcauauacuguagcaggcugggcaaggagucuuucugcucuuucuuggcaugcuucacccaacugaugacagccucaaagacugguucuucaggauccaccugaauuucaucgcacuugauuagcuuuuccaccucuccuugccucagaagaaugaacucuucaugcuguaccacuucaggaaaauucuucuggcuaaaaaccucagcugcuugugucaggucaacacaauuguggguuucagcaaaaucccuaauacccaggcaauuagaaggguccaacugacuuucuaagaacucacagcaggcuuguuucacaccuuucaacugaagcagacaggcugcaggaagcaguuccuguacauucuccaugucacauguacuguuuccguguacacaaaguccaauaaaauuuccaugguagaggcagucaaaccuuggaugucaacauaggguuuccccuucuauaaaggucacuagugaacauggcacagaaguaaucacuacaggcagccagcacaaucucaugggcaggaaagucuuucugcucuacucaaugucacaucacagaagguauugcucuucccaacggaguucauugaacugaggauugauuuagcaugaguauuugucauuaugucuuugggggccauaaugccucccauaaagcagugcggagaaagaacaaaaauagguccuuggauucugcaacucugcuucugaucccacacagccgcgccagggccuguccccagccuguggggauggaguggggugcggguccagcagguggcucaggaggagccgaagcgucgccgccgccgccccggcccggaggcucuggagcuguccgggucugcucccugcggccacgcgacgugaugaccagaagaaaaucuugaggaucuagcuagggcuaggcaaggaauucuuagacuugaccccaaaagcaugagccauaaaaagaaaaauugauaagcuggacuucaucaaaauuaaaaaauauuugcaaaccaccuaucugacaaaggacuaguauuaaauaaauacauauauaaacaacucuuaaaacucaauaaacggccaggugugguggcucacaccuguaaucccagcacuuugaaaggcugaagugagcggaucacgaggucaggaguucgagaccagagaccagccuggccaacauggugaaaccccaucucuacuaaaacuacaaaaauuaguugggcgcgguggcacacgccuguaaucccagcuacuugggaggcugaggcaggagaauugcuugaaccugggaggcagagguugcagugagccgagaccgugccuuugcacuccagccugggcgacagagugagacuccaucucaaaaacaaaaaaccuuggcaaaauacugcaaauaaccccauuaaaaagagggcaaaagaagccgggcacgguggcucacaccuguaaucccagcacuuugggaggccaagguggguggaucacgaggucaggagauugagaccauccuggcuaacacggugaaaccccaucucuacuaaaaauacaaaaaauuagcuggaugugguggcggacgucuauagucccagcuacuugggaggcugaggcaggagaauggugugaacccaggaggcagagggugcagugagcugagauugugccacugcacuccagccugggcgacacggcaagacucugucucaaaaaaaaacaaacaaaacaaaacaaaacaaaacaaaaaacagaaggcaaaagaguugaagaaacauuucacugaagaggauguauagauggcaaauaagcauauaaggagauauguaacauuauuagcuaucagggaaaugcaaauuaaagccacagugagagaacuaccucaggaugacuaaaauaaaaaguagugaaaauacgaaauacuggugacugugcagggaaacuaugcucauggauugcugauaggaaugugaaaugguacagccacucuggaaaacagaucuggcaguuaccauccuggguauuuaucccagagaaaugaaaacuacucuguauacguuagccaggcauggugaugcgugccuguaaucccagcuacuccggaggcugaggcacaagaauugcuugaacccgggaggcagagguugcagugagccaagauugugccacuauauuccagcaugggcaauagaccaagacccugucucaaaaaaauaaaaaauaacuuaucuguacaugaauguuaauaguagcuuuauugguaauagccagaaacuggaaacaaaucagguguuuucaacagugaaugguuaaacaagcugugguagauacccauggaauacuacugagcaauagaaaaggaaccaacuauugguacauguugaguacccuuuaucugaaaugcuggggaccagaaguguuuuggauuucagauuuuuucagauuuuggaaucuuugcauuauaguuacugguucagcauuucuuauccaaaagucugaaaugcauuuccuuugagugccguguuugugcucaaaaagucucagauuuuggagguacucaaccuguacaugcaacaaccugguagaaccuggguugggguagaaagccaaugucaaaagguuguauacugauuuaauucagacaacacucuugaaguuacaaaacuguagaaauagagaagagauuggugguuuccagggcuuaaggaagggauuaggguaagggaggugaguggaugucacccuaaagggcagccccucgggauccugguggugauaggacaguucuguggcuguguccacgucagcauccuggugacccugugauauagugacacaggcuccuaccaugggggaaagaaggcacgugagaccucuguauuuuuacuuccaacuacacgugacuacacuuaucucaaaaugaaaaguuuaauuaaaaagaaaaaccucggcugggcgugguggcucaugccuauaauccuagcacuuuggaaggccgaggcaggugggucacgaggucaggagaucgagaccauccuggccaacauggugaaacccugucucuauuaaaaauacaaaaguuagcuggguaugguggcgggcgccuauaaucccagcuacucgggaagcugaggcaggagaaucauucgaacccgggaggcggagauugcagugagccgagaucgugccacugcacuccggccuggugacagagcgagacuccgucucaaaaaaaaaaaaaaaaagaaaaaccuccccagaccccuacuggugauaggagaagacccaaaccaaacccuugguguguguucuuccuccccacugcuccguccaccucucuagacucuuguguuuuugccacccgcauggccucaguguuagugacuugcccaguaacauagcucuggagccuccacacccugaggggcuccucuacccucaaaacacccagggccuugccuuggggccuucuguuggccugcugggugugaguggguggguuccggaagugguagggccaggguaagaggugcccaugaugggggcaggcugggcccuauggagauagcccaacagagggaggguaaaaagcccacagaagguucaggaccagaaucaagaaccauguguauuuuucuccccacaucaugaguuuagugucagauauuauuuacaaacauuuuaaaagcagggucagcaggcccggaggauugcauguccagugggagugggggagggguggaggccacugagggugggucagcgguccccaggguucuguggcuucuuccagacuggcuuggaaaaaaugcuuuuauuuucuuggaguucccccaugcagauguuaacuuuaggagcaaaggaaagacaaaggcuacauuucauuucugagucuauagauguauccgcuauugggaagagguuagaggucaaugacuaggacaguaugucccaugagaaucgagggaggauucuugucuguaugugagugggaaguggugaagccucacagcguugucaggcaggugugggguggugauuggccuugacagaguacccagccacccuuccucacugcccucucacgccauuucuccugguggcuccacacagguguaugcccacgcaggcgcgacgcuggaggggaagauguauaucaccugcggccgcagaggggaggauuaccugaaagagacacacugcuacgauccaggcagcaacacuuggcacacacuggcugaugggccugugcggcgcgccuggcacggcauggcaacccuccucaacaagcuguaugugaucgggggcagcaacaacgaugccggauacaggagggacgugcaccaggugaguggggcccggggcaguccacacccgucaucauucccaagccucucaguuguuauugauggaaaauguaauugaaucaugugccuuuuaaaaauagacuauuuuuuagagcaguuuuagguucacagcaaaauuaaguggaagguacaguuuccauacacccccuuuuccccccauacacauauagccuccccacugcagaccucucgcuccagagggguggaugugucacaguuguugaaacugcauugaugcaucaccaucaaccagaguccacaguguucacucuuggcacauucuauagguuuggacaaaugucaccaugacaguaucacacacauacacaucuaccuuugcuuauuacucuuaaaaacuuuuaggccggaugugguggcacaugccuguaauccaagcaguuugggaagccaaggcgagaggaucacuugagcucaggagcuugagaccagccugggcaucauggcaaaaccccaucucuacaaaaauacaaaaauuagccaggugugguugcaugccuguacucucagcuacuugggaggcugagguugggggauggcuugagcccaggaggcagagguuucaguaagcugagaucacgccacugcacuccagccugggcgacagagccaggccuugucucaaaaaaaacaaaaaaaaacaacaacaaaacuuuuagauccaggcuggcagcacauaccuguagucccagcuacucaggaggcugaagugggaggauuguuucagcccagaguuggaggcuucacugagcuaugaucacaccgcuguuccccagccuaggugacagaaugagacccugucucuauucaaaacaaaauaaaacaaaacaacagaacaaaacuuuuauuauaaaguuaauauaaccacauugccggaacuuuaaaaaauagagauggguggccgggcgcgguggcucacgccuguaaucccagcacuuugggagguugaggcagguggaucacgaggucaggaguucaagaccagcuuggccaagauggugaaacuccaucucuacuaaaaauacaaaaauuagccaggugcggugaugggcgccuguaaucccaguuacuugggaagacugaggcaggagaaucgcuggaacccgggaggcagagguugcagugagcugagaucacacgacugcacuccagccugggcaacagagcaagacuccaucucaaaaaaaaaaaaaaaauagagaagggugaggaaaagcauucauaaucaggccccugcaguacuguuuuucaguaugaccauuuucagcauugaccguguauguuuucugccugauuguagucaaagagcaucccauucugagcugggcacaguggcucacacccguaaucccugcauuuugggaagccaaggcagguggauggcuugaguccaggaacugauaccagccugggcaacauggugaaacuccaucucuacuaaaaauacaaaaaaaaauuagccaggcaugguggcuugcaccuguggucccagcuacuugggaggcugagggagaaucaacugagcccaggagguugaggcugcagugaaccgugauggugccacugcacuccagccugggcaacagagcgagaccuugucucaaacaaacaaacaaacaaacaaaaaagagcaucccauaucccauucugcuucucucagugacuuuuguccugggcauuuuccagauuaacacucaaucuucaucauccccucuugugucuaaguuuuaacuauuccaaauaacaugacaaguaauaguugcuuuguugagcuuuucagguauuuuggauuauuuccuuagguucaugcaacaguucucaaagugugauucucagacuaacagagucugcaucaccugggaacgcuguguuacgaggcaccucagacccacugauucggaagcccugagggugggucuuggcgaucuggcuuuuaacagguccucugcuugugagauccucugggccagcacauuaguuuucuauugcuucaguaaccuaucaccacaaacauagcaacuuaagauaaauuuauucugcauucauaaguccucugacaugggccuugccaggcuaaaaccagggugcggucagggcaucuuuccuuuguggagacccuaguggggaucugccucccugcucacucugguuagaagaauucagucccuggcaguugcagucccauuuccuugcuagcugucaguugagggccuucuuggcuucuagagguccccacuuuuccuggcuuggggacacuucgucuucaaagccagcaauggcagguugaguccuccucacuucucagcucucuugucuggcuuuacccuuccuuuuuuucuuuuuuuuuuuuuuaugagauggagucuugcuuugucacccaggcuggggggcacuggugcagucucagcucacugcaaccucugccuccuggguuuaagcgauucuccugcuucagccuccggaguagcuaggaggacuacagguguucgccaccacaccuagcuaauuuuucuauuuuuaguagagacgggguuuugccaugucggccaggcuggucucaaacuccugaccucaggugauccacgcaccucagccucccaaagugcuaggauuacaggcgugagccaccacccccggccuccccuuccacuuuuuuuguuuguuuguuugagacagagucucgcucugucgccaggcuggagugcaguggugcucuuggcucacugcacccuuugccuccuggguucaagugauucuccugccucagccucccgaguagcugggguuacaggcaugugccaccaugcccagcugauuuuuguauuuuuaguagagacgagguuucaccauguuggccaggauggucuugaucucuugaccuugugaucagcccgccuuggccucccaaagugcugggauuacaggcgugagccaccacgcccggccucuccccuuccacuuuuaagggcucaugcaauuggauggaucaccuggaaaauccaggaaaacugccccaucucagggucugcacccuuaauccuuuuuuuuuuuguauucuuguacccuugauccuaucugcaaagccccuuuggcugcuuaagguagcauauucuggagauuaggaacuagacaucuuugggggccacuauucugcccaccauagcuagagaaccaaaaacggcuaaucagucaagaagguaagauuuuuauggcucuuaauacuuauugccaaauuccuuuucuggcaugucagacagauacauaguaguauggcuuuaccacacccucaacagcauuggguuuugugauuuuccuucucugcagugguugcuaguugaaaaauuugucucugauguuuugauuuugcguuucuugaauuacuaguagguugaacauuuuuccaugucuuuguuuacuguuuggacaauuuugaagacaagagaauauugauguugacuacuccgcaaggaauuacuuccacuuucugucuccucccccuguccuacugccuguguugagugcugcagaaggagguugaagacauuucaguggaguccaugucucucaggcagcuucguuuccuggaggggagagaagcagugcccucagacauggggaaugaccacaugcugaugggggcacagccacacacucgggggcagagacuggcuuagggccggguggccuagaggaagggcugggcuggagcaaagccagagagaauaggaucauucuaggggagggcccaaaagacagccuccugcagacucggccaucccugggugagaaagcagcagccuggcccauggacaggauguuucaacacuggcccugugccauccuuccagggggccugaccugucagaaugguggguaacuguugccaccuuggucagugggcuugugggggagcuggcagccucgucccagugggugcugggcuuuauucuagccuuggcuuugcagguggccugcuacagcugcacgucuggacaguggucaucugucugcccacucccugcugggcacggugagccuggcauugcugugcuggacaacaggaucuauguguuagguggccgcucacacaaccgcggcagccgcacaggcuacgugcacauuuacgauguggagaaggacugcugggaggaagggccccagcuggacaacuccaucucaggccuggcggccugugugcucacccugccccgcucccugcuccuugagccgccccgcgggaccccugaccgcagccaggccgacccggacuuugccucugaggugaugagugugucugacugggaggaguuugacaacuccagugaggacuaggcucccugugccuggcaucagagggaagggaggcuggggcugcagggcagugaaacccacgcagccuaggccagagcacuuuacuccaggcagggccccugccccuguuggccacagcuuaugggcccugcccucuuucuucacaccagccccuuggccagccugccgcaggcaucucagggccaugcagaucccaggcuguggauuacgucacugcaggaacugcuucugaaaggcuuuggccuuccucagugagcccuggagggguuggccuucucuccucccugccuagaucaguccuucuccaaaaggaccugggagcuggcagccugggcaggggggcugaggcacgugguagcccucuuucugugaaugggguggggcugugggggcagcugggguuggaggaugagagcuccugaggggcagaggagcagagaugcaucagcucgccugggacuggcucugugauaaaaagaccccucccgcuggguuuucagaccccauguuguuggucaaugaaauaaagcaucuuacagaagguguuaacuguu

SEQ ID NO: 192613 - RNA, 5866 nt, Homo sapiens
ugcgggccacacugaggcaucuuuauuucucugggucacacagagcuugggccugggagccucuucugcaugggggcugcagcugccaagggagcggcugagaccagaacaagcgcucgagugggccccagugcagguugggaugugcccgguggaguaaggugugagaacccccagccucacucucugccuggcccugaagcagacagcagcaggcuggcccagccuccccuuuaugagacuauccuaggguuugacagcaagucccagaugaagggugacaggcagcugggguccaccuggucucuccucagcagggggaacccccugcgggcagcugggaaggcaguggccaaaggucaagaagaugaacucugcccagacuucugcugccuguggcuauggugggacagggcugccuuucuggucacacugggcagcaggcaacugccagggaccuccuagccccagggcugccuucccugcccagcagccccucugcugcagcuuccggaugaguuccagcagguucaucugcagcaucagcuccugggauacagaggggccccaugaaggccagagugacccccaggccccuuucaucccggcccaaaggugccaggcagugagcccacggggcgaccauccugugaagccuggucauggccugcuacgacaggguggaaucugagcuucugcccccagcagggccacucggaaucugagccucugcccccagcagggccacucggaaucugagccucugcacccagcagggccacuuggaauggcaugcgggaggggagcagaagagggcccuguggggcacagcaggccuggggagggugggcagugcccauggcuggcuggcucaccccccuguagggaaugggccuggccuccaugcugggaauggcacagaaauccuuuccagagccucaauccuuccacuucacccccuauacccugagccuggcuccccagggaccagcagugaaaucccagauggaauggggcccaggggcacucgggcuaggacagagcaggcccaggcacugaccuguggguugguggucacguagaagccagccacccccgccuucuccagugugcucugcuggucagccaccuuccgguccagcuccaggacgaucuucugguccaucgcccgcugcuccucacggauccggugcuccaccgccugccguggggccgggggcggcgggggaggugagggcagcucaaacacaugcuccugcugcuguccccaacagcaccagcucugacaccaccaaugcauccucaccacacccaggccucuccucggccaagugaaccccugaagggggccccaaggggcuuccacgaaugcuuugacuugggacugccuugggaccacacacacaucuccgcaggcacacccugccccaugacuuguugguuacaugccggucucugguugucccugugcucccggggagaaggaugggccccuuccuggcuggccccaucaccccaccauugccuuuguaccccccgaggccaccugcucugcggagaccccaacccacgaggggcacuaauggacuccaggggagcacugguggguucucacccuccacccagucccagcacaccuggcacccucagcgaggagccaccuggugggacucacuaggccuccagugucccacucaggcccaggguagccacccacaccugagccccccacaccccuucagcucagcccagucagcagagccagguggugcccacaggagagcugggccggccacccugccugcguccccaguaccucuaguucucgcugcugagccgccugaagcacaggcagguuauggggccggcaggccugcugggcuuccuggugcuucugccgcagcgccugccugagcacugggagggaugagagcccgucagcaggcggugggacucggcagcagcccucacccaugggcaccugccuuaccaacccagcagagcagccaggccaaaggggugucugcacuggggaggacgccagccuccuccauccucccaccccacugucacggcaagucuccaggggauuccagaaggugcggggcacugaaagagaguggggguggggaagacuggccagguggggccaaagcugcagccccagacccagggcagcuggagggggcaggcgggagggaggcugcagucugagggcuucagggcccccguggccacaggccauaggacaucuacucaaguguuggagaccaccucaggcaaaggcaugggaaaggagcaggaggagccgggucgcugacccugagcguggggccucugccuaccaggugugugguuggccccuccacccuuggugcugcccuucagggugggcagcccccucccccauuugcagcucccagccccuacacagcaccagagggagaagggugagcugaccugggaggcccaaguuugggaugaaccuggggugucauaagccugugaggcucugggccagggagucuguguggcuuugaggggcucacccucggccaccaagcaaagcuccacggucccugcuaaacugugcacaaacacagaugugcaaacucuagucugaagggaguguacagaggaagcgaucaugggacauaaaccaucauggcaaaauggaacauggagcaccccgcagcuggcgccagugcauuaagugccaaauggcuacaguuccccaggaaggaggggucccuggccacaacaaaacgugaaauccaacacucuguuccugggaagagcccugauguugcagcucuucucugguggcaagucuccagggaacuccacggccccugaggcuccccugcagguagccuggcuccagcugugccuacagccuuccccaaucuccuguuucuuggcauucuguacacaccucgacgaugguauuuaccaaaagccccccucaagacagcuccauaacacagggaagcagggaaaugucaucaucuucacucuacugaucaaacauugcuacaagugccagguccacuacgagauuccacuagauaugcaaccaaaaggcaagaagagagccacgccggcugccugggcagaaggggccuggccuuagacacgaccgggaacacaaaggaggcaggagcagccagucaccccugccaaaucagcaggagaagcagaaagucaacgcaggcaugccugcugcugguggaaccaggaccuggcccaaaccuucugaagcacaaacagcauugggcccaggcaguuacugaaacuccccauccugcuagaaagaacuacaacucuguggaaaaauggccgauuccaggacugagacacggagaaaacaagaaaagaugagccugaacacauaccugaaccagaaagcaagaaagugcucacagaaugauggggcggcaucuaaaggugccuggagcgcccccaacuggccacacauggcacagucugagcauuaaggaauaaugagccaugcacuugggauuaguaaacugcaugcaucuuacagcucaauaaaauuuuuaaaaagacagucacccagacauuuaggggaagaaguaaugccaauucuacacaaacucuucuggaaaacugaagaggagagaacacuucgaaacucauccuauaaggcuggcaaaaacccugauacccaaaccagguauuacaugaaaacuauagaccacaguuuaucaugaacauagacaaaaaaauucuuaacaagauuuuagcaaaucaaauccagcauacauaaaaaggauacuacagcacgacccaguaggauggaauucaagugacuguaauucacuguaguaauagaaaaugauucaccacgugaucaucucaagagcugccaaaaaggaaacugccaaaauccaacauccauucuugauagaaacacaccaauccuggagcagauggacacugccugccuucuggggaagggggccuugccccgcuaggaggaauuuuugccacauuaaaccugccucuaaucaggcuccuaccaggaguccaguguacaguaaacccagagaguggagaagcagguuaaaugcacgaggaagcauuuccucugauagauccagagcagggcauucuaauuauagaauuagacucuauaaaaagucaaugccacaauaaauguuggggacuguuccagaagcaaagagaccaaaguaaccaauuguaguacaugaacuuggacuggauccuuacuuauaaagcaacaauuugccacaaguuagguaccaugauguggccaugcacugaaagucaggagacaccuggaacaguuaauuucucagggggcuacccucugcagcuguguaggagaccgcucuuguucuagagcacuugcucccaauccaaggccaagguugaccccaccacccagguugucuggaggcauucuugguuuucacgacuagggaggguaccccugccauccugcaaugcgcaagacagcaucucaccauaaagacuuacccagccacaaaugucagcauggcuggguugaaaauccuggucuccaggaaugcugaagacucuuggugaauucuaugcugucacauguauguauuuugggaugucaagaacuagagcaaaauguuaacuacugaacuuucgguggagagcacaagcguaugcacuacacugucuuuucaguuuuuccaaauguuugaacuuuuaaaauaagaaguuugggaaaaauaaaacagcaaagguggaaaucugauggugcagggggaccugcccuauauaauuugcaggaaagggcuccgaagcccaggaagcaugcggcucaagugggaagcucuucugguuugggagggcgccacaggagacagugcuuaggaauuugaugugcaacuagaaugaggcccugcaggccugagagggaacugacccugaagggcgcgcacagcugucaacagaccuccaacuacccaagggcgcugcucaccugucaacagaacuccaauuaccggagggcaacgcagucagaucuaccaccagagucagccugccggccaaccaagcacggaggccuagggccaucaggccuggaaggggguggggcacagggaagcccgaacagggaguuucugcuaagaaggugggugcugcgcaacugaaaacaaaacucguuggacacauuggucaccaaaaaggcgcugucucagucucugcgcccuugauuuuguuaaucuuagggaccucuuccgaacacucccaaggaaggagccgagcugcacagauaccaagagcugccgggaggcgccgaccccgaggaggcggcaccuccucccgcugcccccgcgcaccucgaugcucguucuguaggcgcaggcgcugguuguacaggcucuuuucggugaggugcuggaucuccaguagccccugcacgauuucgaacacggugccgucgagaagcgccagggccaggucgcucagcgugguguaggacaagcgcugcuggaaugagcugcgggguagaggagcgcggugagccccggcgggacacgaugcggccucggcaggccgccgcccgccccgcccgcguaccugggcaacuccuucaccaggcucuguaacgccgacagcagcugguagugucgcuccugcugccgggcaccguccgccaccuccuccaaggcgcccgcguagcgcuccauggcgcggacgcccgcuagccgccggcugcagcgacgagcgcccccagcucacgucaucccgaccgcggcgcgucccgccccuuuuaugacagucccuagcgcagcgcgccccgcccgucuuaggacaguccccgaucgcggcgcgccucgcg

SEQ ID NO: 192614 - RNA, 28236 nt, Homo sapiens
cggccugcguccgccaccggaagcgcccuccuaauccccgcagcgccaccgccauugccgccaucgucguggggcuucuggggcagcuagggcugcccgccgcgcugccugcgccggaccggggcggguccagucccgggcgggccgucgcgggagaggugagagcgcuggcuagaccggggccgaaugcggccggauucggggcgggggccuucagaccuaggguggaacacugggauaggguguggggaauucggaccgcugugaagugaucugacguugggugggagucuccggacuugggguggggaaucuggaugggaacuggggaauucggaccuuggguggggaucuuuggaccggggugggguccccagacuccuuguggaaagcugagguugaagaucugugcugugaugaggggcuccagauagcggugagagaucccgcuucaagacuggguuggggguccagaccaggaggauaagccucucccuggaguagggcuugaccuggugagggugugguagagucacaggggagggucccacuugguccuugggcugggaucagacucucagagcuggagaguugcaggaggccugggggagggucuguggagccccagacucagagggccuuggugacuucuccaacaggcucccuguuggaggccuugggguaccccagggccuuucccugcaagagagaggcugcuccaccaggaaggggcccaggacuccccagggucggggggauguguggugugcaggaccacgugggaauguuagagaaaggggaagucacuccgggccugcccugcuaacagaccugcuuuuuggauuuuuccagccagggauuuuuguguccuguugcuuuuuauuguuuaaagugacccuccaagccugagggaccguaggagcugcccugcagagcccagugagacacuaguuaaugcagaaaaaacagauuuuacuugguaacuacugacaacaugagaaaaagcuggcuccaugcugauuugucuagaugugccuggaguuuaaagggagagugagggagugggaagggguggggacucaguagaguuagggaaacagaaaaucaccaaaacugggaagggaggguuggccccugugaaaccaacugaucuggguuugccacuggggcuuaccgaagucaggcccccaaccucccacagagacugggagacaggggccccauccucagguguuggcuggaacacacaggaaauucuuguggcagccuugaacuucucaggcaggcacuuuagagggggcuaggaucguucugggaauguggccuugagcuguuaggagcuauguuaguguucguuccagccuagauaggccagggugaggcccaguggagaaggggacucuaaggagccuggcuggaguguggggagggagggucuuugucagcacucccccugugcaagaagagcagagaccugcuucuuuccucucaacaguccccguccauuuucuguucuguguuguguucauaaacuaccagcgggaccaucuguugagacuugguagcaaaggauuuuugcuggaugaugcaagcagucaagcauuuaaugaggaaacaaaaauaacaggccaggcacaguggcucaugucuguaaucccagcacuuuuggaggccgaggaggaucacuugaggccaggaguuugaaacaagccugggcaacauaaagaccccaucucuacaaaaaauuuaaaaauuagcccggcgugguggcaugggccuauaguuccagcuacuugggaggcugaggugaaaagaucguuugagccugggaggcggaggcugccaugagccaugaucuugccucuauacuccagccugagcaacagagagccccuaucuuuaaaaaaaaaaaauaauaauaaaauaaaaaaauaaaaagaaagaaagaaauaaaaacaaagaugaauggagcuguugauaaacccaguuuuugagccuacagggcagcaguugagguuucuggccguugggcccuaacaaggccagcaggggcacucagggacuuccugguguguggugugaagucugugaugauggcauaggcauugguaucccaguugugguuacuuucuggagagagcauguggcaugcaggagcuggagggggggucuuccugggcggccuguguagcagcagcuccaggcacaaaggcugccccuggagaaucuguugugguucugaguucuuucaaguuuauaucaaguuuuccggcuucagucugcagggcuguuuuuuucagauccugggggcaaagggcagcuacaagaccaccugagucccaauagggauuugaguucuuggugacaccaagucagggaggagacaaauuagaaaugucagucugaagagagugguagguagccagauacugaaggaaaguagaugggaggauuugguaagggcugacguguaggaaggcagugacaguccaagugacaggcagaucauaaaaccucaaggauaggccgggcccgguggcucaugccuguaaucccaagcacuucgggaggccgaggugggcaaaucacccgaguccagaaguucgagaccagccuggcuaacauggcaaaacccugucucuacuaaaaauacaaaacauuagccgggcgugguggugcacucaggaggcugaggcgggauaaucgcuugaacugggagguggggggcugcaguaagccgagaucgcaccacugcacuccagccugggcaacaagagcgaaacuccaucucaaaaaagaauuaggccgggagcgguggcucacgccuguaaucccagcacuuugggaggccgaggcggguggaucacgaggucaggagaucgagaccauccuggcuaacacggugaaaccccaucucuacuaaaaauacaaaauuagccaggcgugguggcgggcaccuguagucccagcuacuugggaggcugaggcaggagaauggugugaacccgggagguggagcuugcaaugagccgagaucacaccacugcacuccagccugggcgacacagcaagacugcgucucaaaaacaaaacaaaacaaaacaaaacaccuacaaaagacagugaacuagacuaggaucugauaacucccaaggggguguuauauuucuccacugaagcauagcauuucucuuuacaaacccuucccuuuugauugaagauaaucaaagugagauuauucuuauuuaccaaauaauucuggucucauuaaauuuggccugauuauuuacauaaaugcagcacgaacaguaauugaccacacaggccuuuuuaaguuugcugaaacuuuuaauagggaaucuuagauugagcuuuuuaaagccuuu[450 bp omitted]aaagauaauugcuucaauuuuguuuagagaaguaucauuuacuauaauauuacgagucauugauagguuaagagaaaagggaaagguuucuuucuuuuuuucuuuuuugaggcagagucucacucuguuccccaggcuggagugcaguggcgugaucucagcucacugcaagcuccgccuccuggguuuacaccauucuccugccucagccucccgaguagcugggacuacaggugccugccaccacgcccggcuaauuuuuuguguuuuuaguagagaugggguuucacuguguuagcaaggauggucucgcucuccagaccucgugauccacccgccucggccucccaaaguacugggauuacaggcgugagccaccgugcccagccggggaaagguuucuuuuuuuaauauucagaaaauaaaacauaaagagccaacaauauucugaacaaaagucauaaaaagacuguaaucauccuucagcaguuuacucaguugcaugcagguacugaauucuuguucugcuugaucuugggcuagcagguacaugaacccaucuuuucucaaccaguggagauccuggcucagugcagucaugugaucucaaaguuaagaaaugcugucacgcccaggugcaguggcucaggccuguaaucccaacacuuugggaggccaacguggcuauaucacuugaagucaggaguucgagaccagcuuggccaacauggugaaacccugucucuaccaaaaaauacaaaaauuagccaguugugguagcagacgccuguaaucccaacuacucgggaggcugaagugggagaaucgcuugaacccgggacauggagguugcagugagccaagaucacgccacugcacuccagccugggcaacacagugagacuccaucucaaaaaaagaaauaaagaaaugcugucagaagccuaccccaugguaccugucaugggccuuuucauuggucccuuuuuguugaagaugaagcacuuugcccuguagcugauugcaagagauuucaggaaagcaucagaguaaaacucuaaugacaaaagacuuaaaauaguguaguuaaauaucuaaugagagaucauuacaaaaucaaacgauuuacaaggaauguugguuguuuaugacacauagcauuuuaaauaauaaccagaaugaugauugcuguuauaugaggacaugucauuggcagaaggguauucaccaguuugugggaacuuuauacaauaucuggaauccuuauauuaacauuuaccaauaugcauguaacucaaggaaguuuaaauagcauuaaaaaaaauuuuuuuuuaguuuuuuuuuuuuuuuuuuuuuuugagacagagucccacuguguugcucaggcuggagugcaguggcacgaucucggcucacugcaaccuccgccuccugggcucaagcgauucuccugccucagccccccaaguagcugggauuacaggugugcaccaucacacccagcuaauuuuuguauuuuuaguagagaugggguuucgccacacuggccaggcuggucuugaacuccugaccccaggugaccugcccaccuuggccuuccaaaguguugggauuacaggcgugagucaccgcguccggcccuaaauaacauuuuuuauuugacagcaccuugcaugaaauucuguaggguccagcccuacagggucuguggguuuuucuccccgugugcagagaugagagaucguagaaauaaagacacaagacaaagagauagaagaaaagacagcugggcccggggaccacuaccaccaagaugcggagaccaguaguggccccgaaugccaggcugcgcuguuauuuauuggauacaagacaagggggcaggguaaggagugugagcuaucuccagugacagguaaggucacaugggucacguguccacuggacgggggcccuucccuguuuggcagccgaggcggacagcgagaggagacagcuuaugucauuauuucuguauuucagagaccuuuaguacuuucacuaauuuuguuacugcuaguuagaaggcauagccagguacaggguggaacaugaaagcggaccaggagcgugacugcuuaagcacagcaucacagggagacgguuaggccuccggauaacugugggcaaaccugacacuccacaagaggugguugagcagagucuucucuaacucccacagggaaagggagacuuccuuucccggucugcuaaguaacgggugcuuuuucuaggcacugacgcaacugcuagaccaagguccgcuaaguaacaggcgucuucccaggcgcugacguuaccacuagaccaaggagcccucuaguggcccuguccgggcauaacagaaggcucacacgcuugucuucuggucacuucucaccgugucccuucagcucuuaucacuguauggccugguuucuccuagguuauaauuguagagcgaagauuauuauaauauuggaauaaagaguaauugcuacaaacuaaugauuaacaauauucauauauaaucauaucuaugaucuauaucuaauguaacuauucuuauuuuauauauuuucuuuauuauacuggaacagcucgugcccucggucucuugccucggcaccugggcgacuugcugcccacaaaauucaccauugaaauaaaccuaauuaguuuaacaucucucuuauaaggucacaggacagauccuuugaggucuuccaggggcccuccaggaaaucucaagucagucugagaucaagacaaugucacaggccacaugcagugguucacgccuauaaucccaacacuuugggaguccgaggagggaggacuccuugagcccaggaguuugagaccagccugagaaacaugcugaggcccugucucuacaaaacaaaaaguugaaaaauuagcugggcauggugguacaugucuguagucccauguacucugaagacugaggcgggaggaucacuugagcccaggaguucaagguugcagugagcuguaauugcaccacugcacuccagccucaguaacagagugagacucugucacuaaaaaaaauuuaggcugggugcagcggcucacgccuauaaucccagcauuuugggaggucaagguggacagaucaccugagaucaggaguucaagaccaggcuggccaacauggcaaaaccccaccuguacuaaaaauacaaaaauuagcugggcguggugccaugugccuguggucccagcuacuugggaggcugagacagcagaauugcuuaagccugggaggcagagguuacagugagcccagaucacaccauggcacuccagccuggguaacagagcgagacucugucucaaaaaaaaaaaaaaaaaaaaaaaaauuuaaagaaacuuuauacauaaauccauucaaugauuaugaggucaauucuagccagcuuugaccucauaacauaaaauuucuuuucugcagacuuucuugaggccaggaguucaagaccagccugggaaacauagggauaacuuucuguauccauucacaguugcuuuuguuuugagacagaaucucagucugucacccaggauggagugcaguggugagaucucagcuuacugcagccuugaccuccugggcucaagcgauccuccugccucacccucccaaguagcugggacuacaggcauguaccaccaugccaggcuaauaauuuuugaguuuuuuuauagaaacaggguuucaucauguuucccaggcuugucucgaauuccugggccauucaggcuuugucccauauuuuuccucuuuuuguaauuuuacuucaggacaaaauuacaucccuuucuuuaacaaaaacacucuacauucuuugcauacuuuucauauaaaaacacauccuaucuuccucccauacuuuguauaggaaauuguuucccucauucuuauuguuucuaggaguuuuguuuucauauauugauuauaauuuuuaaccauuaguaaccgguauuuuuuuuuuaaagagacagcgucuugcucuuuugcccaggcuggagugcaguggcacaaucaggacucacugcacccuugaacucccgggcucaaguaauucuccaaccucagcccccuaaagcacugagauuacaggcaugagucaccacgcccggccauaacuuguauuuuacaaguaaaacugggaagaagacaauuggaaauugucugucauuuaccaguuuguuggcaaauuuuaugaauauaccaucuuauaaucucuagagguauauccuuuuuauaguacaauguuuuuaagugccaaguacauguuuauuaacagaccagaauaccuuuagccagucuguaccauauaaaaauaagaagccaaaaaguacaaaaaguuacgcuuaauaaugaauguuucagcacuuucuucucuucagguauuauuuagauauucaaugaaugucuauuauuuaacuucacuuaguaugacucugagguugaaaguuacugaaaacaucuuguaagcuuuuuuaggccaauauauuaucaaacgcaauuaacaaaacacaacucacuaguuuauauaagagcuaguucucacuuuuuuuuuuacucuauuuuauauauuuuuucuuuucuuuucuuuucuuuuuuuuuuuuuuuuuuuuuucuguagagacaaggucuugcuguguugcccaggcuggucuugaacuccuagccucaagugauccacuuaccuuggccucccaaagugcugggauuacaggugugagccaccacccagcccuauuuuauauuuuuaucugaacuguguuucuggcaaauuggacaaguuaagggucacuugcuccaugugaggggaaggcuuucuaccuguauuuguggauaagaccuuuacgacuuguuuugcccugauggaugacuacauguuuccagugagcucagcugguugcuuuugugggucccugaggcacugcgagccccugauggggcaggaagccuaaaguuccagggaccguggggaguugaggggcuggagggggaagagagaggccugcagcggggauccacagguggaggaggccagacuugaagggggugucuccuucaagagaaaguagggaaguauggaggugauaggaagggagaggccugagaggagcuaguuuggggagaucucaaguaucccaaaggagccacugauguuccaaauuauccuugguaaagucacaucaacaaggaaggaagcagacagaggcgcacuuguuccuugcaguuuuguuuugaugugcugauuaaaguagcgcagagggcaugaucagcagggcuccaguaagacgcucccacgggaggagcaagaacacagaacagagggggcaagacagcuccaccaggagucaggagugaauccccucugggaacgaggcacuaggaagaagaacuuccagcccaggagguagguagcguucagaagaagccuggggcgggcgcgguggcgcacgccuguaaucccagcacuuugggaggccgaggcgggcgaaucacgaggucaggagaucaagaccauccuggcuaacacggugaaaccccaucucuacuaaaaauacaaaaaauuagccgggcguuguggugggcaccuauagucccagcuacuugggaggcugaggcaggagaauggcaugaacccgggggacggagcuugcaaugagccgagauuaugccacugcacuccagccugggcgacagagcaagacucugucccaaaaaaaaaaaaaaaaaaagccugggacucuuagcgccucagagccuuacucagaaucauaaaaucauuagaagcaaugucuguccucacugcugcauccgauauucuuccggaccacuggaucacaaaucaaaccaugugacucccgcaugagcaggcagaguggagauaacacggaucgcuguguacacugugugcuccgguuguugcauccgaggguugaucggauggugguucccauccagauccaaguccuggccccugaucacagagaaacacagcuggacauuaaaguggugaggacggaaauuauaauauuuggugaccagugacaggaggggagagagccgagcuccgcuccgaguugugcaaagaaguggggaguggggaggaagaacaguggggacucaguggagugaggaaaguggaaaauuaccaaaagcaggaagggaggguuagccuugggaaaccaaucuggguuugccacgggggcuuacugaagucaggcccccagucccacagaggcugggagacaggggccccaucuucagguguuggccagaacacaggaaauucucuugguagccaugacuuucucaggcaggcgcuuugaagggggcugggaucauuuuaggaauguggccuugagcuguuagaagccaugugcaguauggcuuacaccuguaaucccagcacuuugggaggcugaggcuggagaaucacuugaggccaggaguuuaagaccagccugggcaacauagcaagacgcugucucuacaaaaauaauuuuuaaaaaauuagccaggcacugcggcaugccccuguguagucccaguuacucaggaggcugaagcaggaggacugcuggagcccaagaguucaagguugcagcaagcugauugcaccacugcacuccagccugggcggcagaggugaucacgccacugcacucccgccugggcgacagagcaagacccugucuuuaaaaacaaaaaggccaggcaggugcgguggcucaugccuguaaucccagcacuuugggaggccaaggcgggcggaucaugaggucaggagaucgagaccauccuggcuaacauggugaaaccccgucucuaccaaaaacacaaaaaaguuagccgggcgugguggcgggcgccuguagucccagcuacugggaggcugaggcaggagaaugccaugaacccgggggauggagcuugcagugagccgagauugcgccacugcacucuagccugggagacagagcaagacuccgucucaaaacaaaacaaaacaacaacaaaaaaaaaacagccgagcgcaguggcucacgccuguaaucccagcacuuugggaggccgaggugggcagaucacaaggucaggaguucaagaccagccugaccaacauggugaaaccuugucucuacuaaaaauacaaaaauuagcuaggcgugguggugugagccuauaaucccagcuacucaggaggcugaggcaggagaaucgcuugaacccaggaggcggagguugcagugagccgagaucgcgccacugcacuccagucugugugacagagugacagcccgucucaaaaaauaaauaaauaaauaaauaaauaaauaaauaaauaaauaaauaaauaaauaaaaugaagcagcagcagcuuuguuaguguuuguucaaggccugauaggccaaggugaggcucagccgagaaacgugcucagaggagccuggccggagugugaugggggagucuuuguccaggcugcugccacggugggccucaggacucauggccugggcgcuggggguggggcugccacucagccuugaggagagcaaugaggaggucagauuccacucacauccagugcggucuggaugcaggccuggcccagagccugguccagaugcuggggcuuuguuuuuuuguuguuguuuuuuugagacagagucucgcucuguugcccaggcuggagugcaguggcacuaucuccacucacugcaacaaccuccaccuccacgguucaagcgauucuccugccucagccucccgaguagcugggacuacaggcacccgccaccaugcccggcucauuuuuugcauuuuuaguggaaacagaguuucaccauguuggccaggauggucuccaacuccagaccuugugaucugccugccucagccucccaaagugcugggauuacaggcgugagccacugcacccagccggcuuuguuuacaguacucagcagcugccaaaauaguccccauucccaggcagggcaggcucccgggcucaguccagcggggcagauggccagccugcacgucaccccacuaggcauguccaggcccuuucugccccucccuaaaggcaccccuguccuuucuguccccuccacacugagccaagccagccuccacucuugccccaggccugcccucugcugggagccgggacacugagcuccugccacaugagcagguugaccugcagggggccuccaagcaggugccaaggcagaaucggaugugaccaggagaacacccuugaaggauaaagcgaaugugcgaccaccaugcaggucuggcccauggaagggaggggagggggccccgacggggccacaguaaaggaguggaggggccccacaggcagggauggcccagcuggcccccuggggcugugaaucugcaggugcagugcagccucuugccucucucagcccagcccuugcaucugccucuuggugugucugugaagacaaagucaccguggucccugcagcaccuggcuugaagcaggugugcaguccgugugaaagccuucccuuuagcuauuagguauugagucaaaaaaaaaaaaagccuuccccugagccugggggccuggccccacugaggauaccaggcgggggaggcuacaggaggcugcccucugccuggccaucugaccuuccauucugaccccuucccuuccacaccagccccuuucccuauguagggugcagucuuuguugcaacugcucaccucugccauggucggaugagagcagccacggacaaugucugugcaauugugcguuuuuuguuuuguuuuguuuugagauggagucccacucuuguugcccaggcuggaguguaauggcaccaucucggcucacugcaaccuccaccucccgaguucuagcgauucuccugccucagccucccaaguagcugggauuacaggcaugcaucaccaugucuggcuaauuguguauuuuuaauagagacugggguuucaccauguuggucaggcuguucuugaacuccugaccucaggugauccacccgccucagccucccaaaaugcugggauuacagacgugagccaccgugccugguugauugugcguucugauaaagcuucauuuacagaaauagcagguaggccccucgcagggugcccagagcaggugcacugucucaccucuucucaggugucaccggggugagaggcuaguccucugccuccuccuuccucucugcagguuggagaaaugacagcuucuuguacuggggguuaugagacaguggcaggagggggacacucccagagugcugccagaaagaggcgaggccccaucuggauuugauggcauuuuuauugugguguuguuuuagagacagugucugucgcccaggauggacgacauggugcaaucauggcucacuccagccuccaacuccugggcccaagcaauccucccacuucagccuccugaguagcugcagcuauaggcacaccaccaugccuggcucaauggguauuuuguggccauuaaacuucuggucauuccuuuagauucccagaggcuggauggaggugaguggccagccccuggguccagagaugagcgcggggccuggcugcagccuguggggucucccaggcuggccuccagguguccucucagccuguccacaggcgcugcccaagcguguggccuaccuggugcugccuggccugucucuacgcaccuguacuggcucucccuggauuacuggaucgcagucgaauccccugccagaauccuggucccccuuuaucacaccggaucagccccaaagggcagggcuucuugcagcaguuccagccuuugcuggggguuuccagcccuguugagcaagccccagguagggcccucugcagcccccgugggggaccugugugccgagcagagcugccccguguguaaacgcuuagaacuggccuccuuccugccaucuguguccuguuugucaucacgccuguggcucuaugcuugucuccccgacugggccaccagcccugugagggcaggaugaggcacguccaagccacaguggcucucagugugcagggugcuguuagcauugguucuguguucuggaauagugagaacagugugccccaaauggccaguggccuuuccgagggucacugcagccgcauguuggcccucuguggagaacggaggaugcacagccauuucagagcacaaccugaggucuccugagcuugcugugcagcccagucuuucucuccguggccccugguagcugucuuucucccaggaggaggagaaagacaccuuccugagcaggaggaugugggugaauagagaccaaagugucaaucacucuucugacagaggugauagcagaaugaaaaacugauggaccccagaucuuugcaaagagaacaaagucaguuucuaguuaucuuucuuucuuuuuuuucuuuuuuucuuuuuuuuuuuuuuuuuuuuuuuuugagauggagucucgcucugcugcccaggcuggagugcaguggugugaucucagcucacugcaaccgccucccggguucaagugauucuccugccucagccuccugaguaaccaggacuacaggcacacaccaccacgcccagcuaauuuuuguuauuuuuagcagagacaggguuucaccauguuggccaggauggucuugagcucucuuuuuuuuuuuuuuuuuuuuuuuugagacggagucucgcucugucacccaggcuggagugcaauggagugaucuuagcucccugcaaccucugccucccagguucaggcuauucuccugccucagccuccugaguagcugggacuaacaggugcuugccaccaagccuggcuaauuuuuguauuuuuaguagagacaggguuucaccauauuggccaggcugaucucgaaauccugaccuuguggucugcccgccuuggccucccaaagugcugggauuacaggcguaagccaccacaccaggcccauuuucuaguuaucuuuuacggauuuuuuaaaaugagccuagaaaccaggucauauaauuaguuuauuuuuuaauuucuuauagagacagggucuuacuauguugcccagagugguccugaacgccugggcucaagugauccuccugccucagccucccaaaguauugggauuacagguguggccacuguuccagccauaguucauauuuuaaaggauuuuuaagagucucauuucacugauguuacuugcaguauauuuauggaaaacauuccugucuuuuuuuuuuuuuugagacggagucucacucuguuacccaggcuggagugcaguggcgugaucucggcucacugcaagcuccgccucugggguucacgccauucuccugccucagccucccgaguagcugggacuacaggugccugccaccacacccggccaauuuuuuguauuuuuaguagagacaggguuucacuguguuagccaggauggucucgaucuccugaccucgugaucugcccgccccggccucccaaagugcugggauuacaggcaugagccaccgcgcccggccagcauuccugucuuuuaaagaaagaugagaccagaugcaguggugugcaccuguggucccagcuacucaggaggaugccuugagccugggaguucaaggcugcagcugcagugagccuugaucacgccacugcacuccagccugggcaauugaacaggacccugucucuaaagaaauaaaauaaaggcagaugaaugucaucuaggguguguccaaugugagagagaauacugaccaggugacagaggugauggacucucuagcucugcagcagacugcugggcagagaagcuugggcaggccuggcacugaggcccagaagcuucaugcucuuuagagccagaggugucaagcccagcugccuguguccuggccgcacugugaggcacugaggaugcccucacacgugcaucugcauguggcgugcauguggcaagcaugugcaggugcugugugggcacgaucaugccugcccucuacugugcuggagagguaagaccaucagccguuucacagaggagggaauguggaccucacgggggucucaugagcuugcgagccgauggccaggcagccggugcagaagguucauccauuuugaugaaccgugaauucaucuguacuuuauucauuuuaauaacugaaucauaccucauuguauggcucuaccauguuuuauuauccauucaggugcuaacggauggaaggguuguuucuaccuguuggccauuguggaugauguugcuaugcauauugggguacgaguaucugguuuagucccuguuuucaauucuugguauacaccuaggaguagaauugcugggucauaugguaguucuauuuuaacuuuuuuuuauuuuuaauuuuuguggguuuuuaagaauuuuuuaauauuugugggugcauagcauguuuaauuuuuuuuuuuuuuuugagacggggucuugcucuguugcccaggcuggagugcaguggcaggaucacagcccugugcagccucaaccuccugggcucaggugauccucccgccucagccucccaaguaucugggacuacacgugcggaccaccacgccuggcuaauuuuuaaguuuuuuguagagauggggucuugccauguuucccagacugguaugggacuccugggcucaagcaauccucccaucccaaccucccaaagugcuggaauuacagucaugagccaccaggucugaccacauguuuaacuuuuugaagaacuaccaaacuguuuuccacggcauucacaccagcaaugcaagaggguucccauuucaucacauccuugcuaacacuuguuauuuuccuuaaaaaaaaaaaaaaaaaaaagccagcugggcacgguggcucaugcauguaaucccagcacuuuggaaggccaaggggguggagcacuugagcucaggagacuagccugggcaaaauaucgagaccccaccuccacuccaucucuaccaaaaaaaaaaaaaaaaaaaagcugggugugcgguggugcacaucugucgucccagcuacuugggggggcugaggcaggaggaucccuugagcccaggaggucgagacugcagugagcugcgaccgcgccacugcacuccaggcugagcgacagagugagacccuguuucaaaaaaacaaaaaaaaagcacauuucaaacauacacaaaagcagagagaauuccccucgguccuccggccugcaccccaccgccccccaccacaggggcauucaaaacugucuuuuugccucucuguaagguaaggggggacucuugacgcuccccagaccacacagccaaaguagggcgaucggaucauagggggucccgagucggacacugagcuggcgugcccacucucgaguccugggaccccaaacuaaaggagcuguuccuuuuccccauggagggcugacggggcaaaaucccagggcugggaacauccgagcagcuuugaguagcacagguggguuucuacguggcuuucuuuaaagggaggccugauucucggcuuuucaggacccgcccuccauuuucucacuugccugcucuuucguccugcgaaacugggcaguggccggugacagcgcagggucagcccucggauggccaggugggcgugaucccacccuccuccguggcugggugggcguggucccaaagucaauuggauguggucccgcgucccucccggcccagugggcggggccuccccuucuggggccucccaucccacaccagcgagcagagaggagggugggcggggaggcccuacggggcuggggcggggcggagcggaggugguuagcugucgggagguggggugggcaggggccagggcucuguugguggcccggggcagccagucccucugcucagggcuucaguucacacucacaagggaaucccagcgcucuucuccucuggcgguugcuggagggccuugugagguggccgugggcacuguagcccccaggcacugcauuguggccugggcguguuggccuuugagccuuuggccuugagcacuuccccaucccccauggcucuuggccguuggggcccaguuggccgcagagccuuuggccuugagcacuuccccagcccccauggcucuuggccauuggaccccaguuggccacagagccgcgggcaggugggacaggcgggcacugggugccuccuugcaccagccaggcccagccugcagaguggagugggccggucccuccugccaggcaaaggaagggggcuucgggccccucccugcuguggccuccuccccucugcugccucccacuaggcccugggagacacugccugcagauuuaugaacagacagaccuagagauuagagauucaaaagccaaauucuuacacaauucaaguauuaacgcagauuuggauuuauaauuugggacuccaaggucuaccaaguaauuugcuguuucagaauagcccuuuuaauuugggguauauauuucuaacacuguuuuuuaaauauggagaguaaacaaaauggcccauuaucugaccacacaaauacuaguagucauuauagauaaaccauagcagauaaauaauaguaaacaaagcaacaggcugugucauaggaaauccccaccaugaagaaaggagcaagguggaaaguucuggcugcuucaggucugcauggucccucuccaccaugguucccccugucaucuuccugccagaauaaggacacuguccuuagggaagcaccaucucuuguuuuuuccccacgagcccugugggucauggcacguccugccccgcugggaaacacagugggccacggguuucccugcaggccugggacccuucccaaggguagcagcagaaggcagcacgauucccacuccugcagcuguggacaggggcacccccacugucacugagcccugcaccggguuccaucaccugcucggggcucuggccuuuggccuuuuccugugagcugcauguuggccacugugaccuaucugucucaucaucuuuuucuuacugguuuguguauguucuugguaaacuagcccuuggucuuacacaucauuuccaagguacuaaggacucuucaggggaaauacaacuugagcagagugguucccuccucuugugguucacaaggugcaggugcacacacacauagcccacagggcaguguggacagggaccaggagacugccccuggggucccuggcugggggacacuaguagggaugucccuuggccucucugaggccuucugcugucucuucugaggccggaaaggcgaagcacugcccucgcccugcuagggaaggcucaggccaggcuggcccuauccggggaaggggcucagguaucuggaccuuggucaucgccagguuaggguuuauguugaugauuauccaaaggcaaaauugauuuccacagaaauaacaucugcuuugcugccgagcucagaggagaccccagaccccucccgcagccagagggcuggagccugcucagaggugcuuugaaggugaguuggccaacggaagccggggcagugccaggguggguacagauuccggcccggugcaugggcacaggucugcugagcacauguccacucugccuguguaaauaggccacauggccugaaauccccuagaagccugguguccgcaugaccucccccuagggcggagccucugcuucccuguucucuucugcucuguccucuggugcccugaggcuggccuccagggguguccccucuguggcccuaggccugccuccuugccugggugugccuuucuaaaauggagcguccagcagagagugggaucuccuaugccacugggagcccagggccccaucccagaaagaccucugagugagcacaggggcccuagaagaaguuuccuuguguccuucccguuuuagggucugugaccugaaccccugggcuucugccucaggccuccugugcucugcucucugccugcuggguccccucaccaggcuucugucugguucccaggcuaccugccuggagggucacaccaggaggauuucaaacagguuucaaguggggucacuugccaucacugugccccacgagguacacuguugugggcggcagggcuggccuuucucaucugggacaugccacguugcuguucccaaggggaguggugagugggucuguccuggugugccuggccuggggacugccaguguccuuacuuggacacucaaugaaaaggccacaugaaucccuggggcguccagagcaugggugaccagcacgggcucaccacaugaggccaaggggcugcaccauacagccucuccuuuggccacccgugacuacccccaacuccgggccauggggcuucccuaccccuggguguccucuaagccagcugggagacaacagccugaguccgugucugcuucuguauuuugugugguuuuagaggaucccugggcugccuggggaagcacccagggccagggagugugacccugcaggcuccacacaggacugccagaggcacacaccugcucugucuacccgagggcaccagagggcacgagaaggcuggcucccuggcgcugacacgucaggcaacugaggcacaaggcuggcauuucugaaccuugccccucugcaaacacaagggggcgaugguggcacuccaagcaaaggggcgugugggugcugcaggaggagcacagagcacuggcgccccuccccucccgcccugcagaugccggaggccccgccucugcuguuggcagcuguguugcugggccuggugcugcugguggugcugcugcugcuucugaggcacuggggcuggggccugugccuuaucggcuggaacgaguucauccugcagcccauccacaaccugcucaugggugacaccaaggagcagcgcauccugaaccacgugcugcagcaugcggagcccgggaacgcacagagcgugcuggaggccauugacaccuacugcgagcagaaggagugggccaugaacgugggcgacaagaaaggugggguccgggccagcaggugcucagcucugggacagggacccaggaccaggcaucaaagcccuuacaggagaagcuguuaucaccccauuuccagggggcugggaacccugggauaugcccagauagggcuggggggcuccucuggagucccagggugccagggucccugaugaccccugcaggcccugcugccugcugccccaggacaacaggcccccacacucacagggucugacgguggugcaguuccccuugaacucuguucuggccaccaugggaccugccuggggaccagucagacagguucuccugggcccgccucccgcuugaacuucagccuggggcacaggauguguuaccgggcucacggagugacucagggaacuagugccgccccagggccccaaggugggcgguucggugauucagagagggcagcucuguguuaggacacacuggggccagccaggaaggguggaaaagauagggaccagcgugagcauagaggcuaagggaccaugggagcuccaagcgcgcucacaguggggaccagguccugggggcuggggacaccagggaggugaaauaccccuccagcggguagggagggugggcagaggagggccagcggccaggcauuugggaggggcuccugcucuuugggagagguggggggccgugccuggggauccaaguuccccucucuccaccugugcucaccucuccuccguccccaacccugcacaggcaagaucguggacgccgugauucaggagcaccagcccuccgugcugcuggagcugggggccuacuguggcuacucagcugugcgcauggcccgccugcugucaccaggggcgaggcucaucaccaucgagaucaaccccgacugugccgccaucacccagcggaugguggauuucgcuggcgugaaggacaaggugugcaugccugacccguugucagaccuggaaaaagggccggcugugggcagggagggcaugcgcacuuuguccuccccaccagguguucacaccacguucacugaaaacccacuaucaccaggccccucagugcuucccagccuggggcugaggaaagacccccccagcagcucagugagggucucacagcucuggguaaacugccaagguggcaccaggaggggcagggacagaguggggccuugucaucccagaacccuaaagaaaacugaugaaugcuuguauggguguguaaagauggccuccugucugugugggcgugggcacugacaggcgcuguuguauagguguguagggauggccuccugucugugaggacgugggcacugacaggcgcuguuccaggucacccuugugguuggagcgucccaggacaucaucccccagcugaagaagaaguaugauguggacacacuggacauggucuuccucgaccacuggaaggaccgguaccugccggacacgcuucucuuggaggugagccccaaccaggauggcauccgugccagcugcugcccagagcccauucagucagccucagccucuccaaagagccaggcauuccaguagagcccuguguggacacagcucgcucuggaggcaccaccugaggucugggagugugggggacugaggaggcccugugguggguggagauggguggggagcugggccaggggccuggcuggguggccuguugggaacuggggagccagcugccugugcaggugcaaaauggguggcagaaguggggugcacaccccagaccagacaccagggcagaaacggcacaggaccaaggagaugggguggggaagggccgcucugggcccagccugcucucccccaagcaagccacugcucgugcaaagaaagcaugugucuccugcagaucuuccuccugaggccccaucuugugcauucccccaacccagccccacuggcgaggacccugagugccccgagugaggcuagacagcggguggggcuguccucgcuucccuggggggcguggggcacugguggcccuucacagacugaugcuuaaggagccucacaucagugacacacugccccaucccucccugguggucagcgacacugaguggcucugugauccuccacugggcuugggacacccacccucacggccuccccaccuggugcucgcucaccugcagcucucccagaaacuggacacugcuguuagcagccggacuaggagcacgaggggcacagcccccaugccuggcuagguagggccgcuggacccuggacacggauuggaaggaaccagcacuagcagaagccugaggugugaaagggcagagaauguuccaggaacaaugggagucagggcacacaggacuuugggcaggugaggaugagguuagaccugucuucuggagcugggcucaggggcucaugccuguaacccuugcacuuugggaggcuacggcaggaggagcgcuugaggccaggagaguucgagaccagccugggcaacauggcaaaagaaaaaauauauauauauauuuuagauggagucuugcucugucaccaggcuggagugcaguggcacgaucacggcucacugcaaccuccaccucuuggguucaagcgauuacccugccuuagccuccugaguagcugggacuacaggcgcgcgcugccacacccggcuaguuuuuuguaguuuaguagagaugggguuucaccacauuggccaggauggucucaauauccugacuucgugauccgcccgccucggccucccaaagugcugggauuacaggcgugagccacugcguccggccguauuccagcuuucaaaacaacaaaaaacaacaaaaacuuuucuggaaagaucccugucagccuuguggaguguggagagggcuguggggagggcauuucagaugcccugaacucacgaggaggcacugaacccuggccguggagagggaggaccuguaguggccaagggggugggcauugggagggugggagggagaccuacaggccaagacaggguagcuggaggggggcucaccccugacaaaggagcaugaugcuggcaauuggguauugauggcagagagcuggcacucagccagaugggcuucacuugggcaggaaagacacccacagcugggccugcguuacugcggccgaguuucagcagcugugaugugggugcuaauuacaggggccugccuucauagaaaaguagcaaacauugcaguuuaguaacuaggaaacuaauaguuuucucagugcugcuugcgcaaagcugguaauuaucucaaaagaagcaaagucaugaagugggaagucaugaauugggaauggguguccuuguuaaacgcacaucugcacacucagggcuggggcccugugcccccuuguggaggguuaggggacaaccuggcucuugugagggucuagccauccccucaguggguucugugagcaucggaggcacgaggggugaggggcucaggagcagguugcaauucaaaaucaagggcugcuuugaggaggccucuccaccgggcugcuguagucaccaaguccagcccaugcccaaaggaagaggaaugaguucccccuuaaaaaaaaaaaaaaaaaaagaaaaagacagagucuugcucugugcccaggcuggagugcagugaugacaucauagcucacuguagccucaaacuccugagcuccagugauccucccaccucagccuccugaguagcuaggacuaaaggcaugcaccacuacaccuggcuaauuuaaaaauuuuuuguagaaauggggucucccuauguugcccagacuggucucaaacuccuggccucaagcgauccucuugccucaaccucccaaagugcugggaguacaggugugugcuuggucugaggcuccaacuuuuuguuguuguuucucgagacagucucucgcucugucgcccaggcuggagugcaguggcgcgaucuuggcucccugcaaccucugugaggcuccaacucuugaagggaggagagucuaaggagggugggccagaugaaaaccaccucagcauagugucaccugcuccucugacacugucgcuucuccacggcauuagauuuucaguccugcucagacgcugaugcauguuuagccaguucuccagguggucugaguagcugguaggaggcuugcagugucgggcgacaggcaggacaggugcugccuucuuuccccucuugaccaguuucguaaaggagugggccccuggcagccuccaaaggugacccaugcuccuuucugcccuucccuccuucuuuccuguuuaacucgugcaggugcaguggucuggugucuuucaguccgcugacgucuucuguaucccugaugaccagauugggcuccugaguccccuggcgcaacccgagaaguccaggagcccaggccccucacucaugcauucccuggcccagacuggaaggcagccgcccugcucaaggccuaggccauuguccuccucccggguggcgcuuuguucuacgucuuuucagcugacauugcuaggacauuuuuuuuuuuuucuaaaugaaaacacaucaugauucauggugguacuuccugcucaacuccggaccuuggggcuguccccugaccucacugaccuugcagccgugugguguccauacugucacaugaaagcccccugcuuucucugcagcauacaggcuggaaacgaccgccacccaccaccaggacagcugcaagcccugugggacucuccaggcccaucccagaggcauguggggucggauaccaguguuucaaggcaccugccugcaaauugauuuuauuauacuuuagauguuugagauugcuuguuaacuuuuguuuggugacuaagucaaauuuccaagacaaggugacuggggugucccuugcccugguagguccuuccuccccauaggcaaacacuuccucucaagguuucuuguuuaugugauguaagcaaacccuuuucugauagcauagauaggcaagcauccuaugagguuucucccgauaguggaccccacgggccaugcccuauggcugcguguccaguaacaacuccuuccuucugcacagaacccaggcagaggaacucuguguccucccagggcccaggcacuggugaagauggggggucugcaaaugcaggagcuuggggauguccagaacugaccccaaggggcaggcuuguugaugggaggucugccccaccucagcccugcagggucacccuggucaggccaauauugucuccagggaccauaccagcaaccccucuccuugggugccucucccucauaggccugaguuccuggcacuggguguugagggccccauuguuuccacucacccagcuagcauuuauugagcaccuacugugugccacaugcuguucuaagggauggauacuccugagauggauacaggaguugaugagagaaaggucccuguccucacggggcccauguucugaagguggcacccaagucuuguacaguccuuuccugcaggagucacgcugggcagaaaguggaaaccuggccccaggggcuaggcacaggcguggugccguggccuagugaggagcacccauccugguuuggggcagguucucugggcaccucugacccucaccucccccaccccccggucuguuugcaggaauguggccugcugcggaaggggacagugcuacuggcugacaacgugaucugcccaggugcgccagacuuccuagcacacgugcgcgggagcagcugcuuugagugcacacacuaccaaucguuccuggaauacagggaggugguggacggccuggagaaggccaucuacaagggcccaggcagcgaagcagggcccugacugcccccccggccccccucucgggcucucucacccagccugguacugaaggugccagacgugcuccugcugaccuucugcggcuccgggcuguguccuaaaugcaaagcacaccucggccgaggccugcgcccugacaugcuaaccucucugaacugcaacacuggauuguucuuuuuuaagacucaaucaugacuucuuuacuaacacuggcuagcuauauuaucuuauauacuaauaucauguuuuaaaaauauaaaauagaaauuaagaaucuaaauauuuagauauaacucgacuuaguacauccuucucaacugccauuccccugcugcccuugacuugggcaccaaacauucaaagcuccccuugacggacgcuaacgcuaagggcggggccccuagcuggcuggguucuggguggcacgccuggcccacuggccucccagccacaguggugcagaggucagcccuccugcagcuaggccaggggcaccuguuagccccauggggacgacugccggccugggaaacgaagaggagucagccagcauucacaccuuucugaccaagcaggcgcuggggacagguggaccccgcagcagcaccagccccucugggccccauguggcacagaguggaagcaucuccuucccuacuccccacugggccuugcuuacagaagaggcaauggcucagaccagcucccgcaucccuguaguugccucccuggcccaugagugaggaugcagugcugguuucugcccaccuacaccuagagcuguccccaucuccuccaaggggucagacugcuagccaccucagaggcuccaagggcccaguucccaggcccaggacaggaaucaacccugugcuagcugaguucaccugcaccgagaccagccccuagccaagauucuacuccugggcucaaggccuggcuagcccccagccagcccacuccuauggauagacagaccagugagcccaaguggacaaguuuggggccacccagggaccagaaacagagccucugcaggacacagcagaugggcaccugggaccaccuccacccagggcccugccccagacgcgcagaggcccgacacaagggagaagccagccacuugugccagaccugaguggcagaaagcaaaaaguuccuuugcugcuuuaauuuuuaaauuuucuuacaaaaauuuagguguuuaccaauagucuuauuuuggcuuauuuuuaa

SEQ ID NO: 192615 - RNA, 48894 nt, Homo sapiens
guugugagcugcggcagagacugguggcuggaggagacgccggcgcuggagagugcgcugcgccgcccgccgcugagggaccgcgggguuagccacugcuggcugcuuccaguguucgccgagagguaccgggggugacagcuccgggaccggccgaaaggcgaggaaccggucagagucugaguccucgggggcggaggggcgacggcgguccugaccaccggggugucugcgggagggcagccagcggcggccggccucucagagccagacuggcggucugcggagaggcugcagcugggcuacagggccccuuucugaggcgaggggccuccaggguucaccuggggggucuuccucccccgcuugguagcuacagcccugagggagggcgcgcgcgccuccuggcacuacggcccggaaccgcggcgcggcuggugcggccuggcuagggcggggugguugccgggacuggggguagccgcaggugcgguaggcuagucgccgcggggccgggcgccgccgggggaggcggcugggcagacgggugcugcuuguugccgaugggcugcgaacggggcgcugcuuuuuauuucaggaagcccgggggagugcgaccgccucaaauccagccuucuuguuuggugggacgaccgucgguucuguccgggaggaaugacggggucaaggugggguccccagggccgcgggcccgugaagccccauuaaagcgauugcgaaaugcacucggcacugucaccugaccguuacccccgcccccguccccugcgagccuuuguuuaccacgaucgcgacacccggcccgcugcggccguccccggggagccggggcgggcgggggagcgggcguuccgccggcgcaguccccgccuaaccuccccaccuucuuaccacuccaggacucaguuucuuaauuuaguuccuaauggacccgcccucaaguucuggacaccccgggugaagacuguuaacgcggcggggauugggcgccugcggcagcuugugggcgguacccgagggagaguucgaguuuuuauuggcgaguuuuuauugucacuaggugggccugcccugggccauucuucccgcccccuugaaggugaucuggaggacgcgcgggagcgcgcgcugucgcugcuuuugcagcugcggcccgaguggagccggguggcgcgggugcgggaggcgcgcgcucccgccccugcugcgggcggcugguagccucgguggccgccgccgccgcugcugcugccugauccugcaggcaguucugggcacgcagagaucggcuaccguggccugcccuccgaggaccggaaaauuaacacccuuuaacuagugucgcguuaucugccgggugguucgcaggaaguccugcgaacacguuguugccaguucuguaaacguguuuagauagcuaaauauagaucacagugccacaucuuagggggccccacggucaccccugaggcaguggcuguucacaauugauuuuaguggauuuuaaugauuaaucacuugcucuugugggcagcuuuucaaaaaucacgucuuuguauuugcagcuacagacuggguccaccagcuaagagguugguuuuuauuaggguuguaaaauagauuuaaaaucugcuuguuguuggcugagauuuaaaagcagauuucuacuauuuaaaaaagauaguuugaagauacuccccuaaaaaguaaagauucuuccauacucggcucggaugaguuguuuuccuuguuugagggauucuaggucacacacuucuauguuuuaauucccgugguaauucaaaauguuugagaaguggguugcgacugugucguuuuaaaauuguacauuaagcugacgguaauaaaaucuucaagaccaaucauuuuuagccauaguguguugaaaaugguuuuucuaaucgcuugaguuaauaggguauuugcguuuugucagauuuucuucugcagauauaggaauucacucaagacuuaauacacuuguuuuguuuuugagacagggucucacauucugucacccaggcuggaguggaguggucucacuccgucacccaggccaucucagcucacugcaaucuccgccucccgaguucaaucgauucuccugccuuaguuucccgaguagcugggaugacaggcgcccgccaccacgcccggcuaguuuuuguauguuuaguagggacgggguuucaccauguuggccaggcuagucuugaacuccugaccucaggugauccgcccgccucagccucccaaagugcugggauugcaggcgugagccaccgugccuggcaaagacaauacauuuuuguagaaggaaguuugagcuccccuggaugaagcaggaauugaauaugaacaguuccuauugguuaugcauucuuuaaaauuccagaggagaugguuacaccggaaugagcaucuccugugaucagaaccgccucaucacuugugcauugagaguauuuaauguaucuaaaugaguacaaaaugcaaucgucuaaccuuuugaaaaaguaaaaccaucacucaguaaaggcuugcuuauucaaacaaagccagcaaccuaagucucuaaacaggaagaagaaauaaauucugcguuaaggcugacuaccagcuuuaacuuaaacuuuccuggcuuuuguccaaguuguugaaccuuaaugcuuuuucaauaacuuuuuuuaacuuccuuuucucccauuucauuaaaacccaaaggucaagccugugaaaaauaaauacuauuaaucaaauaagugaccacaguuauuuuugucuauuugacaaaaauuugggacacuuuuuucaauaaauauuuggguauggacuguauaauggaaaaauguaaguaaauaucuucacaaguauacguaugaaaaauauauuuuuguaugauuuuauuucuggugugacugaaacaacuggagaguauauagccacuugacaacuguugacauuuaaaaaccgcuauuguuucuccuauuaaaaacacauuaagugcuugccugucaucccagcuacuccagaggcugaggcaggagaaucucuugagcucuggaguuugagaacagaaugggcaacauagugagacccugucucaaaaaauaaacaauaaaacaaucgcuaagcaaacuucuuuaaauugaagaguuuggcacucugccuauauucaucaucccagaguuaaaguauuucaacauuuggcacaucuuaaagacuacuaaacugguguuuuaaaaguaggcuuuggcugggugcgguggcucacgccuguaaucucaguacuuucggaggcugaggcggguggaucaccugaggucaggaguucaagaucagccuggccaacguggugaaaccccgucucuacuaaaaauacaaaaauuagccggguguggccgcaggcggcuguaaucccagcuacuuaggaggcugaggcaggagaaucacuugaaccgggaggcggagguugcagugagcugagaucgcgccauugcacuccggccugggcaacaggagcaaaacuccgucucaaaaaaaaaagugggcuuuacucuuaacugagguuuccaaaggcuaccacuguaaauaauucgugucacuacuaagauaaauauaaaccacugacuaugugcuuuuauucauagagaagucauguaaaauauuagaucucaaauuuguggccgggcgcgguggcucacgccuguaaucccagcacuuugggaggccaaggcgggcagaucacaaggucaggagaucaagaccauccuggcuaacacggagaaaccccgucucuacuaaaaauacaaaaaauuagccgggcguagcggcgggcgccuguagucccagcuacucgggaggcugaggcaggagaauggcgugaacccaggaggcggagcuugcagugagccaagaucgcgccgcugcacuccagccugggugacagagcaagacucugucucaaaaaaaaaaaaaaaaaaaaaaaaucucaaauuuguucagguggcagagcuccuugcuggcauccuugcagauuuaauuaaaaaaccaaaaccgggcugggcguggugacucacgcuuguaaucccagcacuuugggaggccgggccagguggaucaccaggucaggaguucgagaccagccuggccaacauagugaaacccccaucuccacuaaaaaccaaacaaacaaacaaacccagaaaauauuagccuggugugguagcacgcuccuguaaucccagcuacucgggaggcugaggcaggagaaucacuugaacccgggagguggggguugcagugagccaagauugugccacugcacucaauccugggugacagagcgagacuccaucucaauaaauaaauaaccaaaaccauuuuucuaacagaaaacauaacuauaucauauaucuauagguguuuugauuaucaaauaaaacaaugcauuaaauaccuaaaagaaacauguuagcaagauaaaaccaaacaacaguaaauuuacacaucaagucuagucagaagcaugaguaggcucaauagggcagcuugguauaccacgugugaugucugaugguuaacaaguuuuuuucuuccuuuaggguuggggaauaucaguagccagaaguuuuaagucgagggagagaaacacuggagaaauucauauuuuuuuuccugugauuuaagagacaauaguauucuuuuuuaguuaaagaaccauauuguuuagucugacacauuguuuaagcuuuccuaaauuugucaucaacagcuaucuguuuuguuucucaucaagcaaagucauauaguauauugcccauuugagguucuaauaaauaugggguaauccauaguugcuaucauucuauccaaagaaacucaagguuuuaguugguuucuguuaccuuuucuuuuuuuucuuuuuucuuuuuucuuuuuuuuuuuuuuuuugagacagagucuugcucugucgcccaggcuggagugugauggugccaucuuggcucacugcaaccuccgccuccuggguucaagcauuuccgcugccucagccuccugaguagcugggauuacaggugcccgccaccacacccggcuaauuuuuuuguauuuuuaguagaaacgggguuucacuauguuggccaggcuggucucgaacccuugaccucgugauccgccugccucagccucucaaagugcugggacugcaggcgugagccaccucggccagccaguuucuguuaucuugugguggguaaauauggucuuggugguuccauuaagaaacuggaaauguugaaaauagcuugaaggcugggcuuuaaacauuacauuuguaaaacaugguccaggaaccacugcugcagaguaauucuuuaaacugaaauuuugauagugcaaguuuaugauuuuuaaaaagucaucaaauaaauuagcuuuugagacuauagggugaaaauaucugaaauguauaaaaauugcuugguuuuguauaguaccuuauuauauaugauuuucugguuauuuuuuaaauaaaagauguacuggccgggcacaguggcucacgccuguaaucccagaacuuugggaggucgaggcggguggaucacaaggucaagagaucgaggccauccuggccaacauggugaaaccccgucucuacuaaaaauacaugguggcgcacaccuguagucccagcuacaugggaggcugaggcaggagaaucgcuugaacccaggaggugaagguugcagugagccgagaucaugccacugcacuccagccuggcaacagagugagacugucucaaaaaaaaaaaaaaaaaaaagauuuacuauauugcaauuauuuucugacuuucuuucuuuugaguuacuauauaucuuucaagauaaaccucuugguuaaccuuucuuuucaucuccugugguguucuuucaagguuaaauuugagaaaauggaguagcguagaacauaguaugcagcaguucucuacuacaaguuuuaggggccaugcuagucaggauguuguugguuccuuuguuuucugguauuaguuuuuagaagccccucauuaauccauacuaucuuuaaggauguuaguaaccucaucguauagaauuucugcauucuaaaggaaacauaagcuuguuucaguacacucacgcuguagauuaauucugauauuacauaucuccaucagacuuuguacccucucucuuccaucccuuacccuuaccgauuagguugguauuaccuaaaaauccauagaaaauguccaggugaauugccuuaugcuuucuaccccauaagguauaauucuagaccagaucgguuaugagaggcucuauuccagucugcaccugcuaagaauuugaaucuauuuuaguaccaaucuuggaguucuuguuuggcucuacucuuagccaaccccacagagucuaaaauuggaucugaauccaguauuugccagccagugacagacauaaacuagguucuuuauaaauguuucaugaauugaccugcaucccugcauugauucaggaucuuauuguccauugggaaggaagauuuacuuagcuaggaguaacaauucccaaauuugcccuaguugcaauauuuuuuuaccaaggguacauacaagucagguucacuucugaaaguaaggaaacacaggauagcauucacuugaugaucauaacacagucuggguauacauauguguuuguguguauacauuuaaaaaaaaggucguuuauauuugguuuuggaaucaacuuuugaauuugucuaaacuuguuaagaauuuacaaguucuauuuaaagauaucugggccagaaaccagaaccacuuguguuuaaauacuauugcuauucuguacacagcucaagguucugguauuuucucuuaagcauuccucuucuccccuuccaccaaaaaaaaaaaaaaaaaaaaaaaaaaggaauugugccgaauuaguugguuucuauggggauauggggauuaaguuucuacaagauucaaggcagaagaaauauacauuuauauauuaaaagauaaaaaaauuauuugcuaacucuuagaauuauuuaauggccccaaacuuggaugaaacaucaauuuccagacacucuucaaauauccaaaguguauucaaauaucacagaguguauguuuuuucagugcuaccauuagcuugcuauugacauuaauuuucuuuuacucauuuuucacucaagaaauuuuacugcaggauaaaacuccaggauaaaacugucaagugccgggcacgguggcucaugccuguaaucccagcacuuugggaggccgaggcgggcggaucaccugaggucgggaguuugagaccagccugacuaacauggagaaacccugucucugcuaaaaauacaaaauuagcugggcauggcggcacauacguguaaucccaacuacuagggaggcugaggcaggagaaucgcuugaaccugggaggcggagguugccgugagccgagauugcgccauugcacuccagucugggcaauaagagcaaaacucagucucaaaaaacaaacaaaaaaacugucaaguaaggaaguugauaaauaagaaaaacuaguuauguaaaauagcauuaaguuauuaauuuacuuuaaggagauguuauucacuaauuauuuuuaaacaaaaacgaacuucaguuggaaacuagaaauuacuaaaaacuuuguucaacauauuaguaaauaaugccagcuguacaugaacugacaacuaucugauuuauauguugcuauucuuucuuuauuuuagguguggaaauuaaaagaacacacauauuuugacuggggcuuugaucaaccaaaugcuaaaaagguauauuuguaauauuuauaaacuaucuaaauguuguuauuagagaauuuaaaccauauuccuuucuuuaaccagggaucacuuaagccaaucagauaacaaggcacaacucuauccuuaagaucacaaaagauggcagugugacaaucauuucuguuacuaaauauuuacccacucuucugugcuuuccugagagccucauucaugucugaucaacuuauauacauuaacucauguagauauaacuuuaagucauuauguuuguuuggaaagaagcuuuuccuacuuauuuugucuagagaugccuacuuaguuguuuacuuuuuccugaugggaauaauucugcugugauauuugcaaaaauguuauaaugguucaaucuguaaucuuacguuuuguuugcuugauuaugcaucaugaguucauuuugaucaaucuugaaccuauauuagucaccguacuuugagaugauaggauaacauuuuucuuuccuuuuuuuuuuuuuuuuuuuuuuuuugagacggagucuugcucuguuuccaggcuggagugcaauggugcgaucucggcucacugcaaccuccgccucccggguucaagugauucuccugucuccuggguucaagugauucuccugccucagccuccugaguagcugggacuacaggcguccacaaccacgcccagcuaaucuuuguauuacuuuauuguauaaaaugggaaggcaaaagcuagcaaauuucauguggaagcccaaaagauacauucugaaugcaucucacacuccuaagaugcccuccugcaaaucauuuauacauaggaaguguuuacauuugguguaguuacggagaccaguaauuggagaguucccagaaaauccagaggaagucaagaugcccaaaagucaggaggcagcaggcugaagcuguuuggaaagaucuaugagauagucucucuuacauacagagcaguaaacaaauaucucauugcuguugaagacuuuguaauacaaggugauuuuauagguguucuaguccaggauuuuccauuuuuuauuggguaaaaguaguggagaggaagaccucuuuugucagugaacaaaucaaggagccaacuaugaaaauaaggggcagauaauagcauaaaaagacagacccuuaauugauacaaagcuuaaucaauuuuauauuaauacuuaacucacuguucucaaauuuaucuaauaaauauuagauagaauaaaaucauugaauacauaaaacaaaguauacuuuuauauuuguuuuucuacuuguccauucuagccaaagggaaauucuuaguucuuacaaugugcuauuuuguuuuguauucugaacaaauuuucauuuaaacauugagaaagugaaaauguaugcaggaagaagcucacgauuuccauuguuguuaauaccaauaauuguaucacuagucaaagucacaaucacuugugugaauuuuuugaaccugaaaugcaacaggaauuuaaacuagauuaagcuggaaugaauaguagguucuugauuuggguaccugacuuguagcuaauucaaccauaauuugaaucuagauuaauaaggcauuaagauuaaaauaugaguuauauuccaugucaucacaguuuauguuuaucauaauugaaauguucccuuuuuuaauuacuugugauauuacauacauugaacuuuuugaaguuucaccaacaacaaaaaauugacauucagguacaguagugaucucucuugauaugggggauacauuucuguuuauaaaaugguuauugagauaacuucaaauuaaaagcauauuugauagauacgcuacugcucaugugugggagccuggaauuuggaagucauucuaugcauuguaaauggaguuguaaauguuaagcuguguguaugcacaugcauccagacauccacacaaauauaugggcaacuguaacccaaguugggugacguauaaugaagcaaacaugaacucugaguaaucagaaaaaucuuaaaagagaugggaagaaauccauuuuuuuuuaguuagugauaauaaauuuuaaaacuaauaaaauauuuuaaacucagauauauuuuuauucauuuagguauuaaaauuaauaaaaugaaauagagcuuuuauuuguucucaggcaagucuguuaccuaaaaucugcaaaacauaauugggucgaaguuaaaaaucuagcuuguuuggaccauaacauacauguagaggaaaauauuuccucaaauuuaagagaaacuaauuuuccuaacuaaauuugugggaguuacuuuguugacauuuacuccgaaaccagccauugguaagcauugucuuguguuuaucuuuacuuuuauauguguucauuuaaauaggccuucuccaugagcuuccauugccauaacuauuauauuacaucacaaagcuuuguuauguauuuagaaaaugcauguauauuuguacauuugaaauuuucuggguuuuuuguuuuguuuuuuuuuuaacuuagaaaugaggguggccaggugugguggcuuaugccuguaaucccagcacucugggaggcugaggcagauggaccacuugaggucaguucaagaccagccuggccaacauggugaaaccccgucucuuccaaaaguacaaaaauuagcccggcaugguggcaugugccuguagucccacccgcuuggacagcugaggcaggagaauagcuugaaccugggagguggagguugcagugagccgagauugugccacugcacuccagccugggugacagaacaagacuccaucucaaaaaaaaaaaaaaaaaaaaaaaaucaacauacugccucugacucuccacccuagugauuucaaaugaaaauauuauuuauuucacuuuagucuuuauuccauuugacugauaaaauugcuuggauuuuuucugacuuuaccugcacauuugggggauagacagagaaacagaaaagauccuguauagcaugcaagcauuuagguguccuucagauguuguuauagccagguauuuuucccugaauggucagaauaaccuggcauauaucuguccagagaaaauccuaucaccuaggcuucaggaagguuaagugcuaauugauaugaagagaauuuuuaaaauguaauagaaguuuaaggaggaacuaggcugucuguaccaaugggacauauugucugugcuacuuuauguuauuauuuauguuguuugaauauguuuuauugcaacucuuuuuuguuguuuuuuugauggagucucgcucugucacccaggcuggagugcaguggcgcgaucuaggcucacugcaagcuccaccucccagguucacgccauucuccugucucagccucccaaguagcugggacuacaggcgccugccaccacgcccagcuaauuuuuuuuuuuuuuuuuuaguagagacgggguuucacuguuagcuaggauggucucgauuuccugaccuugugauccacccgccucggucuuccaaagugcugggauugcaggcgucagccaccgcgcccggccuuguugcaacucuuaaaaaaaaaaaaaaagcugggcgcaguggcuuaugccuguaauccuagcacuuugggaggacaaggcggguggaucacgaggucauauugagaccauccugcccaacauggugaaacgucaucucuacuaagaauauaaaaguuagcugggugugguggugcacgccuguaguuccaguuacucaggaggcugaggcaggagaaucgcuugaaccugggagguggagguugcagugagcugagaucgugccacugcacuccagccuggcgacagagcgagacuccgucucaaaaaaaauuaaaaaauaaaaaaugaaaaggauuacgccuguaaucccagcacuuggggaagcugaggcggguggaucacgaggucaggagauuuagaccauccuggucaacauggugaaaccccgucucuacuaaaauacaaaaaauuauccaggcgugcuggcgcgugccuguagucccagcuacuugggaggcugaagcaggagaaucacuugagccugggagguggagguuacagugagccaagauggcgccacuacacuccagccuggcaacagagcaucugaaacaaaacaaaacauaacaggcugagcgcaguggcucacgccuguaaucccagcacuuugggaggccaaggcaggagaauugcuugagcucaggaguucaagaccagccuagcuaacauggcaaaaccugucucuacuaaaaaaaguacaaaaauuagccaggcgcgguggcaugcgccuguaaucccaguuacucgggaggcugaggcacgaaaaucgcuugaacccgggaggcagagguugcagugagccgaggucauggcacuguacucuccagccugggcaacacaaggagacccugucucaaaaaagcaaaaacaaaaacaaaaaacuccaauagcaauaucuuacaucucuguaaacccuaggccuaguacaguaucgugacaauagugggcauauaauaaauauuuguugaugaugaugaugguaaaagcugcaauauuaaguaaauucagugagagaauucaugaaaauugcaaguaucuagugaauauuggaaguaggauaucuggggcauuagagugagaagagaggauggagauaaauaggaacaugaaaaagaagagaauacuauauauaagagaaugaguugcuucuugauuuugauguuacguauuuuauuucccuuugugucacuuaaaaagugggguacaauuuaauaugcgacaggguacacaaaaugcagccuuaagauguuaacuuucaagucucaguuuuauuuguggcuugcgaauguaggauggcaucucauuuuuuagauuauauuaucugugacauccuuuagcugacuucuuuuugcuugccagucuuaggccugaaugucugacuugaaauauuucaagaaguugggaaugguagaagggauguguaugaaauucugagaguauggcaauagaugagguacccugagugaucuuaaaccaauuacuaauacacuuugaaucauguaucagcuucugaagauguggaaagggaguagaagaaucgccuuaaaauuaaccuuaaagagaauugggcugggcaccaugccucauaccuauaauuccagcacuuugggaggccaaggugggcagaucccuugaggccaggaguucaagaccagccugggcaacauggcaaaaccccuucucuaccaaaaauacaaaaauuagccgggugugguggguacgugccuguagucccagcuacucgggaggcugagguagcagaaucccuugaaccuaggagguggagauugcagugagucaagaucgcgccauugcacuucagccugggugacagaaugagaccuuguuuccaaaaaaaaaaagagacacagagagagaauugauggcuauagccaagugccucaauccaucaguuacuuacugaaagucauuucugaggggguuuugggauguuucuuauuagugaaagggaacaagaccuagauaacaugcaugaaauuuuuuuaaaugaauauuaaauuuuauaauagaaauuuugguagaaaauagagaagauaaauaaaacauuuuagcauauguacauccuaucccuagauucacagauacauuauuuuuucuguuggcauauguuuugugaucuacuuuuucacuuacugugugguuacuacuuccccaugucguuaaauagucauauauaauuuuuaaugguugcauagacuuuguucuagccagaagauguacugugguuugaccaauccccucuuauagggcauuuagguuauuuugaguauuuucuaucaauacagcauuggacaucugcauagauaaaucugucgacauaauucugauuauuuccuuaggagagagugcuaaaaaaaaaaaaaggacuugcuggucaaacaauguacauauuuuuaaaggcuauugauagauauagcuaaauuccucucuaggaauucuauauuaagauaauaauuauuucaccaggcaugguggcucaugccuguaaucccaguacuuugagaggcugaggugagaggaucgcuugaggccaggaguucaagaucccaucucuacaaaaaguaaaaaaaaaaauagccaggcauggugguacgcacacauagucacagcuacucaggaggcugaggcaggaagaucgcuugagccuaggaguuugagguuacagugagcuaugaucaugucacuuuacuccaaacuuggugacagagugagacccugucucaaaauaaaaaagauucuuaaaaagaaagauaacuguuagaauucuaacuguagucaaauugugucuuacaccauucugacuuaacucuacagucaauaguaugaaacucagcucuguaaauggggaggaaacggaagguuauuaguaacucacgaaguacauaguauccuuucagcuagaaaaggggagcuuaaggaguacuauugcaaauuaccccaauguucuaauuguucaaaugcaaauuuuuguugauuaguuuuuauuaacaugagauagugcuguguacccuauaugaaauauauuaugugauuuuguuguaguguuuauauuaaaaugaaauuaugugauuugaauacugaauuuuuugcauauugaaauguuuuccuuuuuuuacuuuuagccacauaaagaagaucccuaauagucauuucucaacaauuauauagucaacugauguaacaaugguacuaauauugggacgcagacuaaacagagaggaucuuggggugcgugauuccccagcaacuaagcgaaaaguuuuugaaauggaccccaaaucucugacaggucaugaguuuuuugacuucucuucaggaucaucccaugccgaaaacauacuccagauauuuaaugaauuucgugauagccgcuuauucacagauguuaucauuuguguggaaggaaaagaauuuccuugccauagagcugugcucucagccuguagcagcuacuucagagcuauguuuuguaaugaccacagggaaagccgagaaauguugguugagaucaaugguauuuuagcugaagcuauggaauguuuuuugcaguauguuuauacuggaaaggugaagaucacuacagagaauguacaguaucucuuugagacaucaagccucuuucagauuaguguucuccgugaugcaugugccaaguucuuggaggagcaacuugauccuuguaauugcuuaggaauccagcgcuuugcugauacccauucacucaaaacacucuucacaaaaugcaaaaauuuugcguuacagacuuuugaggauguaucccagcacgaagaauuucuugagcuugacaaagaugaacuuauugauuauauuuguagugaugaacuuguuauugguaaagaggagaugguuuuugaagccgucaugcguugggucuaucgugccguugaucugagaagaccacuguuacacgagcuccugacacaugugagacucccucuguugcaucccaacuacuuuguucaaacaguugaaguggaccaauugauccagaauucuccugaguguuaucaguuguugcaugaagcaagacgguaccacauacuugggaaugaaaugauguccccaaggacuaggccacgcaggugagaagacuguuuucaaauauaguuaacaaaaguuuuuaauauaucuuuaaaccuccugaaugcaaucucaguguugucauuuauaugcacugucuaccuguggcuguauauaauuuuagauuuauuuuggauuauaugucacuagaaugucuuuccuagugaauucuagauucaacaguagcauuuuuuguuauuguuguuuugugcuaucaaacaguguagcaaagggucuuugcaacugugcauaucucaacauauuucuacuaauuucucuuaaccuuuguagggccccaaaccauuccacuuuucuuuccaaagagucuuuggauacaggguagcuaagauuuuaguaggcucucuuggacugccucuacuuauaaaaaaacaauuugcuccugggcacaggggcucacaccuauaaucccaguacuuugggaggccaagguggaggagcgcuugagcucaggaguucgagaccagccugggcaacauagcgagaccucaucgcuacuaaaaauaauuagccaggcaugguggcacggaccuguagucccaguuacucagaagguugaggugggaggacugcuugagcccaggaguuugaggaugcugugagccaugcucuuacugcucuccagccugggcaacagagugagacucugucucaaaaaaaaaagaaaaaaaaauguuugcacauccacagacuggccuuuguccuaacacagaagcaugaaauauagaggugaauuaaauaagcugguauacauugagugaauucugagauguaaaauccaggccucaaauauuacuuaauugucacaguuauuauauuuaaugucaaucucaauuuuaaaaaaucuuuuuucugaaugugaaaauuacaucaucauuauagagaauuuggaaaaugugugcuuaggggguagaaugcaguuaaauauuguagcauauuuguaucuucuuccaguauauuauuucuauaaaauacuuaucgauuuuaauucauaaacuauagaaaaauaaucuccaugccuuaauaguggaaggaauauuuauugugaauaagcaagaaaugcuuguuaugagaaauauuacaguaaauuauccuuuuaauccuuuuaauauuuuucuaacaaagcuaauguugguguugguuuuuuuuuaauugugguaaaaaacacauaacauaaacuuuacugucuuaaucauuuuuaauuauacauuucaguaauguuaaguauauuuacauuguugugaaacuaguauuuuuauuaguuuauuauugguuuauuauuaagccaucuccauuuuuucugugaauuuacuauagcauagcucauaaaccacauuuuuacuuaaauuuugacuaucauuguuucggaauguuaaaagucagcauacugugagauagcuuguuuuuaaaauuuauacuaguuugaauaauguauuaauuaagaaaacuaaacagcuucagagcugugugacuauuaguucuucgagaacuuucaugaacacacaguaucccucuaaagggaaaaucacuccuuuuuccaagacaaauaccccuguagcagacugaauggucugaggucagauguggcuaauaauacucagccugcauaucucauaggauuagaguaggaaccaaggguuauauguuguaaaaucaaaauaagacauugauuacuaauauuuauaaagacauaauuugaaugcaaucagauugcagccuaagggucccaucacuccuuugaagagauacuucuccuaacuuacuuaauuauuugauuuccaaaaauguauuuuauauccaauuuuuaagggaacaaaucuauuuccacagugaaacaucuauuuauaaauugcaguaucaccguucuuuaagagacaaguauaaaaaccaaacuauaguucuguugaauuugcagacucuuaaaaauacgauagcagauauuuauuuuaugugggcauuacaugaguaauccuuuauuuuauaacucugcuaucaccuucugucccuuacauuuaucuuucacuuaucuguuacugcauguuugcugugggaauuaggagacuggagagaccacugggugaaacagaaggauuuuauuuagguggccaccaacuuaguggauuaacaucuaaaggcugagcaaugaacaaagacagggcuugacuuuuauuuaugcugcugaaguggaguggcuagccaguggcgcaaaauuugcagggcggggaaaccaggcuugcagaagcagaacaaaggcaguuaauuauacugugacagguuuuugcaauuuaggcauguuuugugacuuugcuguguuacagagagaaaaacaggaacguauaaaaccuuugcaaacuuguaaaaauaguuacaaaacuaauuaaugagagcagaacaaagaaugaugguauggggagagaauuuuagggggagacugauaagaacuuguuuuucucauacuugcuuuuggaacccauuuuuugggggccuuugccugguuuugcagauaauguuauagcuccagcuggacuuuggauguugaucugcugaguugguggccgccuaaauaaauccuccuguuucacccagugaccucuccagucuccugauugccacaacauguuggcauuaaucacuaggaauuucauuaucugaacaauguguauuauuuguacagguucucaucuuucugagaaacuccaaacuucuuugaaagaggagugaugucuccacuucuucgacagcaguucauuccucugacuucugcuccagucacucuacugaaacuccucucaaucaggucaucacugaccuucuauuuguuauuugcuagccucucuucggucuuuauccagcuugagcucuuucgaauuugauauuauuaauugccuuauccaucuugaaauaccuccauuggcuucuggaaugccauucuccucuugguccuccuauuucuccaguugcucuuuuucaauuuaaugguucuuacuccuacaucuagucugaaauauuaucugccugauucacaucucuuugucuucccuuauguacuugccuaggugaccuuaucucaucuauuuucaugguuuuaauuaccaugcaugcuguugacuaccaaaccagcccagacuuuucucuuucauucauucauuuauauuucuuuuucaaauuuuauauaucuuauuuauuuuuuauugcauguauauauuucuuuuuaaauuuuuauauauguuuuuuaguugacugugcaucuuuuuaaaauaacaggcaaaauaacauuagcacauuuaaacuuaauaauaauaauucauauuaucuaauacgcaaucuguauucagacucccccagucuuccaaacuguucuuuaauaaaccuggauccaagcuaggauuagucauuacaucagguuauuucugugaaaucucuuuuacuucaaaacaguuucuuuuuuaugauucugacuugucaauggggaaguuguccagaaaaauauucuaccuuuuggaucagucucauugcuuccuuauggcaucauuuagcuguguuuccuggaaacuggaaguugguucuaugagcuucaguuagaugaauauaaguuaaauauuuauagcuagaauuaauccuauguaauguguauaauauauugcaucauauuaggagucacagcauaucuggguaucccaccauuagugaugcagagauuaacucugguuuagggugguggcagucugaucccuccaauguacgguuaaguuauaugcucuauaucagccaguguuccuuuaguaucuauucugugccaaguauuguccagagcucaacccauaauagaaauucucccuauauacccacgugucucuuaaaugacagagaaaucccgaaaaugcauuauauuaaaaacaguguggugguaguuucccagaaagaggacauaggccaauuuaagagcacgaaagcuuugauaaucugcccugccaguuguaaacccuuagguguguggaaaaaacaguagagacuaaucacagaaggaguaaagcuuagaaacaauggcuguaggccaggugugguagcucacaccuguaaucaagcacuuugggaggccaaggcauggggguugcuugagcccaggaguuuaagaccagucugggcaacauaaugacacccuguuccuacagaaaaaaaagaaaaaauuagcuaggcauuguagcauguaccuguagucccagcugcuugggagguugaggcaagaggaucacuugagccuaggaguuugggguuacagugagccaugagcaggccacugcauuccagccuggguggcagagcaauacccugacucaaaaaaauucuacuggccaggugcagugucucacaccuguaaucucagcacuuugggaggccgaggcgggcagaucacuaagucaggagauugagaccauccuggccaacauggugaaaccccaucucuacuaaaaugcaaaaaauuagcagacaugguggagcgugccuguagucccaucuacucgggaggcugaggaggcugaggcaggggaaucacuugaaccugggaggcagagauugcagugagccgagaucgcgccacuguacuccagccuggcaacagagagagacuccuuuaaaaaaaaauuauuauuaauuaaaauuuuaaaaauugacauucugcaaaaaugcugauauuauauaacugcacuacauccucugccuuuauucagagugcccuuagcaucuuuuuuuuuuuuuuuuuuuuuuuuucugagacagggucucacucuguuacucagacugguguguaguggugccaucauggcucacugagccuaggcucaggugauucucccaccuuagccucccaaguagcugggacuacagguguacaucaccaucccuggcuuauuuuuuguagaaaugggguuuccccauguugcucaggcuuguccugaacuccugggcucaagagauccucccuccuuggcuucccaaagugcuaggauuacaggcaugagccaccaugccaaaccacccguagcauucauaauuuccucucuuuccuccuuucuuccuucggcccucuuccugacuccccaacauaauuuugaaacuuguuucuaggucaaaaguuuaauauuaguauggaaaacauuugagguagaaaaaguucauauuaauacuuagaugcauguuugggcucagaaauacuuuugaacucuguagagaauuaauaugguagcuaacuuaaacaggucuuaaauuucaucuaauaaauacuugaguuaccuuuaugugccaucucaguaugcuaagugcuaggcuucaacccuuuucaucuggagaaaaguaacuuaccuuucugcuugugaugggccucugugccccaaccucaucccaauucaugaauaaacugauauuuacucuguggucccugacugauguuucacauuccugacuauuguuuaacaaucugauucugggccgggcgcaguggcucacgccuguaaucccagcucucagggaggcaagaggcgggaggauagcuugagcccaggaguucgagaccugccugggcaauauagcgagaccccguucuccagaaaaaggaaaaaaaaaaaaagacaaaaaaaaaauaagcguaacaaucugauucugaucucuaguacaccuaauuuccauuucuugccccugcuuuacuccaaauacugauuuccauauuucccauaccagccuaaauaucaaacuuuuaaacucaugauugcuugguagugugguucugaugcugcugcuuuugcauccuguccugauccacauccuuagcaccuaccauaaugauucccuggaaagagucauuuccccugauagaugcuaauuuuccauuuugguaggccugggcugccuacaaaaugagguucccaagaggaaacaaggauggcacuaaacugggcaagugucuucugauauauugaccauacauggcaaguuguucgugucuaugaaaaaaauugaugcccuuugccagacuccacugagcaacagacauagcuaagacuuaauaaguucaucauuuugagguuggaaucagccauuaaguacuugucucuucuuucugcuaucucuuaccugauaaucaguuacuauauagugaauauaggaaucuaauggccguaaugagggcaagccucaaguucuguugaaaacaaaugagaagaccaaggaguucuaaauauauuuuuccuuaagaaaugguguuugucauuauuuaauaaaucccuucauuccauauuuugcaggugauaaaacugaggcacaguuaacucacuugcuccuagucacaaagcuaguuagaaccacagccagggcuagaaguuaguguucugaauuccuauuccaaucccacugaagaauacuauucuccuauauuauaggaugaguagccuaccauuuauuguucauuguuuugaacucauugaauuguuugaauucauuguuuugaacucaaauauuuuuacauaaagaguauacauuguaaaucucccucuucuuaacccuucagagaaccauugauucugcuuucaaaggauaccuuuauuacuaguuuuuugaaccucuuuuagaaguauucuuuguauagcugggcaugguggcucacgccuguaauccuagcacuuugggaggccgaggugggcagaucaccugaggucuggaguucgagaccagccugaccaacauggugaaaccccgucucuacuaaaaauacaaaaauuagcuggguguggugguggacaccuguaaucacagcuacuugggaggcugaggcuggagaauugcuugaacccaggacucagagguugcagugagcugagaucgcaccauugcacucuagccuggaugacagagcgagacucugucucaaaaaaaaaaaaaaaauucuuugcauaguuguagaugaaugccucccuacuucuuuuaugcagauaguaggguacagcacucacaguucugcaccuugcauuucccacuuaacaguaucuuggaaacuguucuguaucaucacacauagaucucauuauuauuacuauuauagaacauuucaaacuuguucuuuugaaagagcuauaugguauccuauuuauggauauaccauaauuuauuuuauuuaaucaaucucuuuauggauauuuagguugcuucuaauucauuuuuuugccauugcaagugauacuuagugaauauucuuguacauuaucuuugcauacauacacuguuaauuuauaguuugaauuacuggaaguagacuugcucagucauaggauaugugcauuuuaaaucuuuacagauauuauaaaaauugccuuucaauuuauacuucaacaaaaauaugaaagugccuacuucugcacuccuuugccaauauaauuuguuuacauuaguuuuuguaaaucuuugcuacucugcaaagugaaagugguaucucauaauuuucauuuacauuuccuuccuuccucccauuuuuuuuuuucagguucucgcucuggucgcccaagcuggaguacagugacacagucguagcucacugcagccucaaucucacagacuccagcaaaccuccugccucagccucucucucgaguagcuggaacuacaggcaugggucaccaugcccugcuaauuauuauuuauuuuuuguagagacagagucucacuuuguugcucaugcuggucucaaacuccugggcucaagugauccucccaccuuggucucccaaagugugcauuuacuuuuuuaguguagaugauugagcaucuuuuccugaguuugaaagccauuuguagguuguugauuuuuuucugcaauccauugaacucuaauguauccaaauucugauugcaaauagaaacaaacucaccagcucaagcauaaaagggaaauuuauuaacaggauacaagaggccaggcacaguggcucacaccuaccuguaaucccagcaauuugggaggccgagauggguggaucacuugaggucaggaguucgagaccagccugaccaacauggugaaaccccgucucuauuaaaaauacaaaaauuagcugggcaugguggugcaugccuauaaucccagcugcugcagagacugaggcaggagaauggcuugaacccgggaagaggcagagauugcaagaucgugucacuguacuccagcuugagcaacagagugagacuccgucucaaggaagaaaaggauacgagaaucagugucuuguaggacguaagagcaaaaauucaauaagaccucaaagaagacuggaacaggcuacuaaaaagcuaucagaaaccaagcugugccuucucucuaccucuugccucugcuuuucucugcaugucugcaucauucccucccauuagucuggcagaauaauauauguggcagaaacacauagguuugggguugacauauuacaaguucagucagucagagagaaugaaucucuccuucucuuggggagacauaaucucugauguagccagacaacauuuuguggauauuuaccuauggucaugggagcagaaucacauagcagaaaugugaugacugaaaaucccauccugugcuagguugagcagaugcccaauagcaaccguuaauaguaaggugguggugguguuuuuuuuucuuuuguucuuucuuaacuugcagcaggguaggaaaggagcaauauguuaauuggagaaaauuuagagaaugggagaagcaaaaaaugcuaauuaacaaauuagcaaauuuucagcucgaagagguaacauuguaaaccuuuggcguuuuucuuucuuuuuuuuuuuuuuuuuugagacaaggucucccucugucacccagccuagagugcaguggcacgaucauggcuuguugcagcuuaagacuucccuggcucaagggauuuucccaccucagccuccugaguagcugggacuauaggcacgccaccaugccugacuaauuuuuguauuuuuuauagagacaggaucucacuguguugcuuaggcuggucucaaaccccugggcucaagugauccucccccuguuuuagccuaccaaaguauucucucuuuuuuucuguaugaauuuauuauuucauuuacaggguuguaaucuauuucauagucuguuuuuaccaguuaguauauggugucuuuccauaacaugaguauuccauaacccacccuucccaacauuuguuuuuaauuuucuaccauuaaguaagaugagcaucuuugguggcuacauauuuaagcaugucugugauuaguuucugaugauaaauucuuagauaauugccaauuuugaaaaguuggcauuuugcgucuuuugaucaauauagccauuuucauauagaagcaguccuaccuauugccauuucagguggaaagccuuaccacacaaauugauacuguguccucaccaaguuuaaaagaucuggccgggagccgcagcucacgccuguaauaccagcacuuugggaggccgaggcggguggaucaugaggucaggagaucgaaaccacguguuaggaggcuaacacagugaaacccugucucuacuaaaaauacaaaagcaauuagccgggcgugguggcgggcuccuguagucccagcuacuugggaggcugaggcaggagaauggcgugaacccgggaggcggagcuugcagugagccgagauugcgccaccgcacuccagccugggcgacagagcgagacuccgucucaaaaaaaaaaaaaaaaaaaaaaauucacuagaugugguggcaugugccuguagucccgacuaccugggaggcugaggugagaggcucacuucagccaggaguuggaguugcagugagccacaaucucgccacugcacuccagccuuggcaauagaguaagaccuugucucuauuugaaagaaaaacaaaaaaagaauuaaugaaauagagugacauggcauucacucucuagaaauagauuacauggguguccagaauuuuauuuaugcuauacuaucaucuuuccugccauuuuguuuuacuugccauuaucagcuggaguaaccuauuuccuuuaaggccauuagcucccugccugagauaaguauuucuccaagcucaagaaauaaugcuuuuauuggguuaacaguccgugaugagaacaucagauauaucuaauuaagcuaaaaaccauuugguugcaaauaggauauuuaauacaggcaaaacuacuagcuugcuaauccuuucagauagacacacauucuagcagacauugaaguuacccuuuauuuauugguacuaaauguuuuagcaauuagcuucucaugcuguuuucucuuucuguuccaaaguacaaaaacagauaacauauguuuauugggcuaagaagucuugaaaaaggcaagcgaguuuaagcaaagggaaaguauaaaccaaguaauguacaauaaggaaaggauaaaacaaaauccuaugauauauaaucauuacucuggauuuuauauuaagacagaagugauuuaacuucagugacuagcaguguuuguuuugauugauuaauaaauaagacuuugaggaauaucaccuuuuuugaggauuugucuuagauuuuaaguguguuuuaggaaauacuuauauggaaagaaugauagauaagucaguaguuauacuacuaaaguaucuggugcugugcucucuuuauuuuuaauacuuuuauuuuggaauuacuuggaaaauaguaaauauuacugauaauauuuagguccuucuguuaauguuuuacuaaauacuagguaaagguuauauaauuuccuggauuccuaaaaguacuuuuguuugcauguauagagaaaauucuuuucucccauauuuauuucugauuuuauaacggaaaaaguaugccuggcauagaauagguacgugauuugguuaguugacauaggucugaguaaauguagcuagaacagcucuguuaaaagagacacgccaauauugcuuguuuuuuccuacuguaauuguguaacagcacacugacuaaaauuacaaaucaguguccugauguggguuuuuuuuuccccucuauaaguaagagaagaaggauuguuggcauuuuucuuugugagacuuaacuuguagcaaccauaaaauguaacuauaaaacauuuucauuuagauuauauuugugaaaaauauaaaagcuaaagaauuuuaaaauuccuaaacuaucaauugaauuuuaugaacaaaaaauuguggauaagcuuuugguuauuccugucucuauuuuaaaucuaaaaaaugagagaagccagugauuaacagaaacauuagaauucuuuuagugguguuaaaugcuguuuuuugcauucuaaaaauagcucaggcucauuauugguuuggaaauuuguaaugauagaaauggggggagccaaacaauucagagacaacuaucuuuagcauuuugguauauucuuuccagauacauuuuuuagauaguauugaauaugccuaauguacaguuuuucaucuugcuuuucuccuuuaacauucuuguuauaaacuguuagccuuuuuagugauugcccaacauuuugaguuguauuaccuuaauuuacuugacuuuguauuuuaaaaacuaauuucugaacaaguacauauacauauuccuuuaaagggugcuuggauuauacuaugaauuaguuuuuuagaacuagcaagcugaugaaagagcaccauuuuccuacaguuagaaaaaaaugcauuaucuuaccuugugugguuaugcguaucugaaucacugcaaaacugcauuugaaagucauccuuaauauugccaggauucugauuggguuagauaggaucuuuggacuuuuuuacaauuuucaggucaaaaccaauagaaaaaaauagcaacagaaauuuucuguggaauaaugaugucacuagcuccccuauaaacguucucaaaguaaguaauuuccaggcuguaccguuuggcacaugcacagagaagaaacuuaacuguuuauaauagugcgugguuuguuuuuagaguuuuaagaaaaaaucuggaguauauuuuaauguaauauuauuauauuauuuauguacgcuaauaauuauuauuuuagguccacuggcuauucugaggugauaguugucguuggaggaugugagcgaguuggaggauuuaaucuuccauacacugagugcuacgauccuguaacaggagaauggaagucuuuggcuaagcuuccagaauuuaccaaaucagaguaugcagucugugcucuaaggaaugacauucuuguuucagguaaauauagaauuauuacaguagcuacuuuuaauuuggacacagcuucauuauuuuaaacaucaacagugucuuaaaauagugaaaugugaauacucccacuugaggaagaucaguuuacaacaaauaaaaccaagaaugacuuuuugcucuuaaaaacagguacaaggccaggcgcgguggcucacgccuguaaucccagcacuuugggaggccgaggcaagcagaucaccgggucaggagaucgagaccauccuggccaacauggugaaaccccaucucuacuaaaaaauacaaaaauuagccaggugugguagugggcaacuguagucccagcuacucaggaggcugaggcaggagaaucacuugaacucgggaggcggagauugcaguaagccgagaucgcgccacugcacuccagccuggugacaaagcaagacuccgccucaaaaacaaaaaacaaacaaaaagcaacaacaaaaaaaacacagguacaagaugacauggaaugauuuacaaaagauccaccagaagauaccuuuaaucaugucauauuuuaaaugcucucaaaugcauguagaauaugcuguaauuuuuuaaacuuuaccucuuugcaagucagaaguacucauagaauuaagcauuucuaauucacccauguuuucugaaauucuccgcaaaguuuaugaaauaagauuugcuuuaaaauucuuaacuugaacuucuuuaugauugugauauguuaccuuuaaaauuagaaaauaaaaugacagacuuguacaaaguauaacuauaguaucuaugaugggaagucuguuaauugguaaaauaauuucaccagcuuugcagauuauuauauauauuauccacacugagaaauauaacaauacauacuuuauuuuuuacaauaguaugcuuuuugaaaaaucggucaauuaaaaaaaaaaccuuuagaauaauaccauuauuugcgugcuucugaugucuuacucuuaaauuaacaaucuuuuauguuuguaaaauucacauccuauauuuaauuauuuuggaucuauaauuaucacuuaucaagauaacaauugguaaaguuuaaauuuucucuguagaacuauuuccauuaaauuucaagaggucuuuauuuauugagcugaauucucaaauucuugaauuagaugaaugaauuccauguuuucuuuaccuaugccuugguggcacagaucucuuggugacagcuauaucaugauaaauuaucgugugugcauuguuuugcauuucaagguggaagaaucaacagccgugaugucuggauuuauaacucacaguuaaauauuuggaucagaguugccucucucaauaaaggcagauggcgucacaaaauggcuguccuccuugguaaaguaagagaaaccacuuuuuauuacuauugcugguaccuuuccaaaguaaauaccacagcugaaucuuucauuuuacucacccucuggguauuuuggauucaaauuguauuuccuuccauuucuaaccucaauagauaaaccaaagauauaaacaauaugacacuguacuuuugaauggauauuuuguucuccuaauuuggaauucauggcaguguagcacauuucucuucucaugcaucacugaaguccaaaugccuaagaagcauuggaaaauaaaggaguuacaucaaauacagacaggccaaugucuaacccacgcaguuuguuuucuuuuuacuaacuuugcaagucaggcagagauauauuuguccaaagucauguauuuuaucuuuuuuauuuuaaauaaauauuaagauaaacucacuaacaggccaggcacguuggcucacgccuguaaucccagcacuuugggaggcugaggcgggcagaucaugaggucaggagaucgagaccauccuggccaauguggugaaaccccaucucuacuaaaaauacaaaaaauaagcugggguugguggcgggugccuguagucccagccacucaggagggugaggcaggagaaucgcuugaacccgggaggcggagguugcagugagccaagaucgcaccacugcacuccagccuggcaacagagcgagacuccaucucaaaaaaauaaaaauaaaaauaaaaaaacucacauuuuuaaagaaaaccuauuuuugacugcagcuaaugauuauuauaaacaauacauuauuuggguucuaaaccaucuacugucuguaggaaccugagaaucaaacuuuuuuuuuuuuuugagacaaggucucuuacucuauugcccaagcuggaguacaguggcauuaucuagcucacugcaacuucugccuccccagugcaagugauucuccugccucagacaccugaguagcugggauuacagguguucgccaccacaccuggcuaauuuuuauauuuuuaguagaggcaggguuucgccauguuggccaggcuggucuccaacuccugagcucgugauccucccaccucggccucccagagggcugggauuauaguuaugagccaccgcaccuagccaguuuccaaacuuuuuaaaagcaacuacagguggaguuuccaaaaugcuugggaccagaaguguuucugauuuuggauauuuuuuuuuucuuuuguuuuuagacagguucucacucuguugcccaggcuggaguacaguggugccaucacugcucacuacagccuugaccuccuggacccaaacuaucccuucuacgucagccucccaaguagccaaggccacagguguacaccacaaugccuagcuaauuuuguauuuuuuguagagauuggguuucuccacauugcccaggcugguguugaacuccugggcucaaaugaucugccugccucagccucccaaagugcugggauuacaggcaugagccacugcacugggccaaauauuuuggauuuuuuucauauuuuggaauauuuucauuauauucauugagcaucccaaaucaaaaaauccaagaucugaaauguuccaaugagcauuuccuuugagcauuaaugucaucacucauaaaguuucagaucuggaacauuuuggauuucagauuuuuuaagauuuggaaaguucaaccuguauauugucuuuuaaaaagucauaucuaauacaaaaauuuauuacauaacagaugaaaauacaacaguuguaccaaggauuaccuuggagucuuuagcuucucccugcccccaucuccaucugcuuguccaaaaccaccucaaauuaaugaacaacuaaaagcagcacacuugcuuucgcauaugucuuugacugaucuccuagcaccccuuucuaagaagauugcugucucauaggcccuccuauggagacaguuaaguaccaccaauaaaaaaacaaagcucuagcugaaacagaaauggugaccaggaacccuucuuggucagccucuuacuaguccuccuuccucucuuuccccacagggguuucuuaaaacuucuauacuaggccagucgugguggcucacaccuguaaucccagcacuuugggaggccaagguagguggaucacgaggucaagagaucgagaccauccuggccaacauggugaaacccugucuacuaaaaauacacaaauuagccgggcauggugguccgcaccgguagucccagcuacucgggaggcugaggcagaagaaucgcuucuggcggaguuugcagugagccaagauuuugccacugcagucagcguucuguuaggaaucuaauugcacagcaguaggugagcagccacugagcgagcuuuaccgccucaacuccaccuccugucagaucagcgcacauuagguucucauaggagcauggacagcacauaugagggauaucuagguuguggcugcuuaugagaaucuaaugccugaugaucugagguggaacaguuacauccccaaaccaucccauccccgaccagucccccaccagccccccacccagaccugugggaaaauugucuuccauuaaaccgcucccuggugccaaaaagguuggggacugcugcguagaauacuagagcuucucaaaacaguuuauauauuuuuauuuuuugagauagggucuugcuguguugcugaggcuguagugcagcagcacagucauggcucacugcagccuggacauccugggcucaagugauccuucuaccucagccucccuaguagcuaagacugcaggcacacaccaucacaccuaauuuugguauuuuuuguggagauaauguuuuauccuguugccugggcugguuucaaacuccuggguucaagccauccucuugcuucagccucccgaagugcugagauuacaggcaugagccaccaugcccagcucaaaacacaguuuaaaagcuguuaauuccuaacgaccuggaucuagugugcugcugcugucuacaaggccaaugaaauaaugaggaccuugagacagauuuacuggaaauaaaauauuaauagaaucuuuucuaaaaccauuugguuuguuaguacuuacuauauuauauauaguguuugaggcugugccucaagaaggacaaaauauuacuggaaaagaggggcuaaaauaauccagggguuggaaggagaugcugauacaaaggcaaaugaaaaguacugaugucucaaaaaccauguauguauugguaaacucaaauuuauuugacaaaauaguguacuugacuugaagauacccaaagcuuagaagcacuaaaucaauaaagaaaaggaaucauuccuaccuuacacagcaaguacucaauucauggaagucauuuugcuaaaauuacaauauagauuuaauucaagcuuauaaaacauacuuaaauuuauaaauacucuguuuaaggaaaccugggaugguuuagaauauagaaucuuaggggagcacuccccaguguaacuuagaagugugucuuaggcugcaauccucaagaaaaaauaaaaaauuaccgggugcgguggcucacgccuguaaucccagcacuuugggaggccgaggcaggcaaaucacaaggucaggaguucaagaccagccuggccaacauggugaaacccugucucuacaaaaauacaaaaaauuagcugggcauaguggcggacaccuguaaucccggcuacuugggaggcugaggcaggagaaucacuugagccugagaggcagaggcugcagugagcugccugcugcacuccagcccggugacagagugagacucugucaaaaaaaagaaaaggaaaaaaaucuuagaguaggaagggaugauggaauaauggagaauauuuaauauaacuuggucaucuuauaaauaaccccaaagagaucaagucacuucccaagauuacacaaaaaaugauaaagcagaggcaaaagcucagacuuuucuuaaucuagaggccuuuugucuugaugcucauggcauguauuauauuuuaauuuacacauguaggaauacguauuaaaguuuaauccucaaaauuaugccaugugauagauacuaugauugucuacauuuuaaaauugaggaaauauagccaagcaugguggcgggcaccuguaaucccagcuacucaggaggcugaggcaggagaaucccuugaagccaggaggcagacauugcagugagcugagaucacgccauugcacuccagccugggcaacaagagcgaaacuccgccucaaaaaaaaaauuauaaaauugaggaaauaaauuugagucuccaaaaggguagauaaauugcccuuacauuggauggcagagcuggugaucaaagccugugcccuuaauugcuacaucgugccacagguuccauacuccauauagcuguguggacuuuuguaaguuacuuaaccugucugagcugcauaguguuggggacacaaacucaccaacagauuauuuuaacauaaugugagaaaugcaugauagaaguggcauugaguacuguggaaauuugggggugcacagaaagauaaauuguggacaaauuugaaggacaaguuaugaaauguggccuugacccuuagacauucauuguugaaauauuaagaggaacugauaaaguauuuuaggaagaauaaucugugguuuagagagaacaagaguggaggccaggagguuauuugagaggaaugaaauguuguggacccucaagugggugauggcagcgggaaacguaaaggaagggguauaugugaaagaugcuguggaagaagacucagugggacuuaauaguuaauuagcuauggagggaagaguuaaugaugacaguccauuaagagaaaugugagcugggcgugauggcucacgccuguaaucccaacacuuugggaggcugaggcaggaggauggcuugagagugggagaauggcuugaggccgagaguuagagaccagccugggcaacagagggagacccugucucugugaaaaauaaaaauaaauuaguaggguguggugauacacaccugugguuucagcuacuugggaggcugaggugagaggauuacuugaaccucggagguugaggcuguagugagcugugaucaugccacugcacuccagccugagcaacagaaugagacccaucuccaaaaaaagaaaaagagagagagagaaacguggauguuaagcugcuggagagcuuuguuagguugaaaguucccuauauaaaccauggauuuuuugcauauaagccauuuaauaaauaucuuacugauugguucaccugucauauaaagauacuaauuugcccuaccuuucucuuauuugugaaaagaaaauguacauaaaagcucugugaacuuuaaaguucauuuugugucaaguacuuuucuagguauuguacggacuaaaagaaaggccugaccagcacucucauagucuaguaauucuuuccuaauauuuuaguuucacagcucuaauacuuuauaauaaucaaauauuucauuacccauaagugugaauauuuaagcuaaauuguaccauucucagugugagcaguauuacccccaagggggcaaagauuguuucuuagaagaugaaaaaaaauguacccuuucuuguguaaagaacagauauacauacauuaagguaaauagauacacaauuucucugugguauuacaauuuuauugagggaagacuauuaggaagaaaauaccuaaaaaggcuccguggauugugauggugguaggggaugaugauuuuuuaaaagguucagaaacucugagcuaaauauauugcaauuauauuuauuuagcaagggcauuuuaaagagaagagaucccuuaauucuuuagccaacuacuucaaaauucagacuuuugauaauuaagauuuuuccauguauuuuacauauagguauauguugucgguggcuaugaugggcaaaacagacuuagcagcguagaauguuaugauuccuuuucaaaucgauggacugaaguugcuccccuuaaggaagccgugaguucuccugcagugacuagcuguguaggcaaacuguuugugauugguggaggaccugaugauaauacuuguucugauaagguaagccaugcacuuuuaaagaaauuaccaauauuaaguacaagaagggaaauacagaaggcuuaucaaguagguagccaggucacauagugugaggggucuuuuaaaaauuuucugguacuauaugcuuuuggagaaaaacauugaauucuggguugcuaaagugagacucuaguauaucuaacaauuugcucuaacaaaugugauccaaucuuuuugaaaugagacuaucuguguagaaguuuucuacuaaauaaauuguucugagccuuugcugucaucuacaaaaucuaaaaacuauuuauacaaaacacaguugagaagugaauuagcaaaggguaagacauaguaacuaaauaugcugcuuccaacugggucauuuucuacauacuuuugaaguauuuuucagaaaaaaggaaaggaaaccuccuuaguguaaauagaggauggcucaaaguuguuccgguucaguaaacuucugggacgaaagaauaugugcuauccugacaucucaggaaauguuuauucuggaaaaaagcaucuaaugccuagcugguuuagcacuguuaacugaauuuugucagucuauuaauucuuuuucuaaauucaguuuaaaauaaugugaucaaauguuacuuauuuagaauuuguuauuucagaauuugugauaauucagagcauacugauugaauugagguuuacuuguuuucuuuugaagaaaggacucccuaaaagcauuaagaaguuauauucagaugugaggcauaguuauccuacauaacacaauugugaaaagauuuagacuguuaauuuuaguggacaaaccugguggccauucauucuagaaacaaucuguguguuugguacucuauucugcuugauaguaauaaauuugcauuuuauuugagaauguucguaauucagacauuucacuaucaggcuaaccucucuuaauucucugaauuaauaggauuuuauuuuaaauaauguuuguagguauugguagauucuuuauuaaguacauuuccauuuuuguuuagaaauuuuaauuauauauuuuuauauguuauuagguucaaucuuaugauccagaaaccaauucuuggcuacuucgugcagcuaucccaauugccaaaagguguauaacagcuguaucccuaaacaaccugaucuauguugccgguggacugaccaaggcaauauacuguuacgauccaguugaagauuacuggaugcacguacagaauacauucagccgucagguaauaacauaaagcaguacaaaagaaaaauaaaucuaagagggaccaaguacauaaucauuauuaauacacuggaauuucaauuuuaaaauauuucaggcugggcgugguggcucacgccuguaaucccagcacuuugggaggccgagguggauagaucacuugaggucaggaguucaagaccagccuggcuaauauggugaaaccccgucucuacuaaaaaauuauggccaggcguggugguucaugccuguaaucccagcacuuugggaggcugaggcaggccaaucaccugaggucgggaguucgagaccagccugaccaacauggagaaaccccgucucugcuaaaaauacaaaauuagcugggcgugguggcgcauugccuguaaucccagcuacuagggaggcugcggcaggagaauugcuugaacccgggagguggaggucgcggugagccgagaucgagccauugcacuccagccuggacagcaagagcgaaacuccgucucaaaaauaaauaaauaaauaaaaauaaaauaaaauaaaauaaaacaaaauaaaauaaaaaauuagcuggguuugguggcacacgccuguaaucccagcugcucaggagguugaggcgggagaaucacuugaaucugggaggcagagguugcagugagccgagaucaugccacuugcacuccagccugggcaacagagugagacuccgucucaaaaaaguaaauaaauaaguaaaauaaaauauuucauguuugcuugaauuauuuuauauauuuuucaaaacuccacauaaagcauauggcaaccuguuuugaacuccuuccaaggggucauuuuauugaaauaacuuccuuuuuaccaucccauggagaaguaucuguuacacuugggcuguucuuuuuuuuuucucuugacuuuuuucacaauccuacuccaguauuuauccccucucuuucauauuucagaagagaggaauguucccaaacuuguuguuucuuugguuagaggcugggaaaucuguuauuucuguuguaaaggaaauggcugugcucaccuuucuuucauccauguauucuaaccggagcccuacucccuacccacacugccaccucccaaaaggccuuuuccccaccuuuugauucauggcuccuuuuccuuccacccccaaaaugcuugaugguucugaugcugaaaaucuggcucuacacauaccacucuagagauguacucucaaaggucacugcuaauaaucuccucacucuuguucauacucucuuguuuuucuacccaguccuuaaauauguuccuugagccuguccucuguccucuucccaguuuauacucuuuccugaaucaucucauuuacugcucagcacugaugucuuccaagucuguaucgccaucaaagccucucuccuguguuccaaacucaaauuucuaacugccuauuugauauuuuauuugauauuuuacauggguauuucaagauuuuaaauuucaaauagaacucaccuucuuccccaaaccuguuuuuucuauauuuccaauuaaccuagaaacuuaauuuauuagauuaucuuuuucuucucuuaaauugaauuaaucuagccuaucaguucuccuauuuuuuccauuccuauuguuucuauuuuuguucaaguucuuaccaaguuuuaccuaaacaaacaaaaauacucuaauuagucuuccuuucucuaauagcuugucuugcuagcucauuuagcaucaauuuucuuucuuucuuucuuucuuucuuucuuucuuucuuucuuucuuucuuucuuucuuuccuuucuuccuuccuuccuucccuucuuuccuucuuuucuuuccuuccuuccuuccuuucuuucuuucuuuuuuugagacggaguuucacucuugucacccaggcugaagugcaauggcgcgaucuccacacacugcaaacuccgccuccuggguucaagugauucuccugccucagccucccgaguagcuggaauuacaggcgcccaccaccaagcccagcuaauuuuuuguacuuuuaguagaaacgggguuucacuauguugaccaggcuggucucaaacuccugaccuugugauccaccugccucagccucccaaagugcugggauuacaggcaugagccaccaugcccagccuauuauuuuucaauaaaucuacuuauugucucuucuuugauuggaaaccuauuaaauaaaauccaaaacuuuuaccacuucauucuagaccuucuauugccugaccuucauuugaccuuucagcuucacauucuauaacuuuaccucagguaccuuaaguaucugucauuuguagucucuaaacagaucauaaauguucuugcccugguucaugcugucuucuuauccuguaaugccuguuuuaccuucucuacuuguaauucuacuuaucuuucaaggaccacuucaguacaacagaguuuaacuggggcagaauggaucuauuuugcuuucugaucuguuaaagcacucauaccucuuauggcaauuguauauucccuuauggguauaaauguuuauuuccuauacuagaauuuagucuucuugaggacacuauuucuucuaacucaucuuguauguaucuugcauuuauuucugcauaguaaauauauauauauugaauaaguaaacaaaugaggaaguaccagagggacuuaauuuuaagauaaucuuauuugcaagauacauuagagauacagcauagauuauaaggauagugaauaggguuugaauauaaaaccacuuuucuaaaguuguugacauugagguauagucuccaauuaguaauauauaugcaguaacauugccccaguuaaugaaagggacauaauaggcacuucagcuccaugguacagaaugaguauuacguuuucucccucucauaucacauguaaguaaaaauaaaucacauuucuccagcucagggaccuccccuggaaaaccauucuccagcccuacagaagcgacaguguacccuacuugcaugagaauccucauguggucaaguauugagacuuauuucuaauuuuuaaaaaaucuaagcugcuuuuuauugguuuauuucagugaagauuguaaagaaugaugcauuuuuauuaagaauuacugcucaagcugggugcaguggcucaugcauauaaucccagcaccuugggaagcugaggcaggaggaucaccugaggccaagaguuagggaccagccugggugacacagugagacccugucucaaaaaaaauuuaaaaaaaaaagaaagaaaaaagaaaaagaauuaccauuuauucggaacuuugcuauauuguauaaaacgauaacaguuuaggaagauaauugccaguauguagcauauugcagggcauacaugaauauuuuuuaacuagguuauugagauaaaacugagaaaaaaauuaauaauaggacacacauggcacauuuucucuaauuaaacaacauucauugacuuuagaaauuuaaagaaaauaaacauuuggaucagaaguauauuaagucuaacaaagacaaauaauugaaguucaaaucuaguacugggauuuaggugauuauuuucucuccucuguuuauuguuaccaccaaugcuacuaaauacaucuaugcacacauugaucucggcucacugcaaccuccgccucccggguucaagugauucuccugccucagucucccaaguagcugggauuacaggcgcaugccaccacacccagcuaauuuuuguauuuuuaguggagacaggguuuugccauguuggucaggcuggucuugaacucuugaccuuaggugauccgccugccucggccucccaaagugcugggauuacaggcaugagccacggcaccuggccuuaugcacauguuauugauagguaauuuuugagccgugugugauuguuuacccuuuuaaugccaaccgaugaaaaaggauaaaucaaacuaauuucauuguauacaguuaaaugaacccaauacuguugcuuuuuaaaaugcuuagaauauuaaaugcaaaaaagagcugaaaaaaaugaggucuuuauuuuuuauaguccuaauggacccugccuauuucucuguuuguccuucaccauuuccacgccucuucugacuuugcauaauuccuaaaaacacagcuuauuauucaaaacauauuuugcuuuuuaaccugugucaggaacauccuuuaaaaaaaauugugggauuuuuuaaaaagucagugaugaagacuuuuuuucucucucuucaguagaccagguauuuaaaauaccauuaaagauuagaauaauuaaaugaaaucugauucuuuuugucuauuguugacaguuuaacauuuuaagcauacaaaaauaacgagaggguuuuuugguuuuuuuuuuuuuucuuugcaauguuaggaucauguuucguuucagucuuuaaaaauaacauuaaaacuuuauauauugauaaauuauuguuccuacuagcugcccuuacuccugaaugaagaguaaguuuuucauacaguauaaacaaacagaguaaaugguauuuuacuagcaugaaauaagcuauuauaucggauagagguaauuuccugauaugaauacuugguuucaagguucuuugcuuuauuuaacucugagcauuauuaucugaaaugguauuaauuaccagaccauguaauuauauauuguuuuagaaucauccucaaaauaacuagagguucaauagugggaacuagcuuguaccugaaaacuaagguuuuuguuuguuuuuauuauauucagaacuugaagaauuuauagaaagcgcuuauugugcuuuaaaugaaaaauauuagaguuuguuccauaauuggugcaauucaugggggugugguauucugaauuaaagugucuuucacuauaugauaauaggcuaagucauucugggugucuauaaauucuaauauaggcauuuuuaaguacucacaaauucuuucagaccuaaagauaguauccuucuauuauauaaagccaccaagauuuaauuucuucuauaagagcaaaauuuauauaaagcaaauuuggucaaguaaaaaugcuuauugaacucauugguagaaacuauuucauuguugguuauguggaaccaggauaauaaggugcaauaacucucugaauuaaagugaaacuuuaauuggaaauggaagaauaucuggccugcaguauaaccagaugcauguaauagugaaucaguuguuaauguaggguuuuuuguuuguuuguuuguuuauuuuuuuugagacggaguuucgcucuuaucacccagacuggagugcaguggcacaaccucagcucccugcaaccuccgccucccggguucaagcaauucuccugccucagccucccgaguaguagggauuacaagcaccccccaccacguccagcuaauuuuuuguauuuuuaguagagaugguguuucacuguguugaccagacuggucucgaacucuugaucucaagugauccaccugccucggccucccaaagugcugggauuacaggcaugagccaccaugcccagccagguuuuguuuuugaagaaucacucucauccuugcaagaauauuuguuuuauauaguaacuguguuauugacagagaauaauaaaauuuagcuuagaaucccauugugugggaaguuaacuguaagauguuauuugagacauuucuauggcccagccaaggcuccuaauaacaguguuuuguuaacuuaguuauaaauuuuuuccucauucauucauucaauuuuuggguaaucccauauaaugaauauuguuccuacuccuuggucauguaaccgccacuuucuauaauaaccuuccuguaauaggagaagcaagccaggcucuuuaaagaugcuuuugcuuaacuaccauuaaguuaaaacccuuuuaucaguccacauccuaccucccacaucuuggccccaauuacuaacauauaaucuuuuuuuuuuuuaacuuuuauuuuaaguucaggggcacaagugcagguuuguuacauagguacacugugucauggggguuuguuguacagauuguuucaucauucaguucuuaagcccuaguacccauuaauuuuccugauccucuuccucccccaacucugcaccuucugaaaggcccguguguguguuguuccccucuaugugucccuguguugucaucauuuggcucccacuuauaagugagaacaugcaguauuugguuuucuguuccuguguaaguuugcuaaggguaauggccuccagcuccauccacgucccuacaaaggacaugaucucguuauuucuuguggcugcuacugacauagcaucuaucuugaaauucauuucauucaugcaaaguuguccagcgcuuacacagaacacagagagcagaguugggccaaaggaccuuagcuuuuaucaugucucccuuuuuuuugacugugcuaaagcauuauuuugcuuuucuguuuguuaccaaauccuuuaucuucaaugguuaauuuuuuguuuauauauuugguuaaacaggaaaacugugguaugucuguguguaaugguaaaauauauauccugggcggaagacgggaaaauggagaagccacagacacuauucucuguuaugauccugcaacaaguaucaucacagggguagcugcaaugcccaggccaguguccuaucauggcugugugacuauucauagauacaaugagaaaugcuuuaaacucugaagacaggauaccucaccgaagaagccacacugauccaagaugggagguuuuaaaaacucuacagugggaacuucacauaucuccuuugugccauaugcaaaaaauaguaaaaauaauaauuuggugccuuucuccucaaaauaucaaucuuucaaacuauaauaaagccuuuccuauaauugaaaaaaaaaacuuuuuuguuaaagguaauggugguuguuacuuggccuuugaagaguguaccuuuguaaguauuuguaagaagucuaugugaauuaggaaaugucugucugcauaccuuuuaggagcgugugaauggugucuucacuuauuauguauguuuaucuguauguauauuccuuauuuugucauauauguagagaaaauugcaugacuugaggcaucauuuagguugaagaaguuaaugcuuaggaugcauucuaggagaaaaaaucaguuuuaaaaaccuuuguuguuaacaaaguauauccagauugguuaauuuuauugaaggguuuuuuucuguaauugauaaaaauguaaugacaacaauucaggcaucauaaaauacugaacuauugugacuuuauucuuagaauugcugucuuacauuaaacauguuuuuagggggaaguuagguaggagauagaaaaauaagugccccuacaagggggauuaaaauuacaaguuaauuccuaagagaaaaauggaauggccuuugaaggaaaaaugacccacuauggcucucaaaguuuuuaugcaucaucucuucaauccucuaagaaagccucuuuucuuaacuugauaaagcaguggaaacccauuuugcaauauuguuuugugaaaaacagggacagacagccagguacagagacucacaccuguacucccaacuacucagcaggcuggggcaggaggauugcuugagcccaggagucugaggcuacagugagcuaugaacgcacacggcacccuagccugggcaacagguugcgacacugucucaagagaaaagaaaaagaaaaauagggauagguuuuccuuccuagcccaguagaguuugaccucauuaguauggugcuuugggugaggaccucuuccuugauuaucccacuuucuagugaacagcuaaaauuccugagagucucuacuguuaagguaccuuuaauaggauaaagcagggaccaccuaucucaguggguccauuuuucuuuuaaaauuaguuaucugaaaaaacuuagcaguaguucccaucuuuaagguaagucuuucauuugguccccauuguguaaaauacuaaucaacauuuucaagcuucuguacaacagacugcuuuugucuagauuucucaacuccacuuuauaaagcuuaucaguuuucagagaggaaugugaauuuuuuuucuaaugcaaauaaauggauauggcaggaacuacagcauaagugauuauugugauucuggguggacggauauaauuuacaacauuuagggauguucuagguagccugcuguaguuugacuuccagucacuguugucuuucacauuauaauuuguauauuucuugugauagaagggaugaugcaaauauguaauuaaagugucaccagauuucuguuaaaaccaagguugaaauaaaaagccuaacauugguaagcuacauuguuuucucauuuuagaaugauucagagauuucagauagacauuuuuuaaacuuuaaugcuuagcuagaaucuacauucugaggaaaacucuaaaaaacuuaaaaauuuuuagggaauuuuuauuuuucaaaucauaauuuuaaaaugauagauaccauuuugugauaacaacaauucagaaaacaauuuucuauccucuuaguugaaagaauguagguacaguuuggauacuuguacuuuaauuuuagaguaaacaucugcauuauacucuuauagauaauagaauuauuuaguuaagaaauucuuuacaguaaaugagauaaugugugaaaaaguauuuuguaaaugcugaggauucuacaaaugauaguuguuauuuucauguguauuuguaagaucauguccauuucaugaauauaggacuucacauaaaaaaagacuuucucaagacaacuuuauauucuaguauuuuucuguuguaaaaaguauuaacuauuuacuuuuauuuuguuauacauuuauuuuaauauccauguguuuauuauaguaaauuugaaaugaaauccugaaaaacagaauuuuuuuaaacacagaccucacaccaauauuaauuuuuucucuacauaauuuaaaacuacauaaauuaaguacuuaaaauuuauauugaaggccaccaagaacuuagguugaaucuuagaaaauuuaaauaacuauuuuuaaaguuacccaacuuaauauuuuaauuuuuuaauauuuaucuuccuuuacuaauucuugauaaauaauagcauuagacuugauaaaauaaaaaagaauuuuagaguagaauuaauauaucaaaagggguauaucaaccaaauuggugucagauuguauucauucucucaucacauaaagauuuuucuuuugauaggugaugcucauaugaaccuuugguuuagaaucuauauauguacauguguauguauguagauaguaugguuguauacacacauauauaccaaacaccaugaauuuuagcagucugugaugaucagcaaaaaagcacauaaaguaaaaauuaguugaccaugcuaaauucaauucuggaauuuuuuuuuauuugggcauuucuagaacuuuuuacauuugaaaguacaugaugaguauuaguaacgaugacuuauguauaaucagaaucuuuaugacaauuuaguuuuacaaggucagaagagaugaguuugcuaaacccagcugugauaccucaguuggaaagggaauucaaagguaugcuuuguagaacagaaaaguauaguuuuuuuuucaugaacuuuaaucauuuucuguuuuuccucuaugugagucagcuacaaaaguggucuaauuuuuacaacaguagaacuuccuccuuuucuacuguaaucuucccacugacuuuacugcacagguaugaaauacuaguguauuggaucuucaguaaccuuuuuauuuccuagaugauugaaauauagguauuuacuccauuuaaaccaggugauaagaugauguaaauacucagggaggguauuaacuuguuacuuuugcucguuugggguguaaagugccaugacugaauaaucuucaauucaugauucuagaguaaguuuaauuuggaaaaaggggcuucacacaugguggugguugaacauugauucuuuuauacuuaaaaagaugaaaauguuuuguggacugauacauuuuaucuuacugaauaugaauuguuuauguaucucuacugucaaauagccuuuuugaaacucaggaaagacaaagguucaauuacaccacuuuugucaauaagcaaaccagguauuuuuuuuuucuccuguugucuggauauggcaauagauuuuuuaaauugcugugagaacccauauaugaaaagagaggaguugaauugugugugccuuuuaugucuugagauuuauauguggaaaagacgacaucuacuucaaacuguauuuuuuucguuuuuuuuuuuuuuuggggaaggggggagaacggggucuugcucugucgcccaggcuggagugcaguggcgcgaucucagcugacugcaaccuccaccucccggguucaagggauucugccucagccucccgaguagcugagaccacaggugcgugccaccacacccggcuaauuuuuuuguauuuuuaguagagacgggguuuaguagagacggaucacuccugaccacgugauccgcccaccucggccucccaaagugcugggauuacaggcgugagccaccacccccggccuguauuuucagagaggagagcuugguguuuuuguggugccaagugguaagauaaugucucuuugaggcuuccuauggacugccuuuauuuuaguaaacucaagacaccaguuaaccucaacagaguuuuggccuuauuagaauuuguugugcaucuuauugaaagccagguuuacaucaccucaccccauuauucuuuuuaguuaaauaaauuuaccaugccaaguaaccagaauggagcaaauugguugaucuuuaaggcaguagguuugacuagcuagcuaucauuauugucacaucuaaugcuaggcaccagaaaccauuugagccaggagugugaaugaauaauuccagagacacuuuagacauuuuuuaauguuuuauaugaacauuuuacauuugugugauugccuuagauauuaaauuuuccuagugcugauaaaaacagcaacauucauaacuuauuuuauauauuguuccaaagaaaagaauuuguuuuaaugguuucaaaauaacugcaccugaauuuguuuaugugccuuaaguucucuagugcuauuucaacuuuuuuuucaaucuaaaugaagcuuaccuuagauaagguucauauuuguuuccuauagaguaaauaaacuuccccuucuuaaauuguguaauaagcaccaacgugugguugcuuggcagaaugagaauguuaagggagauuguuggauguuuggaguuucauuauauuuuuuguuuuuauuuuuugauaccuaggugcuuuuuaaaauauucagacaaauaucuaucuuacauugauuaaacccguguaaauucauuugcaguaucuacaucgaaugucaaaaaaguauacuuauuuuuguuccauacuuauguacaauuuuuucccucuucaggcuuuuucauuuaccuuuuugaaaaagcacuuacucuccccuucccuaucaccccucccccaagguuucuuuauuuaaauuuuuauugagaguuguuggagcucuaagacaauacaaauuuagaguugaacaaaaguauaaucugcuuuacaacuaguauagaccuaaggucauuugcuuucaauuagaggcuccagagucuucauaguggaaagaaugcuuuguauuuaauuguucuuaguuaaguuguagcacgugaauacuuacuuacauguuuuguuuaaauauacuucuugcauaguuuaauuuuuuaaaaguuguaucuaauaaaaugucuuuuaaccauuauuacuugacuauaugguuguauuaaauuuuguuuacgaa

SEQ ID NO: 192616 - RNA, 48894 nt, Homo sapiens
uucguaaacaaaauuuaauacaaccauauagucaaguaauaaugguuaaaagacauuuuauuagauacaacuuuuaaaaaauuaaacuaugcaagaaguauauuuaaacaaaacauguaaguaaguauucacgugcuacaacuuaacuaagaacaauuaaauacaaagcauucuuuccacuaugaagacucuggagccucuaauugaaagcaaaugaccuuaggucuauacuaguuguaaagcagauuauacuuuuguucaacucuaaauuuguauugucuuagagcuccaacaacucucaauaaaaauuuaaauaaagaaaccuugggggaggggugauagggaaggggagaguaagugcuuuuucaaaaagguaaaugaaaaagccugaagagggaaaaaauuguacauaaguauggaacaaaaauaaguauacuuuuuugacauucgauguagauacugcaaaugaauuuacacggguuuaaucaauguaagauagauauuugucugaauauuuuaaaaagcaccuagguaucaaaaaauaaaaacaaaaaauauaaugaaacuccaaacauccaacaaucucccuuaacauucucauucugccaagcaaccacacguuggugcuuauuacacaauuuaagaaggggaaguuuauuuacucuauaggaaacaaauaugaaccuuaucuaagguaagcuucauuuagauugaaaaaaaaguugaaauagcacuagagaacuuaaggcacauaaacaaauucaggugcaguuauuuugaaaccauuaaaacaaauucuuuucuuuggaacaauauauaaaauaaguuaugaauguugcuguuuuuaucagcacuaggaaaauuuaauaucuaaggcaaucacacaaauguaaaauguucauauaaaacauuaaaaaaugucuaaagugucucuggaauuauucauucacacuccuggcucaaaugguuucuggugccuagcauuagaugugacaauaaugauagcuagcuagucaaaccuacugccuuaaagaucaaccaauuugcuccauucugguuacuuggcaugguaaauuuauuuaacuaaaaagaauaauggggugaggugauguaaaccuggcuuucaauaagaugcacaacaaauucuaauaaggccaaaacucuguugagguuaacuggugucuugaguuuacuaaaauaaaggcaguccauaggaagccucaaagagacauuaucuuaccacuuggcaccacaaaaacaccaagcucuccucucugaaaauacaggccgggggugguggcucacgccuguaaucccagcacuuugggaggccgaggugggcggaucacguggucaggagugauccgucucuacuaaaccccgucucuacuaaaaauacaaaaaaauuagccgggugugguggcacgcaccuguggucucagcuacucgggaggcugaggcagaaucccuugaacccgggagguggagguugcagucagcugagaucgcgccacugcacuccagccugggcgacagagcaagaccccguucuccccccuuccccaaaaaaaaaaaaaaacgaaaaaaauacaguuugaaguagaugucgucuuuuccacauauaaaucucaagacauaaaaggcacacacaauucaacuccucucuuuucauauauggguucucacagcaauuuaaaaaaucuauugccauauccagacaacaggagaaaaaaaaaauaccugguuugcuuauugacaaaagugguguaauugaaccuuugucuuuccugaguuucaaaaaggcuauuugacaguagagauacauaaacaauucauauucaguaagauaaaauguaucaguccacaaaacauuuucaucuuuuuaaguauaaaagaaucaauguucaaccaccaccaugugugaagccccuuuuuccaaauuaaacuuacucuagaaucaugaauugaagauuauucagucauggcacuuuacaccccaaacgagcaaaaguaacaaguuaauacccucccugaguauuuacaucaucuuaucaccugguuuaaauggaguaaauaccuauauuucaaucaucuaggaaauaaaaagguuacugaagauccaauacacuaguauuucauaccugugcaguaaagucagugggaagauuacaguagaaaaggaggaaguucuacuguuguaaaaauuagaccacuuuuguagcugacucacauagaggaaaaacagaaaaugauuaaaguucaugaaaaaaaaacuauacuuuucuguucuacaaagcauaccuuugaauucccuuuccaacugagguaucacagcuggguuuagcaaacucaucucuucugaccuuguaaaacuaaauugucauaaagauucugauuauacauaagucaucguuacuaauacucaucauguacuuucaaauguaaaaaguucuagaaaugcccaaauaaaaaaaaauuccagaauugaauuuagcauggucaacuaauuuuuacuuuaugugcuuuuuugcugaucaucacagacugcuaaaauucaugguguuugguauauauguguguauacaaccauacuaucuacauacauacacauguacauauauagauucuaaaccaaagguucauaugagcaucaccuaucaaaagaaaaaucuuuaugugaugagagaaugaauacaaucugacaccaauuugguugauauaccccuuuugauauauuaauucuacucuaaaauucuuuuuuauuuuaucaagucuaaugcuauuauuuaucaagaauuaguaaaggaagauaaauauuaaaaaauuaaaauauuaaguuggguaacuuuaaaaauaguuauuuaaauuuucuaagauucaaccuaaguucuugguggccuucaauauaaauuuuaaguacuuaauuuauguaguuuuaaauuauguagagaaaaaauuaauauuggugugaggucuguguuuaaaaaaauucuguuuuucaggauuucauuucaaauuuacuauaauaaacacauggauauuaaaauaaauguauaacaaaauaaaaguaaauaguuaauacuuuuuacaacagaaaaauacuagaauauaaaguugucuugagaaagucuuuuuuuaugugaaguccuauauucaugaaauggacaugaucuuacaaauacacaugaaaauaacaacuaucauuuguagaauccucagcauuuacaaaauacuuuuucacacauuaucucauuuacuguaaagaauuucuuaacuaaauaauucuauuaucuauaagaguauaaugcagauguuuacucuaaaauuaaaguacaaguauccaaacuguaccuacauucuuucaacuaagaggauagaaaauuguuuucugaauuguuguuaucacaaaaugguaucuaucauuuuaaaauuaugauuugaaaaauaaaaauucccuaaaaauuuuuaaguuuuuuagaguuuuccucagaauguagauucuagcuaagcauuaaaguuuaaaaaaugucuaucugaaaucucugaaucauucuaaaaugagaaaacaauguagcuuaccaauguuaggcuuuuuauuucaaccuugguuuuaacagaaaucuggugacacuuuaauuacauauuugcaucaucccuucuaucacaagaaauauacaaauuauaaugugaaagacaacagugacuggaagucaaacuacagcaggcuaccuagaacaucccuaaauguuguaaauuauauccguccacccagaaucacaauaaucacuuaugcuguaguuccugccauauccauuuauuugcauuagaaaaaaaauucacauuccucucugaaaacugauaagcuuuauaaaguggaguugagaaaucuagacaaaagcagucuguuguacagaagcuugaaaauguugauuaguauuuuacacaauggggaccaaaugaaagacuuaccuuaaagaugggaacuacugcuaaguuuuuucagauaacuaauuuuaaaagaaaaauggacccacugagauagguggucccugcuuuauccuauuaaagguaccuuaacaguagagacucucaggaauuuuagcuguucacuagaaagugggauaaucaaggaagagguccucacccaaagcaccauacuaaugaggucaaacucuacugggcuaggaaggaaaaccuaucccuauuuuucuuuuucuuuucucuugagacagugucgcaaccuguugcccaggcuagggugccgugugcguucauagcucacuguagccucagacuccugggcucaagcaauccuccugccccagccugcugaguaguugggaguacaggugugagucucuguaccuggcugucugucccuguuuuucacaaaacaauauugcaaaauggguuuccacugcuuuaucaaguuaagaaaagaggcuuucuuagaggauugaagagaugaugcauaaaaacuuugagagccauagugggucauuuuuccuucaaaggccauuccauuuuucucuuaggaauuaacuuguaauuuuaaucccccuuguaggggcacuuauuuuucuaucuccuaccuaacuucccccuaaaaacauguuuaauguaagacagcaauucuaagaauaaagucacaauaguucaguauuuuaugaugccugaauuguugucauuacauuuuuaucaauuacagaaaaaaacccuucaauaaaauuaaccaaucuggauauacuuuguuaacaacaaagguuuuuaaaacugauuuuuucuccuagaaugcauccuaagcauuaacuucuucaaccuaaaugaugccucaagucaugcaauuuucucuacauauaugacaaaauaaggaauauacauacagauaaacauacauaauaagugaagacaccauucacacgcuccuaaaagguaugcagacagacauuuccuaauucacauagacuucuuacaaauacuuacaaagguacacucuucaaaggccaaguaacaaccaccauuaccuuuaacaaaaaaguuuuuuuuuucaauuauaggaaaggcuuuauuauaguuugaaagauugauauuuugaggagaaaggcaccaaauuauuauuuuuacuauuuuuugcauauggcacaaaggagauaugugaaguucccacuguagaguuuuuaaaaccucccaucuuggaucaguguggcuucuucggugagguauccugucuucagaguuuaaagcauuucucauuguaucuaugaauagucacacagccaugauaggacacuggccugggcauugcagcuaccccugugaugauacuuguugcaggaucauaacagagaauagugucuguggcuucuccauuuucccgucuuccgcccaggauauauauuuuaccauuacacacagacauaccacaguuuuccuguuuaaccaaauauauaaacaaaaaauuaaccauugaagauaaaggauuugguaacaaacagaaaagcaaaauaaugcuuuagcacagucaaaaaaaagggagacaugauaaaagcuaagguccuuuggcccaacucugcucucuguguucuguguaagcgcuggacaacuuugcaugaaugaaaugaauuucaagauagaugcuaugucaguagcagccacaagaaauaacgagaucauguccuuuguagggacguggauggagcuggaggccauuacccuuagcaaacuuacacaggaacagaaaaccaaauacugcauguucucacuuauaagugggagccaaaugaugacaacacagggacacauagaggggaacaacacacacacgggccuuucagaaggugcagaguugggggaggaagaggaucaggaaaauuaauggguacuagggcuuaagaacugaaugaugaaacaaucuguacaacaaacccccaugacacaguguaccuauguaacaaaccugcacuugugccccugaacuuaaaauaaaaguuaaaaaaaaaaaagauuauauguuaguaauuggggccaagaugugggagguaggauguggacugauaaaaggguuuuaacuuaaugguaguuaagcaaaagcaucuuuaaagagccuggcuugcuucuccuauuacaggaagguuauuauagaaaguggcgguuacaugaccaaggaguaggaacaauauucauuauaugggauuacccaaaaauugaaugaaugaaugaggaaaaaauuuauaacuaaguuaacaaaacacuguuauuaggagccuuggcugggccauagaaaugucucaaauaacaucuuacaguuaacuucccacacaaugggauucuaagcuaaauuuuauuauucucugucaauaacacaguuacuauauaaaacaaauauucuugcaaggaugagagugauucuucaaaaacaaaaccuggcugggcaugguggcucaugccuguaaucccagcacuuugggaggccgaggcagguggaucacuugagaucaagaguucgagaccagucuggucaacacagugaaacaccaucucuacuaaaaauacaaaaaauuagcuggacgugguggggggugcuuguaaucccuacuacucgggaggcugaggcaggagaauugcuugaacccgggaggcggagguugcagggagcugagguugugccacugcacuccagucugggugauaagagcgaaacuccgucucaaaaaaaauaaacaaacaaacaaacaaaaaacccuacauuaacaacugauucacuauuacaugcaucugguuauacugcaggccagauauucuuccauuuccaauuaaaguuucacuuuaauucagagaguuauugcaccuuauuauccugguuccacauaaccaacaaugaaauaguuucuaccaaugaguucaauaagcauuuuuacuugaccaaauuugcuuuauauaaauuuugcucuuauagaagaaauuaaaucuugguggcuuuauauaauagaaggauacuaucuuuaggucugaaagaauuugugaguacuuaaaaaugccuauauuagaauuuauagacacccagaaugacuuagccuauuaucauauagugaaagacacuuuaauucagaauaccacacccccaugaauugcaccaauuauggaacaaacucuaauauuuuucauuuaaagcacaauaagcgcuuucuauaaauucuucaaguucugaauauaauaaaaacaaacaaaaaccuuaguuuucagguacaagcuaguucccacuauugaaccucuaguuauuuugaggaugauucuaaaacaauauauaauuacauggucugguaauuaauaccauuucagauaauaaugcucagaguuaaauaaagcaaagaaccuugaaaccaaguauucauaucaggaaauuaccucuauccgauauaauagcuuauuucaugcuaguaaaauaccauuuacucuguuuguuuauacuguaugaaaaacuuacucuucauucaggaguaagggcagcuaguaggaacaauaauuuaucaauauauaaaguuuuaauguuauuuuuaaagacugaaacgaaacaugauccuaacauugcaaagaaaaaaaaaaaaaaccaaaaaacccucucguuauuuuuguaugcuuaaaauguuaaacugucaacaauagacaaaaagaaucagauuucauuuaauuauucuaaucuuuaaugguauuuuaaauaccuggucuacugaagagagagaaaaaaagucuucaucacugacuuuuuaaaaaaucccacaauuuuuuuuaaaggauguuccugacacagguuaaaaagcaaaauauguuuugaauaauaagcuguguuuuuaggaauuaugcaaagucagaagaggcguggaaauggugaaggacaaacagagaaauaggcaggguccauuaggacuauaaaaaauaaagaccucauuuuuuucagcucuuuuuugcauuuaauauucuaagcauuuuaaaaagcaacaguauuggguucauuuaacuguauacaaugaaauuaguuugauuuauccuuuuucaucgguuggcauuaaaaggguaaacaaucacacacggcucaaaaauuaccuaucaauaacaugugcauaaggccaggugccguggcucaugccuguaaucccagcacuuugggaggccgaggcaggcggaucaccuaaggucaagaguucaagaccagccugaccaacauggcaaaacccugucuccacuaaaaauacaaaaauuagcugggugugguggcaugcgccuguaaucccagcuacuugggagacugaggcaggagaaucacuugaacccgggaggcggagguugcagugagccgagaucaaugugugcauagauguauuuaguagcauuggugguaacaauaaacagaggagagaaaauaaucaccuaaaucccaguacuagauuugaacuucaauuauuugucuuuguuagacuuaauauacuucugauccaaauguuuauuuucuuuaaauuucuaaagucaaugaauguuguuuaauuagagaaaaugugccauguguguccuauuauuaauuuuuuucucaguuuuaucucaauaaccuaguuaaaaaauauucauguaugcccugcaauaugcuacauacuggcaauuaucuuccuaaacuguuaucguuuuauacaauauagcaaaguuccgaauaaaugguaauucuuuuucuuuuuucuuucuuuuuuuuuuaaauuuuuuuugagacagggucucacugugucacccaggcuggucccuaacucuuggccucaggugauccuccugccucagcuucccaaggugcugggauuauaugcaugagccacugcacccagcuugagcaguaauucuuaauaaaaaugcaucauucuuuacaaucuucacugaaauaaaccaauaaaaagcagcuuagauuuuuuaaaaauuagaaauaagucucaauacuugaccacaugaggauucucaugcaaguaggguacacugucgcuucuguagggcuggagaaugguuuuccaggggaggucccugagcuggagaaaugugauuuauuuuuacuuacaugugauaugagagggagaaaacguaauacucauucuguaccauggagcugaagugccuauuaugucccuuucauuaacuggggcaauguuacugcauauauauuacuaauuggagacuauaccucaaugucaacaacuuuagaaaagugguuuuauauucaaacccuauucacuauccuuauaaucuaugcuguaucucuaauguaucuugcaaauaagauuaucuuaaaauuaagucccucugguacuuccucauuuguuuacuuauucaauauauauauauuuacuaugcagaaauaaaugcaagauacauacaagaugaguuagaagaaauaguguccucaagaagacuaaauucuaguauaggaaauaaacauuuauacccauaagggaauauacaauugccauaagagguaugagugcuuuaacagaucagaaagcaaaauagauccauucugccccaguuaaacucuguuguacugaagugguccuugaaagauaaguagaauuacaaguagagaagguaaaacaggcauuacaggauaagaagacagcaugaaccagggcaagaacauuuaugaucuguuuagagacuacaaaugacagauacuuaagguaccugagguaaaguuauagaaugugaagcugaaaggucaaaugaaggucaggcaauagaaggucuagaaugaagugguaaaaguuuuggauuuuauuuaauagguuuccaaucaaagaagagacaauaaguagauuuauugaaaaauaauaggcugggcaugguggcucaugccuguaaucccagcacuuugggaggcugaggcagguggaucacaaggucaggaguuugagaccagccuggucaacauagugaaaccccguuucuacuaaaaguacaaaaaauuagcugggcuugguggugggcgccuguaauuccagcuacucgggaggcugaggcaggagaaucacuugaacccaggaggcggaguuugcaguguguggagaucgcgccauugcacuucagccugggugacaagagugaaacuccgucucaaaaaaagaaagaaagaaaggaaggaaggaaggaaagaaaagaaggaaagaagggaaggaaggaaggaagaaaggaaagaaagaaagaaagaaagaaagaaagaaagaaagaaagaaagaaagaaagaaagaaaauugaugcuaaaugagcuagcaagacaagcuauuagagaaaggaagacuaauuagaguauuuuuguuuguuuagguaaaacuugguaagaacuugaacaaaaauagaaacaauaggaauggaaaaaauaggagaacugauaggcuagauuaauucaauuuaagagaagaaaaagauaaucuaauaaauuaaguuucuagguuaauuggaaauauagaaaaaacagguuuggggaagaaggugaguucuauuugaaauuuaaaaucuugaaauacccauguaaaauaucaaauaaaauaucaaauaggcaguuagaaauuugaguuuggaacacaggagagaggcuuugauggcgauacagacuuggaagacaucagugcugagcaguaaaugagaugauucaggaaagaguauaaacugggaagaggacagaggacaggcucaaggaacauauuuaaggacuggguagaaaaacaagagaguaugaacaagagugaggagauuauuagcagugaccuuugagaguacaucucuagagugguauguguagagccagauuuucagcaucagaaccaucaagcauuuuggggguggaaggaaaaggagccaugaaucaaaagguggggaaaaggccuuuugggagguggcaguguggguagggaguagggcuccgguuagaauacauggaugaaagaaaggugagcacagccauuuccuuuacaacagaaauaacagauuucccagccucuaaccaaagaaacaacaaguuugggaacauuccucucuucugaaauaugaaagagaggggauaaauacuggaguaggauugugaaaaaagucaagagaaaaaaaaaagaacagcccaaguguaacagauacuucuccaugggaugguaaaaaggaaguuauuucaauaaaaugaccccuuggaaggaguucaaaacagguugccauaugcuuuauguggaguuuugaaaaauauauaaaauaauucaagcaaacaugaaauauuuuauuuuacuuauuuauuuacuuuuuugagacggagucucacucuguugcccaggcuggagugcaaguggcaugaucucggcucacugcaaccucugccucccagauucaagugauucucccgccucaaccuccugagcagcugggauuacaggcgugugccaccaaacccagcuaauuuuuuauuuuauuuuguuuuauuuuauuuuauuuuauuuuuauuuauuuauuuauuuuugagacggaguuucgcucuugcuguccaggcuggagugcaauggcucgaucucggcucaccgcgaccuccaccucccggguucaagcaauucuccugccgcagccucccuaguagcugggauuacaggcaaugcgccaccacgcccagcuaauuuuguauuuuuagcagagacgggguuucuccauguuggucaggcuggucucgaacucccgaccucaggugauuggccugccucagccucccaaagugcugggauuacaggcaugaaccaccacgccuggccauaauuuuuuaguagagacgggguuucaccauauuagccaggcuggucuugaacuccugaccucaagugaucuauccaccucggccucccaaagugcugggauuacaggcgugagccaccacgcccagccugaaauauuuuaaaauugaaauuccaguguauuaauaaugauuauguacuuggucccucuuagauuuauuuuucuuuuguacugcuuuauguuauuaccugacggcugaauguauucuguacgugcauccaguaaucuucaacuggaucguaacaguauauugccuuggucaguccaccggcaacauagaucagguuguuuagggauacagcuguuauacaccuuuuggcaauugggauagcugcacgaaguagccaagaauugguuucuggaucauaagauugaaccuaauaacauauaaaaauauauaauuaaaauuucuaaacaaaaauggaaauguacuuaauaaagaaucuaccaauaccuacaaacauuauuuaaaauaaaauccuauuaauucagagaauuaagagagguuagccugauagugaaaugucugaauuacgaacauucucaaauaaaaugcaaauuuauuacuaucaagcagaauagaguaccaaacacacagauuguuucuagaaugaauggccaccagguuuguccacuaaaauuaacagucuaaaucuuuucacaauuguguuauguaggauaacuaugccucacaucugaauauaacuucuuaaugcuuuuagggaguccuuucuucaaaagaaaacaaguaaaccucaauucaaucaguaugcucugaauuaucacaaauucugaaauaacaaauucuaaauaaguaacauuugaucacauuauuuuaaacugaauuuagaaaaagaauuaauagacugacaaaauucaguuaacagugcuaaaccagcuaggcauuagaugcuuuuuuccagaauaaacauuuccugagaugucaggauagcacauauucuuucgucccagaaguuuacugaaccggaacaacuuugagccauccucuauuuacacuaaggagguuuccuuuccuuuuuucugaaaaauacuucaaaaguauguagaaaaugacccaguuggaagcagcauauuuaguuacuaugucuuacccuuugcuaauucacuucucaacuguguuuuguauaaauaguuuuuagauuuuguagaugacagcaaaggcucagaacaauuuauuuaguagaaaacuucuacacagauagucucauuucaaaaagauuggaucacauuuguuagagcaaauuguuagauauacuagagucucacuuuagcaacccagaauucaauguuuuucuccaaaagcauauaguaccagaaaauuuuuaaaagaccccucacacuaugugaccuggcuaccuacuugauaagccuucuguauuucccuucuuguacuuaauauugguaauuucuuuaaaagugcauggcuuaccuuaucagaacaaguauuaucaucagguccuccaccaaucacaaacaguuugccuacacagcuagucacugcaggagaacucacggcuuccuuaaggggagcaacuucaguccaucgauuugaaaaggaaucauaacauucuacgcugcuaagucuguuuugcccaucauagccaccgacaacauauaccuauauguaaaauacauggaaaaaucuuaauuaucaaaagucugaauuuugaaguaguuggcuaaagaauuaagggaucucuucucuuuaaaaugcccuugcuaaauaaauauaauugcaauauauuuagcucagaguuucugaaccuuuuaaaaaaucaucauccccuaccaccaucacaauccacggagccuuuuuagguauuuucuuccuaauagucuucccucaauaaaauuguaauaccacagagaaauuguguaucuauuuaccuuaauguauguauaucuguucuuuacacaagaaaggguacauuuuuuuucaucuucuaagaaacaaucuuugcccccuuggggguaauacugcucacacugagaaugguacaauuuagcuuaaauauucacacuuauggguaaugaaauauuugauuauuauaaaguauuagagcugugaaacuaaaauauuaggaaagaauuacuagacuaugagagugcuggucaggccuuucuuuuaguccguacaauaccuagaaaaguacuugacacaaaaugaacuuuaaaguucacagagcuuuuauguacauuuucuuuucacaaauaagagaaagguagggcaaauuaguaucuuuauaugacaggugaaccaaucaguaagauauuuauuaaauggcuuauaugcaaaaaauccaugguuuauauagggaacuuucaaccuaacaaagcucuccagcagcuuaacauccacguuucucucucucucuuuuucuuuuuuuggagaugggucucauucuguugcucaggcuggagugcaguggcaugaucacagcucacuacagccucaaccuccgagguucaaguaauccucucaccucagccucccaaguagcugaaaccacagguguguaucaccacacccuacuaauuuauuuuuauuuuucacagagacagggucucccucuguugcccaggcuggucucuaacucucggccucaagccauucucccacucucaagccauccuccugccucagccucccaaaguguugggauuacaggcgugagccaucacgcccagcucacauuucucuuaauggacugucaucauuaacucuucccuccauagcuaauuaacuauuaagucccacugagucuucuuccacagcaucuuucacauauaccccuuccuuuacguuucccgcugccaucacccacuugaggguccacaacauuucauuccucucaaauaaccuccuggccuccacucuuguucucucuaaaccacagauuauucuuccuaaaauacuuuaucaguuccucuuaauauuucaacaaugaaugucuaagggucaaggccacauuucauaacuuguccuucaaauuuguccacaauuuaucuuucugugcacccccaaauuuccacaguacucaaugccacuucuaucaugcauuucucacauuauguuaaaauaaucuguuggugaguuuguguccccaacacuaugcagcucagacagguuaaguaacuuacaaaaguccacacagcuauauggaguauggaaccuguggcacgauguagcaauuaagggcacaggcuuugaucaccagcucugccauccaauguaagggcaauuuaucuacccuuuuggagacucaaauuuauuuccucaauuuuauaauuuuuuuuuugaggcggaguuucgcucuuguugcccaggcuggagugcaauggcgugaucucagcucacugcaaugucugccuccuggcuucaagggauucuccugccucagccuccugaguagcugggauuacaggugcccgccaccaugcuuggcuauauuuccucaauuuuaaaauguagacaaucauaguaucuaucacauggcauaauuuugaggauuaaacuuuaauacguauuccuacauguguaaauuaaaauauaauacaugccaugagcaucaagacaaaaggccucuagauuaagaaaagucugagcuuuugccucugcuuuaucauuuuuuguguaaucuugggaagugacuugaucucuuugggguuauuuauaagaugaccaaguuauauuaaauauucuccauuauuccaucaucccuuccuacucuaagauuuuuuuccuuuucuuuuuuuugacagagucucacucugucaccgggcuggagugcagcaggcagcucacugcagccucugccucucaggcucaagugauucuccugccucagccucccaaguagccgggauuacagguguccgccacuaugcccagcuaauuuuuuguauuuuuguagagacaggguuucaccauguuggccaggcuggucuugaacuccugaccuugugauuugccugccucggccucccaaagugcugggauuacaggcgugagccaccgcacccgguaauuuuuuauuuuuucuugaggauugcagccuaagacacacuucuaaguuacacuggggagugcuccccuaagauucuauauucuaaaccaucccagguuuccuuaaacagaguauuuauaaauuuaaguauguuuuauaagcuugaauuaaaucuauauuguaauuuuagcaaaaugacuuccaugaauugaguacuugcuguguaagguaggaaugauuccuuuucuuuauugauuuagugcuucuaagcuuuggguaucuucaagucaaguacacuauuuugucaaauaaauuugaguuuaccaauacauacaugguuuuugagacaucaguacuuuucauuugccuuuguaucagcaucuccuuccaaccccuggauuauuuuagccccucuuuuccaguaauauuuuguccuucuugaggcacagccucaaacacuauauauaauauaguaaguacuaacaaaccaaaugguuuuagaaaagauucuauuaauauuuuauuuccaguaaaucugucucaagguccucauuauuucauuggccuuguagacagcagcagcacacuagauccaggucguuaggaauuaacagcuuuuaaacuguguuuugagcugggcaugguggcucaugccuguaaucucagcacuucgggaggcugaagcaagaggauggcuugaacccaggaguuugaaaccagcccaggcaacaggauaaaacauuaucuccacaaaaaauaccaaaauuaggugugauggugugugccugcagucuuagcuacuagggaggcugagguagaaggaucacuugagcccaggauguccaggcugcagugagccaugacugugcugcugcacuacagccucagcaacacagcaagacccuaucucaaaaaauaaaaauauauaaacuguuuugagaagcucuaguauucuacgcagcaguccccaaccuuuuuggcaccagggagcgguuuaauggaagacaauuuucccacaggucuggguggggggcuggugggggacuggucggggaugggaugguuuggggauguaacuguuccaccucagaucaucaggcauuagauucucauaagcagccacaaccuagauaucccucauaugugcuguccaugcuccuaugagaaccuaaugugcgcugaucugacaggagguggaguugaggcgguaaagcucgcucaguggcugcucaccuacugcugugcaauuagauuccuaacagaacgcugacugcaguggcaaaaucuuggcucacugcaaacuccgccagaagcgauucuucugccucagccucccgaguagcugggacuaccggugcggaccaccaugcccggcuaauuuguguauuuuuaguagacaggguuucaccauguuggccaggauggucucgaucucuugaccucgugauccaccuaccuuggccucccaaagugcugggauuacaggugugagccaccacgacuggccuaguauagaaguuuuaagaaaccccuguggggaaagagaggaaggaggacuaguaagaggcugaccaagaaggguuccuggucaccauuucuguuucagcuagagcuuuguuuuuuuauuggugguacuuaacugucuccauaggagggccuaugagacagcaaucuucuuagaaaggggugcuaggagaucagucaaagacauaugcgaaagcaagugugcugcuuuuaguuguucauuaauuugaggugguuuuggacaagcagauggagaugggggcagggagaagcuaaagacuccaagguaauccuugguacaacuguuguauuuucaucuguuauguaauaaauuuuuguauuagauaugacuuuuuaaaagacaauauacagguugaacuuuccaaaucuuaaaaaaucugaaauccaaaauguuccagaucugaaacuuuaugagugaugacauuaaugcucaaaggaaaugcucauuggaacauuucagaucuuggauuuuuugauuugggaugcucaaugaauauaaugaaaauauuccaaaauaugaaaaaaauccaaaauauuuggcccagugcaguggcucaugccuguaaucccagcacuuugggaggcugaggcaggcagaucauuugagcccaggaguucaacaccagccugggcaauguggagaaacccaaucucuacaaaaaauacaaaauuagcuaggcauugugguguacaccuguggccuuggcuacuugggaggcugacguagaagggauaguuuggguccaggaggucaaggcuguagugagcagugauggcaccacuguacuccagccugggcaacagagugagaaccugucuaaaaacaaaagaaaaaaaaaauauccaaaaucagaaacacuucuggucccaagcauuuuggaaacuccaccuguaguugcuuuuaaaaaguuuggaaacuggcuaggugcgguggcucauaacuauaaucccagcccucugggaggccgaggugggaggaucacgagcucaggaguuggagaccagccuggccaacauggcgaaacccugccucuacuaaaaauauaaaaauuagccaggugugguggcgaacaccuguaaucccagcuacucaggugucugaggcaggagaaucacuugcacuggggaggcagaaguugcagugagcuagauaaugccacuguacuccagcuugggcaauagaguaagagaccuugucucaaaaaaaaaaaaaaguuugauucucagguuccuacagacaguagaugguuuagaacccaaauaauguauuguuuauaauaaucauuagcugcagucaaaaauagguuuucuuuaaaaaugugaguuuuuuuauuuuuauuuuuauuuuuuugagauggagucucgcucuguugccaggcuggagugcaguggugcgaucuuggcucacugcaaccuccgccucccggguucaagcgauucuccugccucacccuccugaguggcugggacuacaggcacccgccaccaaccccagcuuauuuuuuguauuuuuaguagagaugggguuucaccacauuggccaggauggucucgaucuccugaccucaugaucugcccgccucagccucccaaagugcugggauuacaggcgugagccaacgugccuggccuguuagugaguuuaucuuaauauuuauuuaaaauaaaaaagauaaaauacaugacuuuggacaaauauaucucugccugacuugcaaaguuaguaaaaagaaaacaaacugcguggguuagacauuggccugucuguauuugauguaacuccuuuauuuuccaaugcuucuuaggcauuuggacuucagugaugcaugagaagagaaaugugcuacacugccaugaauuccaaauuaggagaacaaaauauccauucaaaaguacagugucauauuguuuauaucuuugguuuaucuauugagguuagaaauggaaggaaauacaauuugaauccaaaauacccagagggugaguaaaaugaaagauucagcugugguauuuacuuuggaaagguaccagcaauaguaauaaaaagugguuucucuuacuuuaccaaggaggacagccauuuugugacgccaucugccuuuauugagagaggcaacucugauccaaauauuuaacugugaguuauaaauccagacaucacggcuguugauucuuccaccuugaaaugcaaaacaaugcacacacgauaauuuaucaugauauagcugucaccaagagaucugugccaccaaggcauagguaaagaaaacauggaauucauucaucuaauucaagaauuugagaauucagcucaauaaauaaagaccucuugaaauuuaauggaaauaguucuacagagaaaauuuaaacuuuaccaauuguuaucuugauaagugauaauuauagauccaaaauaauuaaauauaggaugugaauuuuacaaacauaaaagauuguuaauuuaagaguaagacaucagaagcacgcaaauaaugguauuauucuaaagguuuuuuuuuuaauugaccgauuuuucaaaaagcauacuauuguaaaaaauaaaguauguauuguuauauuucucaguguggauaauauauauaauaaucugcaaagcuggugaaauuauuuuaccaauuaacagacuucccaucauagauacuauaguuauacuuuguacaagucugucauuuuauuuucuaauuuuaaagguaacauaucacaaucauaaagaaguucaaguuaagaauuuuaaagcaaaucuuauuucauaaacuuugcggagaauuucagaaaacaugggugaauuagaaaugcuuaauucuaugaguacuucugacuugcaaagagguaaaguuuaaaaaauuacagcauauucuacaugcauuugagagcauuuaaaauaugacaugauuaaagguaucuucugguggaucuuuuguaaaucauuccaugucaucuuguaccuguguuuuuuuuguuguugcuuuuuguuuguuuuuuguuuuugaggcggagucuugcuuugucaccaggcuggagugcaguggcgcgaucucggcuuacugcaaucuccgccucccgaguucaagugauucuccugccucagccuccugaguagcugggacuacaguugcccacuaccacaccuggcuaauuuuuguauuuuuuaguagagaugggguuucaccauguuggccaggauggucucgaucuccugacccggugaucugcuugccucggccucccaaagugcugggauuacaggcgugagccaccgcgccuggccuuguaccuguuuuuaagagcaaaaagucauucuugguuuuauuuguuguaaacugaucuuccucaagugggaguauucacauuucacuauuuuaagacacuguugauguuuaaaauaaugaagcuguguccaaauuaaaaguagcuacuguaauaauucuauauuuaccugaaacaagaaugucauuccuuagagcacagacugcauacucugauuugguaaauucuggaagcuuagccaaagacuuccauucuccuguuacaggaucguagcacucaguguauggaagauuaaauccuccaacucgcucacauccuccaacgacaacuaucaccucagaauagccaguggaccuaaaauaauaauuauuagcguacauaaauaauauaauaauauuacauuaaaauauacuccagauuuuuucuuaaaacucuaaaaacaaaccacgcacuauuauaaacaguuaaguuucuucucugugcaugugccaaacgguacagccuggaaauuacuuacuuugagaacguuuauaggggagcuagugacaucauuauuccacagaaaauuucuguugcuauuuuuuucuauugguuuugaccugaaaauuguaaaaaaguccaaagauccuaucuaacccaaucagaauccuggcaauauuaaggaugacuuucaaaugcaguuuugcagugauucagauacgcauaaccacacaagguaagauaaugcauuuuuuucuaacuguaggaaaauggugcucuuucaucagcuugcuaguucuaaaaaacuaauucauaguauaauccaagcacccuuuaaaggaauauguauauguacuuguucagaaauuaguuuuuaaaauacaaagucaaguaaauuaagguaauacaacucaaaauguugggcaaucacuaaaaaggcuaacaguuuauaacaagaauguuaaaggagaaaagcaagaugaaaaacuguacauuaggcauauucaauacuaucuaaaaaauguaucuggaaagaauauaccaaaaugcuaaagauaguugucucugaauuguuuggcuccccccauuucuaucauuacaaauuuccaaaccaauaaugagccugagcuauuuuuagaaugcaaaaaacagcauuuaacaccacuaaaagaauucuaauguuucuguuaaucacuggcuucucucauuuuuuagauuuaaaauagagacaggaauaaccaaaagcuuauccacaauuuuuuguucauaaaauucaauugauaguuuaggaauuuuaaaauucuuuagcuuuuauauuuuucacaaauauaaucuaaaugaaaauguuuuauaguuacauuuuaugguugcuacaaguuaagucucacaaagaaaaaugccaacaauccuucuucucuuacuuauagaggggaaaaaaaaacccacaucaggacacugauuuguaauuuuagucagugugcuguuacacaauuacaguaggaaaaaacaagcaauauuggcgugucucuuuuaacagagcuguucuagcuacauuuacucagaccuaugucaacuaaccaaaucacguaccuauucuaugccaggcauacuuuuuccguuauaaaaucagaaauaaauaugggagaaaagaauuuucucuauacaugcaaacaaaaguacuuuuaggaauccaggaaauuauauaaccuuuaccuaguauuuaguaaaacauuaacagaaggaccuaaauauuaucaguaauauuuacuauuuuccaaguaauuccaaaauaaaaguauuaaaaauaaagagagcacagcaccagauacuuuaguaguauaacuacugacuuaucuaucauucuuuccauauaaguauuuccuaaaacacacuuaaaaucuaagacaaauccucaaaaaaggugauauuccucaaagucuuauuuauuaaucaaucaaaacaaacacugcuagucacugaaguuaaaucacuucugucuuaauauaaaauccagaguaaugauuauauaucauaggauuuuguuuuauccuuuccuuauuguacauuacuugguuuauacuuucccuuugcuuaaacucgcuugccuuuuucaagacuucuuagcccaauaaacauauguuaucuguuuuuguacuuuggaacagaaagagaaaacagcaugagaagcuaauugcuaaaacauuuaguaccaauaaauaaaggguaacuucaaugucugcuagaaugugugucuaucugaaaggauuagcaagcuaguaguuuugccuguauuaaauauccuauuugcaaccaaaugguuuuuagcuuaauuagauauaucugauguucucaucacggacuguuaacccaauaaaagcauuauuucuugagcuuggagaaauacuuaucucaggcagggagcuaauggccuuaaaggaaauagguuacuccagcugauaauggcaaguaaaacaaaauggcaggaaagaugauaguauagcauaaauaaaauucuggacacccauguaaucuauuucuagagagugaaugccaugucacucuauuucauuaauucuuuuuuuguuuuucuuucaaauagagacaaggucuuacucuauugccaaggcuggagugcaguggcgagauuguggcucacugcaacuccaacuccuggcugaagugagccucucaccucagccucccagguagucgggacuacaggcacaugccaccacaucuagugaauuuuuuuuuuuuuuuuuuuuuuugagacggagucucgcucugucgcccaggcuggagugcgguggcgcaaucucggcucacugcaagcuccgccucccggguucacgccauucuccugccucagccucccaaguagcugggacuacaggagcccgccaccacgcccggcuaauugcuuuuguauuuuuaguagagacaggguuucacuguguuagccuccuaacacgugguuucgaucuccugaccucaugauccacccgccucggccucccaaagugcugguauuacaggcgugagcugcggcucccggccagaucuuuuaaacuuggugaggacacaguaucaauuugugugguaaggcuuuccaccugaaauggcaauagguaggacugcuucuauaugaaaauggcuauauugaucaaaagacgcaaaaugccaacuuuucaaaauuggcaauuaucuaagaauuuaucaucagaaacuaaucacagacaugcuuaaauauguagccaccaaagaugcucaucuuacuuaaugguagaaaauuaaaaacaaauguugggaaggguggguuauggaauacucauguuauggaaagacaccauauacuaacugguaaaaacagacuaugaaauagauuacaacccuguaaaugaaauaauaaauucauacagaaaaaaagagagaauacuuugguaggcuaaaacagggggaggaucacuugagcccagggguuugagaccagccuaagcaacacagugagauccugucucuauaaaaaauacaaaaauuagucaggcaugguggcgugccuauagucccagcuacucaggaggcugaggugggaaaaucccuugagccagggaagucuuaagcugcaacaagccaugaucgugccacugcacucuaggcugggugacagagggagaccuugucucaaaaaaaaaaaaaaaaaagaaagaaaaacgccaaagguuuacaauguuaccucuucgagcugaaaauuugcuaauuuguuaauuagcauuuuuugcuucucccauucucuaaauuuucuccaauuaacauauugcuccuuuccuacccugcugcaaguuaagaaagaacaaaagaaaaaaaaacaccaccaccaccuuacuauuaacgguugcuauugggcaucugcucaaccuagcacaggaugggauuuucagucaucacauuucugcuaugugauucugcucccaugaccauagguaaauauccacaaaauguugucuggcuacaucagagauuaugucuccccaagagaaggagagauucauucucucugacugacugaacuuguaauaugucaaccccaaaccuauguguuucugccacauauauuauucugccagacuaaugggagggaaugaugcagacaugcagagaaaagcagaggcaagagguagagagaaggcacagcuugguuucugauagcuuuuuaguagccuguuccagucuucuuugaggucuuauugaauuuuugcucuuacguccuacaagacacugauucucguauccuuuucuuccuugagacggagucucacucuguugcucaagcuggaguacagugacacgaucuugcaaucucugccucuucccggguucaagccauucuccugccucagucucugcagcagcugggauuauaggcaugcaccaccaugcccagcuaauuuuuguauuuuuaauagagacgggguuucaccauguuggucaggcuggucucgaacuccugaccucaagugauccacccaucucggccucccaaauugcugggauuacagguaggugugagccacugugccuggccucuuguauccuguuaauaaauuucccuuuuaugcuugagcuggugaguuuguuucuauuugcaaucagaauuuggauacauuagaguucaauggauugcagaaaaaaaucaacaaccuacaaauggcuuucaaacucaggaaaagaugcucaaucaucuacacuaaaaaaguaaaugcacacuuugggagaccaaggugggaggaucacuugagcccaggaguuugagaccagcaugagcaacaaagugagacucugucucuacaaaaaauaaauaauaauuagcagggcauggugacccaugccuguaguuccagcuacucgagagagaggcugaggcaggagguuugcuggagucugugagauugaggcugcagugagcuacgacugugucacuguacuccagcuugggcgaccagagcgagaaccugaaaaaaaaaaaugggaggaaggaaggaaauguaaaugaaaauuaugagauaccacuuucacuuugcagaguagcaaagauuuacaaaaacuaauguaaacaaauuauauuggcaaaggagugcagaaguaggcacuuucauauuuuuguugaaguauaaauugaaaggcaauuuuuauaauaucuguaaagauuuaaaaugcacauauccuaugacugagcaagucuacuuccaguaauucaaacuauaaauuaacaguguauguaugcaaagauaauguacaagaauauucacuaaguaucacuugcaauggcaaaaaaaugaauuagaagcaaccuaaauauccauaaagagauugauuaaauaaaauaaauuaugguauauccauaaauaggauaccauauagcucuuucaaaagaacaaguuugaaauguucuauaauaguaauaauaaugagaucuaugugugaugauacagaacaguuuccaagauacuguuaagugggaaaugcaaggugcagaacugugagugcuguacccuacuaucugcauaaaagaaguagggaggcauucaucuacaacuaugcaaagaauuuuuuuuuuuuuuuugagacagagucucgcucugucauccaggcuagagugcaauggugcgaucucagcucacugcaaccucugaguccuggguucaagcaauucuccagccucagccucccaaguagcugugauuacagguguccaccaccacacccagcuaauuuuuguauuuuuaguagagacgggguuucaccauguuggucaggcuggucucgaacuccagaccucaggugaucugcccaccucggccucccaaagugcuaggauuacaggcgugagccaccaugcccagcuauacaaagaauacuucuaaaagagguucaaaaaacuaguaauaaagguauccuuugaaagcagaaucaaugguucucugaaggguuaagaagagggagauuuacaauguauacucuuuauguaaaaauauuugaguucaaaacaaugaauucaaacaauucaaugaguucaaaacaaugaacaauaaaugguaggcuacucauccuauaauauaggagaauaguauucuucagugggauuggaauaggaauucagaacacuaacuucuagcccuggcugugguucuaacuagcuuugugacuaggagcaagugaguuaacugugccucaguuuuaucaccugcaaaauauggaaugaagggauuuauuaaauaaugacaaacaccauuucuuaaggaaaaauauauuuagaacuccuuggucuucucauuuguuuucaacagaacuugaggcuugcccucauuacggccauuagauuccuauauucacuauauaguaacugauuaucagguaagagauagcagaaagaagagacaaguacuuaauggcugauuccaaccucaaaaugaugaacuuauuaagucuuagcuaugucuguugcucaguggagucuggcaaagggcaucaauuuuuuucauagacacgaacaacuugccauguauggucaauauaucagaagacacuugcccaguuuagugccauccuuguuuccucuugggaaccucauuuuguaggcagcccaggccuaccaaaauggaaaauuagcaucuaucaggggaaaugacucuuuccagggaaucauuaugguaggugcuaaggauguggaucaggacaggaugcaaaagcagcagcaucagaaccacacuaccaagcaaucaugaguuuaaaaguuugauauuuaggcugguaugggaaauauggaaaucaguauuuggaguaaagcaggggcaagaaauggaaauuagguguacuagagaucagaaucagauuguuacgcuuauuuuuuuuuugucuuuuuuuuuuuuuccuuuuucuggagaacggggucucgcuauauugcccaggcaggucucgaacuccugggcucaagcuauccucccgccucuugccucccugagagcugggauuacaggcgugagccacugcgcccggcccagaaucagauuguuaaacaauagucaggaaugugaaacaucagucagggaccacagaguaaauaucaguuuauucaugaauugggaugagguuggggcacagaggcccaucacaagcagaaagguaaguuacuuuucuccagaugaaaaggguugaagccuagcacuuagcauacugagauggcacauaaagguaacucaaguauuuauuagaugaaauuuaagaccuguuuaaguuagcuaccauauuaauucucuacagaguucaaaaguauuucugagcccaaacaugcaucuaaguauuaauaugaacuuuuucuaccucaaauguuuuccauacuaauauuaaacuuuugaccuagaaacaaguuucaaaauuauguuggggagucaggaagagggccgaaggaagaaaggaggaaagagaggaaauuaugaaugcuacgggugguuuggcaugguggcucaugccuguaauccuagcacuuugggaagccaaggagggaggaucucuugagcccaggaguucaggacaagccugagcaacauggggaaaccccauuucuacaaaaaauaagccagggauggugauguacaccuguagucccagcuacuugggaggcuaaggugggagaaucaccugagccuaggcucagugagccaugauggcaccacuacacaccagucugaguaacagagugagacccugucucagaaaaaaaaaaaaaaaaaaaaaaaaagaugcuaagggcacucugaauaaaggcagaggauguagugcaguuauauaauaucagcauuuuugcagaaugucaauuuuuaaaauuuuaauuaauaauaauuuuuuuuuaaaggagucucucucuguugccaggcuggaguacaguggcgcgaucucggcucacugcaaucucugccucccagguucaagugauuccccugccucagccuccucagccucccgaguagaugggacuacaggcacgcuccaccaugucugcuaauuuuuugcauuuuaguagagaugggguuucaccauguuggccaggauggucucaaucuccugacuuagugaucugcccgccucggccucccaaagugcugagauuacaggugugagacacugcaccuggccaguagaauuuuuuugagucaggguauugcucugccacccaggcuggaaugcaguggccugcucauggcucacuguaaccccaaacuccuaggcucaagugauccucuugccucaaccucccaagcagcugggacuacagguacaugcuacaaugccuagcuaauuuuuucuuuuuuuucuguaggaacagggugucauuauguugcccagacuggucuuaaacuccugggcucaagcaacccccaugccuuggccucccaaagugcuugauuacaggugugagcuaccacaccuggccuacagccauuguuucuaagcuuuacuccuucugugauuagucucuacuguuuuuuccacacaccuaaggguuuacaacuggcagggcagauuaucaaagcuuucgugcucuuaaauuggccuauguccucuuucugggaaacuaccaccacacuguuuuuaauauaaugcauuuucgggauuucucugucauuuaagagacacguggguauauagggagaauuucuauuauggguugagcucuggacaauacuuggcacagaauagauacuaaaggaacacuggcugauauagagcauauaacuuaaccguacauuggagggaucagacugccaccacccuaaaccagaguuaaucucugcaucacuaauggugggauacccagauaugcugugacuccuaauaugaugcaauauauuauacacauuacauaggauuaauucuagcuauaaauauuuaacuuauauucaucuaacugaagcucauagaaccaacuuccaguuuccaggaaacacagcuaaaugaugccauaaggaagcaaugagacugauccaaaagguagaauauuuuucuggacaacuuccccauugacaagucagaaucauaaaaaagaaacuguuuugaaguaaaagagauuucacagaaauaaccugauguaaugacuaauccuagcuuggauccagguuuauuaaagaacaguuuggaagacugggggagucugaauacagauugcguauuagauaauaugaauuauuauuauuaaguuuaaaugugcuaauguuauuuugccuguuauuuuaaaaagaugcacagucaacuaaaaaacauauauaaaaauuuaaaaagaaauauauacaugcaauaaaaaauaaauaagauauauaaaauuugaaaaagaaauauaaaugaaugaaugaaagagaaaagucugggcugguuugguagucaacagcaugcaugguaauuaaaaccaugaaaauagaugagauaaggucaccuaggcaaguacauaagggaagacaaagagaugugaaucaggcagauaauauuucagacuagauguaggaguaagaaccauuaaauugaaaaagagcaacuggagaaauaggaggaccaagaggagaauggcauuccagaagccaauggagguauuucaagauggauaaggcaauuaauaauaucaaauucgaaagagcucaagcuggauaaagaccgaagagaggcuagcaaauaacaaauagaaggucagugaugaccugauugagaggaguuucaguagagugacuggagcagaagucagaggaaugaacugcugucgaagaaguggagacaucacuccucuuucaaagaaguuuggaguuucucagaaagaugagaaccuguacaaauaauacacauuguucagauaaugaaauuccuagugauuaaugccaacauguuguggcaaucaggagacuggagaggucacugggugaaacaggaggauuuauuuaggcggccaccaacucagcagaucaacauccaaaguccagcuggagcuauaacauuaucugcaaaaccaggcaaaggcccccaaaaaauggguuccaaaagcaaguaugagaaaaacaaguucuuaucagucucccccuaaaauucucuccccauaccaucauucuuuguucugcucucauuaauuaguuuuguaacuauuuuuacaaguuugcaaagguuuuauacguuccuguuuuucucucuguaacacagcaaagucacaaaacaugccuaaauugcaaaaaccugucacaguauaauuaacugccuuuguucugcuucugcaagccugguuuccccgcccugcaaauuuugcgccacuggcuagccacuccacuucagcagcauaaauaaaagucaagcccugucuuuguucauugcucagccuuuagauguuaauccacuaaguugguggccaccuaaauaaaauccuucuguuucacccaguggucucuccagucuccuaauucccacagcaaacaugcaguaacagauaagugaaagauaaauguaagggacagaaggugauagcagaguuauaaaauaaaggauuacucauguaaugcccacauaaaauaaauaucugcuaucguauuuuuaagagucugcaaauucaacagaacuauaguuugguuuuuauacuugucucuuaaagaacggugauacugcaauuuauaaauagauguuucacuguggaaauagauuuguucccuuaaaaauuggauauaaaauacauuuuuggaaaucaaauaauuaaguaaguuaggagaaguaucucuucaaaggagugaugggacccuuaggcugcaaucugauugcauucaaauuaugucuuuauaaauauuaguaaucaaugucuuauuuugauuuuacaacauauaacccuugguuccuacucuaauccuaugagauaugcaggcugaguauuauuagccacaucugaccucagaccauucagucugcuacagggguauuugucuuggaaaaaggagugauuuucccuuuagagggauacuguguguucaugaaaguucucgaagaacuaauagucacacagcucugaagcuguuuaguuuucuuaauuaauacauuauucaaacuaguauaaauuuuaaaaacaagcuaucucacaguaugcugacuuuuaacauuccgaaacaaugauagucaaaauuuaaguaaaaaugugguuuaugagcuaugcuauaguaaauucacagaaaaaauggagauggcuuaauaauaaaccaauaauaaacuaauaaaaauacuaguuucacaacaauguaaauauacuuaacauuacugaaauguauaauuaaaaaugauuaagacaguaaaguuuauguuauguguuuuuuaccacaauuaaaaaaaaaccaacaccaacauuagcuuuguuagaaaaauauuaaaaggauuaaaaggauaauuuacuguaauauuucucauaacaagcauuucuugcuuauucacaauaaauauuccuuccacuauuaaggcauggagauuauuuuucuauaguuuaugaauuaaaaucgauaaguauuuuauagaaauaauauacuggaagaagauacaaauaugcuacaauauuuaacugcauucuacccccuaagcacacauuuuccaaauucucuauaaugaugauguaauuuucacauucagaaaaaagauuuuuuaaaauugagauugacauuaaauauaauaacugugacaauuaaguaauauuugaggccuggauuuuacaucucagaauucacucaauguauaccagcuuauuuaauucaccucuauauuucaugcuucuguguuaggacaaaggccagucuguggaugugcaaacauuuuuuuuucuuuuuuuuuugagacagagucucacucuguugcccaggcuggagagcaguaagagcauggcucacagcauccucaaacuccugggcucaagcaguccucccaccucaaccuucugaguaacugggacuacagguccgugccaccaugccuggcuaauuauuuuuaguagcgaugaggucucgcuauguugcccaggcuggucucgaacuccugagcucaagcgcuccuccaccuuggccucccaaaguacugggauuauaggugugagccccugugcccaggagcaaauuguuuuuuuauaaguagaggcaguccaagagagccuacuaaaaucuuagcuacccuguauccaaagacucuuuggaaagaaaaguggaaugguuuggggcccuacaaagguuaagagaaauuaguagaaauauguugagauaugcacaguugcaaagacccuuugcuacacuguuugauagcacaaaacaacaauaacaaaaaaugcuacuguugaaucuagaauucacuaggaaagacauucuagugacauauaauccaaaauaaaucuaaaauuauauacagccacagguagacagugcauauaaaugacaacacugagauugcauucaggagguuuaaagauauauuaaaaacuuuuguuaacuauauuugaaaacagucuucucaccugcguggccuaguccuuggggacaucauuucauucccaaguaugugguaccgucuugcuucaugcaacaacugauaacacucaggagaauucuggaucaauugguccacuucaacuguuugaacaaaguaguugggaugcaacagagggagucucacaugugucaggagcucguguaacaguggucuucucagaucaacggcacgauagacccaacgcaugacggcuucaaaaaccaucuccucuuuaccaauaacaaguucaucacuacaaauauaaucaauaaguucaucuuugucaagcucaagaaauucuucgugcugggauacauccucaaaagucuguaacgcaaaauuuuugcauuuugugaagaguguuuugagugaauggguaucagcaaagcgcuggauuccuaagcaauuacaaggaucaaguugcuccuccaagaacuuggcacaugcaucacggagaacacuaaucugaaagaggcuugaugucucaaagagauacuguacauucucuguagugaucuucaccuuuccaguauaaacauacugcaaaaaacauuccauagcuucagcuaaaauaccauugaucucaaccaacauuucucggcuuucccuguggucauuacaaaacauagcucugaaguagcugcuacaggcugagagcacagcucuauggcaaggaaauucuuuuccuuccacacaaaugauaacaucugugaauaagcggcuaucacgaaauucauuaaauaucuggaguauguuuucggcaugggaugauccugaagagaagucaaaaaacucaugaccugucagagauuugggguccauuucaaaaacuuuucgcuuaguugcuggggaaucacgcaccccaagauccucucuguuuagucugcgucccaauauuaguaccauuguuacaucaguugacuauauaauuguugagaaaugacuauuagggaucuucuuuauguggcuaaaaguaaaaaaaggaaaacauuucaauaugcaaaaaauucaguauucaaaucacauaauuucauuuuaauauaaacacuacaacaaaaucacauaauauauuucauauaggguacacagcacuaucucauguuaauaaaaacuaaucaacaaaaauuugcauuugaacaauuagaacauugggguaauuugcaauaguacuccuuaagcuccccuuuucuagcugaaaggauacuauguacuucgugaguuacuaauaaccuuccguuuccuccccauuuacagagcugaguuucauacuauugacuguagaguuaagucagaaugguguaagacacaauuugacuacaguuagaauucuaacaguuaucuuucuuuuuaagaaucuuuuuuauuuugagacagggucucacucugucaccaaguuuggaguaaagugacaugaucauagcucacuguaaccucaaacuccuaggcucaagcgaucuuccugccucagccuccugaguagcugugacuaugugugcguaccaccaugccuggcuauuuuuuuuuuuacuuuuuguagagaugggaucuugaacuccuggccucaagcgauccucucaccucagccucucaaaguacugggauuacaggcaugagccaccaugccuggugaaauaauuauuaucuuaauauagaauuccuagagaggaauuuagcuauaucuaucaauagccuuuaaaaauauguacauuguuugaccagcaaguccuuuuuuuuuuuuuagcacucucuccuaaggaaauaaucagaauuaugucgacagauuuaucuaugcagauguccaaugcuguauugauagaaaauacucaaaauaaccuaaaugcccuauaagaggggauuggucaaaccacaguacaucuucuggcuagaacaaagucuaugcaaccauuaaaaauuauauaugacuauuuaacgacauggggaaguaguaaccacacaguaagugaaaaaguagaucacaaaacauaugccaacagaaaaaauaauguaucugugaaucuagggauaggauguacauaugcuaaaauguuuuauuuaucuucucuauuuucuaccaaaauuucuauuauaaaauuuaauauucauuuaaaaaaauuucaugcauguuaucuaggucuuguucccuuucacuaauaagaaacaucccaaaacccccucagaaaugacuuucaguaaguaacugauggauugaggcacuuggcuauagccaucaauucucucucugugucucuuuuuuuuuuuggaaacaaggucucauucugucacccaggcugaagugcaauggcgcgaucuugacucacugcaaucuccaccuccuagguucaagggauucugcuaccucagccucccgaguagcugggacuacaggcacguacccaccacacccggcuaauuuuuguauuuuugguagagaagggguuuugccauguugcccaggcuggucuugaacuccuggccucaagggaucugcccaccuuggccucccaaagugcuggaauuauagguaugaggcauggugcccagcccaauucucuuuaagguuaauuuuaaggcgauucuucuacucccuuuccacaucuucagaagcugauacaugauucaaaguguauuaguaauugguuuaagaucacucaggguaccucaucuauugccauacucucagaauuucauacacaucccuucuaccauucccaacuucuugaaauauuucaagucagacauucaggccuaagacuggcaagcaaaaagaagucagcuaaaggaugucacagauaauauaaucuaaaaaaugagaugccauccuacauucgcaagccacaaauaaaacugagacuugaaaguuaacaucuuaaggcugcauuuuguguacccugucgcauauuaaauuguaccccacuuuuuaagugacacaaagggaaauaaaauacguaacaucaaaaucaagaagcaacucauucucuuauauauaguauucucuucuuuuucauguuccuauuuaucuccauccucucuucucacucuaaugccccagauauccuacuuccaauauucacuagauacuugcaauuuucaugaauucucucacugaauuuacuuaauauugcagcuuuuaccaucaucaucaucaacaaauauuuauuauaugcccacuauugucacgauacuguacuaggccuaggguuuacagagauguaagauauugcuauuggaguuuuuuguuuuuguuuuugcuuuuuugagacagggucuccuuguguugcccaggcuggagaguacagugccaugaccucggcucacugcaaccucugccucccggguucaagcgauuuucgugccucagccucccgaguaacugggauuacaggcgcaugccaccgcgccuggcuaauuuuuguacuuuuuuuaguagagacagguuuugccauguuagcuaggcuggucuugaacuccugagcucaagcaauucuccugccuuggccucccaaagugcugggauuacaggcgugagccacugcgcucagccuguuauguuuuguuuuguuucagaugcucuguugccaggcuggaguguaguggcgccaucuuggcucacuguaaccuccaccucccaggcucaagugauucuccugcuucagccucccaaguagcugggacuacaggcacgcgccagcacgccuggauaauuuuuuguauuuuaguagagacgggguuucaccauguugaccaggauggucuaaaucuccugaccucgugauccacccgccucagcuuccccaagugcugggauuacaggcguaauccuuuucauuuuuuauuuuuuaauuuuuuuugagacggagucucgcucugucgccaggcuggagugcaguggcacgaucucagcucacugcaaccuccaccucccagguucaagcgauucuccugccucagccuccugaguaacuggaacuacaggcgugcaccaccacacccagcuaacuuuuauauucuuaguagagaugacguuucaccauguugggcaggauggucucaauaugaccucgugauccacccgccuuguccucccaaagugcuaggauuacaggcauaagccacugcgcccagcuuuuuuuuuuuuuuuaagaguugcaacaaggccgggcgcgguggcugacgccugcaaucccagcacuuuggaagaccgaggcggguggaucacaaggucaggaaaucgagaccauccuagcuaacagugaaaccccgucucuacuaaaaaaaaaaaaaaaaaauuagcugggcgugguggcaggcgccuguagucccagcuacuugggaggcugagacaggagaauggcgugaaccugggagguggagcuugcagugagccuagaucgcgccacugcacuccagccugggugacagagcgagacuccaucaaaaaaacaacaaaaaagaguugcaauaaaacauauucaaacaacauaaauaauaacauaaaguagcacagacaauaugucccauugguacagacagccuaguuccuccuuaaacuucuauuacauuuuaaaaauucucuucauaucaauuagcacuuaaccuuccugaagccuaggugauaggauuuucucuggacagauauaugccagguuauucugaccauucagggaaaaauaccuggcuauaacaacaucugaaggacaccuaaaugcuugcaugcuauacaggaucuuuucuguuucucugucuaucccccaaaugugcagguaaagucagaaaaaauccaagcaauuuuaucagucaaauggaauaaagacuaaagugaaauaaauaauauuuucauuugaaaucacuaggguggagagucagaggcaguauguugauuuuuuuuuuuuuuuuuuuuuuuugagauggagucuuguucugucacccaggcuggagugcaguggcacaaucucggcucacugcaaccuccaccucccagguucaagcuauucuccugccucagcuguccaagcgggugggacuacaggcacaugccaccaugccgggcuaauuuuuguacuuuuggaagagacgggguuucaccauguuggccaggcuggucuugaacugaccucaagugguccaucugccucagccucccagagugcugggauuacaggcauaagccaccacaccuggccacccucauuucuaaguuaaaaaaaaaacaaaacaaaaaacccagaaaauuucaaauguacaaauauacaugcauuuucuaaauacauaacaaagcuuugugauguaauauaauaguuauggcaauggaagcucauggagaaggccuauuuaaaugaacacauauaaaaguaaagauaaacacaagacaaugcuuaccaauggcugguuucggaguaaaugucaacaaaguaacucccacaaauuuaguuaggaaaauuaguuucucuuaaauuugaggaaauauuuuccucuacauguauguuaugguccaaacaagcuagauuuuuaacuucgacccaauuauguuuugcagauuuuagguaacagacuugccugagaacaaauaaaagcucuauuucauuuuauuaauuuuaauaccuaaaugaauaaaaauauaucugaguuuaaaauauuuuauuaguuuuaaaauuuauuaucacuaacuaaaaaaaaauggauuucuucccaucucuuuuaagauuuuucugauuacucagaguucauguuugcuucauuauacgucacccaacuuggguuacaguugcccauauauuuguguggaugucuggaugcaugugcauacacacagcuuaacauuuacaacuccauuuacaaugcauagaaugacuuccaaauuccaggcucccacacaugagcaguagcguaucuaucaaauaugcuuuuaauuugaaguuaucucaauaaccauuuuauaaacagaaauguaucccccauaucaagagagaucacuacuguaccugaaugucaauuuuuuguuguuggugaaacuucaaaaaguucaauguauguaauaucacaaguaauuaaaaaagggaacauuucaauuaugauaaacauaaacugugaugacauggaauauaacucauauuuuaaucuuaaugccuuauuaaucuagauucaaauuaugguugaauuagcuacaagucagguacccaaaucaagaaccuacuauucauuccagcuuaaucuaguuuaaauuccuguugcauuucagguucaaaaaauucacacaagugauugugacuuugacuagugauacaauuauugguauuaacaacaauggaaaucgugagcuucuuccugcauacauuuucacuuucucaauguuuaaaugaaaauuuguucagaauacaaaacaaaauagcacauuguaagaacuaagaauuucccuuuggcuagaauggacaaguagaaaaacaaauauaaaaguauacuuuguuuuauguauucaaugauuuuauucuaucuaauauuuauuagauaaauuugagaacagugaguuaaguauuaauauaaaauugauuaagcuuuguaucaauuaagggucugucuuuuuaugcuauuaucugccccuuauuuucauaguuggcuccuugauuuguucacugacaaaagaggucuuccucuccacuacuuuuacccaauaaaaaauggaaaauccuggacuagaacaccuauaaaaucaccuuguauuacaaagucuucaacagcaaugagauauuuguuuacugcucuguauguaagagagacuaucucauagaucuuuccaaacagcuucagccugcugccuccugacuuuugggcaucuugacuuccucuggauuuucugggaacucuccaauuacuggucuccguaacuacaccaaauguaaacacuuccuauguauaaaugauuugcaggagggcaucuuaggagugugagaugcauucagaauguaucuuuugggcuuccacaugaaauuugcuagcuuuugccuucccauuuuauacaauaaaguaauacaaagauuagcugggcgugguuguggacgccuguagucccagcuacucaggaggcugaggcaggagaaucacuugaacccaggagacaggagaaucacuugaacccgggaggcggagguugcagugagccgagaucgcaccauugcacuccagccuggaaacagagcaagacuccgucucaaaaaaaaaaaaaaaaaaaaaaaaaggaaagaaaaauguuauccuaucaucucaaaguacggugacuaauauagguucaagauugaucaaaaugaacucaugaugcauaaucaagcaaacaaaacguaagauuacagauugaaccauuauaacauuuuugcaaauaucacagcagaauuauucccaucaggaaaaaguaaacaacuaaguaggcaucucuagacaaaauaaguaggaaaagcuucuuuccaaacaaacauaaugacuuaaaguuauaucuacaugaguuaauguauauaaguugaucagacaugaaugaggcucucaggaaagcacagaagaguggguaaauauuuaguaacagaaaugauugucacacugccaucuuuugugaucuuaaggauagaguugugccuuguuaucugauuggcuuaagugaucccugguuaaagaaaggaauaugguuuaaauucucuaauaacaacauuuagauaguuuauaaauauuacaaauauaccuuuuuagcauuugguugaucaaagccccagucaaaauauguguguucuuuuaauuuccacaccuaaaauaaagaaagaauagcaacauauaaaucagauaguugucaguucauguacagcuggcauuauuuacuaauauguugaacaaaguuuuuaguaauuucuaguuuccaacugaaguucguuuuuguuuaaaaauaauuagugaauaacaucuccuuaaaguaaauuaauaacuuaaugcuauuuuacauaacuaguuuuucuuauuuaucaacuuccuuacuugacaguuuuuuuguuuguuuuuugagacugaguuuugcucuuauugcccagacuggagugcaauggcgcaaucucggcucacggcaaccuccgccucccagguucaagcgauucuccugccucagccucccuaguaguugggauuacacguaugugccgccaugcccagcuaauuuuguauuuuuagcagagacaggguuucuccauguuagucaggcuggucucaaacucccgaccucaggugauccgcccgccucggccucccaaagugcugggauuacaggcaugagccaccgugcccggcacuugacaguuuuauccuggaguuuuauccugcaguaaaauuucuugagugaaaaaugaguaaaagaaaauuaaugucaauagcaagcuaaugguagcacugaaaaaacauacacucugugauauuugaauacacuuuggauauuugaagagugucuggaaauugauguuucauccaaguuuggggccauuaaauaauucuaagaguuagcaaauaauuuuuuuaucuuuuaauauauaaauguauauuucuucugccuugaaucuuguagaaacuuaauccccauauccccauagaaaccaacuaauucggcacaauuccuuuuuuuuuuuuuuuuuuuuuuuuuugguggaaggggagaagaggaaugcuuaagagaaaauaccagaaccuugagcuguguacagaauagcaauaguauuuaaacacaagugguucugguuucuggcccagauaucuuuaaauagaacuuguaaauucuuaacaaguuuagacaaauucaaaaguugauuccaaaaccaaauauaaacgaccuuuuuuuuaaauguauacacacaaacacauauguauacccagacuguguuaugaucaucaagugaaugcuauccuguguuuccuuacuuucagaagugaaccugacuuguauguacccuugguaaaaaaauauugcaacuagggcaaauuugggaauuguuacuccuagcuaaguaaaucuuccuucccaauggacaauaagauccugaaucaaugcagggaugcaggucaauucaugaaacauuuauaaagaaccuaguuuaugucugucacuggcuggcaaauacuggauucagauccaauuuuagacucugugggguuggcuaagaguagagccaaacaagaacuccaagauugguacuaaaauagauucaaauucuuagcaggugcagacuggaauagagccucucauaaccgaucuggucuagaauuauaccuuaugggguagaaagcauaaggcaauucaccuggacauuuucuauggauuuuuagguaauaccaaccuaaucgguaaggguaagggauggaagagagaggguacaaagucugauggagauauguaauaucagaauuaaucuacagcgugaguguacugaaacaagcuuauguuuccuuuagaaugcagaaauucuauacgaugagguuacuaacauccuuaaagauaguauggauuaaugaggggcuucuaaaaacuaauaccagaaaacaaaggaaccaacaacauccugacuagcauggccccuaaaacuuguaguagagaacugcugcauacuauguucuacgcuacuccauuuucucaaauuuaaccuugaaagaacaccacaggagaugaaaagaaagguuaaccaagagguuuaucuugaaagauauauaguaacucaaaagaaagaaagucagaaaauaauugcaauauaguaaaucuuuuuuuuuuuuuuuuuuuugagacagucucacucuguugccaggcuggagugcaguggcaugaucucggcucacugcaaccuucaccuccuggguucaagcgauucuccugccucagccucccauguagcugggacuacaggugugcgccaccauguauuuuuaguagagacgggguuucaccauguuggccaggauggccucgaucucuugaccuugugauccacccgccucgaccucccaaaguucugggauuacaggcgugagccacugugcccggccaguacaucuuuuauuuaaaaaauaaccagaaaaucauauauaauaagguacuauacaaaaccaagcaauuuuuauacauuucagauauuuucacccuauagucucaaaagcuaauuuauuugaugacuuuuuaaaaaucauaaacuugcacuaucaaaauuucaguuuaaagaauuacucugcagcagugguuccuggaccauguuuuacaaauguaauguuuaaagcccagccuucaagcuauuuucaacauuuccaguuucuuaauggaaccaccaagaccauauuuacccaccacaagauaacagaaacuggcuggccgagguggcucacgccugcagucccagcacuuugagaggcugaggcaggcggaucacgaggucaaggguucgagaccagccuggccaacauagugaaaccccguuucuacuaaaaauacaaaaaaauuagccgggugugguggcgggcaccuguaaucccagcuacucaggaggcugaggcagcggaaaugcuugaacccaggaggcggagguugcagugagccaagauggcaccaucacacuccagccugggcgacagagcaagacucugucucaaaaaaaaaaaaaaaaagaaaaaagaaaaaagaaaaaaaagaaaagguaacagaaaccaacuaaaaccuugaguuucuuuggauagaaugauagcaacuauggauuaccccauauuuauuagaaccucaaaugggcaauauacuauaugacuuugcuugaugagaaacaaaacagauagcuguugaugacaaauuuaggaaagcuuaaacaaugugucagacuaaacaauaugguucuuuaacuaaaaaagaauacuauugucucuuaaaucacaggaaaaaaaauaugaauuucuccaguguuucucucccucgacuuaaaacuucuggcuacugauauuccccaacccuaaaggaagaaaaaaacuuguuaaccaucagacaucacacgugguauaccaagcugcccuauugagccuacucaugcuucugacuagacuugauguguaaauuuacuguuguuugguuuuaucuugcuaacauguuucuuuuagguauuuaaugcauuguuuuauuugauaaucaaaacaccuauagauauaugauauaguuauguuuucuguuagaaaaaugguuuugguuauuuauuuauugagauggagucucgcucugucacccaggauugagugcaguggcacaaucuuggcucacugcaacccccaccucccggguucaagugauucuccugccucagccucccgaguagcugggauuacaggagcgugcuaccacaccaggcuaauauuuucuggguuuguuuguuuguuugguuuuuaguggagauggggguuucacuauguuggccaggcuggucucgaacuccugaccuggugauccaccuggcccggccucccaaagugcugggauuacaagcgugagucaccacgcccagcccgguuuugguuuuuuaauuaaaucugcaaggaugccagcaaggagcucugccaccugaacaaauuugagauuuuuuuuuuuuuuuuuuuuuuuugagacagagucuugcucugucacccaggcuggagugcagcggcgcgaucuuggcucacugcaagcuccgccuccuggguucacgccauucuccugccucagccucccgaguagcugggacuacaggcgcccgccgcuacgcccggcuaauuuuuuguauuuuuaguagagacgggguuucuccguguuagccaggauggucuugaucuccugaccuugugaucugcccgccuuggccucccaaagugcugggauuacaggcgugagccaccgcgcccggccacaaauuugagaucuaauauuuuacaugacuucucuaugaauaaaagcacauagucagugguuuauauuuaucuuaguagugacacgaauuauuuacagugguagccuuuggaaaccucaguuaagaguaaagcccacuuuuuuuuuugagacggaguuuugcuccuguugcccaggccggagugcaauggcgcgaucucagcucacugcaaccuccgccucccgguucaagugauucuccugccucagccuccuaaguagcugggauuacagccgccugcggccacacccggcuaauuuuuguauuuuuaguagagacgggguuucaccacguuggccaggcugaucuugaacuccugaccucaggugauccacccgccucagccuccgaaaguacugagauuacaggcgugagccaccgcacccagccaaagccuacuuuuaaaacaccaguuuaguagucuuuaagaugugccaaauguugaaauacuuuaacucugggaugaugaauauaggcagagugccaaacucuucaauuuaaagaaguuugcuuagcgauuguuuuauuguuuauuuuuugagacagggucucacuauguugcccauucuguucucaaacuccagagcucaagagauucuccugccucagccucuggaguagcugggaugacaggcaagcacuuaauguguuuuuaauaggagaaacaauagcgguuuuuaaaugucaacaguugucaaguggcuauauacucuccaguuguuucagucacaccagaaauaaaaucauacaaaaauauauuuuucauacguauacuugugaagauauuuacuuacauuuuuccauuauacaguccauacccaaauauuuauugaaaaaagugucccaaauuuuugucaaauagacaaaaauaacuguggucacuuauuugauuaauaguauuuauuuuucacaggcuugaccuuuggguuuuaaugaaaugggagaaaaggaaguuaaaaaaaguuauugaaaaagcauuaagguucaacaacuuggacaaaagccaggaaaguuuaaguuaaagcugguagucagccuuaacgcagaauuuauuucuucuuccuguuuagagacuuagguugcuggcuuuguuugaauaagcaagccuuuacugagugaugguuuuacuuuuucaaaagguuagacgauugcauuuuguacucauuuagauacauuaaauacucucaaugcacaagugaugaggcgguucugaucacaggagaugcucauuccgguguaaccaucuccucuggaauuuuaaagaaugcauaaccaauaggaacuguucauauucaauuccugcuucauccaggggagcucaaacuuccuucuacaaaaauguauugucuuugccaggcacgguggcucacgccugcaaucccagcacuuugggaggcugaggcgggcggaucaccugaggucaggaguucaagacuagccuggccaacauggugaaaccccgucccuacuaaacauacaaaaacuagccgggcgugguggcgggcgccugucaucccagcuacucgggaaacuaaggcaggagaaucgauugaacucgggaggcggagauugcagugagcugagauggccugggugacggagugagaccacuccacuccagccugggugacagaaugugagacccugucucaaaaacaaaacaaguguauuaagucuugagugaauuccuauaucugcagaagaaaaucugacaaaacgcaaauacccuauuaacucaagcgauuagaaaaaccauuuucaacacacuauggcuaaaaaugauuggucuugaagauuuuauuaccgucagcuuaauguacaauuuuaaaacgacacagucgcaacccacuucucaaacauuuugaauuaccacgggaauuaaaacauagaagugugugaccuagaaucccucaaacaaggaaaacaacucauccgagccgaguauggaagaaucuuuacuuuuuaggggaguaucuucaaacuaucuuuuuuaaauaguagaaaucugcuuuuaaaucucagccaacaacaagcagauuuuaaaucuauuuuacaacccuaauaaaaaccaaccucuuagcugguggacccagucuguagcugcaaauacaaagacgugauuuuugaaaagcugcccacaagagcaagugauuaaucauuaaaauccacuaaaaucaauugugaacagccacugccucaggggugaccguggggcccccuaagauguggcacugugaucuauauuuagcuaucuaaacacguuuacagaacuggcaacaacguguucgcaggacuuccugcgaaccacccggcagauaacgcgacacuaguuaaaggguguuaauuuuccgguccucggagggcaggccacgguagccgaucucugcgugcccagaacugccugcaggaucaggcagcagcagcggcggcggcggccaccgaggcuaccagccgcccgcagcaggggcgggagcgcgcgccucccgcacccgcgccacccggcuccacucgggccgcagcugcaaaagcagcgacagcgcgcgcucccgcgcguccuccagaucaccuucaagggggcgggaagaauggcccagggcaggcccaccuagugacaauaaaaacucgccaauaaaaacucgaacucucccucggguaccgcccacaagcugccgcaggcgcccaauccccgccgcguuaacagucuucacccgggguguccagaacuugagggcggguccauuaggaacuaaauuaagaaacugaguccuggagugguaagaagguggggagguuaggcggggacugcgccggcggaacgcccgcucccccgcccgccccggcuccccggggacggccgcagcgggccgggugucgcgaucgugguaaacaaaggcucgcaggggacgggggcggggguaacggucaggugacagugccgagugcauuucgcaaucgcuuuaauggggcuucacgggcccgcggcccuggggaccccaccuugaccccgucauuccucccggacagaaccgacggucgucccaccaaacaagaaggcuggauuugaggcggucgcacucccccgggcuuccugaaauaaaaagcagcgccccguucgcagcccaucggcaacaagcagcacccgucugcccagccgccucccccggcggcgcccggccccgcggcgacuagccuaccgcaccugcggcuacccccagucccggcaaccaccccgcccuagccaggccgcaccagccgcgccgcgguuccgggccguagugccaggaggcgcgcgcgcccucccucagggcuguagcuaccaagcgggggaggaagaccccccaggugaacccuggaggccccucgccucagaaaggggcccuguagcccagcugcagccucuccgcagaccgccagucuggcucugagaggccggccgccgcuggcugcccucccgcagacaccccgguggucaggaccgccgucgccccuccgcccccgaggacucagacucugaccgguuccucgccuuucggccggucccggagcugucacccccgguaccucucggcgaacacuggaagcagccagcaguggcuaaccccgcggucccucagcggcgggcggcgcagcgcacucuccagcgccggcgucuccuccagccaccagucucugccgcagcucacaac

SEQ ID NO: 192617 - RNA, 34187 nt, Homo sapiens
cuugcgcgguguggcggccgaugccgcuauaaaggcuuguuuugcugcagggcucaugcucgggagcgugguugagcggcuggcgcgguuguccuggagcaggggcgcagguaggugauggcugcugccgcaccccugcccuccagcucgguugucacggggaucaccccuuugcauuuccucggggcguggcgggauguggccagggcugcgagcaguucgggggacacuggagacuuggggaacggcguauggccucccccuggucuccugccgccgccuccuaggccugugagcccggggucuggugacggggucgugugcuggaagacaggcagguaggaucgggaugagcgggcagggacgcgggcuacgucccuggccgcggccgccagggggcgcugcgcccgcgggccgugggugugggucgcgcucgccugggcaggccggagcgggcugugggaacgcccuagggcccgggcaucccaggcgaagcgggucugagagaaacgcccaccugggaggcugugcagcggguggcucggggcacccugcucaacccgcagcggagccgccagcgaccuucgaaguaagucauccccuucguuuuugcaagcggguaaauggagguacgugacauaagcacgcgcagcaaagccguggcugugccgggaacgcagcccagaucucuccacggucauccagugcucuuuucgcuucugccacacagagccgcggguggcuuuguguuuaucacacaggggccauuugguuucugcacagacggagaggcuggaggcaggugggcacaggaacgacggggaaaguuucaggaggucuuggaggaggagauggcuagguuuuacugugguccgcagcguguaugaaaggugaggcugcuuggagacgcaacaaguggauuacagugggugugguaaauacguaucccuuuagcguggugucuuccucgugcagcuugagggccuggaggugauggaaaccuacucaugaguguugggaugacugcagcuugcacacaccagucugguaaucccgugcaacucuccuccugccaugcaguugaaucaguaucauugugcagggagagugucuacacuuuuaucaguggaaagagaaucuugguaaaaaagggcagcugacuaaguggccucaacccuauugggcacuucuuugggguucucccacguugauuauucugcuucuacccuuguacaugucuggacaacagguuuguuuuuuacaaacaaaaaucccuucucuuucuuccucucuugauagcugaggcaagugagcauuuaaaaaagauauuccaacaacuuuaaaggaggacacgagaagauagggaaauauaaauaguaucaguaaaauggcuggccuggggauccauccuugcuugcuugcuugcuucagacuggggcuuuguuucuuuccaaaccugucaggauucccagcucuucgccggccuccacguggggugcccucuuuuauguuccagauacacagacgaugguguccuuauguucaaggccacagacaguaacuuugugccuacuuugggccugccugcucuccugauugugccucuuuuuccaggaaaguagagaugaguguguuagagauaauggaacacuguuccccacacccuucauacauagaauaacuuagucccuuaggauaguuuagcagugucuaccacagcagucacuguaggcacaaaacagucauuauuugugucauaacagggaagucguuuugucccugccucucucugcuccugugcuccacugauucuacuucauccuuugaaauaaaagugguugaaagaaucuuugguuaucaugggugcuuagauaauuaagauuauguucguguucuucuugauguggcauuucauauuguggaugaguuccagugaccuccucuguuucaaacugcucaccgccccaacccccaccuuuuaaaaagguaguacuaaucuuuuccucuuccagauaaucagcuaagcuagggaacccuugaaggggaagguuagaauuucgugauucccguaagaagguuacucugaucuacagcuacagcucaacacuggggacacuggcagaugccaggucuguuuauaguuuagccuuaaugaggucucaaugacgugauugcugcacucuggcuuggugagccgcuguucuuuaugguguaguuugucauuggacaaggugacuuuuuuuuuuuuuuuaaagauaaguaacagcuauaucaacuuaggguacuugaaccagaauucugaaaggcaagaaaucaagcuuucuuuggacuggaaaccugucuuugcauaggagauuuaguccuuuuuauucagaggauuaguaaguguucucuuuuuaucugacacuuuaaaaauugcauuauaaugguuagaauuuugugcugcagaaguaguaguuuuaagucacagcgauagccagggauuuauggaauccagaaggcgacacggcuacacgucuuuaauuuccguuggaggcuaguaugaaagguguuuucucagcuugucucugggaggcugugacccuucuuagaggggggaaacauuuuggagaaguauguauguguuuuuuguuuuuaagugaccugaguugauacagcauauugauuagacuuagccaggcaagcagugguuuagaauagaguuucagguaaaaacuagguaagacuuaguaauacaggguggagaauuuguuuuuguuauuguuuuuuacuaacagcuuuguugccauaggauuuauaugacaugaaauucacucuuuuaaaguauaaauucaguguguuuuuuuucaauguauucacugcauugugcaaccauuaccacuaucuaguuuuagaacauuuucaguacccagggaauuuguguuugaaguuaaguuauaacauuguuuuaacuggauaacuucauggagcuuuaaaauaacaccagcuaacccauuaguuaauuauaaaaaggcagagauggaauauaucauugguagaauaaguguuugguaaguuuuuauuuaguaaaauuuaguagaagaaaugauguccacuuuaaaauuguggaguuuuuaauacuugggacaaacugaaauuguuucuagaaagucuuuaaaaaaaaaaccaaccuuucuauuguauacacuggauuugagcuuaguugaagagaaugggugucucuuuacuaguguguuuacuguuucuaauuuuuuuucccuuagaguugggagaagguaauuuuucuugauucucuuauacugaaucuuuuucuuuaaaaaaaugaaaucaaaaucuuugaacuuuuuuugaaaauuaauuuuuguagcuauaacaguagaaagcuuuaguacuuuugccuuuuuuuuuuuuuuccuauuuuuaaggcacuugagcuuaugguuaaguacuguuuaggaaauaaucuauuucuugaugaauuuuuaauuucaggaauucugaugugaaacuaacagucugugagcccuggaaccuccacucagagaagaugaaggauaucgacauaggaaaagaguauaucauccccaguccuggguauagaagugugagggagagaaccagcacuucugggacgcacagagaccgugaagauuccaaguucaggagaacucgaccggucaguuuccuuuccuaagagucucuuaccugcuuguuguacuaaaacacaucuuuuuucguauaauggguaauuuagaaacuuauuuuuuggccgggcgcgguggcucacgccuauaaacccagcacuuugggaggcugaggcggguggaucaucugaggucaggaguucgagaccagccugaccaacauggugaaaaccugucucuacuaaaaguacaaaaauuagccaggcgugguggcgggcgccuauaaucccagauacuugcgaggcugaggcacgagaaucgcuugaacccaagaggcggagguugcagugagcugggaucaugccacugcacuccagccugggcgauagagcgagacucagucucaaaaaaaaauguguuuuucuuuauuggcuuuagguuacuguuaagaauuuaugguuauugauaagucucugguccauaguaagcacucaauaaguggaagagaggcuggcugucacccucucacccggucuguucugagcauucuccucuuuuucacuuuuauucuauguuggugccuucugaaaaggcuauacuuaacagaagacaacuuauugagggggagggggucauggggucaaugacagggaauauaaagccaauuaagcuucauucauguaccuaaacaaaauugguguuuucuucuacuuucugucauguguguuuaaaaugugaaccuggccaggcacaguggcucaugcuuguaaucccagcacuuugggagguugaggugggugggucacuugaggucaggaguuugagaccagccuggccaacacggugaaacccugucucugcuaaaaauacaaaaauuagugaggugugguggugggcaccuguacucccagcuacucaggagggaggcaggagaauugcuugaauccaggaggcagagguugcagugagccaagaucacgccacugcacuccagccugggcaacagagugagacuccgucuccaaaaaaauaaaaaauaaaauaaaaugugaauccuuuggagagacucagauuucagaacaauucuagauaguugugggauuaucaguauguuuuucaagcgaauucauaaguuaagcagucuuuagauaauaaucuaauuuccuccaagggaaauaaugaagaugcguuuuuaccucgagaaaauauucuuuuuccugaggaaaaaaagcauuauaccuuuucuuacaaaaguaccuaauaaggcagaauggacuagguuuaggaaguugagguuuuuguugguguauuuguuaugugaaaauuugagaaagauaauggacuuugcagcugacacuggccuuuccuuagccugauacuaccuuucccucuuugguuguguuaaagccauugcuuuauuaaugaacauuuucuugcuaaugagucuuuucuguacccuacuguguauuauagaaugcuuuuccauucagguuuaacuucagagaaacaggcuuaauguaaucagugucaaaugcuucucguggugccaguuuuauaacuuccucauguccuuuugucuagaccuuauguugauuaaacaucuauccauuacaucugagugcuagacacauuuaguguaacaguuaagucuggaaaaagucagaagguaacauuggggcagggccuuaaagggugauuagguggggaggcuuuuuaggcgguacaaguacagacccaaagguauggaaagagcgugugacauauugggacuuuggauaagcuacuuacgucauuuguauauaaaaugggguugacaguaguaccugacucaugggaucacugaggaguaaaugagauaauacauauaaaauauuuaaaaugguaccuggcacauggccagugcucaauaaauguuagcucuuagaacuaguuguucagggcauaggauguguaaagagauuauaggucgggugaaauucugcaugccaugcuaagaaauauuucacugugggcauuagggaacuauuggaaguuaaugagauuaaaaaaaaaaaccuuuuuauuuugagcuaacuguagauuuacaugcaauuauaaaaaauaauauagagauccuauauauucuucauccaguuucccccagugguaacaucuugcauaacuauaguccaguaucacaacaggauaaugauugacauugauacaauccauugacuuuaggauuucaccaguuuuauaugcacucauuuguguguguguguguguguguguguguguguguuguguucuaugcauuuuuuaaagguguaaauuugugugaccgcuuccacagucaggaugcaaagguuccaucacaaggaucucucguuacccuuuuauagccacagucauguccccucaaccccagucucuggcaacugcuaaucuuuucuccauuucuguaauuuugucauuuuaagaaugcuauauacauugaaucauauaguauauaaccuuucgagauugcuuuuuucacucagcugaacucccuugauagccaucuaauuuuguugugugcaucaauaguucuuuccuuuguauugcugaguagcauuccguguuauagauguaccauagcuucuuuaaccauucauuuguuaaaggacauaugggucauuuccaguuaauggcaauuauacauaaaggugcucugaaccuucaguuacaggauuuugugugaacauaagcuuuuauuucucuggauuaaugcccaggacugcgcuugcugggucauaugguaagugcauauuuaguuuguaagaaacugcaguacucuuucccagagugucugugccauuuuacauucccaccagcaaugauccaguuuuuccacauuguugccaguacucaauguuauaauguuuauuuuagccauuccuauagaugugccugguaucugauugugguuuuaauuugcaguucccuaauggcuacgauguuugagaguagauuuuuaucuuagauuagucuugaagcaaugcagaaaaaaaccuguacaggagaaagagaccaaauauaaagagcauucaggaagcggcucugccuauccaugucagagaggccaggguucuguuguaaagcacagaagugaggauggaggaaaggcguuucuagaagauagggaggcauuggggugucugggauugaugguaaggauuuaaaccuauucguggacauaagaaaaggagauuggggagauauuaagaaugaguuugggccgggcacgguggcucacgcccguaauccuagcacuuugggaggccgaggcugguggauugccugagcucaggaguuugagaccagccugggcaacacagugaaaccccaucuacuugggagguugaggcaggagaaucgcuugaaccugagaggcggaaguugcagugaaccaagaucgcgccauugcacuccagccugggcaacagagugagacuccaucuccaaaaaaaaaaaaaaaagaagaagaaugauuuugauuuugaagauguugaauuugaagugcauauggguaaaauuaucaguagguagagcauagacaagaaguaguguaggaaaaaacauuuagagccuuuaguguguccacauaggugaagcugugagagugagcaggcuuacccaaggauggcuugcagagcaggagaagguggaggcuguggagcuggugugugguccugugaaauuucuggggauaggguccccagcuugugagaguagaguugacaucaggguuugcaguggcagcagcgagcuuuuccucuacgaaguggagaagaacagcagguaggcaccgcugggcuuugaguacccuaaaggauauggagucagccaccacuguagcagguuuucaacaugccacugaagccuuaucucagagaaauaugaaggcuaauaccacuuuuauaaaauuucaggaauccacaugaauuuuaugaauuuuauuuuuauuauucuuucauguuuccuaaacuuuuuuuuuuuuuuuuuuuuuuugagacgaagucuccuucugucacccaggcuggagugcaguggugcaaucucagcucacugcaaccuccaccucccgggcucaagcaauucuccugccucagccuccuaaacagcaggugccuaccugcuguucucuguuaccacauuggccaggcuggucuugaacuccugagcucaagugauccgccugccuuggccucccaaaguacugggauuacaggcgucagccaccacaucuggccaugaacuuuuauuuuuuauuaaauuuuuuuuguuuguuuuuuuguagaggcacucucacuguuggccaggcuguuguugaacucccagcuucaagcaagccucccgccucagccucccaaagugcugggauuacaggcauguggcaccacacccugccccuaaacuuugaaauuugaguacuguuuuccugauuuuuacuguauccuuguaaucucugaacuuuuuuaaaagauuucuuuuauucuacucucuuucuguuacuuagucuagaccuagcaaaacaacaacaauaagcccauagguuuauucaagcuauuuuuguauauacauuaaaaugaaugcaucgcuacuaaguauuuuuguaaguucagacaccaucuagaaucugcuugaccguuaccugucaaaaaacaaaauuucucagauguauuuaucuuuaacuugucuucauguuacaaguuugcugacagaagcaaccagcaagaugacaagaaauuuuguggucugagaaaauuguauaaaugguauaaaauggauaauguaaguaguugggaagcagaauuccuguauaagcauauaguuuuucuuuuuuuaaaguaagcaguuaauugggcagagauugcaauuucaugucacaucaucauuaccaucauuuuuauauuuguuagagaggaaaucugggacaggaucucccaggaugccagguaugccuacuaucugucaaaaauuuaaaacaaacaacaaaaaagccucuaaguaacaaaagauaaggauacaucuauggcucuuauguggaaagcaagguuucauucagcacuauuagccuuuaacacguggaauuaaccgagaagcaggagaccugugcugcuggugccucacgccuguagucccagcacugugggaggccgagggaggaggcucgcuugagccugggagugcaagaccaaccugggcaucauggugagaccugucucuacaaaaaaauaaaaauaaaaauaaauuagcugggcacagggguuugugccuguagucccagcuacuugggaggcugaggugggaggaucacuugagcccaggagguccaggcuacaguaagcugugauugugccacugcacuccacccugcgugacagagcgagacccugucucaccaaaaaaaaauaaagaaagaaagaaaagaaauggugucaaacagaagucagaagcaaagcaccaaagaauaaguucugacuuugagcaggccagugcuuuucuucuucaagguguaagugaagaugcagauuacaugguuugcccauuucucaguauugugaccaaaucauucuuuuggaauaugacuuggaaaaauugcucuauuagucacaucuucaaauauuuauaauuucucacguaugcuuagaaauaauuaggguugaaauaaagcauucgcacaucuacccacuuucuucgggacuguaauguuaaugcuuguggccacacacaauuugaggcuuagcaggcauccuuuaauccugaaguguuaauaaaguggugguuucuguugcuguuaguucuuugagccugaguacuaacuuuggcuggcauuaggcuggcguuacuucagcuaacaugaaguuuuauaccuaggcugcuccuaaacacuguuccuuugccugaggcaugauuauucaggcaugguuccuuuuuuuaauccuauuuauauaugcacauguagaucauaugacuccacgagcccugauuuuuuuuuaagaugcagucaguguuuauucauuuuuuuaaauuuagcaaauauuugaacacucuucaagaugcaugcacagcacugaaccgaguggucuggugcagauaaagauaaauuggugcugggccugcuuguccaccaauagaagcuuaaacucacaacacguacucuacauagaugacuguaauuuagaugcugugggaauuaguaaaaggagaaagugcuucucucucagggaacucuuuaggaggagguaucauuuggcuggaaacuugaggaauggauagaauuuggagaaaugaagaacuugccaggcaaaagaaagaguugugggauagggauaccuaguccuuguugguauugagcaucaaaugugugaagucuuagcuauagugcaauaccucagugaauuucacauuaugugugggguuuuuuuguuuuuuguuuuuuguuuuugagguagagucucacucuguagcccaggcuagagggcaguggugcgaucuuggcucacugcaaccuccgccucccaaguucaagcgauucuccucucucagucucccaaguagcugggauuacaggcacaugcaaccacacccagcuaauuguuuguauuuuuaguagagaugggguuucaccauguuagccaggcuggucuugaacuccugaccucaggugaucccuccgccucagccucucaaagugcugggauuacaggugugagccacugcgccugggcauguguguucuugaauaauaagccaaggaguuuggauuuuaauugcuuuaaauuaauauuuaagcaaaagcaagacaaagcuugucagaugcuuuuaugagcuuuauuuuauugugguggugguuuguuuucuuagugcucucaggcaaagguaagggugccuuguuuuucauuagcaugucuaaucugggaaagaaggaagaauggaaaaauaagcagaagugggccgggcgugguggcucacgccuguaaucucagcacuuugggaggccgaggcgggcagaucacaaggucaggagauugagaccauccuggcuaacauggugaaacccugccucuacuaaaaauacaaaaaauuagcugggcaugguggcaugcaccuguagucccagcuacucgggagacugaggcaggagaaucgcuugaacccgggagccagaguuugcagugagccgagaucgcaccacugcacuccagccuggggaacagcaagacucugucucaaaaaaaaaaaaaaaaaaaaaaaagcagaaguaaacuaaaguucauguaccauuauuacuggcacaugaacuuuaguuauuuuuuccccuucucucaaaagugugucauuggugggauuuucuuccuaccaaauuagaauauccugugucuaggaaagguaacaaagcaaguauucauaaaauccagggcucuuacuuaguauuuccuuaguucugugguaggcugacccuuuaaucuugguuggaguuuucauaauuaaugcuuugaaauauuuuggugagcucaaguuguaucuuagggaucaaagaugugggucuaaucucuuaccagaaaugauucgaagauguauuguuaggaaagaaauaugggcucauuauagaaaauguacaaaguguguaaaguuguagaaaaaaaguaaccacccuuaauuccucuacccagagacagccauuguuuucauaaaauaguuuugucuaguacauuguacuuuuagaguuugcuccugaaagcuuuucuuuacagacuaaggacgugugaauuugucuaugcccuuguguuuuccaagucaagaguauuaccugugagucggcuugcuguuaggaaggagagcaggaggaaggagauuagcauuuugcagcucugcauuauuuuucucuugauugauacucggugacucagcagauuuucuggacaggguuaagauaaguaagaauaccugccuuuuuuuuuuuuuuuuuuucuucucucccuguaggcauccauaaagcuuuaugaggcacaguagucucuuaggcgcugcugggugugacaccguaucuggucuggugccagguguuggucuccaauagcagcccagagaucuccggcugagguaacaacagugugcgauugguguggagcccagguggcucucaugcuugguaacugcauugacagcucgcuggggcucuugagguugggcugcugccgggaucaucagcucucuuaugccguuugcugcaagacugccgcggcuuuccuaggaagugcugcuuaagggaaauaaauauagccuguuggcaugaguuaaaggaacuuucugucaaaggggaagaaaaguguuggaauuagcuuccuguuuuuuuuuuuuuuaaguaccuaaaucuuuauuugguuaagauaacuuggaaguuacaaaugguuaaugaaaacuuuuucaaugaaauauuguuuccacaguuagguggguuuccguuaaugcuuucuuuuuuuuaguuauuauuauacuuuaaguucuaggguacauguacacaacgugcagguuuguuacauauguauacgugugccaugguggugggcugcacccauuaacucgucauuuacauuagguauaucuccuaaugcuaucccuccccccucccuguucaugcuuuuuuuaaugucuuaccguuuuucccucucuuuuagucaaaaauaaaaaggucaacgcaaagaaacagggacuccagaaggcuuugcaaugguuaaaccugucauuauuaaacucacagacuaaugugaaguuaauuuggugcacugaaguccacuaaugagcagaauuaaauuuauccuuuuccucccugccccccuuuuaaggaguuagccuauuuagauaauuagauguuauauauguuuuaacuauuuaagauuauuuuaugaauuagcuguucaaagaaucaauuguuacuagauaucagaugagaacuuccacuuaccaaagccugcucauggagguagaaagcaagacugacauguguacuuuaaaagauggauggaaccucaaaggccgucuugcccaguccccauuuagccucaccucucuguaggugaggcccaggagagacacuuacuaggcagacuaugcuggggcugggugagcuucccaaggauguucuuucuggaauucgguggcucagaauacagcacuuggcuccucuuugaagcaugauggcucuguugccugucucuggcccagugugcugggcugcugaaaagagcauggaaccacccaggagacgccacgacacugacagcuguaccugaccugaggguucaggauauguuuucaaaagcaaaucucgcuaaaaaggauuuguauguuauuaugaaaucuauauuuaugugguggaaauagacacacucaggcuuuuagagauaaacuacacagaauggguuacaauaaaugcuuauaauuguuuggcuuuuuuaagaauccuguuaacuugacaaccuucuguuuacuuuucuuugguauuaugcagguaugauauugagcagucacuuaguuuucuuaaauguugugucucacaguagaaaaauagccaaaccacucagccccugaccuuuguguuugcuucucacggugaucagcaguucuggucugcucugcaguaugguggucacaugauggaacccagaaagccuuguacuaagcauuuaacacacauuguguuaggcacuggaggaaguuucauuuacaaauuauauuuuggccuuuuuuuuuuuuuuuuuuuuugagacggagucucugucacccaggcuggagugcaguggcauggucuuggcucacugcaaccucugccuucuagguucaagcaauucuccugcccucagucucccaaguaccugggauuacaggugugcaccaccaugccuggcuaauuuuugcauuuuuaguagagacaggauuucaccauguuggccaggcuggucucgaguccugaccucaagugauccaccugccugggccucccaaagugcugggauuauaggugugagccacuguaccuggccuuuuuuuuuuuuuuuagcuaaagccugaaaaucuuguugaagggauuuugucaaaugcaaaagaccaauauucacaacucucuaaaucagugguuuucaggccaggcugaauguuaaaaucacuugaagaauguucaacaaauaccaguguugggguccuauuccagaccaauuaaaucagucucugggauagaacccagacauugguauuguuuuaaaacuccucuggugauucuaguagguaggcagugcugggaaucucuagaucucauggaauaaagucuguucucuccccucacucaauggcuccaaguguuuccuguaaaucccguuuuaccccugugauucauuuucaguuuaauccuuugaaaccuuaccaugcuauuaacaaaguuaaucuuagacccaacauaacaggaacuuugaauaaguuccuuggaauuuagcuuaugaaacaacugaaagcccucaaauuccuggugauuauggaguaaugcuagauuaucaacugcagacaaauaccuguuuuacuguggugguggagauauguuugugaauuguauugcuagcugaucaucggcuugagaguaacauagcacagcuacagauaagugagcugaugcucaaguuaauucuuuucucaguguaguauagcuguugagugauaggacugaguuuagcagcuucccugacuuggaauaauagcucuuucuuuuguauucugcuucuuccccauauagguuggguucuagaauuuugcugauccucuugacugaaauggcuacuauuuggaaguucuuaagggaagagcuuaagauggucaggguugugauaacaacccacuggggaguaaggauguggugggaauugcagaggaaacgugcuugguagguuucuuuaacuuguuggagauuaggaagggcgggaaggccugaagucagccggucuugggaggacaucaguuuuugaucuuuuuaaauuuaaaagugaauuuuaauucacuuuuaaauuuaauuucuaauauucugagucccuuaagaaguauaucuaguggcacaacaguuccccuuaaaaguuugucuuucuagauguuugucauaaaggcugcgugggccugggacaucuguagaaaugguuuucuuggccagaaggauguauuugaagaggcgcccauugucuuguuugucuuaaggucuugugaaugaggagaggagaggaagacaguguugugagaucugaggccuguugauuccgauugugccccagauaccgcuuuauuugaggggugugccagacaggagcaggcagccuuuaacccccuuggaaaccgagguaccucucuguugccaguugacaccugcagucucugccuucaggaacaacuugguugaauccucagcccgaggcuuauuaggcaggcuacccugcuguuguccggccuccaggaagggauuggauuguucagacggggaacgauuucuggccccugguaucugucccagaggccuccgugcaggggaaaagcccuugguugcccugucagcaggcauuugcucuggcagccuguuaaaaugagaugggacagcuggagaagugguggccauggggugugauaggugcgcugauuaucugaggccugaggauggcguuagcgcccgcagaagcgucuuuugcaagagcagaucugucugcuuaugaaucgaauguuaccuguuuuucauaccagaggugucuaugaauguguguuucccugaucuuuguuugaaccuugacagaaucugaauugcuuuuuguuauuguuguuuuuguuuuucucuuuuuuuuuuuuuugagacggagucuggcucuguugcccaggcuggcgugcaguggugcgaucuuggcucacugcacccucugccuccuugguucaagcaauucuccugccucagccuccugaguagcugggaugacaggcaugcaucaccauacccggcuuauuuuuguauuuuuaguagagaccgggauuucaccauguuggccaggcuggucucgaacucccaaccuuaggugauccucccaccuuggccucccaaaaugcugggauuacaagcauaagccaccccacccggcagaaucugaacuucauugucccucuuuagcuucccugugaccuuacuccugccccauugccauuaccuugguaggaaaaaugcugaguauccuagucacauagucauggggaagauauaaauggcagucauacuuccucguuugauauuuuucucagcuccuggaucugccaguauuuuucccuuuaagacaaagcagcugcugugggugccuuucuguguggcugggucgucuggccacugacagccuuucagugugcugugcuccuuaagagaaauggguccccucaucuuguuucaggggaaacuuuaaaaaguuacuuguaaaagggauugaaagcaucauaacaaaaaacaaauggccucauaaaauacauuccucuaggucagccuauaucaguacuaacuguguuagcucuucagcuaucuaggguuaccuuaguacgauugacauuuugggccacauaauucuuuguugugggggcuauccugugcauuguaggauguucagcagcaucccuggacuuuaccugcuagagcuaguagcaccccucaaacauuuccagauauugccacauguccucugggcaagcaaaacacccucacuugugaacuccugggcugcaccgugcgacacaguacuauuguggcuauuaagcauuugaccuguggccagucugaacugagaugugcuguaagcauaaaauaccugauuucagagacuuaguacgaaaaaagaaauaccucguuuguaaaauaccuaauaauuuuucacauugauuauauguuaaaaaagauaauacuuugcauuggguuaaaugaaauauauuauuuaaauuaauuuaccuuuuacuuuuuauuuuuagagucagagucucacucugucacccagacuguagugcgguggcaugaccauggcucacugcagcgucaaacaccugggcuccugugauccuccugccucagccuccugaguagcuaggacuacaaucucgugccaccaugccuggcuaacuuuuaaauuuuuuauagugaugggguuuuggaggguuacacagacuagucucaaacuccuggccugaggccauccucccaccucagccucccaaaguguugugaugacaggcauaagccacuguacacugccuacuuuuuacuuuuuaaauguggcuacuagaaaaauuuaaauuacauuauguggcuuacauuugcagcuugcauuauauuucuauuggacagugcugaacuagaguguugaucuacuguagguuagccauugauuuuguauuaggcauuuagaucccuguaagcuguuggguuuaaugauuuuuuccuuuggaagauuuuccuuuaugcaguaaaauuauggagacacagaguauguaguauuacauauuaccaguuugcucuccugaaucccugcugguagcauauuaaaaaucaguuuaauguucagaccguguauguuugucuauauuucucuccuuuccauauugcauuuucuuuuccauauuagauuuuaucucuuuuaaggcuuaugugguuguaucuuaaauuuaauuuguauuucucgauuggugacauugggucuguguguucucuccuguaucuagaacagugccuggcacauaguaggcccucaguaaggacuaguugaaugaauggaugaaaaaauacuguauuuuacuuuuucaguacaaguccacuacucgaaauauauuauuauguuagcuacuugguuacuucuuauuuuuauuuauuuauuuauuuauuuagagacagggucucacucugucacccaggcuggagugcaguggcaugaucuuggcucacuucagcccgaugguccuggcucaagcgauccucccaccucagcuuccugaguagcuggggcuaacggugucccuuuuuuguauuuuuuuguacaggcgggguuucaucauguugcccaggcuggucucaagcuccuaggcucaagcgaucugcccgcuugagccucccagagugcugggauuguaggugugagccgccgcgcccagccacuuggucacuucuuuagcuuuaucuucccuucucuuaaugcuaauuuccuuacgcaaaaaaguuuccuuuucauguuugaaccucucuucccuuugauacauuucugcuuguuggguguaaauggaggcugucccccaucauagcuggacuaaguaugcuauauaauuuaugucaucauuuuuaauguaauuuuugggagguuaauuccagauggauuaauguaugauaugaaaccuggauaucaauuaauucaucuccaaucugguuaguugguaggaagguagguaguagguaggaugugagugacugucucugucacccaggcuggggugcagaggugcaaucauggcucacuguacccucgacuuaccaggaucaagcgauccuccugccuuagccucucagguagcuggaccacaggugugcaccaccaugcccggcuaguuuuaaaaaaugcuguauauagauggguucucacuuuguugcccaggcuggucuugaacuccugggcucaagcgauccucccacuuuggccucccagugcugagauuacaggugugagccagugcaccuggcccaaucugguauuuauuugucccaacaauauucacugacucaugauucccuaccuuguuauauuauuuaugcuuuuguauaguaagcccuuauagcuugaauauauuaagucuuuucucuugguucauugccauuuuuaauccauucaaccuuagaauguugauaacucacuuuauggaauguuaacugugguagaaaauauuuauuuuuaccuucaaauagacauacuuuuuuuuuuuuccuggcaugcuuggccaugugagcuuuuuuaggaagccuagagaggaagagaaguuagacauccaagcauauaguuaguuucaagugggagacaucugugcaguuacuggcagguuaguauaaagaugcuguuauuuuauguuucuuuuuuuuuuucuuuuuuuuuuuugagacagagucucccucugucacacaggcugcgguucaguggcgcgaucucagcucacugcaaccugcaccucccagguucaagcaauucuucugccucacccucccgaguagcugggacuauaggcaugugccaccaugcccgccuaauuuuuguauuuuuaguagagaugagguugcaccauauuggccaggcuggucucgaacucuugaccucaggugauccacccgccucagccuucuaaaaugcugggauuacaggcgugagccacuacgccuggcccugagucauuguuuaucuuaaucugguauucacccuggggaagagagaagagccauuuaugagguacaccugggaucauuuuguacaguuaugguuuauuugcuugguuuuguuuuuuguuuuuuuguuuuuuuugacaggcccauagcauagugaucaagacccuuagcucaaggcuggauugaaaucccugcugugaccuaacaucggugugccucaguuuccuuagcuguaaaacagggauacuaguaccuaccucaaaggguuguuaugaggauuaaauuaguuaguaucuguaaaccauuuaaaacagugucuggcacauaguacaugcuauguugguuuguuauaaauuuguauaaauuuucuuaauuaccuuuaagugaaaagcuugccuuuauaaaugcauacuagucgugagauuuggcuguacacaaggaagauugcuauagcuuccuuuauuucuugcuaaugucaagacaaccugagguccacaaaauagaagugaaaguacuaaaguuaauagcaauucucuuuugcaauaauacuggagcacauauccuguaauaaaguuaauuggggcaaacuggguagaagucuaauugcuaggagcuacauuuuuuuaauccuguaaccccagggauagaauuuauccuaaauaaucuagaaggagaaaaauaaaacuauaauuguauauuauacuauuaauaauaagcaaaagcuggguguggagacucauaccuguaaucccagcacuuuccgaagccaagaauggaggauugauugcuugagcccaggagcucaagaccagccuuggcaacauaguaagaacccgucucuacaaaaaauaaaaaaauuagccagacauggugguagugcaugccuguagucccagcuacucuggaggcugaggugggagauugcuugagccagggaggucaaagcugcagugagcuaugauugugccacugcauuccagccugggugacagagcaaaauccugucucagacaaaaauaauaauaagcaaaacagcuagagaaucuaaacagaaguggaauggguaagaucgccucagugguauaucauguagcauuaauugaugauauguagaauguaagggaaagaagguauuuugaagguguuuucauugacguuugaauacugggugccaaacucucuacuaugccagaggccagggauauaaacaagaggaagacagcuugcccucuaggagcucuuaccagaagcauugggcuguggugguauagguacagggaagacauaggaggaaggaaguaaguuccccgaccuugaaagagucagggaaaacuaaaggaaagaagaaaucguugagacagacccuaagauuuauuggcuaaguaaauugggauaauauagcuaacauguauugaauguuuauuauauacccaauauuuugcuaagcacuuuuaauuaucccauuaauuccucucaucccuaugugguagaugcauguaucauuguaaaaaugaguaaacugaaacuuaaaucuguaucuaucuucuaaaauucauguuugaaaucacuguauuuacuauggcuuccagcugugggaaaauucugccuguggagaucuucauacuuuaaggccauaagaaaaaauaguuuuguuggaguaagagaauuauuuucucuuguuuuuauuuuuuauuuauuuauuuuucauguuaacauuugaaaguucuugccaacagcugaauaucuguugcuuauuguuuugagagaccugucucugaaggagguaggugcaaauauggaguaggacagugguuccuucaaaggagaagauccuguaucauauccuguauuuccaucagauauuucauuuuccugacuugggcaauguguaaagauaugacaacaagauugacaauuugggaaaacguuuaggaaagaauaacagggacaggaugugacuuggaaaguucguugcuuagaguagcaagguuugauucuuuuugaucaacaauauagacuuuuccauccucuuacugugagaauuucuacuccaugcuuuguuacaugagaauucugagauuagugcuauuucaaccacuuuuauggggguuuguuaggauaaaauugcacugagugccuguucuaaaaccaaaggcagcaggagagcccugagucucugccaucaguagugccacugcaguacucacgagaaaccuggggaaugaagacuugccuggcagcuuucauuugaaucuuuuuaaaaagagccuuugauuuugauguuuuccaauauaggaaguaacuuacuaccuaggagguggugaaacaugacauaguuauauauaguaaaaagaacaaaaaccaugcaaucagaggauuuuaaaaauauuaaguccauuuaguuuucuaugaauagguuuuagugaaaacugucacuaggcauuuuagaaaugaagaaaaugaaaucaguguguuauacacauaggaacuggcauuuuuuugguucccaccaucuggaauagucuuacagaucggaggcacucgguaaguuauuuguggaaagaauggaugaaagcugugaagauucugguuuccuauuaaugcuaauaugccaugcucauguaaacauacugauggauugcuugccaaguuuuccucuucugaugcuucucaaacaucaaagauguuuauagaacccuucuggccggacacgguggcuuacaccuguaaucccaacacuuugggaggccgaggcaggcggaucaugaggucaggagaucgagaccagccuggccaacacggugaaaccccaucucuacuaaaaauacaaaaaauuagccgggcgugguggcgggugccuguaaucccagcuacucgggaggcugaggcaggagaauggagugaacccgggaggcggagcuugcagugagcuuaggucgcaccacugcacuccagccugggcgacagagugagacucugucuuaaaaaaaaacaacaacaagaaaaccccuucuaacucuugaacuugguucaccuggaaaagcaaaagaacuagaauagcuaaaacaauuuugaaaaggaaggauaaaguugaaggcaucacacuauccaauuuuaagacuuaguuuguagcuacaguaaucaagucaguaguaucaauguagggguagacaaauagaucaaugaaauagagucuagaaauagacucacacaggcauggccaacuuuucgacauaagugcagcacaccucacuggagaaaugguaaucuuuucaacacaugguacuggaacaaccggacaucuguaggcaaaaaagugaaccuuugccgaaaccuuacacuuuauacaaaaauuaacucaaaaugaaccauagauuuaaauauaaaauguaaaacuauaaagcuuuuaagagagcacauaggagaaaaucuucaugaccuggggguuggaagaagaguucuuaggcaugacacuaaaagcacaauuguaaaagaaaaaaauugguaaauuagacuucaaaauuacaaacuuuugcugcaugaauggcccuaauuaggaggaugaaacauggccauaaaaugggagaaaauauuugcaaaucauaugacaaagaacuuuaauccagaauauauaaggaacuugcuaaacucaauaauaaaaaaaaaaauucacuuagaaaauaagcuguaauuucagcacuuugggaggucaaggugggaggaucgcuugagcccaggaguucaagaccggccugggcaacauagugcugucuccacaaaauaaaaauaauuagcugggugugguagcacgugcccguagucccagcuacuugggaggugggaggaucacuugagccugggaguucaaggcugcaaugagccgugaucaugccauugcacucccagccugggcaacagagcaagaccuugucuuaaaaaaaaaaaaaaaaaaacauagaaaaugggcaaaagacuugaacagauacuucagcaaaaagaauguaggggugacauauaaguacacauagauguuaaacauuauucguucaccauuaggguagugcaaauuaaaaccacaauaagauaccauaccacaccuauuagaauggcuaaaauaaaauauaaugccaauacuggccaggugcgguggcucacgccuguaaucccagcacuuugggagcccaaggcaggcggaucacuagguuaggaguucgagaccagccugaccaacauggugaaaccccgucucuacuaaaaauagaaaaauuagccaggcgugguggugggcaucuguaaucccagcaacucaggaggcugaggcaggagaauugcuugaacccuggaggcggagguugcagugacccgagauugcaccacugcacaccagucugggcgacagaucaagacuccgucuuggggguaaaaaaaaaaaugccaauaccaagcacuggugaggauguggggaaacuagauuucucauccauugcuagugggaauguaaaaugguacuguggucaaguaauuucaaugacaacuaauauuugaaucauaaauaaugucaagcugcuuuauauacuucuugugcuaucaaaaguuaaacaagaagugagaucuccacuugaagucaggaguuugagacuagccugggcaaaauggcaucucuacuaaaaauacaaaaauuagacggguugguggugggcauuuguaaucccagcuacuugggaggcugaggcaagugaauugcuggaacccgggaagcggagauugcagugagccaagauugcgccacugcacuccauccugggugacagagcgagaugcugucucaaaaaaaaaaaaaaaaaaaagugagaucuccauuccaguacaaauuuguaguggauauauuuuucaaacugaaauuacaguucuaguagugauuuuuagaccucgaugauguaugaggcaaauuuccauauuucaagauccguguauuuuggaaauaguggcaaugguuguauaguauugugaauauaauuaaugccucugaauucuauacacuuaaaauggcuaaaauggcaaauuuuauguuauauauauuuugccacauagaaauaauccauuuaacuguggcauuuaguugcuuccacauaacuuuccauugaaagugauuaaucugcaguggggugcaugcauguaaugauaugauaaagguaaaugucaagagaggaaucuaauagaauucuauaaugucuuccaugagauaaaaggcucaauuaaaaauguguauuccuggauuuagcucaguauuuggaaguuccugucuuuuuuuuuuuuuuuuuuuuugagacagggucuugcucugucacccaggcuggagugcaguggcacaaucuuaacucauugcaaucucugccucccugguucaagagauccuccuaccucagccuccugaguaucugggacuauaggugugugccaccacgcccugcuaauuuuuguauuuuugguagagauggggauucaccauguugaccaggcugguuucagacuccugaccuaaggagucugccugccuuugccucccaaagugcugggcuuacaggugugagccacugcgcccagcccggcaguaccuucacgaagacauuugcaaaaguggaauuguagacucucauugcaaaucagcauucauagaugaagauuugcaaucaauuuugaugaaagggaaaacuauuuuaaaccccaguuaagugaaauguuauucccccauaaaagaauuucauucuucucaucaguagaccugcauuacaaaaaauuguacucaauuauuauaaucugaauugugucaacauuuuguggagauuuguuuucucuuguaauaggaguaccuacuuaauaucuuugauuuugccucuuagcccacaaaacugaaaauauuuaccucuggccuuuuacagaaaauguuugucaaccccuagcuuaaagcauugauuuuucucuuuuucuucuuuuauuuuuuuauuuuuuauuuuuuuuuugagacggagucucgcucuuucgcucaggccggagugcaguggcgcuaucuuggcucacugcaagcuccgccucccagguucacaccguucuccugcuucagccucccgaguagcugggacuauaggugccugccauggcgcccagcuaauuuuuuguauuuuuuuuuaguagagacgggguuucaccguguuagccaggauggucucgaucuccugaccucgugauccgcccaccuuggccucccaaagugcuaggauuacaggcguauaugcuuugaaagcgaugaaaaucucaccuuauucucuguuuuagcugcaucccagagauguugauguauugcaguuucauacuguuuagcacagaauauguucugguuuccauuuaaugccuucuuuuuauuuauuaauuuaaagagauagagucuuguucuguugcccagucuggaguguaguggugagaucaaaguucacugcagccucaaacuccugagcucaagcaauccucccaccucagccuccugaguaguugagauuauauagguacaaauugucaugcccguuugauguuuucuuucacuuacauuacuuagaaguauauugcauaauuucugaacauucagauauuuuaaaaaucuuuguuacugaacucuaauuaaauccuaaaguggucagagugcauguauacaugaugucagucuugagauuuguugagguuugcuuuauagcccaauguauaguccauuuuggcaauguauuugaagugacauuuuucagaucuuuugucaucuucugaagcuuuggauauccaaauaaggcuggucccuguaacauucuguaccuacucuguacagauucccaguuucuacucacuuaaaguaggugugcuuguauuuuuaguguaucuuucucucucaauccaggagguuuuuuccuuccccuugugauuauaugcagcucauagguaagaaaaaccuuuguaauguacuuaaaucucagcaguccucagcucauuaucaagugccguagucccuaaccacuaaauuaaguguugaccuuauacauaaggacuucauuuaagagcgaguucguucuuguuguugacuccugucauguuguaccauuauucucuugaaacuggucugacuugccuuugacaaaaggaaaggagugugcuuugcagggcuaugugcuuuccuaauaccagaaguuaucuaaagauacuuaacugugcugugaacuaaagcuauuguguuugaucugcccaggcauccagcugacuccuguauacaaaauucuacccguucaguucuguuaauguuuaaguucccgcuguucuuuggugggaaaggaggugauguauaaaaaucaacugcuuuguauaaggcuugguguguuaggugcuaaaccacuuaacuuuuucuugauuuggggaucuauucuccuuguuuuuuuguuuguuuguuuguuuuuuguuuuuuuuuuccuucuuuuagagacagagucuugcucugucacccaggcuggagugcagugguacgaucauagcucauugcagccuccaacuccugggcugaagucauccuccugccuccaucucccaaguagcugguacugcaggcacgcaucaccaugccuggcugauuuuuuuuuuuuacuuuuuguagagaugguguguugcuguguugcccaggguggucuugaacuccugagcucaaccgauccuuccaaagugucaggauuacaggcgcgagccaccaugcccagcugagaucuguuuuuuacuguuucacaauaauugcuggaaauauuuguaauaaugugacuuucacugcuaagacagaaaaggaagauaaggaaauugaggaaaaugaagcuucugcuucuacaacaggaaagcauaaacguuugaguuacuuuuagaguaaacgggggauaagugugucuagauucuugacccacccucuucugccacagucagacuuagaaugcacuuuugcaugcacuuuuguuaaucuaaugaacgaacauuuauacacuuucuaguuaguaaauacguguaacuuuauauuucagcucaugagauccuuugcugcgugcugcagggaaguguagagcucuucagcugugcagccaggauaagaacucacguucuguucucccugcugcugcugugacaggggaggcacguguacauccaggcucuuucuguguggcagggcuguuuaauuggggcugauggaaauuuuugucauaggaaaugggcaaucagauuuucaguuaguagugaaauaauugacucucaauccauauugggaaacagaagauaaaacauuugguaauaaaaauguaaauuuuagaacauagaacacaaagagugguccauaagcugggcgcggcagcucacaccuauaaucccaacacuuugggaggcugaggugggcggaucacgaggucaagagaucaagaccauccuggccaacauggugaaaccccgugucuacuaaaaauacaaaaauuagcugggcaugguggugcacgccuguaaccccccuacucggaggcugagacaugagaauugcuugaaccggggaggcugagauugcagugauccaagaucaugccacugcacuccggccugggcaacagagcgagacuccaucucaaaaauaaaauaaaauaaaaacagggccgggcgcgguggcucaugccuguaaucccagcacuuugggaggccaaggcagguggaucaugaggucaggaguucgaaaccagccugaccaacauggugaaaccccaccucuacuaaaaauacaaaaauuagccaggcaugguggcacaucccuguaaucccagcuacucaggaggcugaggcaggagaauugcuugaacccgggagguggagguugcaaugagccgagauugcgccacugcacuccagccugggugacagagggagacucuaucucaaaaaaacccaaaaaaacaaagagcggacccuaauguaaccuauggacuucaguuaauaaugaaucuguauuggcucaucaauuguaacaaagguaccacacuaauggaagauguuaauaauaggaaaaacagaugaggaggacgggagagguacagagguauaugggagcauucuguacuaucugauuaguuuuucuguaaaaccuaaagaugcuaaaaaaaaaaaaaagaaaacuguuuaaaauuuuuaaauaucuagcuuaauguuccccaauggguucaaaucauacaaaguuaguguuuaaccuccugacccuugcuuggaauuucucaguuaagaugaguccaguuugcaguuugagcuguuucaucaguuccguuugccucucgccuguguauuaacugugcucuugccuuucucccuaucugcuggaacaguuggaaugccaagaugccuuggaaacagcagcccgagccgagggccucucucuugaugccuccaugcauucucagcucagaauccuggaugaggagcaucccaagggaaaguaccaucauggcuugagugcucugaagcccauccggacuacuuccaaguaagaugccgugcugagugaugacagugaagcaucaaaggccuuuuuuuuuuuuuuuuuuuuuuuuugagauggagucuugcucugucgccaguggcaugaucucggcucacugcaaccuccgccuccuggguucaagugauucuccugccucucagccuccugaguagcugggacuacaggcgugcaccaccaccaagcccagcuaauuuuuuuguauuuuuaguagagacgggguuacaccauauuggccaggauagucucaaucuccugaccucaugaucugcccgccucggccucccaaagugcugggauuacaggugugagccaccgcgcccggcccaucaaagccguuuuagaacauucaggcuaagauuagaucaucuggggagacuggucuuuagcuaagagcuguguucacuaaacaguguccauuaaacacgggcugcccucuccgugcguguugauagcuuugugauuucgguuuucucuccuuagacaccagcacccaguggacaaugcugggcuuuuuuccuguaugacuuuuucguggcuuucuucucuggcccguguggcccacaagaagggggagcucucaauggaagacguguggucucuguccaagcacgagucuucugacgugaacugcagaagguaggcgccucugguccacccucaucucccccaugccgggugggcagggccugagcuaggagugugaaguccacagcucugugucuuuaaagagccgagcuguccaguggagggcgggcggccuggggaugacuuucucuuugcucuuuugcuuuaucuccuauuucaccuuugauccuguuuuaaccacgggcuuucucucucucucucagccccgcuucucuuccugagucugcagggagauuauguugcugccuugugacagaauacauuuuugugguagcugauugucaugauuaaaauguaguuuacaacuuuacauuuuaccacaggaaccuucagaaaggguugggggccccugaaaaagaaaguucuuauucacaaauugcauucagggaucauuuuccuggguggaaagaaaggcuuuugcucucaucauuuucuguauccugggaggcuccuuauacaggguaaauguguaguucccuaggaaggguauuuuuucccagaaggugaagacuauguacauaauuuuaaaggagagacuugugugagugguggcaaaaccuggagacaaaaagugguggcaggcggggagcuaggugugccuuucccccgaggagauguguaacgaggacgugugcccuuguuaagacuagagagacuguggcaagaagagcugaaugaaguugggccagacgcugcuucccugcgaaggguuguguggaucuucugccgcaccaggcucauccuguccaucgugugccugaugaucacgcagcuggcuggcuucaguggaccaguaaguucuaaccauccuuuccgacagucuccaggggcccggccacggccagcucuaacacucuuauucuguugcagagguugugcucagcuuugggcuagguagcagucuuagagaugccuucaggucuguugaaaggggucgauggauuuuggcaacagcuggaaggaugaaagggcaguguugccagagaagaaauggaacuggcuugauuucugggugggggugaaauggaacugacuccaguucugcacaggacugugcuucucgguuguguguuaacaugaacugacagucggugcaggcagaugugucuugcagugcuaugagugggugagagcacguuguguggcccgggcuggugagccagcaccgggaacauaccaagugccuggaggcaguuaucacauguuuggcaggucuguggcaaauaagcccugagaaaacuagaggacugucgaggauuuuagagucugaccuggaguccguuuaaguuuggcuuauagugugacuguguggcaaguguugggguggcagccgugguuuuccccagucuguacugaugcagaguagacaagagagccuuugacguucacucuguuuccugggcaccuguuucuuacaccugcugugcugccuuacacuugagaccuugauuaaaucuauucucuacacauuugccuugaggcaucggagcaguaguacugcuuguacugugcguuuuccauauguggguaagcuggagguucaugguuuugguaaguaugugccuaagaugcauggcaauuagguaaaacuaauuugcaguuuuguuuuuguuuuuauuuuuuuaacguuugaugccucuuguuaaaguuuugaucucuuuucugaagcagagaacacuacuuuucugguauuggguuucuauauuauuaauaauugaccaacuaacauacuuuauauaaaaguuuuaaguaagaaggaccauguaacugaaauguuguguuauguaauuuaccaaaauggcaaacauuuucauagagccagcuucccccaagaagagcuucugucauuguuucacuacagggcugguggcugcucugaucucauagaauucauuccucuggguagcaccauaugcaggcuuugcgaauaaagugaucaugggcuuucuugauuccauuuggccaaugcaagaacuucauuggcuccccucuaaaaaaaauuccauggauugcugggauuuuuauuuuuuauuuuuugaaaaaaaugguaccuauccguauucagcuugguggcuucacagucccuccccugaacauccguauauuccuuauucucucauuuauggugcagaacacugggguacuaaccucuaggaaacuguucuagcugccagggaaagcuaagagcccuccuuuaacaggaaagcagcagcaugcuuuuucuucucucugccguuucagggaagagcaccuuaaggccaguguuauuucaugggauucugcccuagagcugagaaaguaauggacucauccauaaucucuuuuauagauuugaaaguguaaacaauacacacuuccuuuuuuggaacuccaauucuaauauguuucuuuuucauuggaaauugaaaaaccaggcugguuuugagauuaguacuagcagugaguaaaccuccugucuguggacuuaaauccuuuugaggaacauuucguuuuagauuuuuacaaguuuucuaaucuggcacgacuuucaaacuagcuuaaucuguucuuacagaaaccuguguaaggacagacugcccacauacgggcuccccaaauaaaauggcauuuuuauuucuugucccugcucggguuucaccgaaccuugguagccauaaucagaacaaaugaaacacagucaaguuguuguguucuguuuguuuuuaccugccagccagcugaugcugacauuuauacaccaagaugauccaagguuuuggugacgccgguggggacugccgcuauaugugcagggugcccgggggucauaguaauguuaauggaguaccagaaucucuaacagugugguccuguguagccacauugcuacacuuacagagaugcuuuggggccuuuuuggauuaagacaguucuaaaagaccaggccucaccuaugaucuguguauaaagaauuagcaucgcacuguagaucugcaagagaaggccgccuccugcagugcucucucuuggugaaugcuaacucugcucgagggccuuuuggggaaaggacaguguaaaacccuuagagagguaaguuucccacccuuccaaccucucuccaccugcagcuugcuuggugcugucaggaucuggauuuggggggagucucucuguaguggaaccagugacagaagcuguucuuuagaauuuucaggauggcuguauucugcggucagaaugagagagucaagcugggcagaaucucucgccaagaguucagguaagguaauguuuauucacugggaaugcuuuccacagccagacagcuaugcuaacagucucaaguuuucuuccaguuuguuuagauuuaaaugauacauuuguaacuuuuuaaaaacuaaauuuugguuggauuuuucaugaaaaccucuuuuuucuuuauccccuaaaaaaugguuugaaaugucauuguuauuuaaaaacccgauguguuggaacuucuuuaaucugcuguuuccucuuuuucccccccuuugaaaguuucgcauaguguaaacauucacuaugucuuuuaccuucccugcuccucccaucugggaggcgcugaugcuauuacccagugcugaaaaauggcacucuaaagguaugggaaggaaggagcccaaggcaaccaccugcuguccuuucagccuuccuuuggagacugcuccaucagugccgaggugugugggaacaggcuucacugcaccgccaucuuacugaguugcuucacgugaggaaaagggggcuuuggcccugugacucaguuccacauuuuggauugcauacuggaaaagaagccaaucuucuugcuaguaaaccagcaacccggcuguauacaguggugacccaagcaauggauauaaaccuaaaaaucugagggaggggagagguggaauacaguaguucuuggaaucugaagucuccuauuugaucagguuauuuccugggacuuggcaaaaaucugauugguggggaucuccuaggaccuaguggacaucugguauuaauuuaaucucaggaaaaacaagaaauuaacccagagagagucuggguuuuggaauucagcguagcuaccuccagaccguggugucuggccuccauuuuugucugucauucagcucugacuuacagcugcagucaccuuugcuauaaggcaccuggguagaaggguggaugggcuucacaucaauuuuuuucuuccuuuagggugggggauugguuuggcuuucuuuuguugugguuuuuuguuuuauuuuugucaagauugauuuuuagaugcaaggacuugaaaagacccagaaggaugccaccaguuuuuccuugaggccuaggauuuuuuauucugucccgagcagagguaauuccucacaacuuagugcaccaguagcaccagccauuuugagcagaguaccucuuuggggagcuuuucguuuuguuuuguuuuuaauucucuuuccuuagcagcaaggucuuuuuuccuagagaaucuacuccguugcagaaucauugcaaccucaggagcccucacugauugagugcugucagccugauauacuacuuuggacucuggaaacagauauggguucuauucucuauuucuacugugugucguuaaacaaccgucggagaccagaugaccuguuagauggcuaguccuguauaacucgacucuguauguuucaauguauguuacugcaaugcuucaccugcuguacaguguuugugagaugcucuuugaagaugguacuuuuauauuuuuucauuuucaauaaaaguacauuccuuccca

SEQ ID NO: 192618 - RNA, 18031 nt, Homo sapiens
gaacaagggagcuggcgccgccagcagccgccgagcuggguugagccgcugggccgcgccgcgcgccgccgccgucugggaggcucggcccggccgcccgagcaggccgcgcgcgggccgccgggcccgaggccagagccaugggcgagaccaagaucaucuaccacuuggaugggcaggagacgccguaccuugugaagcugccccugcccgccgagcgcgucaccuuggcggacuuuaagggcguuuugcagcgacccagcuauaaguucuucuucaagucuauggacgacgauuucgggugaggauggcccccgccccgccuccgggagccccggccgcucuggcuucuaagggaugacgcgguccguuucgacuugccucgcuacaccggcuccuagccccgcucugacuucuaggggcgacucggcccauuugggccccuuugguuccagccccaguagcaacucccguuuaccucugaagaggggacguuggccucccuuguuuaaggggacguccaauuccccacuagcaaucagaguuccugccggugcgguccccuuaccucuucagagaccaguggcccacagagacagacacacccccccuccaccuaguuucagagcccgagucccccauccuccuccugccgaggagccagagccaccuuuuuccgcacagacuugggucguguggcccucguucuucgcccccuucaucuuuucagcagcacagcucccagccauauuuggaguaugcugcaucugagggcucugcugggacuuugagcugggggaggggugucgggggugcucgggcgccuggccgcgagcggggucugcagaucugauguuuaucuagcugccugcccucuccuuugugggcuguuguggguguugucaccggaacagagagccugaccccugcggaguaguccucacugacccaggugcugaucuuuccuccaauucgggcuuuuuuccuccaguugguggccaguggagagacguuaggaagggccuggggccugggugggauagccaggaagaguuucuugguguucucuaucuuccccucccugguggggucuucccuuccacccagcugcagagaucuggacaggcacaguuuggaagcagucacuuucccuuuaagaggggauggaauguuggagccggaagguucugaagcagcuggccugggaagaggggggccuggcugaucccccucgaacccccccaacucccaggagacugggggagggggaggcgcccacacuugccugccgccucacuaacugggcgcugggccuggaggcgguggggaaggccccuccaggccugaaggcugccucuccagcccuagccugaggccugcacugcucuuuggagcugaggccccacagccaagaggagacauucuucuccccaguguucaucugucuggcuucucucccaagccccuggcccaccuagcacuaggaagcaagcaccuucugucuaaugccuggcauguuuugcugucaccuucugcccuggaacucaggguuggaugagccccugaaaucaugugugugagagugcuuuguacagugggcagugcuuuguagauucuaacuauucuuguuucuguuguuguuccugcccugggguggggugcuccuggugugauaaugauugucugccuucagcccagagacagacaccucuaauuggaagauucugaggagggauggaucuagaaggggucugggugaggggguggauacuuuggccuggcaagagaagaauaggguuagaagggaucaagcuacugccuccacauaaggaaugggggaagaugagccagaguccagugcccuggggccaccucagauccagaugccuugagggacuaagauaggcugucucuccacccuguacuuaucuccagacccacuggaccuggccccugccuccuaagccuggacaacucugggcugcucucccaaucccaaggccuaacugcaguuuuaagagggcccccauuacauccagucacuguuacuuaauauuuuucuuuaaauccauugucaguccacuuacuguuuuucuuagcuugaaccaagcaauaauaugaaaccauaggucugacuuuucuguuuauauuucuuucuaaaauauguuuaacauaaauauuuaaugauugaacuaagcaauguuaaucugugugccaccugaagccaucuugcaaacaucagugguacuugaaccaaaaucagaguuggaccauuuuagcaggguugaaaacaguauuaaaaaugaaguggaggagauggauucuguuuguauccccagaaggauaaaugagcaggggaacugauagagcugucuugucacagaggacuaauagcugaagagcauauauauauguuucauuuauuuaacacacgccuuuuaugcuuagugugccagggacuaaucuaaaugcuuuucaaaucuucacucauuuaaucuucgaaacagccuuaugaaauagauagcguaauaguaucucuaguuuacaaaugaaacucugucaggcaugguggcucacaccuguaaucucagcaauuugggaggcugaggugggaggauugcuugaggccaggaaucugagaccagccuuggcaacauagcaagaccccaucucuacaaaaaaauuuuuuaauuagccaggcaugaugcuuugugccuguagucccaacuugggaggcugagacaggaggaucacuugagcauaggaguuuggggcugcagugagcugugauggugccacuguacuccagccuggaaaauagagugggaccguguuucagaaaaaaaaaaaaaaggaaacuagagcacagaaagcuuaaguaacuugccuaaggucacacagcuaauaagaggcagagcagagcuugcuuugacaucaggaaucuggauccaaaaaucuaaauccuuaaucgcacaauuuuaggugucauuauuaucaccauuuuacugaugaauccucuccgagggaggugguaagccuuggaaaacuguagaggugacaaggccaccauuucuccgagccccacaagaggaaggucaggcggaggucagugacccuagaggaaggaaagugggucagaggaggaaggcugcugucucuccaguuucuccacuccuggcucagccuuugaggugcuaguugugaggcuccucaagucccaucuggucuacaaaaguauuugucaagcucaggguaggcccagccaucuuuuuaaauuuuuuuucuuuuuuuuuuuuuuuugaggaguuuugcucucgucacccaggcuggagugcaguggcgcaaucucggcucacugcaaccuucgccucccggguucaggugauucuccugccucagccucccaaguagcugggauuacaggcaugagccaccaugccuggcuaauuuuaguauuuuugguagagaugggguuucaccacguuggccaggcuggucuggaacuccugaccucaagcaauccacccaccucggccuccccaagugcugggauuacaggugaugagccaccgcgccuggccugccaucuuaaguuauuugagaaauggaggaaggauaaacauuuucagcauugagggcaugguggaugguucauagaaguaaggugccuacugcuagucuggccuugagcugugagagagggcagcauggcgaucaggucauuagcuguguggcuuccugcuccacuguccucccucugggccuuccaccugcagacucuucuuccccugucuccuccagguucaaauucuccugucuucuggguugagcuuuucugugagaacugucauggcacucucuuauuuuauccuuuuuuuuuuuuuuugagauggagccuggcuuugucacccaggcugggguacaguggugcgaccuuggcucacugcaaccucugccucccggguucaaacgauucuccugcuucagccucacaaauagcugggacuacuggugugugccaccacaccuggcuaauuuuuguauuuuaaauagagaugggguuuugcuacguuagccaagcuagucacgaacucuugaccucaagugauccgcccaccuuggccucccaaagugcugggauuacaggugugagccaccgugccugguauauuuuaucuuuauauccugacaccuguguaacacucagcagaugucuauccauugaacacaugugcugcuccuacggcuccaaccacuuccuggauugcaguauauuuccaugaacuauccacuggaccauagucucucugagaacaaggcaggcucugggucugauguuucaugagaaaaccuacaauagcaagcucaggaccugaaacccacugggcccucagccaaagcauuuuauuuuauuuuauuuuuauuuuuuuauuuuuuauuuuuauuuuauuguauguuuuuugagagggagucucgcugugucgcccaggcuggagugcaguggcacgaucuugguucacugcaagcuccgccuccuggguucacgccauucuccucccucagccucccgaguagcugggacuacaggugcccgccaccacgcccugcuaauuuuuuuuuuuuuuuuuugguauuuuuaguagagacgggguuucaccguauuagccaggauggucuugaucuccugacucaugauccgcucaccuuggccucccaaagugcugggauuacaggccugagccaccgugcccugccagucaaagcauuuuaauuggaugaacaaugaaugaugaacagguuuauuugcuuugcccuuaauaauguauacguaguuagaaauaguguauggauccugcuaaaaauggacaauauaauuagcuuuuacuguaugccuggaucaugccaggcauuuaaggaucccuuuuaccaggaugagacaaaggcuuggagaaauuaagaaacuucucuaagauaagagggccaguaagugguagaauuggaauuugagucauuauuuguuugacuccauuugggguaugaguguguguguguguguguaagugcuauguaaaccccagccauucagcuccauggugggagaguaagaccugucugagguuccccaaagcugcugaagaucagcugauuguuuugagucagcagagccuugguggccugucgaugacccccagaaagagaggaaacguguaguguggagcagugugguggggccugccaggggagcagggagguagggacucagcagcaauuucccccagacaggcagacccuauccaaagcaggcugugccauguggcccacauauucccuuuuccuuugagcccuguggggcugccaaccuggaguacccuguggccagaguggcuggugggucugagcuaccucugugucccuucuuucuagccuguccuuucuacacuuucugccauggugggccgcaguaggaugauuugggcugcuuuccgagggucgcuguggcucugggaaugauagaggagccagagcuggaugggaguggggagggcaggcuuggccugugaacuuggcugugaguccaaaaaugugagcaucacaagggagccaagcacauucccagcucugggcagaagcugcucuaagaacaaggggggccaggcacggcggcucacgccuguaaucccagcauuuggggaggccgaggugggcgggucaccugaggucaggaguucaagaccacccuggccaacacggugaaacccuaucucuacuaaaaauauaaaaauuagccaggcgugguggcaggcaccuguaaucccagcuacucggcaggcugaggcaggagaaucacuugaacccgggaggcgcagguugcagugggcugagauugcaccacuggacuccagccugggugacagagcgagacuccgucucaaaaaaaaaaaaccaaagaacaaguggggacugaacuucccaaccuccuccuugcugucuucccucucugcucagagcuccuggcaugcgucaucuuacccuuggucaugucuucccaucucuguacuccuggcauauuugacagucugaggguccucaaacuuuuccacuccccuuccuagccccaaacuguaguuacugccugacuucuugccucaccacauucccccggccaaacuacaugcuccgugaccacauuccacacccuucaugccucacaucauuguccuccagcacccacucuccacauagacccacauuaccucuguuauuauauaggaaagaaugugaaauacaguggaaagaguauggauuuuggagucaagccuggggugaaauuccagcucugacaucuaccaguccugugaccuuggacaaguuaacugaauacaucucaguuuccuuauucaugaaaugaagaucauagucugcccacugaggcugaugugaagauuauagguucuaacuauaggaagauaaggugguguaaugguaagaaugcagauguuagagucaggcuaaccaggauucaaauuucagcaguuuaggagaauuacugaaccuauugagccuaguuuccccauuguaccugcugccuuauagcauuguuguauuaaaugaaauuauauaaguaaaguguuuagcauagugcuuggcccauaauacucauuuaugcucaauaaaugacagcaauuuuuuuuuuuuuuuugagacagggucuugcucugucacccaggcuggagugcaguggcacaaugauagcucacugcagccuugaacuccuaggcucaagcgaucgucccaccucagccuuccaaguagcugggaccacaggcauacgcuaccacgcucggcuaauuuuuguauuuguuuuguuuuguagagccggcaccucgcuauguugaccaggcaggucucaaaacuccuggccucaagcgauccuccugccuuggccucccaaagugcugagauuaccagcgugagaaagagcaauuauuacuguuaauuaucauaauggcauguggaaaauguucaguaaaugccuucuccccuucucuuuuucuuuuucuuuucuuuuuuuuuuuuuuuuugacacggagucucacucuguugcccaggcuggagcacaguggcgugaucucagcucacugcaaccuccaccugcccgauucaagugauucgccugccuuagccucccaaguagcugggaucacaggacugguagaugucagagcuggaauuucaccccaggcuugacuccaaaauccauacucuuuccacuguauuucacauucuuuccuauauaauaacagagguaacgugggucuauguggagagugggugcuggaggacaaugaugugaggcaugaaggguguggaauguggucacggggcauguaguuuggccgggggaauguggugaggcaagaagucaggcaguaacuacaguuuggggcuaggaaggggaguggaaaaguuugaggacccucagacugucaaauaugccaggaguacagagaugggaagacacccaaguagaugggugcacaccaccacacccggcuaauuuuuguauuuuuaguagagaugggguuuugccauguuagccaggcuggucucguacuccugaccucagggugaucugccugccucagccucucaaaguucugggauuacaggugugagcuaucacgccuggccuccccuucucuuuucuaauuuucuuaaauucuuuguccauaccucccacaacaauguuaggauucccacuuaagaaaggaaggacaguuauaauuguaugcuuuuuuccaauuagggaucagagggaaagagaaagucuagcccaggagagucauguuggggauggguagagcacuuuagagauuuuagggaguggcaugggggacagugaugugucaguuguaauuugcaaucaccugaugacugagaggaugccccgggaagguaucuggccuaggcagggcuggugucuuccugguggugccaaagagcugucucugggucuccccaaccucugcuuucauuugaacagucuugugcuggugguuugauucccaguuuaggauggaggagccccugagaguugggauuugaggauccuccauuugcacccuagaagguucucugugacaucccccuuucucugcagaguggugaaggaggagaucucggaugacaaugccaagcuaccaugcuucaauggccgggugguguccuggguaaggagcccucagccuuccauccaccugcaucccugugcugggcuggacgagggaaaggcaucacugagauuguagcuggugguuuuaagcuucaguaucugaaucuuucuuuaguuuugcaaaugaacugcuucucaccccagauucuguaaccuuugaugaaaagugagaaauuagugggaagggggaagagggagagacggaaacacacaguggagacaguaacguuuccuaugccguucagacacuugccucagauuuccuucugccaucugcucaucucugccuuagaccucugagccuuguucuuuguccccauuccacuucaccaccccaugccuuccaacaaccccgucaauagcaggaaguggcagaggggccacuguucaucucagccacccucgcacagcccugucuuuucucccucgauauuuccugcuuccuuccucuuaggccuucaugccuugcuggaagugaacuauccccuucuccuugaugcuccuguaacauacuacucacucaguuucucccuuucagcuggugucagcugagggcucacacccagacccagcccccuucugugcugauaacccaucggagcugccaccaccuauggagcgcacgggaggcaucggggacucccgacccccauccuuccagugagugugaccugaggguggggagggccgcaucaguucagcccagggcugggggagggagcccccagccugcccccucccccaucaagucucuucccugcagcccucaugcuggugggggcagccaggagaaccuggacaaugacacagagacggacucuuuggugucugcccagcgagagcggccacgccggagggauggcccagagcaugguauaucuuccugaacacggacacuguccgcaccucacacccuccccucacuuuccacccagcuacccaccuucuugcccuacuucccgagcucaggauaugccuggccccagugcagccccuggcuugccucucucccuccuucaccccugcacugggcacuguguaaacccaacugcuuccauccccugcagcaacccggcuaaauggaacugcgaagggggaacggcggcgagaaccaggggguuaugauagcucauccacccuuaugagcagugagcuggagaccaccagcuucuuugacucagaugaggaugacuccaccagcagguggggcuugaguuucauggguauuguggggcaggugacccuggaggagcccuaaacccugaggaugcggggccccugggaggcuuaugggcuuuguguuggggacccaggcccugcagugccuccccucaugggggcagggcugggccagccugguggggaacgacugugggccccacagguucagcagcuccacagaacagagcagugccucacgccugaugagaagacacaagcggcggcggcggaagcagaagguuucucggauugagcggguauggggucugggaggcuagggauggguggaggcagauugugagcccuuccuacgcagggccaaggcuuguucuuccuuagaucccaucccccuagugcaguguugagaaccuuggggcugggggcugcaccggggacucaccuugaggaggagucaggugggagugaauuccugccaccuccaccugcugcucagggccucugucuauuccaguccucguccuucagcagcaucacggacuccaccaugucacucaacaucaucacggucacucucaacaugggugagucugaggaaacagcacucucaagcaccugcuauaugccagacacugggcagacuugaguucagagagcguagaauauguucccugcccucaaggagcucucuuucguaaacaucagcugauacauaaacugaucauuuuaguaucucaccaucagggcuaugacagagauaagcacagagagcuguggaagcagaaaaugguaucagggaaggcuuccuggaggaagugauuucugagugcccacuccuucacaucucucagccauugcauccuugcucuccgauuucugcccuagguacucucuuuaugagacagcuggauauaguaaaaggagcccaacuaugggauuuaaaucugaguuugauuccuggcucugccacuuacuggcuuagaaaagucaucuucuaaguucacugaaccucaguugccugcucuguaaaaugggacugagucccuaccuuauagccagcaaggguuccauggaagcauguuugagcaugcugagugcagugccugauucaggaucagcaaaugucaguucaguuccugucccuuuccauuuucuaaugggcugggaaugcggguaggaaccuugcucccccuuaaggucuuaaauuacucucuauagaaaaauauaacuucuugggcaucuccauugugggccaaagcaacgagcguggugacggcggcaucuacauuggcucuaucaugaaggguggggccguggcugcugauggacgcaucgagccaggagauauguuguuacagguaucagugcccauccuaggcggugguguggauagagggcagggagguguccuaccaucuguacccugcuccuucagaggccccuucuugguugggggaagacucccugaccuaccaaguugaguucccuuuucauccuccccagcacagcuguuuaucccacuccugguccuuucccagguaaacgagaucaacuuugagaacaugaguaaugacgaugcaguccggguacugcgggagauugugcacaaaccgggguauggauggaauggggcacugggcaaggggcuuggucuggccuauacgcauccugccuucacuaggacacccuuguuuucaggcccaucacccugacuguagccaagugcugggacccaaguccacgugguugcuucacauugcccaggaguaaguggaugggagacucaguccuaaagcuggugcuuacauacaugagcacugucucuccuuucuucucucacccagaacccccauaucuauccuguugggcccagcagugggugggguggguagcccaugacuccucauccucccugcaggcgagcccauccggcccauugacccugcggccugggucucccacacugcagccaugaccggcaccuucccugcauacggcaugagccccucccugagcaccaucaccuccaccagcuccuccaucaccaguuccaucccugacacagagcgugagugucccacccugucuccugggcccagcagacagggccagguggggggacugaugaggguccauguggagacucuugcuugagcaucagagagggcuggagauggggcucggcucauuccagcaaccccacacugcaacucccccacagcgggcacuccaacccucacuaaacaguguuugcuucugaacuuguaugagcacccagggcgccucaguuuccucuuacaaaaugggacucacgauauaaacuuuaccagguuccuguggguuuaaugagaggauauaagugaagcaccauugcgaugugugguguaaaguaagcauucaguaaacggcagccauuucgauuaucaucacaugcacaucguacacuggccaagcaccugcauuuacauuauuuaauccuuuauucaaauagccuuguaaaguagauauuaaaauccccauuuuuuacagaaggggaaacugaguguccaagaaaucaguaauuuucccagcauugaucccauaauuacuagaugguagagcuagaaugcaaacucuuguuuaccuaacuccaaagccccuuucugccucaccauucugccucccacccccaggccuagacgacuuccacuuguccauccacagugacauggcugccaucguaaaagccauggccuccccugaaucaggguuggagguccgugaccgcauguggcucaagauuaccaucccuaaugcuuucaucggugagagagccccauggugggaugcaggguggguggggagugauggggcagggcaggccggagggcccaggacuugccuuggacccuuccuuugaucuggagccagccccagccucauagcuucugugaggccagaugaguccaagucagaugggccuccccaucaacuggcagccuuguccccaggcucagaugugguggacuggcuguaccacaauguggaaggcuucacggaccggagggaggcccgcaaguaugccagcaaccugcugaaagcuggcuucauccgccauaccgucaacaagaucaccuucuccgagcagugcuacuacaucuucggugaccucugcggcaguaugugccucccucaucuucuugcccugucuccuggcugggaguggggagguagccagggaaguggcagcagacucuggggaacccaaacugggggacagcagagccaggggcccaauucaaggccugagaguucuaugguggaagaagaguccaguuuagccucuucaccuggcccacaucucccucuugggccuggcauuuucuaagugccugcucugccugguaccauguugguuguuccuaaagcaucaucuuacucaauauucacaaccucccagaggcccagcucaggaggauacugccagaauaggccuuuuccuucucacucgucaaggucucagcuaggguguuguaggcuuaaagggaagaacuggaggccuagguagccccgaggagcacacagucauucccucaaaacaaacagccuggaggcucacgucaucaccagcucugggcaacagcugacagaccacugcuuuccuccaccaccacuccccaugcuggcugcuggccucuugacagguugauggcuuggcugcaggcuccacaggcagccucagagcccugucuccugacuucucucuuggaaggcuggggcuggcucuucuuagggcugggaggaaugucucaucuuaauagggccgguggccucaagggcaguuguagcucucuuggagcucugggaccugguaccgauagugugugagcagagggugucccaggcagguauucaguccugguggccccuuauauucucuucaauguaguuccaacauuggugggaguagccuugccauuaaggaauguauaauuuccccgggggcgccaggaucgugagaugaguaauguugguggagugagacagugcuaugaagagcuaggccuggcugggaacgggguggagagcagugggggaggcaccuaaguuguucuuuccuucuggccccuucccacccuacucacccugcccagcagcacugggaaaguauaaucagggccaaguaccuucuauauagggaaucucuggaaggcccugcacucauucuaggcuuuuaguggguauuuaguucuaggugaagggguggguaacacuuuaccuaaauuucccaaacugcuccuuguccuaauuaaugaccucaucugagaagguaaggagaaaguaagcuacucuucgcgucuguucugauuaguuuaggcugagcugaagguaguguucgcuauugugccucaugaacuucaggugcgacauaccugguggcugucuaguauuucagccuuccaaauucuccagucuugcaccagcugagugaacggaagagaaaauggccacauaagaguuuugcaggccgggcgcaguggcucgcgccuguaaucccagccuuuugggaggcugaggcgggcagaccaccugagguuaggaguuggagaccagccuggcuaacguggcaaaacccuguaucuacuaaacauacaaaaaaaaaaauuagccaggugugguggugcaacccugucaggaggcugaggcaggagaaucgcuuaaaccagggaggaagagguugcagggagcugaaacuguaccacugcacuccagccuuggccacagagcaagacuccgucucaaagaguuuugccgcuucuagcccacugaggccagcagagaaagugcaaaagcuuggccagggccuucaagggauugggagguacagcuuuggcugagaaccuagaaugaugacucaggguuguccugagaagggucuccccggggcuggcucuggugguggcaaagggggucugcagaaggggggagcucucugggcugugccuccucucauucuagccagaaacuaccacggucucucucauccagagcccaccugaccuaggcuagggaccucucuccggaaagaccuagcuccauccggcccuccccuucacagacauggccaaccugucucuccacgaucacgauggcuccaguggcgccucugaccaggacacacuggccccuuugccgcacccgggggccgccccuuggcccauggcuuucccguaccaguacccgccacccccgcacccauacaacccgcacccgggcuucccggagcugggcuacagcuacggcgggggcagcgccagcagucagcacagcgaagguaagguagaggggccguggaggaaggcuauaggugggccccaggcuucccccgcccgcucagccugccccaccccggcccuguuugccuccuacaggcagucggagcaguggcuccaaccguagcggcagcgaucggaggaaggagaaggacccgaaggccggggacuccaaguccgggggcagcggcagcgaaucggaccacaccacacgcagcagccugcgggggccgcgggagcgggcgcccagcgagcgcucagggccggcggccagcgagcacagccaccgcagccaccauucccuggccagcagccuucgcagccaccacacacacccgagcuacgguccucccggagugcccccucucuacggcccccccaugcugaugaugcccccgccgcccgcggccauggggcccccaggagccccuccgggccgcgaccuggccucagugcccccggaacugaccgccagcagacaguccuuccgcauggccaugggaaaccccagugaguucuuuguggaugugaugugagcagggccccucccccagcuccauuccgcucccaccccagccggcugcguuccucucuccauccguccgucuuuuuuacuuugucugguaccugaaagggaaauaaaaggaacuaaauccaggugcgcuaacugcucgcagggugcugcgaggguggggugcaccuaccgauuggcucugcagcccccuaaccugccucuggccccaguucguuuccucugcccacuaaucccugcgcaggacuucccaggaccccuuuugucucugggaccagacuuguuggugcuaccccuuacuccccucugcaacccccauuuugggaguugaccccagcaaugaccuugguggcacgcucacucccucauucucucguuuccccuuuagcucccuuucaccauuuauucagcuacaucaucccucuauuaaccccaccccaucaggcacgugugcaaaccucuugacuuuaccccacauuacugaaaccaaaauauauuugcuucaucugccccuacuaaccaucccccugccugcugccucaguccugcaaccuaaagcuguagucgccuccaauagccauccaugccaucccugccugugccuagaucagaggcccagagggcccccucaguugccugagcagcugguggcuuccagggagcaucucugcucuaccccugccccaugccugcccugcgugcugguuccuucagaccccuaacccuacuaaccagcaggcucaucucaccuccaggccugaaacauuucuuuucuuucuuuuuuccucccccaauuuacccugggccuggagcagccaagaauuucgggcuguuugacuuucugugagcccccagcgaggggaggcccagccuccgaggagaccaggaacccugcuucagcagccccucagggcuucccaaggauguccagcccccacacccacacguuaacauaaugagucacuaggcuucuggggagggcccaacuucacccaugcaugagagacucuccuccuuuccagagagaaucggaucgcaccacguguggcagccugcggcggggggaggggggccucuuuagcucucuuuaucuuucucucucacucauguaugcauacaugcacagagaugcauacacaggugccuaugcaaguucauuuaagccucagggcuggucccugcccaaagggcuggacccuccuaauccucuccuagguuguggggcugguccccugacacccuucuccccuuccugguagaccuuaaaccucgcacacauguccccagcauuuucucaccuggauaaagcccauaagcugggucucaggcugggcucagcaaaggacucgccuugcaaccgacaggccauucccacccccacacacaaccuccccuguuuucacauucaccauggcaucccagagcaaggacacaggagcccacaggccaguugagguugggcaaggagacuuccaggacuuccagacagaguaccagguuuuauuuuucaccuuauucucuacuuuaaacaaaucauaacuuucucuuuaagccucugcuauaaauucuccuggcucuccugggcuuccauauuuugggggcuggggugucaaaagugagaugaaguucuuagcuccagguuuugggguaaaccaagguaggaacauuuuggcauuuauuucaauuaacaauacuuccuuggacgggugcgguggcucacgucuguaaucccagcacuuugggaggcugagacagguggaucacuugaggucgggaguucgagaccagccuggccaacauagcaaaacccugucucuacuaaaaauacaaaaauuagauggguguuuuggcaccugccuguaaucucagcuacucaggaggcugaggcacaagaaucgcuugaauccaggaagcaagcggagguugcagugaguugagaucgcacuccagccugggugacagagugagauucugucucaaaagcaaacuaacaaagaaaaacaauacuuccugggguuuuggugugcagagggcuuuguuggaagugugacucaaucuugccugccuucugggagcucuagaauuguucccaacccaguccauggcuucuagccaccacuacagggcuguuucauguacuucucucucugacucugucuuguccgacucucuugagaauuucucaacgauugcucaugccugucaguaucagugcuuccaucguuccaucuuugauucacuucucuuuccuuucuauuuacucccaaaauggagucauucauccugauguccucaauugcugcugauaugcuggugauucccaaauacauagcuccaacccccaacuucccccagacuuuagaucuguauugguauuaccuacuggacaucucuauggacaguuccguauagacucaacucaucugcccaaccaaguauguuccuccugaauuccucuccugguuacuucaucacaaucuacauaggcucaccagcuagaaacauuuaugagcuuacauuccuucuucccauaucuuaucagcauaucauauccauuucacuccaacacucugucuugaauuuggcccucccucuccccucucuacuuuaauucauuggagcaugggauuuggaguuaggugguuuuggguuugaauuccagcucuacuauuuuugguugugugauagaguuauuuaaccucucugagccucaguucccucguauguaaaaugaugauaauaauaccuaccucacaggguuguugugaggauuua

SEQ ID NO: 192619 - RNA, 206154 nt, Homo sapiens
ugaaguacacuuuuuguuuaauuccaugcauuuguuugcuuugauagucauucuuguucccauugccguucaauacagagagggagccggcaucagaaaacaacacugggagcuggggacugacaguacaggagaccagaggggagccagguaaggagguucauuuggagaccuaaccacaaaagagaaauucauucgcuccaagucgauaggagcucaaauuacuguaauaaagcgucaaagagggucuucccacuuccagagucugggaaguggucacucugaaggugaagagccacuggggugauaugggcaagaugggacaucuuccuaauagcuugcacaugcuggcugggguucccuuggccugcagucacuggaggacccuguccaccuggucacuggacagcagccuagggccgggagccagcgaucccugagugcugugaaguggcucuggagagcagaccugggaugcugccgggagcuuccuuacaguggccuugccaucugcuuagggcucugcucugugaaguccugccaucguacccuggccacaugacaguuaacaaaagccuuaacccaccuccuguuucucagagcagugauuuuagagcuccccucuuuagccaccugucccugagaaaugcuccagguuccacaaggguccucugcuuagccuaguucaguccgacuugaauaggcuuuugcaguaucaguuguaacaugcaaacaagcagauuaauaugauucuaaugugccagucugugagggugggacacugguggugugaguaugcuaggauauuuguccuaugaaaucagcaaagaagaaacauuuugcugccuggaaaggcacuaaauucauacugaccguacaagucaaagucucgaaaagaaugucacauuguuuugguacaugagucucacagagucuaagaagcaaguaacugggacuuauauuaauuuucuguuuauaaaaggugagggaggaacauauucauucaacagaauuaaaugaugugaaugaagagacauuuuggaaugggauccaucagugauugguguuccuucaauuggaauuguuguccaaaagggcaguggguagaggcaaguggccuuuccccuuucugugguaccgccccugacagccacagguggacacuagugcgagccugucguucugccauuggggcuaacucaagcucaaauggcaauuccaaucaagcggcaauuguugcuccaagugcuauguugagagguucugaggcugugucuaggcucaguaggaaagauacgaugcucaauacauaauguuggucuuggucuuggaggugguagauggugguaagugguaguauaauauuucggcuucuggcucagugggaaaacaaaacauagcacacucuacugcagagcagggcaggaauucuauggauuauaaauauuauguucuggagaauucaguuccaggaaguucaagugggacuguuuuaagaaaaggaaaaaaaaauugagacaugaggacauugaagaaaaaaagaguaaaucauuugaucaaaaaggaugcauuuauucuuaaaggaugccaauguuccacagugggagagggcauuuaaaauagucuggaggcugggcauggcagcucacguuuguaaucccaguacuuugggaggccaaagcaggaggaucgcuagagcccagaguucgauaccagccugggcaacacagggagacgcccaucucuacaaaaaaaaaaaaaaaauuguugugcaugguggcacacaccuguggucccagcuacucaggaggcugaggugggaggaucacuugagcccaggagguugaggcugcagugagccauaaucaugccacuguacuccaaccuggugacagagugagauccugcgcccucacccccccccaaaaaaagucuggguuggugccagguaaaucccaaacccaagcacaucuauuauuuagaaaaggagaggggaauaauuuagcaugaugaagcucuacaggagauguccaguacuuacuaaauccuacucaaaaugucuuuacuucuagaaggauagauuuguuugaugccaacauuuuaaaauauaguaucucaacuucaaguagcuagaugaagacgccaguuuacaauagagcuagcaucuucaucuuucucaguaggagcuccccaccaucuugcaaacaggucuaaacuuaaguggugguaagguccauuauaauuucaaaguagaugcaggcuucucagccccucugcaaagcaauuuuaaaaggaacuguuauccagaggauaugaucuugaaauagaugaaaaucagaaccaaaugcucaucugcaacccaaauuaaaacucaucaucuugcagucaguuaaaaacagacgcuaacggaacauggacauucaucccaagauggugaaacuuuccaucaaugaagcagcuugaaaucacagucuugugagguuccuggaagcacuguuguaacacacuugucaggacugaagaauuagcucauaacuucccugagcucuugauucaacacucuucagaugacuguggagucguucucaaagaaacauacaucaauucaagauuuucccgguuaucacaaggcaggcagcgaaggaccaggcugggcuagagaagguauuucccuuuuuaaccuccacuaaggaccuuauucuccucugaaaccucuagucaauucuacuuaaaaaaauguguucaauauggacuuuauucaacucucgacuauacaaugaaugacugagauucagccacuacguacuacccuaacauacucauaacaguuaauccacauaagguguaugaugacaauagcauaacagauaaucaagaugagaauucaaaaaaaacugaucaaaauuacgagguaucagggguagguuuucuaggaagaccaucacugaaagauguaagauaaaagcugacccucauguuucucuguugccacuaaaggugggcaagaauuggacaaaacugccaguguuuuauguuggauagaaagaagacauagaguuguagcaucucuguuccaaggaauaaugaaccagagagauuuacaguacagugagaucugaagucaagaggauggaaaauauagccuuucaagaauuuuuuuccagucguugguccucuaagugaccaggccuccuucuuaaaguucuuuagucuuguucuaggaugacaucacaguuaggcauuuuaugucaugcccuacauguauauacgguaguccucccuuauuucugggggauacauuccaagacccccaguggaugccuaaaaacucugauaguaccaaacccuauauauacuauguuuuuuuuucuauacuuacauaucuaugauaaaauuuaauuuguaaauuaggcacagcacucuugcccuuuggggcuauuauuaauuaaauagggguacuugaacacaagcacugcgauacagucaucugauaaccgagacagucgaucugaucaccgagacugcuacuaagugacuaauggaugagcagcaugaauaugcuggacagagggaggaucaccuccagggcagcaaggggcaagaucucaucaugcuccucagaaugcugugcaauuaaaauuuaugaauuguuuauuucuggaauguuccaucaaauauuuuuggacugcuguugagcguaacugaaaccaugaaaaugaagccauggguaagaggggacuacuguauaccauuucuuuuuuuagucucccugcuacucuccacuaggagaauaaaggugggagaacaaaggggucuggcaggaaggagauugcaaacuauguugucaauucuugaaacgaauccaugagcccugugcggaaacccucuaggucuguuccucucaggacauuaaaucauucucuuuuuauuucuaauauagucccaugaauuuauuuccuaagaaacuuuagaaaguuuacagcuuuuuaacuauauguccauccacuauuugacauccugggggucaucggcccacccaggagcuuucaugaucaagucaaaaucacaauguauccauugggcuucagggcagaacaugcguccucagaugauuguuguacacagaaaauuagggaacacagcuaagaucaauaccagggagcucccaaaugggaauuccauuuucauuccuucauuaaaaucauaaaauccauaauaauuccugguuagcaauaaacacaaccauugugccacaucauaaaucacaccuucugaucgacagaaaaugagaaugauaauauuauaaaauaaaauaacaaugauaauaaugccauaacuuaagaucuuucauguaguccagcuacagaauuuuuacaaaauggaauaaauuaaugcaaacaauacugcucuuuguauaaauuaaacauuuuccuucauccuaagagcuauaaaucacagacacuacauuuuaaaucaauguaucaacauaaaguguaaacaaauggaucaaacaagcaaaaggaacucuaaauucccuccugccuuuccuuuuuggcugaugcaaucaguaaaacccagaggagcggcaacauuuucaugugcauuggaaaugguuuaacagcugucugugcaaguauuuccuaacguccaacaugaugcagugucaaagaguccagugaaucuagagagguuguuugacgguaaucugucuuggagacagggacagguacuaggucaacaccuauuuguacauaaaauucuaaaaaaauuuuuccuuaaggccaaggcaccaugaaguaccuuggaaugcuuuucagagcccaugacccuggagacaggcaggaccucaugcuuuuggcaauguaaaaauccuuccuaucccugcucagcaucccuuguucuuuccacaaauguucaaauccaguuauuuaaaacugcauugauuuggagugaaguaaaagauauuuuacaaguagcauugaacaaaaaugcuauugugcugggagaggaguugccuuuugcaagcugcuuguuuuugcuuuuauucugacagugguagccagucauuaagacuucuaagauaggccgggcacaguggcugaugccuguaaucccagcacuuugggaggccgaggcaggcggaucaccugaggucaggaguuugagacaagccuggccaacauggugaaaccccgugucuacuaaaaauacaaaauuagccaggcgugguugcgggcgccuguaaucccagcuacucgggaggcugaggcaggagaaucgcuugaaccugggagauggagguugcagugaacugagauugugccauugcacucuagccugggcaaaaagagcaaaacucugucaaaaaaaaaaaaaaaaaaaagaacuucuaagauagaaugaguuauugaauaaaaacaaagggaugguuugggcucagacauuguauagacacacauacauccuagcugccuucaaagucuguucuccugcuugaaucaauaugacucaaguagacaagcaaccuggcuccagagaggggugguuccaucuucuccucguagcugaacugagugauccugagaauggaguuuuauaaauuccacguucguuuuccuaacaccacuguagauguucuuccucucucacccuuuucuccuccucaguacugccccccaaccuuuguuccuacaggaaguggucagcaggcagaaaggaaaugagcuacaaggaaauggcacuugaguaugaaagaucaacacguugggucaagguagcacauuugccaagguaaugacagugacagcacuaaaaagggacguauuugccaaaaacaagauuugacacuaucuguaaaccucacuaccaacugcugcuuaaacauuuaaaaaugaaaccagcuuccacauacacagguuuguuuguuuguuuguuugucuguuuuucccuccuagaggaagcacaugcccuugaagacauugggugcaaguaucuggucaccagacuuuucuaggucauuuccguaagccaccuggacaagcugguugaagugaauauggucuguucacaaguugccuggaauugcuuuucuuuugcuguucuuuguguucuaaaauguucaaugucuugcucuggcucuucuuuagucacuuauggccaaaagaccugguccccuguucaagcagcaauaauaccucccggccccacaaauucccaaggauguugcucuuaaauuccacuuauuucuuuuuuucuguucuuucuuuuaucucuuuuuuuuuuugcaagaaauuauugucucucuaucucauauauaguucacucuuugcaguacaaaguguuaaaaugucaaacaaaaauaaauaucaauguuacaguagcuagaauauucaauaaaauagaucccugccauucuugauugaaauguucagugagacuuaauuucauuuggauauuauuuuccagagauuugcgaagucucauguuccuguuauugcagcucauuucuagggggugguaaagaugggguagucucucuucccagacaaaaugcugggagagagugggaugagucugggggugggguggaucugaaaugccaguauagucacgagaucuucaggauguguauuccuucauuaccagguagcagagcuguaguguuuauugguccuaacuguggcaucagaacacuccccaucugaagagucacaguccgauucuucaaacugcaugggguucugcaaaggcaagacaaaaccuuaauucauuucgauaaucacucaguaaauauaugucaaacaccucccacacaacaggcacugugcuugguaagggggcuacaaagguaaacgagaccagguccuguccuugugggacuuauggagaaagaaaacacaugaugauuaugauugcuacgacaauaaaaacagugcccaccacacaaccacuuauauagcguuuacuaugcuccaggcacuguuguaaguacuuuacuuauuuauuuauuuagagauggagucucacucugucgcccaggcuggagugcaguggcacgaucuuggcucgcugcaaccuccgccucccggauucaagcgauucuccugccucagccuccugagcggcugggacuacaggcgcgugccaccaugcccggauaauuuuuuguauuuuuaguagagacaggguuucacuguguuagccaggaugguuuugaucuccugaccuugugauccaucugccucggccucccaaagugcugggauuacaggcaugagccacugcgcccggugguaaguacuuuauuaauacaucuguuaauccauuuaguccucaugauaacacuaugagacagaugcuauuaucauccccauuuuacagagagguuaaguggcuugccaggucccacaguaaguggaaugcuacaauuugcauucaggcagucagauuccaggcuuuacacuuagaaccacuaugcuagccugccucuccaaaggcaguccugaauaugaaauaaagugcuauauguccuaugauggcaucauccagggaagagucaggguauggaguggggaggcucagaccuuuaaaauaauuuuuuuuuuucagagacagggucucacuguugcucaggcuggagugcaguggugugaucauagcucacugcagccucaaacuccugggcuuaagagaaccuuccaccucaagccucccgaguagcugggacugcaggcauguaccaucaaacucagcuaauuaaauuuuguuguuguuguuguuguagaggcaaggucuugcuauguugcucagacugaucuugaacuccugacccuaaagugauccuccugccucagccucccaaagugcugggauugcagguaugagcuaccacaccugaccugggcucagaccuuuaaccguguugggagauaggagugggaggaagugauguuugaguuaaaucuugacaugaaggguuccugagcaguucaaugugugugugucauuugggagaaacugcccucauuucugggagcucuguugaucucuguacgucuacuuacuucuuggaggccugauaugguuuggcucucuguccccacccaaaucucauguugaauugcaauucccaauguugggggaggcaccuggugggaagugacuagaucaugggaguggauuucccccuugcuauucucaugauagugagugaguucucaugagaucugaugguuucaaaguggguggcacuuuccccuuugcuuucucucuccuaccaccaugugaagacaugcuugcuuccucaucaccuucugccaugauuguguuuccugaggucucccagccgugcuuccuguacagcuuguggaagugugagucaauuaaaccucuuuucuucauaaauuacccagucucagguaguucuuuauagcagugugaaaacagacuaauacaaggccacuguuguaucuuauuauuaaaugaaaauuguaaaggcccuagagacuugaaccccaaagagcaaaaaagggaacagugaugggaggagaagggagaagcccccaccucauagccacguuccuccacacacagcuugcccagagacaucugagucuucacacggcgcacggcacacuccuugucagagagcccauccgagugugaggauaugucaaugggaaucucuggcgucugggacagcaggucgucuagcuucucugccaagcggucuucaaguuuaucagcuaacucaucaggacuguuugaguggucacugguauuucccucuucuccaucagacacagagaaauucucagagcuaaagguugaauaugacuggcagcugcugauacagcgauggggccuagaaccaagaagaaccaggagaacuuagucagaggaacaacugcuuuucuuuccuuaucugucacucauaguagugguagagauaaucuaguuuuuucccugccaucaaggaggccuaagaaaucaagauagguagaaacuauuuaacuuuuaacauuaaggcaauggacugaauuuuaucccccaugaaauuccauguugaggcccuaauaccagugcgacuguauucggagauagggcuuuuaggaaguaaauaaaguuaaauggaucauaagggugagguccugaucaaauaggauuggcagccuuauaaaaagaggaagagauucucuccauuccucccucccaccuuuuuucaacauucaugugcggggcaaagaccaugugaggaaacagagaagguggcugucugcaagccaggaagagagcccucaccagaaacugaaucugcugacaccuugaucuuggacuuccccagcuccagaacuugagaaauaaguuccuguuguuuaagccauccaaucuguaguauuuuguuauggcagcccaaggugacuaacacaagaaggaaauuuuaauuuccccuuucauuugguuuauauauuuaugugacuaaacacuacacuccaagcugauggcuaugacuggccuuugaaaaacaucagcuugucuaaucacguuauguacauauaugcauaguauggaauguccaaauugaaauuaugccucuuauuuagagagucauagauucucacaggugaaagagacuuuggagaaucucuggacuaacucauuucccagaugagaaaacuggagccagagaagggaagugacuuguuuaaggccacaccaugagaaaaggcagagcugaggcuugggcugggucuacacacacuuugaucaguguccuucucuaaccuccaucccucaccucccugucaauccaccccagcuucauuucccagagcccaguguccacugggcaugguggcccuggaggcccaagugcuuucacuaccucuguugaccaaccuucaacagaaaugagcauggaaggaacauucacucugcagcuguggguacugcccagcuaguuaguagcucauuccaguuaacaucugaguuuggcucugaugagccaacgcuucuggggagauaauuugcaaaaguuccucaguuccuucccguuguuuauaagcagcuuaguaaauaaggauguuacuagcuuacacuggcuuaaaaaaacauaagaaaacaaauaauaaagacuuccuuuuucuuuugccauugucugaucuuucuguauuucuuagucuaaagaguuuuguuuuguuuuguuuuuuucuuuuuuuuuuuuugagacagagucucacucugucgcccaggcuggagugcgguggugccaucucgccucauugcaaccugugccuccuggguucaagcaauucuccugccucagccuucugaguagcugggacuacaggcaugccccaccaugccuggcuaauuuuuguauuuuuaguagagacgggguuucgccguguuggccaggauggucuugaacuccugauucagccucccaaagugcuggguuuagaggugugagccacagcacccggccuaguacaaagagauuuuaugccauaugaccuaggccuggcugaugcccaggacaggugauggggugaguugguugggggucaggggggcagaucauggauauauaagaagaggucauaaagaguccaggaauagcagggaaugagaacagauuucaauuuuguguauaaugcagggauccaggauauaacuuaucaaagggccaggaguccuuugguuuguagggaauuccuguuuccaggcagguacacaaaccuuccuggggagacuucuuagagcauuacucuucaagaacagaauguccauuagcagaaaaagaccucuugguaggaaaacuaucuuauucucuacauuagaggcagcuuuuauucuagaaguaaggggagauggcccuuauugacuccuagcaggaauauuauuaucgcuaucuaagcaagaagcuauuucuaaggcuggguugaagguggauucaacuuaucuaaucauauuuaacuugagauauaaaaucuaaggcauggggaaugcuauggacugaauugccuuccucccaaauccaucgguugaagcucuaaacuccaauauaauuguaucuagauagacccucuagauagggucuuuaggagguaauuaauauuaaaugaguucauaagaguggaccccuaauccaauaagacugugaccuuuuaaaagaaggaagagcucucucugccaugugaggaaacagcaagaagguggcugucugcaagccaguaggagagcccucaucaggaacugagucagcuagaaccuugaucuugaacuuccccagcuccagaauugugagaaaucaauuucuguuguuuaagcauccaguuuguuacagaagccugagcagaccaacacagggaggcacacuagaaaccaacacaauuacccauaaaacagcauggccaucugucacaaacugcccacuguauucucaguuguaaccuugaaucuguauucaugcuccucaucaugaaguugcuguaaaaugaaugcuaaugaacuaggaucugcugugcacgaacaacugccaaaauguagcaacaggaaaacaugaacacagugaguucaaaguucccuauaagguggcugccagggaaucaccugugguugaagagcagguguggcaaacuuaggauuuuuuuuccccauuccacuaaaagcaaucgugugcauuuguugguuuuaccucugucuucguggaaauucaacuucacuaucuacuuccccuucuuccucuucugaggagucaucuccacucugaggagaacaaggauuaagaguuuuauuuauuuuagugucacucugucucucucaccccauccccacuaacuguaaaaaauguaauuaucaucaaaagucauucauuuaguaguagcuugcugaaugucaucuuuaaacauacauguccucauuauucauuuaguaacuuuuccaggguaccuaugauggcgggccugcaugagaugcuggaagacguguagaacugagugaaauuuucuuuguccucagagaggugauggcucuauuaaaguguccagaggugagugauggagagggaaguuggagaggaggucuuggauuuggggucagucucuuguaaucauugucacuagugguuccaggcucuguuauagaauugaucuuugaaauccucaaagccgaacaauuacuuuuucccuuuuuauauaccaaucccuuuuucacuaauauuauguaguuagauagacauuuuugagggucagacuauauccuguuuguacuguaugccucacuccauuaauacaauacugcauacaaaauugguguuaucccuauaaauauauauaauuauuguuugucaauuaaaagaaagugcuuaaugcauuuuuauugagucagcauguuggcagcaauaagggagcucuggcugggacaccugaguccccgugauugcuggggcuccaugguugaucuggaaggcgggguaaguguccugacugaggugaucuuccuuuacagagaacucaucucacaccaagggcauaggagcagccacacuuaagaucaacuguccuuaaccacagcaucaugauacgcuggauuacccaaucgcuuguaagguggguaauuggguccaaggaacuguaccaaauauugagaauaauuuaccuuuuaaaaagucaguucuaaaauaucaugaaucuuacucauuuguauucugauaugcuuuuuuuuuuuuuuuuuuuuaaaauaggaaagacagagaugaaguuauccugacugcugagaugagcaguuuacccuaggaggaccugugggacuauguuuugguaaagaaaaguugagcugcucugugggagugagguuccaaugaagccaaauguacaagguguguguucuauggccuaaagacccguagaugguaucacaauggcaugagaaagguucaaagauacauguuauuugggggagccuggggaauguggugacugcuaaagggugugggguuucuuucuggggugauaaaaguguuguaaaauuggucguggugauaguuacacagcucuguggauaaaaagcauugaacuauacacuuuaaaugggaggacuguaugguaugcaaauuauaucuuaauaaagaaguuaucaaaaaauacaaguuacuggccaucggaguuggaagaggagagaauggaucggcccaaaucaacugcaccagcugaaacacaauuuuauguauuuauuuauuuauugagacagagucuugcucuguugcccaggcuggagugcaguggugcaaucuuggcucacugcaaccucugccuccuggguucaacugauucuccugccucagccucccgaguaccugggauuacaggagugcaccaccaugcccggcuaauuuuuguauuuuuaguagagacaggguuucccauauuggccaggcuggucucgaacuccugaccucagguguuccacccgccuuggccucccaaagugcugggauuacaggugugagccaccgcggccacccccugaaacacaauuuaaucucugggacugcuuagucaguauaggagcagcaauguagguggagggggaaaugcaguucccagaugacagcccucagcuucagcuucuuuucuacucaaugccuaguugaccaaacauacucauuacauuuuauacccuuucauuccuucagcuaaauuccuggugaacaaugaugaugagaugaaaccauacuuagaauugggugggugucuaccauguuguaaacauuuuucauacauaaucuuauuuuuugacucauagcaagaagagcuaauacuuuuggaaaagugcuacguuccaggcccuguucuaaaugcuuuauauguauuuaugcauguagucuuuauagcaacugaugaggcagaguccaauauuaggcccauuuuauagacaaggaaacugagguccauagagguacuaaauggaagagcguggcuuuuuuuuuuuuuuuuuuuugagauggggucucacacugucgcccagucuggagugcaguggcgggaucucggcucacugcagccuccaccucccagguucaagcuauucucugccucagccuccugaguagcugggauuacaggugccugccaccacgccuggcuaauuuuuguauuuuugguagagauaggauuucaccaugcuggccaggcuggucuugaacuccugaccucaugauccaccugccucggccuuccaaagugcuggcauuacaagcaugagccaccgugccuggccaagagccuggcuuuaaaguaaggucugucugacuccuaggcucaugcucuuaacugcuaugguagucugcuucccagguaacaaaucccaggcagccaguggauaaggaggagagaaacagguuucaaugauuaagaacuaucugggucacgaugccugucaauuaaggcaauguuuuccaaagugugaagaaagcuagugccucaggggauuaauagauguuaauuuaaaaaggcuguauguucaaauaggugagggaaaugcucgguuaaacaaguuuacugcaggauuucucaaagcagaggacuguuaaugugcccuaggaaucuguaugaggggaugagagaauacugugcuucuuaaacuuacucuauaacaggcucuuuacuucccauaacaucccucaggacuagagcuguagcauaguaguuuccaaacuauuuugauuacauauccccacuauauaguuuuuuuguuuguuuguuuuuugagacagagucucgcucugccacccaggcuggagugcaguggugugaucucggcucagugcaaccuccgccucccagguucaagcaauucucaugccucagucuccugaguagcucggauuacaggugugugcuaccacaccuggcuaauuuuuguauuuuuuuuaguagagacaggguuucaccauguuggccaggauggucucgaacucuugaccucaagugauccuccugccuuggccucccaaauugcugggauuauaggcgugagccaccaugugcagcccauauccccaguauauaguuaucuauaaauaaguuauuauacauacacuugacucaguccucugguucaguaguugcuaaaguguauuccguaguuuaucacuuaaacaguguggaaagaacgaauuuaaaguaaaauaaauuucuauuuauguuucuguuaucuuguccuuuuacaaaauguauacuuuuuacauaugcucucuaauguguauaacaugacaggcucuggcauucuuugaaggcagugacgcaggccacucucaucauuacacuuuaccuucugcagaggccuuguuuuucgagguagcgcuggaggggugccgagaugagaggugccgagggaugacucagaccuacagccgcugaauucauuuucuuccguuuucucagaacucugggcguuuuccaagagaggauuaugugcuggugacuuggaaaggucagggcuccuccccacuggcucagcagaggguaugucuaaggacccauacuguucuggccugcacugaaggcaggggucauaagcgucagccuggcaacagccccagggaccagcuuggcccuugucaggcucagaacuucuccagcagucugcagccauggcuguggagaugaggucagggcucgagccgggcagcugucucugagcaugguugcugagugggcuccgcagggcugcugcugggccgaaauaccucagguuguuggcgcagguugcuauguccuguccgugcauauugagucugggauggugacucugggacauggcaggagggggcugcugguauugcugcugcagagaauuauggugaugaagagaaggguauugggauugagcuuggugcagguaagugggauggggugaauuuuccugggcuggcugguuuuucaagauugcggcaaagucacuauggcugccucugcuauucccucggcgguggcgugguuugcuucgauaucggcucuugcugcuagaaguggacauuuugggacuuccggacaaaggggaugcagugggagccacuucugugguggggaucccuucugaucucaacaagucuggccugggaggaaagaacagguuuaaucugaaacacaugaaaacacauucaaguuuggggaaauguauccuaagacuuaaaauacacagagccuuugaaucagcagucaucaggauuuauccaauagagauaacguaugaggggucuucaaaauguucauggaagaugcauauuaugaagaaacuaugcauggaucucaaaauuuuuugcauggaaauaaacucauaccaacuuaucgguaacaucucuaagcacgaucuagauugaggcacuaagaacaaucgcuuugaaaagagccccuaucagagcaacaugaauucugcuacgauuaaagaacaaacaucaaauuuguggugaagcuuaaguggaagaauggugaaaacauugacgcuuuaugaaacguuuauggaacaacgucccaaagaaaucagcaguuuacaaauggguaacuucuuuaagaagggaugggccgggugcgguggcuaaugccuguaaucccagcacuuugggaggccaaggaggguggaucacgaggucaagagaucgagaccauccuggccaacauggugaaaccccgucucuacuaaaaauacaaaaauuagccaggcgugguggugcaugccuguagucccagcuacucaggaggcugaggcaggagaaucgcuugaaccugggaggcggagguugcagugagccgagauggugccacuacacuacuccagccugggcaacagagugagacucugucucaaaaaaaaaaaaaaaaaaaaaagaagaagggaugagaugauguugaagacgaagcccacaggagcagaccaaccacaucaauuugugaggaaaaaaauucaucuuacucaugcccuaauugaagagaacugaugauuaacagcagaaacaauagccaacucaauagacaucucauuuggcucagcuuacacaauucuaauagaaaaauuaaaguugaacaaacuuuccacucaaugggaaccaaaacuguugcauucagaucagcugcauacaagagcagaacuuucaauagaaauuuuaaacacuugggaucaagaucuucaaacaucucuuugcauaagugaaauuguaacaggagaugaaacacagcucuaccaguaugauccugaagacaaagcacaauuaaagcaauggcuaccaagagguggaacugguccagucaaaacagacuggucaggaguaaaggucggccgggcgugguggcucacgccuauaaucccagcacuuugggaggccgaggcagguggaucacuugaggucaggaguucgagacuagccuggccaacauggugaaaccccauuucuacuagaaauauaaaaauuagccaggcgugguggugggcgccuguaaucccagcuacucagggggcugaggcaggagaaucacuugaacccaggaggcagaaguugcagugagcugagaucgugccacugcacuccagccuggguaacaagagugagacuccaucucaaaaaaaaaaaaaaaaaaaaaaaaaguaaaggucguccagguacaggcucacaccuguaaucccagcacuuugggggccaagauaggaggauugcuugaggccaggaguuugagaccagucugagcaacauagcaagacccuaucucuacaaaaaaaaaaaaaaaaaaaagcaaaggucauggcaacaguuuuuuugggaugcucaaagcauuuugcuuguugacuuucuggagggccaaauaaugacaauaucugcuuauuauaggaguguuuuagaaaguuagccaaaacauuagcagaaaaaaauccaggaaaccuucaccagagaguccuccuccaccauaacaaugcuccugcucauucaucucaucaaacaagggcaauuuuucaagaguuucuaugggagaucauuaagcauccaccuuacagucccgauuuggcuccuucucauuucuuuuuguuuccuaaucugaaaauaccuuuaaagggcauccauuuuuucuucaguuaauaauguaaaaagacgguauugacauggauacauuuccaggacccucaguucuuuagggaugaauuaaauggcugauaucaucacuuacaaaacuaucuuaaccuugauggagcuuauguugagaaguaaaguuuauauuuuuaauuguuaucuuuuauaauuacauuuuccaugaacuuuuugaaguccccucauaugugcaucaaaauacauguuugaugauguuauguuacaguauuuuuugaaauagcaaaaagcuggaaacaaccuacauguccacuuacagaggauuucuguuauuccuucuguauuauauccuacaccucacccuagaaagcaaggacucuuguuuauagugaguacucagagaagcuugaaggaaggaaaaggaagggaggggucagagaaggaggaaagacagagcucagcaggagguugaguagaagcaggaagagacgggcuagugcggagugacacuggcauuucacuuugauccuaaagggagggaguucuuucacaguccuguuuucaagucuucacugggccaguugugaagauuacgugcaaaagaaaaucagaggccugaaguuacaccuugcccacacugacuccaaggccugcaggugaacaauaaaugguuucuaaacugaugaacugauucagggcagagccucuaggauuaccaggaagaaccacugcuuucuuccuaccagcaaguagccuuacccuucuuuggaccagaaagacacaagucagcaugaaauuuuacaggugaugggcccagacuuuuuuguuuuuaacaacagaauccucucgaauuauuaugagaaaugcaauaaauaaaaaagguauaguggaaccgguugaaguggagagcagcagcccuucucugcagaguucccagguucccccuccuuguccuuccuaccccugcaauagccucugagaaaccucuguacaagcccuuggguguuccaggcuuugcuuggaaaccacagguacaguccugucuucaccauaugugacaaagagcucacagcccagccaaaauggcugaugcucucauagcucauuagugguagaauccagacaaaaagucucuccuaauuuucaaucugguuuauugaaggucagaguucaaacuugaaggcacauacaaaucacccggggagcuuguuaaacacgaagacuuugauuuaguaggucugggguggggccuaagagccugcaaguauaacaagcucucagaugaugcuaaagugaggccacacauugaacagccacagcucauaaguaggcagcaggcagcaggagauggguuuuucuucguuuacaggaaaaguacaguuaaggacuugucuuagcauggaaguuccagguauuaaggguuuaugauaagguggguaggguauugucugcuauuggcagcuuccugucccagauucaaaauucuguggucagcuggccaauuuguacugcagaaagcacuuuguuccuacuauuacaauacccauuugauggagaagugcacugaggaucagagguuaugcuggguuguauccaucacaaagccagcaaguggcagaacucauaacuugaacccaaguccguugaccccaaggcauaguucuuccccauuucaagccucucauuauuacaggguauuuagacuaucuuuuuggacuguacucacuuaugacaggcuggaaauguccaugacugaacuugacacucuuuuuagucucuaacuaaacauaaacugaaaccugggcuuaaggaugguugaaugguuucuccucucuaauuuccuucaaggucuccagacuucucacuagguaaucauuggacuguccaaaucaucugaaacggaaguccuucaagggacaaucagcugacaguacagcucuuugcagguugccuuccucguguucagcuagcucauugacuaagcaucuacuuguguugucaaacucuuucaaacauuucucauagccaaaauaaaagcaaacaugagcucauauuugaaaaagcuaaauaguucuauuuucucccccagcgcucuuaguuuuaacuguaggcagaaggcagggagcagccaucgggcagacucugucccuaauuaguacaacaaaagaaaagggguguugggauuucccccaaccccaaggauugugucagguggaaucugaaaaaaguuucucagaacuugaccauuagaugguuggggcagaagguaaaagcaaaauuggaauuaguccguguaguuacucguuagaaguuagguaccuauuaguccagcuaugguagaaugacugccauucugauagagucauaauacauucuugguuuguguucucucauuagcucuauucuuacugcauuuaacucacaucucacuauuaggucuauacccuagguuuagggaccuuccuucccuuuacauuaacuuagcuaggagagagccaacccucuguuauugaggaaugagucucuacagaguuugguaaggaaaaaugagaggaagagaauuccaagauuaaacuaauacaaggcaaauauguaguaaaaaggggaaagggcaaucuuuuuuuaaacuaucccaaaauacauuuuucgagcaccuaugauuugauagaugauuucacauguuauacauguuaucauauuuaaacuucacaaaacucccaugcuaggguacaaugaggggaacccauaugguuagauauagguaauuaucaaaggcccugcuuuuguuuccaugaugagugauacgguuugagucuacguccccacccaaaucucaugucggauuguaaucccuacuguuggagguggggccuggugagggggugauuggaucaugggggcaguuucucaugaaugguuucgcaucaucuccucggugcuguucucaugauagugagugagugaguuuucaugagauuugguuauuuaaaggaauguagcaccuccugcuuugcucucucuuccuccuauuccagccaugugaagcgcuggcucccccuuuguuuuucaccaugauuauaaguuuccugaggccucccgagaagcugagcagaagcugucaugcuuccuguguagccugcagaaccaugagccaauuaaaccuuuuaucuuuauaaauuacccagucucagguauuucuuuuuuuuuuuuuuuuuugagacagagucucgcucugucaccagacuggggugcaguggcaugaucucagcucacugcaaccuccgacucccugguucaagugauucuccugucucagccucccgaguagcugggauuacaggcacgugccaccacgcccagauaauuuuuguauuuuuaguagagaugggguuucaccauguuggccaggauggucuugaucuccugaccucaugauccacccaccucggccucccaaagugcugggauuacaggcgugagccaccgcacccagucagguauuucuuuauggcaaugcaagaagggacuaauacagugaguuugcagguacuuuccacauuauuaaaaagaacgaacuaaaugugugaauaaaaguaagccaugcauggucuauuguguuguaaaucaagaauuaugacuaacccaauucuguguccuagaggucagaaaaauaaaaagaaaucucaugugcuguaauuguaccauuuuauccaugaggacacugggguugacagaggucaacucacacagcuuauaaggcagguccaggauuugcauccaggucugucuggcccccaguuuauuucucuuuccaugcuaagacaauaaauauuuaugccacagauguaaaagcuagauuccuaaaguuugugauacucccucaccuucuuacucuguuuuaccuagaguacugaguaucucuacagucaucugaugagcuaaagaagaggccacauccgccaucaugugagaauggauuugugggugggucuuucccuauuuaucugaauacugcguuuguacaggugucucaccguuuggucugcaucccagauuugugaggcacuccuuuccuuuucaugaguuucuccauggcauugggauggaugauaggacgaacagggugucguuuguaggucccaggauacuucuuuuccacugcuugcucacgccugcagaauaaaggcaaaagccacaccucagucauugcagacagaaaggauaggcagaauauuuucaccggcuaauucuaccacagauucugccacauuuagcuauuugaauaacaagacugcuauucagguuuaaaaaacaaacaaacagccgggcucgguggcucaggcauguaaucccagcacuuugggaggccaagguggguggaucaccugagguugggaguucgagaccagccugggcaacauagugaaaucccauuucuacuaaaaauacaaaaauuagcugggcaugguggcaugcaccuguagucucagcuacucaggaggcugaggcaggagaaucacuugaauccgggaggcggagguugcagugagcugagaucaugucacugcacuccagccugggugacagagcaagacuccaucucacaaaaaaaaaaaaaaaaaaaaaaaggaaauacuaaauucaaauuaaccugacuucauucugcucuucagcucaugcacugagacacuaauacucacuuucauuuccccaacauaauacaaugacagaaguccugcuuguuuucaguagcugcuuauuuggucaggauucccaggguuuucuugccaccaucaggaguaccuuacaccacuuucagcagccaauacauuuccccagggggcaaucggcuccccggucuucaccccgugcucuucuugaaauggggaccccuucccuaugcagcaaaugacugccaagugcauguucuccuauaacuugcucuguggcaacuccacuuauuuguauaccucgccaggggcagggaccugugcauagcacaucccggaaggaauguugggugaaugaauaaaauaucugccaguucugaguagcagcaacauggaaggguaguauguuucugcugauugacagacucaaaucaguaagaacagacacuagucuggauacauacuuaaugagcuccuucucccgcauuucuagcugcagcaugauggcacucaauuccauguauaaauuauucgcccgcucaagcuuccgcucauaguguucacgaauauccagcgcaugccugucagagaaaacacagggucagcccagccaaccaacuucgggagaaaaaaguccgcuugaugaaauaagaaacaggaugauugaucacaaaagcauuugcccaaggcccucuuacuuuaagccucccuuguccagugcaguaacucagacaaaauggaacgggaggugggaaaucuaagcucuccaccugguuuauccuaaagagcccaugagccauauagaauagccaagagggccacagauaaaaaucugucuauaauuugucacuaucuuaauaagaauacaguagaauagacucauauguuaauggaaauaugcaguuaaagccaacaccaugaucacucauuuacacuuagccacggcccagacccugugugauauagugguugguauggucugaauguuugugccccccagauuuauauguugaaaccuaacacccaagaugauaauguuaagaggugggguuggccagaugcaguggcucaugccuguaaucccagcauuuugggaggcugaggcagguggaucacgaggucaggaguucaagaccagccugugcaauauggugaaacccugucucuacuaaaaauacaaaaauuagcccggcaugguuagcacaccugcaacagcuacucaggaggcugaggcagaagaaucgcuuaaaccugggagguggagguugcagugagcugagauggugccacugcacuccagccuaagcgacagagagagacuaucucaaaauaaauaaauaaauagguggggucuuuaggaggugauuaggucaugagagcucugcccuugucaaugagaugaguccccuuauaaaaaagacuugagggagcccuuuugcccuucuucggugugaggacacauagaaggugccaucuaugaagaaugggcccucaccagacacugaaucugcuggcaccuugauuauggacuucucagcuccagaacugugaccaauacauuucuguuguuuauauauuauccagucuaaaguucguuauagcauucagaacugacucagcugugauugucuuagucuguucucacacugcuagaagaaauacuggacacuggguaauuuauaaaggaaagagguuuaauuaacucacaguuuugcauggcugggaaggccucaggaaauuuacaaucauggcagaaggcaaaggagaagcaggcaccuucuucacagggcggcaggauggauugagugcaagcaggggaaaugccagauguuuauaaaaccaucagaucuccugagaacucacccauuaucacaaaaacagcaugggggaagccgcccccaagauccaguuaccuccaccugguucuugacacauggggauuauggggguuacaauaugaggugagauuuggguggagacacagagccaaaccauaucagugauuauucgugaacaugucuuaucucucucucuuuuuuugagacagaaucucacucugucacccaggcuggggugcaguggcacaaucugggcucacuguagccuccaucuccuggguucacgugauucucaugccucugucuccugcauagcugggaucacaggcaucgugcgccaccacacccagcuaauuuuuuguauuuuuaguagagaugggguuuugccaugcugggcgggcuggucucaaacuccugggcucaagugacccgccugccuuggccucccaaagugcugggauuacaggugugagccacugcaccuggccuuauaucucuuaauagauuauaagcaucuugaagccagggacuaaaucuuauaaauuucuggaauugcauggcaccuaggacacuggcugaaugauuaaauagcauuguuucaagaaucuuuguugcagagaccuaauaaaagaggauaauggaguugggaagaaaggauaggaaagagauacaaaggaaggcuaacuuuuggggcaacuuuuaaagagcauaacaauaaaaagcagaggugaaagguguguggaaagugaaauggugguuaugauaagggugccuguuaacaucugaagaccuggggaugaagggagguggggaaggagggaugagcugaccugagcucuucucugcgccuucgaaucaguucuucaucuaaccgguguauacaaguuccuucacuuuugaucuucucaaaauguuuuuucacuucuucucuccauucagccuggguaaggacaaauuagauuuugauaaauuccaggaguuucaaucccugauauauccauaaagucacguacaagauuuuuuuucccugcaugcuucuacugaagagccuuuuucagaauagauguucaauaaauaugauuugauuaauagcaaaauaucuccugcuacuauaucuccacgccccagcccacuucuauauuucuacuccaauauaugaugcuguguuuuuccgaguuuuccuccagcacuggcuaugaggaacaucacagccggcaugcuggccaucacuuuuggaauaaaagaguucacuuuaaggcaagaugguggcugagaucgccuggccagaaaaaaacagcucugauaaccacauggaaacguaugugugcaugugagauuacgaacaucuuuuugggcccagaauuccuccuaggcuuuguuugggaaaguaucuugagaaaauaccuagaguagaagacccuacaggcaugaacagcaggaaauuagaauagaaauauaagaagcuauacgggaauuuggaguugagggaaauaacagaaaggagagaaggaggaggaggaaagagagaguauggccaagcaaucuaguaguuugacaaaauuuuuagagcagggauggaugucuaauacaugguugaaguuguucaaaauguaaacuucuuuaaauuuucuaaacuuucagugaggucucugacauucaccuaggcuuugaaugacugcuuuaaaaaaaauuuguuuauuuauuuauuauuauuuuugagacggagucucgcucugucacccaggcuggagugcaguggcgugauaucggcucacugcagccucugucucccggguucaagugauccuccugccucagccuccugaguagcugggauuacaggaacgugccaccacacccggcuaauuuuuguauuuuuaguagaggcgggauuucaccuuguuguccaggcuggucuugaacuccugaccucaaaugauccacccaguuuggccucccaaagugcugggauuacaggcaugagccaccgcacccggcccuguuuuguuuuuuaaagaaaggugcugaauugaauguuuggucaauauaggacaaagauaaaggcacaaccacaaggcagcagggguggggaccaagaauuuuaggaaggcagaggcagagcagccaugaaauuaucacucucccagaaauguacagaaguauuagaaaggacauugagcuuuccacagggcaugaaauuucaagcuaauuuuaccuaaauuuuaggggguagaaaaaaaccacuacuggaauauggccuacaggcaauaggccacagagagaaacaaacagugaaaauaaguuuccucauauuauguauagacuaucuuccaucuccagaagccagugagacauaauuuccagugaaggcuagauuuguaacuaaauguaucuauauaaucuucuccugaaauuauucuacuaccuuuagauucauguuaaaaaguaucucuccagaucgucagguagcuccauuuugaauuuggugggagucucccuauuguuuuccauguuagcugcaccauuuugcauucucaccaacaguguauaaggguuccaguuucucuacauccuugccuauauauauuuuuaaaauuaaaaaaaauaauagcaaucccuaauugcuauugugggugugguggcucaugccuggaauuccagcacuuugggaggcugaggugagaggauugcuugagcccaggaguucaagaccagccuggccaacauggugaaacccugucucuacuaaaaauacaaaaauuagcugggugugguggccugccccugcaaugccagcuauucggcaggcugaggcaggagaaccgcuugaacccgggaggcagagcuugcagcgagccaagaucaugccauugcacuccagccugggcaacaagagcgaaacuccaucucagaaaaaaaauuaaaaaaauaaaauaaaauaaaagacaguagcucucauuaaguguacaacaauaauagaaagaguaucuuucuggaucaaguaaguaguuauucuuaaguaauuguggauuuauagaagguuuuccccaaauuagcuguuucucaucuauuuuuauagaggaaauuauauuuuaaucaugcaaaaaaugaucauucuauaauaugcuagauuuucccacauauagguugaacacuggagagaaguuucuguugguugguugacuuucaggcagcaaaucuauccaacaaugccauuagaaagccaagauccagaauacaguacugcagucuauggccauaccacccugaacgugcccaaucucaucagaauacacuacugcauuguuugauaggggccuuugacagcaucuaagcuguaaacgaaaguuugguugagccccugcuaaugcuauucucucaaucaucagaucaaagucauggagcaggaggaguauuugagccuuaggaggcgaaagaaugacaagugaaaguaguuagaccaaaaaagaauaagagggucagauuugugucuugaaguauccucuuuugugcaaaacugucacuguauccuacuaaaauacuccaagaagggacgagaaaaggaguaccucccucugguggugaggaauuuuauaucacagaugagauuuguuuuaauucuagaggaaauaaaucuccugacaucuagcuuauaauuacgggaaacucaaggagaacuuucugaagauugaaaucuguaagaaaguagauuuccagaaaagaaguucccuccugugaacagaaaaaaggacguaugggaaaacaccagguacugaugaauaauguguuucccccgaagguauccuauuccuggcacuuguugauuucgaguuccauuuuauauacuuagaaucucauggaaaaggaguuccaauuugagcuuaaucugcaauucagccaugucugggcacauaugaagaaagggaggaugggcaagcccacagccaauuugcacagcuaucgaggaagcucugagagagaaggcuaagggugggaggaguccugcaugagccugaccugugacaaagccaccuuccuaggaguggaggggcauuucccaucguuucacuacaaggccugagauacccuggaacagaaccagcguugcucuccugcuguccacaguauugauaagaggcuaaucaguuaauaggguugcuccaaaaaauaaaaaaauaaaauaaaaaguaaagacagagcuuaguuaagauagaagagacauuacauuuguggguggaagauaugaaaagaaacguguucugauggacagcagucaggcuccguacuauucaagguuuaggcauccacugggggucauggaauguaccacggauaaguggggaauacuguauagaugucaaaauaaagucaaauuaauagauaaacggauaaacaaaaugugguauauauaccauggaauauuauuuagccauaaaaaguaaugaaguugugacacgugcuacaaaauacgugaaccuugaaaacacaccacgugaaacaagccaggcacaaacgaacaaauauuguacuauucuacuuaaaugaaauaaccuggaauaggcaaauucauagagacagaaaguagaauagagauuaccgggggugguggggaggagggaauggggaguuacugcugaaugaggugaugaaaauuuuuggaaacagauaguggugacaauuucacaacauugugaauguaauuaaugccacugagucaugcauucaaaaaugguuaaaaucggccggguggaguggcucaugucuauaaucccagcacuuugggaggcugaggcggguggaucaccugaagucaggaguucgagaccagcuuggccaacauggugaaaccccaucuuuacuaaaaauacaaaaaauuagccagcaugauggcaggugccuguagucccagcuacgugggaggcugaggcaggagagaauagcuugaaccugggagguggagguugcagugggcugagaucacaccacugcacuccagccggggugacaagagcgaaacucugucucaaaaaaaaauuuuuuuuaaugguuaaaauggcaaauuuuauacuaucuuuauuuuaccacacuuuuuaaaaaguaaauaacaacaacaaaaaagaaauugagccaguuccagccuagcuuaaggaguagagaagcaagauuuggggggcuuauuagagggaaaucagaugggaucagaaaagccauagugggguccaguccaacccuuucugggcacacgacuccucuccugaugugaguguccagccucugcauacguaucugcucccucacaagauuacuuuuaaggcagcagagucuaaccucacaguuggggugucuccgcaacucccagucccugcauuucugggcggucacaauggcacucaagagaacacuagaaugaugcaaaggcagcagggugagagagcuucaaagccaggcacacgauccaccuggcaacugggaucuggaauugggugacaguguuuucuaaagacucaugucaaauguaauugaauaccaggaacaguaauugccuauuuggagaaaugggugauugucuagcaaugaagcuauagcuuuggcagaaucuaacauuguauugaaaucgguugcuuuguucaucugcuccauauaggcuacaucuuuauacaugugcuguugacgaaaaacaaaugccgcguuuucucaggaaggagucagcuggacucuuggcagcaccucuugaccgaaguuuugguggaaaguggagaccaggugcuaacaacuauugauugauaacugacguugagaggaucuuagcaggcaggaggaggcaaggccucagguacaagaggacuauagaaagagaaugugccugccaaaaagccaggucuucccuacuggggcaggauaaagucaaacacaauaggaguucccuggcugccaucuuauucaucucaggaguucaucagaaaaagaauccagaaucuaacaacccaaaggaggcuuaauuuuuguacuuaguacaaagcuacaaaaauuaaggugaauaauggcaccuuuguuuuuguuuuaugcuaucguacgcaacucaagaauaaugacauaaugacaucuuuuuuuuuuuuuuuuuugagauggggucucgcucuauugcccaggcuggagugcaguggcucgaucuuggcucacugcaaccucugccuccuggguucaagcgauucuugugucucagccucccaaguagcuggcauuacaggugauuacaccacacccagcuaaguuuuguauuuucaguagacacuugguuuugccauguugcccagacuggucuugaacuccugaccucaaaugauccacccaucucggucucccaaagugcugggauuacaggcaugagccacuguggccagccaagaauaaugacaucuuacaaucaacuguucuugauggucuacaaugcauuugcaguuuuaucuuuucauuugcuccucacagaaacucccuaaggaagggaagauaggauuaucuucauuguuuuggugaauaagcugagguuuaguguaacugagugacuuagccaagaccacacaguaugaagugacaggauggaguuuagacuaaaggucucuuacuauuuguaguaccucacuagccaguucauauuagcuagagguagucucacuuucagauccagagacaaauugacuuauaaauaccgagaaaauucuaggagguagcaaaauagcagauuuggagcuauuuaaggagaagagaaauuuuauguugggaaaaauguggaagaagaagaagugaauaugaaaaaaugcugcuauggucugaauguuuguguucccuccaaauucauaugcugaaaucuuaacugcaaagggacaguauuaggagguggggcuuuggggaaguaauuaggucaugagggcagagcccucaugaaugagaaaagugcccuuaucaaauaggcccaagggagcuuguucacccuuccaccucgugaggacacagugagaaggcaucaccuauaaaccagaacucaggcccucaccagacaccaacucugcuggugccuuggacuucucagucuccagaaccgugagacuaacuucugcuguuucuaagccacccagugugugacauuuuguuguagcagccugagcuaagauagaugcuuaauguacucaguuuucuucuccccucuucucuccuauucugaccuccucuccuguucucuccucuccuuuucuuuccuauucuuuucccaagacaaccuuuucugaguucaguuuuaaugcuccaugcuaugggugucuugauaaucugggagcgguucaggugaggaacccgacuguggcaacuuagcugcccugcacagggcucugcaagugguagguucucaaaaugugugacuggcuucagaagugacguuuuaggaggacuuaaguaacaucuguucagaacuggaaguuuuuccaaauauguaaacuuauauugaccgucuuaauggcuugugacuuaauaccaucaucagaaauugcuuuucaaaauuaugcuacguacaguuuuauuguaaaggaagcaaaguuggcugugcacgguggcucacaccuguaaccgcagcacguugggaggccaagguggguggaucaccugaggugaagaguucgagaccagccuggccaacguggugaaaccugucucuacuaaaaauacaaaaauuaaccgagugugguggcacacgccuguagucccagcuacucgggaagcugagacaggagaauugcuugaacucgggagguggaggcugcagugagcagagauugcgacacugcacuccagccuggguaagacagagcaagacuccgucucaaaaaaaaaaaaaaaaaaaaaggagaagcaaagcugugauugcaaccauaucuuaaaguucgaaagauuuccuagcgaguacuauauucucuuucauuucacaaaaggguuaaguguuuuuucugauuacuaacagaagauaaagauuucucauccagugccccgauaccuacauguaucugaacagaugggcgauagugcuaagggaauugaucugaauguguaucaaagaaugcaggaaaugccaugaagucaaccuccuaccucaucuuauuuccucugaaagcaaacacuuuacuuacauaauaauuucuuagaaauaguaacaaacaauaggggcaagccugacuauuuaaagacacaguuguggggagaucuaaguuuauggaucagagaggguguguuagaacuuugguaacaggacaggagucucugauuuaucauuucuuaggaacuccaaucaaaacaacaaaaaccuaugccuuuacuaagauauuccucaauaucugugugacaggcagagugucucucuguguaucagacaccacagaaguacuccaagccuccagcaggggcagguagaaaaacauauaucucauauauauauauaucucauauauaucucauauauaucauauauauaucucauacauaucauauauauacaucauauauauaucucauauauacaucauauauaucucaucuauaucauauauaucucaucuauaucauauaucucaucuauaucucauauauaucucauauauaucucauauauauaucucauauauaucucauauauauaucucauauaucucauauauauaucucauauauauaucauauauauaucucauauauauaucauauauauaucucauauauauaucauauauaucucauauauaucucauauauauaucauauauauaucucauauauauaucauauauauaucauauauauaucucauauauaucauauauauaucauauaucucauauauaugauauauauaucucauauauaucauauauaugucauauauaucucauauauaucauauauaugucauauauaucucauauauaucauauauaucucauauauaucucauguauauaucucauauauaucauguauauaucucauauauaugauauauaucucauauauauaucucauauauaucauauauaucucauauauauaucucauauaugauauauauaucauauauaucauauauaucucauauauauaucauauauaucucauauauaucauauauaucucauauauaucucauauauaucucauauauauaucucauauaucucauauauaucucauauaucucauauauaucauauauauaucucauauauaucauauauauaucucauauauaucauauauauaucucauauauaucauauauaucucauauauaucauauauaucucacauauauaucauauauauaucucacauauaucucauauaucucacauauaucucauauauauaucucacauauaucucauauauaucucacauauaucucauauauauaucauauauaucucauauauaucauauauaucucauauauaucauauauaucucauauauaucauauauauaucucauauauauaucauauauaucucauauauauaucauauauauaucucauauauauaucauauauauaucucauauauauaucauauauauaucucauauauauaucauguauauaucucauauauauaucauguauauaucucauauauauaucauguauauaucucauauauaucauguauauaucucauauauaugucauauauaucucauauauaugauauauauaucauauauaucauauauaucucauauaugauauauauaucucauauauauaucauauaaauaucucauauauaucauauauauaucauauauauaucucauauauauaucucauauauauaucauauauaucucauauauaucuauauaucauauauauaucauauauaucauauauauguguauauaucauauauauaucucauauauaugguauauaucauauauaucucauauauauguauauauaucauauauaucucauauauauaucauauauaucucauauauauaucucauauauaucauauauaucucauauaucucauauauauaucucauauauaucucauauaucucauauauauaucucauauauaucucauauaucucauauauaucauauauaucucauauauaucucauauauauaugauauauaucucauauauaucauauauaugauauauaucucauauauguaucauauauaucucauauauauguaucauauauauaucucauauauauguaucauauauauaucucauauauauguaucauauauauaucucauauauauguaucauauauauaucucauauauauguaucauauauauaucucauauauauguaucauauauauaucucauauauauguaucauauauauaucucauauauauguaucauauauauaucucauauauauguaucauauauauaucucauauauauguaucauauauauaucucauauauauguaucauauauaucucauauauauguaucauauauaucucauauauauguaucacauauauaucucauauauauguaucacauauauaucucauauauauguaucauauauauauaucucauauauauguaucauauauauauaucucauauauauguaucauauauauauaucucauauauauauauaauuuuuuuuuuuuuuagacggagucucgcuuugucccccaggguggagugcaguggcgugaucucagcucacugcauccuccgccucccagguucaagugauucuccugccucagccuccugaguagcugggacuacagguguguagcaccacgugcagcuaauuuuuguauuuuuaguagagacaggguuucaccauguuggccaggauggucucaaucucuugaccucgugaucugcccgccucggccucccaaagugaaaagcauauuuaaggacuuguucagcucccagggaugaugccccuccaaaaguucaggacuguuuucaucagacacuuuccugguggguaaacucaucgcccuucagggauggggggcuaugagaaggaggcugaaaugccaauugcuaguaaaaugucuuuucugagacugaaucuuugaaaugcuacuggaagucaguggggagaugcgauucacuuuacaaaauucauuucugaagcacaauaacauuaagugagauaaagcuauaugagaaaugagaaauuagguaauuuuguuauguucuauaagcauacagcuauaauucaggaucaucacauuuauuucaaaaguuauaguuccauuccuuuugauauugccugggucuggaagggauaagggccuuauaaaaaauucaucucucaccacccccuuauccacauugauagugguuagaugaccaauccuuaugacauuugcacccuuuuaauuuaauugccaccaauucuuccccucuccagaucugcgcccuuaugaugugcuguggcagauucucuugucaagaggugaagccuauuucucaaucccgagaaucuggguuggccugugacuugcuuggccgauggaacauuagcaggaauaaugcagcacaggccuggaaaucacuugugcauugggacuugcucucucgcuacauuuguuacccugagaacacuaugugaacaagcccaagguggccugcuggagggauagaggccacguggaggagaagcaaggugcucuagcuaauagccagccaguggucaggugcgugaaugagaccguccuaggaccagccagccucccagcugaccugacaauucaccacagacacacgagugagcccagucaaagccaguagaacugccuggcccaaauugccaacccauagaaucaugagcuacauacacauaaaugcuuacuguucuaagccauaaguuuugggauggggccaggcaauggcucaugccuguaaucccagcaguuugggaggccgaggcagggagaucgcuugagcccaggaguuugagaccagccugggcaacauggugaaaccacaucucuaccaaaaaaacaaaaacaaaaaacaaaaauuagccaggugugguggugcaugcuuguaguccuagguacuuggggggcugaagugggaggguugcuugagcccgggaggugaaggcugcagugagccgagaucagaccacgguacuccugccugguugacagagugagaccuugucucaaaaaauaaaaauaaaaauaaaaguuuugagaugguuuguaguacaguagaggcuaacagaaucauuaaauuauacuuacuuggagcuacuaggugacacacuuagagaaaagguucucucuaggcugaguucuaucauaggcucauugugguauuuaaccucccacgucuguacuucagcuuuucuacuucaaagaagauaauacuuucuugaaggucagcaguaauccuaauucagguguauguacauuacagcuuucuuaucuucuuuuucucuuuucucuucagcaguuuuaccaggagccacuauaaggauaauauucugacacguguuuuuucuuuucuuucuuucuuuuuucuuuuuuuuuuuuuuugaggcgguguuuugcucuuguugcccaggcuggaguacaauggcaugaucucggcugaacacuaccuccgcuucccggguucaagugauucuccugccucagccuccugaguaggugggauuacaggcaugcgccaccauaccuggcuaauuuuguauuuuuaguagaagcggggguuucuccauguuggccaggcuggucuugaauuccuggccucaggugaucugccuggcucggccucccaaagugcacccggccaacacguguuuuuucaaaugaguuaauaauaauguuaagugcuuuaaaagcucuuaagaugucauaugugugaaguaucauauuuauugugucacaaugaauggaguuauauaacuauuauaacaaacacaaugggcccuucuaagaguuacucuguuucauugagaguucucuaucuguuuaguagcaccugguaggaaguuucccaacuuaccugagacuugaaguaaguuucuugugggguggcaaguacaucugcagaggcaaugucuaaaugcaugagugucugccgaaaagaaggucgguuucgagguuuacucugccuaaaagugaaaaagacaguuugugcauuucagaaguuguauccaggagaaugaagauuuuauuuuacuuuaugaagaagauuguuuacuucaaaauggcuauaucugaguaaaaccagcuguacuccauuauaucaggauagcauaacugaauuguaucucaguacaguuuuaacauuucuuuuuuucuuuuuuuugagacggagucucgcucugucacucaggcuggagugcaguggcgcaaucucagcucacugcaagcuccgccuccuggguucacgccauucuccugccucagccuccugaguagcugggacuacaggcacccgccaccagaccuggcuaauuuuuuuguauuuuuaguagagacgggguuucaucguguuaaccaggauggucucgaucuccugaccucgugauacgcccgccucggccuccuaaagugcugggauuacaggcgugagccaccguacccggcccuuaacauuucuuuaaauuuauuuuuuauuuuuuuuucagagacggggucucacuauguugccuaagcugaucucagacucauggguucaagugauccuccuaccucggccucccaaaguguugggauuacaggcgugagccaccaugccuggcccugcaguacaguuuuuuauuuauauuuuauuuuauuuuauguuuuuaacacagagauggggucucgcuauguugcccaagcugcucuugaacuccucgccucaagugauccucccaucucugccagccaaaguguuggaauuacaggugugagccacugugccuggcugcccugcaguacaguuuugauauacugaagagcaaaaggaaaauguaauuaugagauacgucuaaugaugaaauggaaaucuaggauuagugaccuauuuaauaauaguccauuaggacuagcaaagaaauaguagcuaucauugaccaaggccuacuauuuugagauaauaacaccaaguucuuuauuucuaaauuuuaauuaauuacaacacaauaacucuaugagucaguguugucucuauuuuacaaaugagaaaacugauauugaauaacgugcccaaaauugcacagauagaaaggggcagagcuaguauuugaacccaagauucuccuacuccaaagcuccuauucuuuccaccaccaggauauuuacuccaaauacacauuagagaccucccuauuguuuuagagacaauauucuuaccacgucuguuucauaaggauuuugaauccaucagggcaaguggaaggaacuggaagguggaggcuguugcuuccaacaccccagauaauggcugaagaaucuacaucuuuguaagggaucucuccugucagcagcucccaaagcaccacuccaaaagaccuacaguagcgccgggaacauggacagaagauguuucagaaagacugauuuguauuuuaguucucuauuaauugaaaucaaauuaguacauauacccaguuuuaaaauucuaauacugcuauaagaaaaacagaaacaucugggacaacucugaaaaaaaaaaaaaaaucuaugugggguaaucaacacuaccagaaauuaaaaccugaauaauuaacucccgugugugaacagaucaccagcauaauggacuggacaagaaauccagaaauaaaccaaauacauuuaggaauugaauguaugauagaagugacaucaaaaaccaguggggaaaaauugauuaguuaauaaauguuguuggaacagcuaggaaaaaaauuaaaucuauaacucaccauaaaucaagauaaauuucacaugaaucaaagauuuaaauagaaaaaugaaaccauaaaaaucuucuaaaaaauaaggaguuaaaaaauuaucuaggaguguuaaaaacuuuuuuuuuuuuuuuuuuuuuuuagacagcaucuugcucugucaccuaggcuggaaugcaguggugcgaucuuggcucacugcaaccuccaccuccuggguucaagcgauucugcugccugagccucccaaguagcugggauuacaagugcgugccaccacgccuggcuaauuuuuuguauuuuuaguggagaugggauuucaccauguuggccaggcuggucucgaacuccugaccucaagugauccacccgccuuggccucccaaagugcuggaauuacaggugugagccacugcgccuggcuuuuaaagacuuuuuaaaccaugaaaucuaaaagccauaaaaggagaaauugagaaauuaaacuguauuuucaaaaucugacacugaaaaaaauaccauaagcaaaauaacaaaaugugaaguaucuacaauuuacacaaaaugugaaucuccuuaauacauaaaauacucugauaaauuaugaguaaaaaucagaaagcugagcaaagauuaugagucauucacaaauaagcaaauacgauggcuguaacacauaugaacaaaaguacaggcucacuuauccuaagaggaaugcacccaagauaccguuuuuuuaccuauaugauuggcaaaaauccaagaguuuagcacauuuuguuggugagacugagaaaacacucuuacauauuucuggugggaacaucaauuaguaaucccuaaggaggguacuuuaguaaugauuaucuaaauuacgaaugaccccacauuucuacuuuuuccuauuugcucugguauuacaugcaauuuugacaugugcuauuauuuugguuuuaagccuagaaguuacuaguugccaauuuuaaggguaaaagaaaagcuauuacagggaaaaauacuguuaauagaaaagacuuauaaccucagaggaaagguuacagagauuuuuuuuuaaagcauagccuauagaggcuguucaauaaaagggcaaaacaaccuccuacaucucaaacaugucuagagaacauaauuguaucauagcaagguacauuauugauauguguaaugaugaccugagucauugagauuagguaagcucuuguacuuuacucaagaaggugagaacuauguaacacauuucagaaagacuucuauacuaaaugaucauuugaaguaaacuuucaguuuccuagaaaguucagcauauucucugaggucccccaaacuggugacuuacugaguagauagccacccuaauucccccuaauccuucuccccauauaucaccauacugggaaguaccucagaaaauaugaggcugaaaucaaccaaaagugagcaacacugaagaauauucuggaaaaguaagugcugaaggaagacagugcuaauagggcgaaagugggaaaaggcuuuuuaguuggcacaacugguggcgccacucaccauauaucaacuuuuucagagacagguucauuccguaucaccucuggcgccauccaugcgaccgugccagcaaaugacaucuugguacuuuugucacugaguuccuuagauguaccaaaaucugaaauuuuuaccgcaucugugugggucacuaaaacacuuuaaaaagaaauaaaaagaaaacaucuggaucauuaguacuaacgaaaaccaugauucuaaauggcugaaacugaagacuuuaucugcuacuuccuaucuuguagcauucagcuugcaguuuccaaugucacuggggcauuggcuauacacuagaaauagcaucauucauacuugugaggcaguuuagcguaaugggcuuuuaacaccuagucuuauucugccucuucuacuugcugugugaccuuugccaaguuauuuaacucuuuuuuuuuuuuuuuuuuuuuuuuuuuugagacagaguuucacucuugccgcccaggcuggagugcaauggcacgaucucagcugacugcaaccucugccucccggguucaagggauuuucuccuugccccagccucccaaguagcugcaauuacaggcaccugccaccaugcccagcuaauuuuuguauuuuuaguagagaugggguuucuccauguuggccaggcuggucucgaacuccugaccucaggugaucgacccaucucagccucccaaagugcugcgauuacaggcaugagccacugcacccggccuuacuuaacucuucuaagccaguuuucucauguguaggauggagacucuucaggucuuauucacaaauugaaaaugcaaaaaguucucaaccaguuuauauuuuuuucacauguauaaggcaaacucacuuucuucaucccauuuugugugaacaauagguuuugcugcagauuuguuaaugugguugauuuuaggaugcugcuccagaccucgcuggaugucuaagguagugcacuaccuuucugaaaauaucuugcuucaagaguuuuggauaagggaugauagaccuguaauaacaaucucacugaauuuucauuugaauuaaaugagguaagauacauaaggcaccguuaucaauaaauauugguuuccauccuugcuggcuuuagccaggccacuaaaaagaguacuucuuuuaaaacacuguuuaaaugauagccaacuaauaucaugaaugagaccaugauguuugggauucauuacauuaaaaggcuaauauauaugcugggauuucacuagugcugauaaggaaaagcagaaauaaauccaagcuuaaguaaauuccacaccaguccuguuuuacuugucauaguaguuaucugaaaauguggccugaggcaaagugcucucugccagccuugaagaugaauacaauccgguaccaaauugacagcuucacauuagaucgaauucacuugcaauaaccuguucagaacuuuagaaaauuaaagacuuaggguuucagaggcuuuaaugaucuagggaccuauguuuaaugaugagaggcuuacgagcgugguggcgggcgcuuguagucccagccacucgggaggcugaggcaggagaauggcgugaacccgggaggcggagcuugcagugaguggagauugugccacugcacuacagccugggcgacagagcgagaccccaucucaaaaaaaaaaaaaaaugauaagaggcuucauccucaaauaguaucagaauugaggaggcuguaaggcagaaagcaucugacucuauccccuugcuucuccauuugaaccagggauuccuucacauuuaccaugcucacaaccccaacaccaauggcuauuuaccaaauagcucagagcuuacaauugcuuuugaauaccauccuccaugcccugguuuugcacguaauauguaaaauuuauauaacuuaggaguuuugauuuaacaguguuagucuuagugaaaaugcauaaggauuaaaauauuaugggauauaugagagaauuggagaauugauaucauacaccaggaaagugagaguaggcaguaagccccuaaaagagggaacuuuuuaugggaacuuccucucugccucuguuggugugacaagagaggauggacuugagaggagacuagaaaaauauaacauuagaauuuuucugaaaucuucucugagacaaaguuguggucacagagccugcagauuuaauguaaguaaugagaucucuuguuacagcaagucagauugaucucugucuucccaaagucagcuugaaaccuaaagaagccaacgcugcugggguugggaguguuauugcuaauagagggaaaggcuuacuggguaacccaauuacuacucuauucuacggcuuccugacuccuucccucuaagauuaauucauaaggagaacaaguugguuaaaaaggagaccauucagagaggccuucagguaguucauguccuuuacauguaugcacuggauggcaaaagcaacaggguaagaaugugaacggaagaaaugaacacuacacaaucauguuuacuugcaaguaaagcaaggaggagguuguucagucaacuaagcacuguaauaaauauugcugagaaugauggugauaaauaagagcuguuuugaaguuuauaaugaaggauugauuuauaccguccauggaggaaaggcaggauucauugugaguccccuaccuucacauaaugagguagaaugcaguaaccuuugguucagaaauucuagguucgaguccuagccccaugacuuugggcuaaucucuaguuuuccuuacauaaaauaacaauacuuguuacguaucccacacaguuuuugccaggaucaaagaugugauaauggauucccccuaagauauuauaaaccaugaaaacacuaugcaaauauauauauguguguguguauauacaauaaauauauaguuuuuuuaaauuuuuauuauuuuuugagacaggguugugcucugugguccaggcuggagugcaguggugugaucauggcuuacuguaggcuugaccuucugggcuuaagugauucucccaccucagccuccugaguagcuugaacuauaggcucauacuaccaugccuggcuaauuuuuaaauuuuuuguagagauggguuuucacuauauugcccaggcuacaaauauauuuugaaaagagauuaauccuuugcuuaucuaacccaaaaugugaugauaaauaauaaaaauaauguuuaaaaauaggaguuauacugaaauaaaucauuuuaucaauuucuuucuucauucaauuuggggaacuaacuacacacuccucuuaaagugauugguagccaagaaaucauuuugaaaacagagauuacuagaaauagcccugcuucucuuacauagccaguguuuauuuuuccuauggccauugugaaccuuguaauuguuuauuuccuccuuugcuuagacacuagaagcucaaagccaaaucuguaauccacgucuacagaaucuuacggcauauaauuugugaacaauuuuuaguucuaauguuuuuacuuuuccuuugccucugcuucuuuuuauuuuuauuauuuauuuauuuuuauuauuuuuuuuuugagacagagucuugcucugucacccaggcuggaguacaguggugugauuucagcucacugcaaccuccuccuccuagguucaagcaauucuucugccucagccucccaaguagccgggacuacaggcaccugcuaccaugccuggcugauuuuuuguauuuuuaguagagacaggguuucaccacguuggucaggcuggucucaaacuccugaucucaagugauccacccaccuuggccucccaaaguucuaggauuacaggcgugagccacuccacccagcuagccuguuucuuauuuauccauuuuauccuguuguauacauuucugaaacucaguuuaaaaaguuuuuugaacacauggaaaacaacaaaucaagccuucuagcgggaaggucuggcauuagcuaucugagaugacagaaggugaauacuucagauaauaaugaauuuuguuucacaguuguaugauuuaaaagcaccaaaaaggaaaagugguuucagauaccuggacguaucugcccuacagguaaccagguaggucaacaauaacccaagagaugcgcaaacagaauuacccacugugcugauugaaacugaacuaaagguaugaugucugaaaacgucaacugagguugauaaaaauucuguauuucaaaacaacaaaccaaaauagcugaaacauuagccccagaacucacuuaggugauuugagaucacgaugaauaauuuuauggaggugcaaauaauucauuccacuugcaauuccuguggaccagucuacuagcaaucgaggugugaucuuccugccagcucguaagaccucguagaguuguccaugggcacaguauuccaugauaauacaauaacauggggccugaguacaaacaccccuuccaagaaaacauaaacauguacaucaauacacacauacaaguauacauauguauauuuaaagaauauuuaauaaaaaccaauucuauacccgaauuauuuuaaaaauguguauagauaauaguuccugauucucaaauuagcauggaaacuucucuagucuacagguuucucuaugaugcacauagacaauuuuuguuuguuuuguucacucuggcuaucuauaugcugugcugugucuggugccuuuucugugggacccuuccauuccgggacaaagagcacacuuuucugaaguuugugcaggcuggauacuguguuguuuuagaucauuaagaauaauuugggaggccaaggcggguggaucacagggucaggaguucaagaccagccuggccaagauggugaaacccugucucuacuaaacauacaaaaaaauuagcugggcaugguggcgcgcgccuguagucccagcuacucaggagacugaggcagagaacugcuugaacccgggagguggagguugcagugagccgagauugcaccacugcacucuagccugggaaacagaguuagacucccucucaaaaauaaaaaauaauaauaauuuggccaggccgcgguggcucacgcuuguaaucccaacacuuugggagucugaggcagguggaucaccaaggucaggaguucgagaccagcuuggccagcauggugaaaccgcgucucuacuaaaaauacaaaaauuagcugggcauaguagugcaugccuguaaugccagcuacucgggaggcugaggcaagagaaucacuugagccugggagaaggagguugcagugagccaagaucgugccacugcacuccauccugggugacagagugagacucugucucagaaaaaaaaaaaagaaaaaaaaggaauaauuuaaaauuucuuccuuuuaaaguuuuagaggguuuuaugaguguacaggaagauaauucagagaaaauacuucuacuuuuaauauuauuugcugaauuuuaaauuacucaaauuaaaaauaacuaacuagacugaggacccaaagacgacucaauuuuccaucuuacauaaucuuugaaaaacauuucuuuuuuuuuuucaugucagacagguaauguggugacgucguaacaagguuggagggaggcacaucucacccgugagugggaacacccagucaugcuuaugaaucacaaaagaauaugaaaauauacacuuuuuuuuuuuuuuuaagaaagagucucgcucugucauccagguuggagugcaguggugcaaccucugccucccaggcucaagugauucuccugucucagcaucccaaauagcugggauuacaggugugcaccaccacgccaggcuaauuuuuuuuuuuuuuuuuugagacagagucgcucugucacccagguucgagugcaguggcacaaucuuggcucaccacaaccuccaccucccggguucaagcaauucuccugucucagccucccggguagcugggacuacaggugcccaccaccacacccagcuaauuuuuguauuuuaguagagacaggguuucaccauauuggucaggcuggucuugaacuccugaccucaggugaucugccugccucagccucccaaagugcugggauuacaggcuugagccaccgcuccuggccaccaauuuuuuuuauuuuuaguagagacgggguuucaucauguugcccaggcugcucucgaacuccuguacucaagugauccacccgucuuggccucccaaagugcugggauuacaggcgugagcuacugcauccagccuauacaacauauuauauaucuauuagccuuuauuugcaucaauuccuacaucauccaugaaaaccuuuuccaauuauuccaauccaaaaagaucuuucucuucccuaaauuccuaugauauacaacagccacuaguucuuuauaugcaguuuuucucucugcauauagauuguaagcuccuugaagggaaaggucuucaaguucuuuucucucuaccucaacgccuagagguucacagcaagucucuagcaaauguucguuaacuucaccucaaccuucuugacuaaaaaagccuucaaauaacaugugcagaggccuggaggaggaggaaggagacuaacaugaaagaaccucuucuauuuuucaaggacauuuccauguuuauuugucuuauuuaaucugccccaaauuaccauaagauaaauauuaccuuuuccauuuuuacaaggaaggcucagagugagaaagugacuuguccuaaucacaacuagaucauacaacuaauaagugacagagcugggauucaaacucagucugccuaauuugaaaguccaugcccacuccacucuguacaauacugccucccuuuuagcuuuuuaacuucuguuuagacaagcacauugggaauucuuguguuaacaccauuaucucauaaaagggaaugaucauaguaacucuacuucuguuuuguucucaagaugagaagaaaaauuacuauauguaauucucuaugucuuaucgcuuauggguauacaugccuuccuuugaaacuuucuagagaaguuagcagaguaucuguaagacauccaguuaaagccuucagccagcuaccaacccaugccuaucucuucagcugcuguaagugaugaaagaauuuugaggucauggcuuacggcacugaucauaugaaggugaugaugaucuuauaacaauagcagguuaugaagaaguauaauuagucuucauuuuccccugcccugaugugccugucaaaugccacaaagcuauuucuauuacucuccuaucauuuucuaggcuacagagaauucuuaucuugauuuuuaauaauuuuuuuucaaguuccgguuauaugucucuuaggaaagcuuggugaacccaagugucuggcagcuacaaacaaaugauuaauuaucauuacagagaacuaauaaauacggcagguauaauguaauaugcuuaaguauaucaacauaaacauuuuugaagguacucagccuccuauucgacuauguuuuaacuuguuccacauagaaacggucuaacagugaucuuacgcaccuuuuauuucucuugacugacgaacgaggagcaaucauuccaucaucccuguacuaugacaagguuucuuaguagcuauaaauaacagcucuauaaucacuucuaauugcuaccuuuucuuccccuuggcacugaauuccauuaggaacagucagguugaguuuucuuaaaagauuaacaaaaaaauuggaugcaaaaagaguauagcauucuuaucuuguacuuccccuucuguaugugguuuuuauuaacuucaaaagaagcuguaagcacagaaaucaguauccagagagauguacuaaaaucuaaucauucucucauauaucuuccagacgguccugaaugggauucauuggccaagcaacacauggcacagauggcugcaaacauaacacugcacaaugcccaagagcaugguguaaugggccaggaacacagucucacuauuguuuuccauguagagguaaauacuauucaagugucuucagccuaaagaguugggcacuagcagggcagugcugaaaacugcauaugcagguaggagagucagaagggagaggugggaaaaaggaagaaagagaaagaagcaaaagaaaggaaguaaaaauaaagcuucucacaacaccauccuauuaggacacauuucuacuuucagugaccccggguacccuacuggaaagcccucuuaccugcaacacacagccuaauucacuucaagaggccaaaaggccauacucaucuacgggacauucugugucucaaacccagcguccuagugaucuaaguuuaaaagcuuuugacccuuccuuccauuuaggaggguguagcauacuggaagugaagauggucucaguguaguaaaaugaaggaaagaaagaagagggucucuguuugucugucugcuugaaauaaucuccccauugucuuuugaaauuuauccucuuuggaaagaugauaauuggucucugcagcauuucauuuuagucacacauccuccuggcccuacuaggucaaccaaggauagaauuaacugcagcaauugaagcuuucucccaugcccucugcaugaaugucccuuccccaaggaaaugaauccaaguacuucuuucugucucuuaguguccugguugaaugcuucucuuuuuuucacaggucuuucccuuuccauaaggggucuuguuugggaaucaaaacucaacuucaguacucauuuaaacccauucuacaaaaccuguacccaagauuuaccuuccuuacuuuguggaugugaucccaauuaagacuuaucacaugacauuuuuagcuuuauaaucagaguuuuaucaaggaaggauccauucugauccuaguuccuccuaguuuaggagggggauuuguaaguuauuccacuuuuagcuguagccucauuggucauacuguuuuccaggaaugcaaaauacauaucaaauauaucacaaagcuccaguuucuaaacuuucauccuaccuaaagauacuuguccuguucuucaccuucuuuccucuaaagccacuuaccacuuauuuguuuaagccuagggcaacauuaaaaggcuagugagggagagaacucaagggaaagauucaggcagaagagauaauaucuauuuagagcucagcacuuccacccuuuaaacuuugacucuccuccuucuguuagggaucccaggcaauauuaugaaaagaaucaucuaggcuagaaaaauauguucacagacucuugaaaacaaucacuuugugaaaugaauauaacauaugacuuacuaucaauaacucaacaaucauuagguuaagaaagcugaauguuugacauugcuuggaaggagaucuaggaaaaccagaggcuauacucuaaagguaccugccauuacacguuaauguuuaagaagggaugcuaacagaaccuaauacaaaauauguaucuacuacacaaggauugauuguucuuugaucacuucagauguuaccuuugucucuuucuuucuuucuuucuucuuucuuuccuuuuuuuuucagggucucacucugucaccuaggcuggagggcaguagcaugaacauggcucaacacagccucaaccuucuggguucaagcaaucccccugccucagccucuuaaguagguaggacuacaggccugugcuaccacauucagcuaauuaaaaaaaauuuuuuuuuacagacaggguuccacuauauugcccaggcuggucucaaacuccugggcucaagugaucugccugccuuggccucccaaagugcugggauuacagacaugagccacugcgcccggccaacuuuguuuuguuaagugaaucuuaggcuguucaggugauauugaaguaaccucuguuaucccauugauaaaugagguugaugcagcagaucugacugcuuggcaggaacccacauuuucccuuccugccccaugugcaugccccuuccauguacuuccauguacuuugcacauacuucggcaaaaugaaccacuggauuauaagaugccugaggacacaacuccaauuuaauaguuccuugauacccucccaaagcaccuagcacagugcuaagucuagagaaugcuuuugaaauaucucucaaagcagaaacuuguguguauauauugggggaaagaaaauaggucuacuucuuaaaaaaaaaaagccuugaccuacuugaaugcgaugauguuagggugcuucaacuuccucaaaugcuugauauccgucucauucuguucucucacuuucuugauggccaccucuuccgcccggaacuugcccaagaagaccgcuccuugggcuccacuacccagccacugcagcucugagaucuccucaaauggcacuucccaaguaucuaggcacacaagcaagaaauaagcuugaagagaucucagaagggaccacucuacaaggccauucugaagguaccaacuucaucgucacccaggaugacccuuacccucugucucccggcaaaagauagaaccuuccuauguaccuuggaacuauagaucaaauauucauaaacauuaguuuguaucaauuuuuaaaucacugaaauaaagcagagcagaagccuccaauauaccuuccuccaaauaaaacauauccuaccacuccugcaguccuaccuccucaccuuaagcuugcaugucagucaauuuacccgucugucucuaugcaacuaucccuaccccaucacccacuaucgguguuauuuuauuccucuuuuaauuucuggugcagaugcucagugaaucuuugcuaauuuuuuuuuuuuuuuuuuuuuuuuuuuuuuuugagacagagucuugcucugucacccaggcuggagugcaauggcacgaucucagcucacugcaaccucugccucugggguucaagcaauucuccugccucagccucccaaguagcugggauuacaggcaccagccaccaugucuggcuaauuguauuuuucaguagaggcaggguuucaccauguuggucagacuggucucgaacuccugaccucaggugauccacccgccuuggccucccaaaguguugggauuacaggugugagccacugcgccgggcugcuaaugaauuuuuuaaugauacucuccuaagaacuucauuaugcauacuacuuacauuaauauuuaccuuuuauugaggacuuacuauauaccauacacuagcauaguacuuuacauauaucauauguucaauccuuacaacaacccuacagguauggccuuauuauaguuauuuaaagaugaaaaaacuaaggcauagggugguuaaguaaauucuccuaaaaucauauaacugauaacugguagaacugggccuagaaucccaggauuggccaauuuuacgaagagugcuuucucuccuauaugacauugccucucaaaaguaauugagagagccauuagucauuagucaugauaugcuuacuuauauagcuguaguauuuucaaguuucuuuuuccuuagaguuugaauauuuuuuugcaccagaaauuuaagaagggucauuucuaagugguggcauuauuagugcuucauauucucuauuguuuucugucuuaaaaacuauuuuuaccauaagccuauaucacuuuuauaaugaauaaaaugcuauuuuaaauaaagcacuucaaaaauucaaucaauaugugcuuuaaucucaugaaacuuuuuuaaaaaagaauguaauccauugaggcuucuccuuucccccuucuuaccagaguauuaucacagguaagaaacaaauaucaaagagcuaagagccccacggagugagaaaaaugaugccagugugaaaggucaugagagauucuccucagaucacucaaaagccaguguuugcagaacauggaacaaaguaguguugaguuagcuucaaagauacucuggucuugaaagcaaaucaacucaccauccacugcauugaugaaacaauuuaucugccucuagaagugagcuacacuucccucuucucuaauuuucucuaccuuaagagaaaagaaauccuguagauucuuaauaaaauguuuucucauuacaauugcuaaaaccuaaccuucaaaauauaacuacauagagcaaaaaguauauaaaaugagggugguuuaugccgugggccuucaucccguucuccugauaugagcaguauuaaagguuuccacucuacugaaauugaauaaaugcuagauaaaagcaaaucucucucaaauacaaauagcugacaaauuuaaaaucacccaagaaacacaugauaccaagugagauuugggaggaaacagcaagugauagcguuggcuauuuuaacuaucuuuaggguuucuauagaggacaaguauuaauaaguggcucaugaaaucucacuuucaccuccaugggcucauacaugcagcacacgugguacacagauaucgauggcauauuguaagauaguuuuccucauuagggguccagugacaaaaacaguaucauuggccaggcguggugguucacgccuguaaucccagcacuuugggaggcugaggcaggguggaccaugaggucaggaguucgagaccagccuggccaauauggugaaaccccgucucuauuaaaaauacaaaaaaaaaaaaaauagccaggcaugguggugcaggccuguaaucccagcugcuuaggaggcugaggcaggagaauugcuugaacccgggaggcagagguuucagugagcugagaaugcgccacugcacuccagccugggugacagagcgaaacucugucucaaaacaacaacaacaacaaacaaacaaacaaacaaaaacaaaaauaaaaaaaccucagugucauuuugacaauucugggggcugaauaaaguauuauuacuggacucuggggcaagaacauaacugagcaguacgucuuugaacagcuuuacacaagcccaaauuacccuaauuuuuaauaaaauaacuacuaaaauuagacuguuugggugucuuuuuuacccuauuuacucaaucuuuaguuacuguuaaacauuggaaacauuagagaaagaucagaaaagucagaaaaacacagauuuuaugugaaagcucaucccacacccacuugccaucuacccuccuaguuuguguucauguuuacagcuguguaaaaauggcaggugaugucuaauuuuuucuacuuuuucacauaucauguauccuucauguaguuccuauuuuuauuauaaguucuaauaguuguucuguacccucuuaccuguucugcauaaguauauccccagauucaguuccuugguuaaagaggacaguuuccuggcuccaggaauacauacauuccaaauucuguccaaaaggauuuugauaguuucgcucacaauagcaagguaugaacauguuggcaguaaguguuaucaauucuuuuuugguucuauuuuaguuuaguguuuuauaacuuugcacuaguuuaacugccggugcucacauuuguuuaauauucauaaucugcuuugcaugaauugucaaaaccccuuuguucauuuaucuauuagccuuccauuguucacauaaacuugaagaaacuccuucuauauuucuuugauacaaaugagaauauuuuuauaagccuuuuucuuuuaauuuuauuauuuuugaacaaaguauucuauaucauugucuauuauuuccuuuguaauuucuuccacugccuagucuaccuucuaaaaguuaucuauaguucauuuuuaaaaauuuaaucuuuacuuucaucugaaacuuauuuugguguaugguaugaggacagauauaaauuauuuuuuuccacauugcuauuuaaugauucccaaauaauuuguuuaaaaauccuuucuuuucauauugcuuuaggauacuuacauuguaacucacuauguuuuuuagaaauaaugccuauuaguauuuuuauaagaugauaaacagacuaauuacuaaaauacaaauacauuuggcacucaaauacaaaguauuccgaguauugcaauaaaaaauaaaauuauccucuaccaaccucuaccucaugccugugcuauucaacuauguucagccaagucuugauuauccauagaaaaauaaaguggauaguacugguaaugaaagaacacagauuguaaaauaaagaaaguaaugcuucaacaauguuucuauccaucuuuuuacugaaacuaauuaucagaaguaaaaucgauugauaugaauuuagcacucuuugaccagucucaaagucccuaucaauaaugagcagagagcucagaaaugggaaaauggcagaaaaaaggaaauuggugauaaggaugcacaaaauuaagggccuagauaauugaugagugagauaacuaaucucauaauaaugaagaacugacuacacucucucuagaguuagucccaaacuuuucguugcuucuaugucugucccacugcuacucuuccccagcguuuaucuucaauuuuaucuucccaaugacuaugaucuuaauuccaauauccaccagaauccuuaggacugagaaaaagacacaugcccacccacuuuaaggcaacaguucuccuuuguuuauucagacauggccaugacaguacuugcuuugagacuggaaacuauuugacaauaaaagauuaaauugcaugcuacuuuacuugggcucacuaucaacauacucaaagggaggugaggacaucauuaaaauuuuuuaaaaauccagugacaguuccucauaaguaccaaauguagggacacaucugugauauguguuagccuucgguugacugcaaugcaggauugaagauuggcucccugaucccagaccugacaaggaaauuugcuagucucuggcuagcgaaacccuuucauggugcacagcaacaccagcccucaguaggauauccugcaaucugcugaaaggccaggcaccugcugugccugugucagaaucuuaagcugaccagggcuguuucuuauuuauuugugaaauaaacccuuuugaaagucacauaaucaguuggaaaacaaauuaaauacuaguuuacagaauaauaacaaaaaauuuuaaaaccuccuuuugacaaacauaugggcugggugaaucgccccucauucugagucugaaccucagugaugcacuuggauccugagaucuucaaauuaucaccaaaaguaagucuaagacuggacaagcagagacccuaaaaaccaaauguacucgaucacuuaugcagcuaucaguagguuuuguguccaaccaaagaacagggaacuuuuaaaaaauaacaaauuagggccgggcgugguggcucaugccuguaauccagcacuuuggaaggccgaggcagguagaucaccugaggucaggaguucaagaccagccuggccaacauggugaaacccugucucuacuaaaaacacaaaaauuagccaggcgugguggcacacgccuguaaucccagcuacucgggaggcugaggcaggagaaucgcucgaacccagaaggcagagguugcagugagccaagaucacacccauugcgcuccagccugggcaacagaccaagacuccaucucaaaaaaaaaaaaaaaaaaaaaagcaauuagaaaugguuaucucuggauuguggaaagacaggugauuuuaauuuucuucuuuauuuuauuuuccugcuuauauuuauuuccaauguaaaacauaauaaugcuguuagcaaaaaacaacuaauuuccuuuaaaaccuugaaaucaugggggccaggggguggagggaaaaugaaagcagaauguguagcgugucggaguauguaugaaagagagagagagagagauacacauacauaaaaccagggacugacgaagaauuuuugcauggagcaagaauagaugauaugguugacaaguccugaaaaggaccuggaagugauagauauaccaguaaucccaauauaguuauggaaaacagguauagagggaggaguugguauuugguuuaaggaauguauugcagaaacaggggaaauaaaaugcaugaaaaaaguggauaaugguaacugaagucugcuggcuguuguggaaaagcugucaacagucuugacuaaaagagaugaacagacuuuuaggggagggucccagagucuaaaauucaguuauaaaauaaauagaaucucauuuuugguccauauuuucccuuuccagaauuucuuggugagagaacucauaaaaauuuaaucauuuacauaaggccacaaagauauguaucaaaagucuuaaaacaacacaucuuuugaauucaacuauuccucuccuaggaauuuaucccaaggacuaaucaaagauauaugcaaaaguaaaggaguagacaaauggucauugcaguauggcuuauaauagcuaaaaauguaaacaaauuaauguugagcacuaggggauugcuuaaaaauauuggcacauucacaucauuuaauauuauguggccauuaaaaaugaugcugaagaauuauacuuaagacauggaaaauguucacaauaugaagugacaaaauauuacaaaacaauaugugauauaguuuggcucuguguucccacccaaaucucaucucgaauuguaauucccacgagucaggggaggggucuggugggaggugauuggaucauggggcggaucucccccuugcuguucuggugauagugagugagugcucacgagaucugguuguuugaaaauguguggcccuugccccuucucugucuccugcucugccaugguaagaccuucuugcuuccccuucgccuucugccaugauccuguuucuugagguuuccuagccaugcuuccuguuaagccugcugaacuguggguccauuaaaccucuuuucuucauaaauuacccagucucagguagauccuuagagcagugugaacauggauuaauacaguaugacuccauuuuuuaaaaguauacacacacauacacaaauagacuaaccuaauauauaaugaaaacauuaaugguuauucucaggagauggaggaucauagauuauuuuaaaauuuuuuuggagcuuaccuguauuuuccaaauuucauacguauauuacuuuuguuaucagaaaaaaaaguuacuuugaagaauauuaaugagguuauacaagaucuuguccuuugcgaggacauggacagagucagaggccaucgcccuuagcaagcuaaugcaagaacagaaaaccaaauaucacauguucucacuuacaagcaggagcuaaaugaugagaaaacauagacacaaagagaggaaugacagacacuggggccuacgugaggguggaggguggggggagaaagaggaucagauaaaauaacuauuggauacugagugaugaaauaaucuguacaguaaauccccauggcacaaguuuaccuauauaacaaaccugcgcacguaccccugaaccuaaaauaaaaguuuaaaaaaaugagguuauaaagaacaccagggcuucaaaaguguaauauuaauauuugaauuagaauauugaauauauuguuacacaaugaugggaguuaaaaacuuaauuuuuuuuuuuuugaggcagaguuucacuguaucaaccaggcuggaaugcaguggcacgaucuuggcucucugcagccucugcuggguuuaagcaauucuugugccucagccucccaaauagcugggacuacaggugcacaccaccaugcccagcuaauuuuuguauuuuuaauagagacgggguaucaccauguuggccaggcuggucuugaacuccugaccucaggugauccgcuccccuuagccucccaaagugcugugauuacaggcuugagccaccacgcccaacaaaacuuccuuuuuuuaaaagcugugugaucuagaaauaauaaugcuucucaagauugguuagauauuuugucauuuccucaaaauguaagcuuucuaugccuuuauuguaagaaaauaacuccuuuuuacuauaaucuaaguuuuacuauaaucuaagcccuacaaucuucaggggcauuaccauguggcuucugucugguuuuaaauugguccagcagccaucagauuuuuuugauuguauaaguuaucaguaaacuuuuuaaaauuuauuuuuauuuauccauuaauuaauuauuuuagagaaacagucucacucugucacccaggcugaagugcaguggcaccaucauagcucacuguagccucaaacuccugggcucaaguaauccuccugccucagcuucccaaagugcugagauuauaggugugaaccacugcaccuggcaaaaaauuuuaaauauguggccacugcaugauuucuuuauguauuauauaucugcacagcuauauuaaaauaugaaauauaucugaaaauguaugaaaauagaaauuuuaaaugaugagauaaacaugaucucuaauauuuucuucuuauaaucccauggauuguuuuauauguacuguacuuuggacaccgcuagacuggaugaccacaaaagaugggcuacaaccaaaaaagacccaccaaaugugaaucucuucccuucagcuggucuacuggaaacugaaaugagguauucaucugucacuaguucuuuaauuugcccaaaggucauagguuauccagcuaaugguggugacggugguggugaugguguguuuacacaagaaauaucuuccaaguccauauucuagcuuaccuugcugcugcaauuuguaaucaguggaauaugccuucccaaugauauuccauacaggccuuaagcauccaaauaguccuucaagaaacccaccacugccacugccugaccugcugaacugaaucuuuaugucuucaguuccgcuugugcucucuccguccaccguguugcuguuccccugagacaccgccgucucugauucaucguguucccuuagcugaagaacgcuguucucaaacuggucccuggaauccucacuuacgcucgucaacacuguuguggugacggggcugugcacgcucucgauuagcucuguucguaccauccccuuuuccugcugguccucgagcagcuugggagaagggugguuccccauagcugugagcucaucuuguaguccauugaagguuuugcuuucacugaaggguaaguguggagaagaggagcagcucaggugcuccugaaaguuggccaucgugccaugaguauaaccaaaguccugagaugacacucagaagauuuuugggacagaguucugacuuaagagagggcuccaaaaccugagaaaaacaggagggagauaagagaucauccuuucuuuaguaugcacacuacgacacuucuguuugcauuaaaaaaaacugaaacaauggggauugguuaaccuguggguuaguccaugugauggaaaugagugcagcaaugaaaaauuaugcuguggaagaguauuuaugaacaugacaaaauauccaugacacauuaauauaaaaaacagguuagaacaauauauacaacauuaacuuagaaauuuauuuaaaaggacauacauacaagaaaaaagacuucaaggaaaaaauccaaggaacuaacaacaguuaauuuuaggugguuagauuugggggagguuuauauuguugugauuuucaagguauucuaagcauucuguuuuaauaucuauuaucuuuuuuuuuuuuuuugagacggaguuuugcucuuguugcccaggcuggagugcaauggcgcgaucucggcucacugcaaccuccgcuucccagguugaagugauucuccugccucagccucccaaguagcugggauuauaggcaugcaucaucacaccuggcuaauuuuuguauuuuuaauagagacaggguuucuguauguuggucaggcuggucuccaacuccugaccuuaggugauccaacccccucggccucccaaaguguugggauuacaggcgugagccaccgugcccggccuaucuuuuuaaucagaaaagaauguuucccuuucuacaagggaaauuuaguuguucugauauacacaucuuuaguacaaacuacauccuguguuauaaguugcuacucaucuuuucucuuugcuuucgugucuuauccacuggggcacugcgucacuuuauaaggcauucauuaagucauggagauaaaugucaugugucugugacaagacaaguuucuaagauauaaaauuuguuuuuauuauacugcaccaaaucugggguaacacaacuaagcccuagcucuuuaaacuuguucuuugcuucugaucuguccauuagcaccauuucuuguggccaccuaaccuuuaaaagugaagauuuguucuagauuggccagaucacgcauagucaaucuuaaauuuauucaaaguauguuuuuuuuucuuuuuuuugagacagagucucgcucugucaccuagacuggaguacaguggugugaucucggcucacugcaaccuccgccucccagguucaagcaauucuccugccacagccuccugaguagcugggauuacaggcacgcaccaccacgcccagcuaauuuuuuuuuuuuuuuuguauuuuuaguagagacgggauuucacuauguuggccagacuggucucaaacuccugaccucaggugauccaccugccuuugccucacaaagugcugggauuacaggcaugggccacugcgcccagcccaaaguauguucuuaucagaaauguacuuucuuuuuaaaucccuuuguaacagucauuccuuccuucacucuguacuaagcaucuagaauaugcuagaggucaggguaugaagaugaccucauuuugcagaggggguaaaagaaagaccaacaaaaaaugacagaacagugcuuauaaucaaucaaguaagugcucugagagcacagaagagggaggaauaguuucagggaaaggugcucaaaggugguaacuuuugauccauuugaaggaaguguaggcauucauuaagcaagucaggaaggugugagugaaggaagagggggaagguauuacaggugugggggaaacugugaaggagggcauggaagcuugaaagacuauagaacagaugagaaauccaaaguggcuggaauguaggcuauauauaagugcaugcagaaagacaugaauggacagauagguagggacuagacuauaaggagcuuugcaugccaggcugaguuugagauuuuauacugaaggugauggggagccauaguaucuuauauugcggauuauggauuaaaauagacccucucaauuuuauuauuuucuuaucuucauaacugagaccuaaauuuuaagccuuuuauucauuaccauaucccaugaauagcuuguauuagugaaccaaugaaaacaucguauccuuggcuggcgugguagcucacgccuguaaucccaaaacuuucggaggccaaggugggcagaucaugaggucaggaguucgagaccagucuggccagcauggugaaaccccaucucuacuaaaaauacaaaaaauuagccgggcaugguggugcaugccuguagucccagcuacucaggaggcugaggcaggagaauugcucgaacccagcaagcggagguugcagugagccaagauugcgcuacuacacucuagccugggcgacagcgugagacuccaucagaagaagaagaagaagaaggagaagagggagagggagagggagaggaaaauauccuuuccucugaauucuuauucauucacugagcuccuauuacaugguaugcaguguguuaggcauuaguaaaugguccauagguuccuacccuuugggaaaucacaauccagaaggaaagaccgauagauaacggccacauaguuagauaugggacaaagauauguaaaagaugcaaugggagcucagaaaaauaaauauaaaaugugucuagagauguuauaagaagaaguuuugcuugaauugagucuugaggggugaauuaauggucacuaggaaagaaagacuaggcauuccagguaguauggggaaacagcaggagauaacucuuagaaaaaguaggcaaaggcuagauuaugguaggccuguaugacaagcuaaaucuuugggguuuuauccucaugacaacagagagccauuaaggaauuuuaagcaagggaguaaucuggucagauaaauuaaaaucacgucuauagaaguagagguuagauucaaagggaaagacuaaagguccaguuagaagguacaguucaaaaagaaaugacuuggaccugaauaagucaguuagcaauggcagugaagagaacaggaaagauuuaagagguagaauuaguaagaucuaguaauugauuagacauggauguggguaaagaaaaaggggagaggaagacuuuucaaaucacuuauuuggaauaaugaauagacagacaaugucaauaacugagauaugaaaugccagaaagaaagguugggaaagaagacgauuagcucaacuauggacauacagaauuuaaggccuacuaugcaucaugcacugagcuagggagcuaggcuuuuacugaugcuaucugauuuuaaaaagacacuuuguagagagagauuggaagaaagauaaagauggggcucauuuaucacaggggcagaaguuuccaaaucauaaagcuaaauucaaaauguguuuauugaauauauacucagccugcacaacauggcaaaaaguacaaaaaauacaaacauuacaaaaaauacagaaauuacagaaaauacaaaaauuagcuaagcaugguggcauacgccuguagugucagcuacuuggguggaaggcugaggugggagaaucacuuuagcccaggaaaucgaggcugcagugagcuguguuugugccacuguacuccaggcugggcaacagagcaaggcccugucucaaaaaagaaaaaagaauauauacugagaauugugccaugcacuagccuagauucuguggauauagaacguuacuguuaccauuacuauuuuuaauaauaaguaagacaaagugcuuuacaauuuacagaaggcuguuuacauaaucagcaauauacugguaaaucagcucuuuccaaaacaacagcaaucugguuuguaguguuugcucauuucccugguguaaauauucccaccacagcagauuucaagcuaauaaaaguuuaacaacuugcuugcaaaguuucuaaauauuugacaauuggcucuuaaaagcugguguauaagccagcuccagcaccauaauccuuguaauaaugucauuucuauuucacaagagaagaaauuucucuaaaguaauauacucaguaaguaauagagcaggaauuaaaaucuagcucaaaguucagauuccccaaauccuuugccuuuuuuacaacacgauggaacauuuuaugacuccucacuuucauagagugcuuuccagguuaaaaaaugcuguuaucugugaucauuugaucuaaguuuuugaucccuagguaaggaauccagaacacagaaugauuaucccuauuuuucauggaaggaaaugaaggccuacaaagagguagaugcuaaaggucacagagccgggaugaaauaccggguuauuuucccuaaucaugacauucucuccuguaccaggcaaucucugaagacaugguuccuauccuguugaagcucacagacuacuuacggaacuaauaauuacacugaaggaauaaccuccugccaucaucccccaugacaagugagccauauuccguucuacagagccaagagagaugggaacaaugcuaaaagagguaggauuugagauggaccuuuaaagguaaggcgugugacagacggaaggaaaucaggggcgaacaagagcacuggcagaggcagggaagcgggaaugaccagagcgugcgugauggggcugcugacccagaaacagcaguggcuaaugugggggagcagugugcagcaaggguaacuccugcugccacacgugggcucugaaagcuuacgauacagugcaggugauucuucccuccuaacaaaccagagagaucacuuuaacuggacgggguuagguuaagaggcacuuaaauuauaggguauggagaaaucuaggccuugagaagcucccugggaauauaagguuggggcagggggaagaaagaagaaaaacuggagcccuuuguuacagacaccauuccacccacuccagccuccccuccccuguucuuuucgugcucaucucugagcuuugacauuacugaucuccucauuauacuuucuggcugaucaccugccacaaccuugagcugucuccugccuuuggccucucugaccuugcccugccucaucucuuuuaagacugcugauuucauacuaucugaccuagccagugacucagcaguuacuuccggucugccuuggcugccaggacucuugguuauccuauacagcagcaguccccaaccucuuuggcaccagggaccaguuuuguggaagacacuacuuccacggaccaggcaggggggaugguuucaagaugguucaagugcauuacauguauuguguacuuuauuucuauuauaauuacauuguaauacauaaugaaguaauucuacaacucacuauaauguagaaucagugggagcccugagcuuguuuuccugcaacuagacaguccuaucugggggugaugggggacagugacagaucauuagucauuagauucucauaaagggcacauaaccuagaucccuagaucccucgcaugcacaguucacaauaggguuugugcucccaugagaaucuaaugccccauggaucugacaggagguggagcucaggugguaaugcaagugacagggaguggcuguaaacacagaggaagcucugcucgcucacccaccugcugcucaccuccugcuguuccgcccaguuccuaacaggccacagacugguaccagaccauggccuggagguugggaaccccugcuauacagcacaagucuuacgugcuauuggcucacaugaauugcauacccaaauauauaugugaauuucagccaaacacuuacuugugugauuuauuuuuuugaaucaaacuaucagacuuuauauuaauuccucguaaauuucuacuuugucaauuuuuuaucccgaacuucugcccaauacauaauguuaggaugggcucauacacagaaaguuagaaaaacacauguuuguuuuguaauuuuuuuccuaucucuaacagguuaaggaugaauguaaaguggaccuguucccauuggcaugagaaugagucuaaucacagucaucauacgcguuugauauuuaagagaucaggggaaaacaggacaaucaaggaauaugguucaaccuacuuauuucacauaugagaaucaaauuucagagagauugucgacuugcuuaauauaacaucugaccaguggcagagcugagaugaguccuccuuccucagcccagcuccuuccacuagcaugguuguuuguuuauuugaagagaaacaaauagccgugguaucauggccacugaugacaaaaacaauagcaagucccagugcuauucuagaugcacuaaaacuauucccaaggaaacacuagugccuaccuagcggggugacccugcgccuauccacaggccagcaggaggcuacccacugacugcucucagaguaggcagaggugagguaaaccucaaggguguauaaagauguguagucaaauaggcuucccucaugcucaccaagaauaucuaguccaacgggucccaacaaaggcagagaaauagagagguacaagaacaaagggaaagaaaaaucaucaccauggcuauauucaaauaugaucagagcugacucuacauuuaagaagaguguaggaagcuaaaaauaccuaaguuuuaccuguguuuguaugcacacccacacgcugccacugcacagugaagagacuguuagguggaaacugcgggaacacaggugguuccacuaucucuggcugucuucugcccucucaguuccucucucccugugcaaaucuggcucagguacccucaugggaacugauuguuugguccuuucaauucauaagaaaucaaaacuaguauaaauuagaaggagacagaaaggaaguggggcaagauuuuugaauguugagagucaaagggaaaaagacaaggaacauuggagggauaaagggcaaguuuggaauggcacccuuaucaaaagaaaguacuaugggagccaggugcgguggcucaugccuguaaucccagcacuuugggaggcugaggcaggcagaucaccugaggucaggaguucgagaucagccugcucaacauggugaaaccccaucucuacuaaacuacaaaaaauuagcugggcaugguggcaggcgccuguaauuccagcuacucgggaggcugaggcaggagaauugcuugaacccaggcaggagguggagaaugcagugaaccgagaugcugccacugcacuucagccugggcaauagagggagacuccgccucgaaaacaaaacaaaaacaaacaaacaaaacaaaacaaaacaaaaaaagaaaagaaaagaaaagaaaaaagaaaaagaaaguacuccgggaaggucuguaggugaggugaugcuacugccgcccuuacaacaggucccgauccgcaaagggugcaggaagugcucccguaucugcccuugaggaacacuuucccuaccuucugaguuucuuggccccaagaggaggaagugguuugugcaaaauuaguaggcaagaguuggagacagcagcagcugugcauuuggcagggcacugccaauuucuggaaauuaccuugguuuugugccaagaucccaggaugcaauguagagagaaagaggaauggaggagguaauguggccaaauggcccuuaaauucuuggauuucuaucauagaauacaauuuuucccauguuacuaauugaggauuuuuauaaugaucagauuuuaaauuuuauaucauaaauaugaauaaaucaaagauuuuggacaauuuagccccacaaaguuuuugaugugacuaaaauugaauaaaaaauuaaaguaagcauuauugcuacaagauuuauugauugacacugagcucuuucuaagcuaucuucucuuuacuuggcgucuucuugccuaucuuuaaaaaugaauacaacacugccaucuuagucuucuggucauuucucuaaaauucauauagcaguugagaacauaaaauaauuucugcuucuaggagcaucaaucccauuuuaaaacuuagauuacuuuacuugugcauaguaauaacauaaaaugaucuuuccaggauagaggucugucacccagaucuuaauuugaacuuugaaaacauuagcuagcuucuucgaauggaguugugugauuagaaguaugugacuucaaaucagguaaaaagaauggccuacaaucgugccuuuaucccuacuuacucucuuaacuguggaccaucuccugaaacgccuauuugaaggaacaauaaaaacucaaaucgacaaaauccacugaccuaccucuuuucaucuucuuuauaauauuucaugaaacaauuaugcauucaaaaauauugauuccauguuuaccauguaccuauauuuucgguuaagauuaugaauguuuaauaaucuugaaguaugcuggagacaucaaaaaaauaaaaauuacaaagaagcaaauucuccauggugacaaauuaccuuuugaauaccaguaccuauaaaugcaacugugauuacaguuaaaauaaguuuauuguaggcuuuaaaaugaauaaagauacuucauuuucagaguaguagucuauaaauuuaucaagaaauagaaacuugugaggcuucaaaaaugccuuaagucaaaggugaaacaucuugaccaaaggaaugauuuauccauaaaucauaucauaaaugcuaucuccauaaaucuuuaauaaauaauauaugguauuuuaaguauuaauauucaacauuuucugaccuaaauccagcugccauaugaaugauaaaaucaguaacuuuaaauguuuuaaaaauaagauacagacauauauguaccuuuaaauauauaaauauuaauaggcauaaaaauuuaaaauguguauaauuaaguaagcauuuuaagaaauuauguuuaaaaggucaacagugguuauuacuguuguucuuugaaguuuucuauauuuuuccaaauuucuaccauuagcaugcauuauuuguuuaaucagagguuuucaauacaaauccuuguugcuuuaaacgcacagauuaaugggcccacuucacuauauuuucagauaugaaaaaugaugugaaauguuaaggauacugucaggaaagcuaauugucacugugugcugaggcuugcaaacaggcauaaaaagaacuauaggccggaugugcuggcucacgccuguaaucccaacauuuugggaggccaagguggaaggauccccugaggucaggaguucgagaccagccuggccaacauggugaaaccccagcucuacuaaaaauacaaaaauuagcacaccuguagucccagcuacucaggaggcugaggcaggagaauugcuuuaacccgggaggcagagguugcagugagccaagaucacgccacugcacuccagccugggugacagagugagacucugucucaaaaaaaaaaaaaagaauuauaaauucaaaaugaaaauaaaagugaacuuaaaaagacgacaaugagcaaacaaaaguuaaugacuccuauuuuguuuuuaccuuuucuacuaaugagauucacauuugauucuagaaaaggcagaaugaucaugauuaagagaacugaaacccaaaacagaugaaaagacaagaacaugcuuuuccuguggcagcagccgggcugagaggagcguggcugucuccucucuccgccauggcgugugcucgcccaaugauaucgguguacuccgaaaagggggagucaucuggcaaaaaugucacuuagccugcuguauucaaggcuccuauucgaccagauauugugaacuuuguucacaccaacuugcgcaaaaacaacagacagcccuacgcugccagugaauuagcaggucaucagaccagugcugagucuugggguacuggcagagcuauggcucgaauucccagaguucgagguggugggacucaccgcucuggccagggugcuuuuggaaacaugugucguggaggccgaagguuugcaccaaccaaaaccuggcgccguuggcaucguagagugaacacaacccaaaaacgauaugccaucuguucugcccuggcugccucagcccuaccagcacuggucaugucuaaaggucaucguauugaggaaguuccugaacuuccuuugguauuugaagauaaaguugaaggcuacaagaagaccaaggaagcuguuuugcuccuuaagaaacuuaaagccuggaaugauaucgaaaaggucuaugccucucagcgaaugagagcuggcaaaggcaaaaugagaaaccgucgccguauccagcgcaggggccugugcaucaucuauaaugaggauaaugguaucaucaaggccuucagaaacaucccuggaauuacucugcuuaauguaagcaagcugaacauuuugaagcuugcuccuggugggcaugugggacguuucugcauuuggacugaaagugcuuuccggaaguuagaugaauuguauggcacuuggcguaaagccgcuucccucaagaguaacuacaaucuucccaugcacaaguugauuaauacagaucuuagcagaaucuugaaaagcccagagauccaaagagcccuuugagcaccacgcaagaagauucaucgcagaguccuaaagaagaacccacugaaaaacuugagaaucauguugaagcuaaacccauaugcaaagaccaugcgccggaacaccauucuucgccaggccaggaaucacaagcuccggguggauaaggcagcugcugcagcagcagcacuaccagccaaaucagaugaaaaggcggcgguugcaggcaagaagccugugguagguaagaaaggaaagaaggcugcuguugguguuaagaagcagaagaagccucuggugggaaaaaaggcagcagcuaccaagaaaccagccccugaaaagaagccugcagaaaagaaaccuacuacagaggaaaagaagccugcugcauaaacucuuaaauuugauuauuccauaaaggucaaaucauuuuggacagcuucuuuugaauaaagaccugauuauacaggcagugaggaaaaaaagaaaagaaaagaaaagaaaagaacauauaucaguguuuugauuauuuccaaguucuaagguccagaugaauuacaugugaaggcaucaaaacucuugcauuuaggauuacaaaaacaaccuuugguaaauaauuaucuucaggaacuaugagcaagacaguuguucauggaaaaguagaagauaaagaaauacccuauuuuuuuaaaaaggaagauuacagaauauguggaacuaugaacuuaaguuggucccugacaagaugcuaaguauacaguaagcauucauuaaaugcuagucucuuuccuucuuuucuuuuccuuuuauuuuguaaccauuuccucucuuuuuuggaacucuaggacucuccuaagauacauaguuuaggagaacaagaauugaaaugguuuaaaaauuauuauuaaacccaaaauuuaaaagaaaaaauaaaaauaaaauuauuuuuaaagaauuugguuuauagcugggcaagguggcucaugccuguacucccagcacuuugggaggcugaggugggaggauugcuugagcccaggaguucaagaccagccugggcaacacagugagacccuguuacuacaaaaaaaaaaaaaaaauagcugggcaugguggcaugugccuguaggcccaacuacuuacuaggcugaggaucacuugagcccagagggucuaagcugcagugagccaugauugcgccacuguacuccagucugaacaacauagcaaggccgucucaaaaaaauagugcuauuauauacacuuuaaaguuauuucuuguccagucuguauucagauguacuucaucauauugagagcaauauuguaagggcuuaagagagaaggcacuagaggaagauagaccuggauucaaauuguaaucacuaaccucgccauaacucucucuaagccucaauuuugucaucuauaauuaguaguaacaacagaauccaccucauagaguagaugauuauacgagauaguauauauaaaaaaacacauuuacccucaauauuuguuagcuaugcaaaucuuuaacuagaaaaauuagaauaaacagauauaugucaauaugcucaauauauaugugaaaucaaggggaauaaaaagaagggcaaggaaaagacaaguaagcuuuuccuuaggaaagugauaagaugagaaaagagagcuaagaagaggggaacggguugauauauauagaaacugaggcaagcugagcuuguaacauucauuugguauuauaaaugaaagcacaaagaaucaauaaacagugagauaccagaucaaaagggugaaagcaagauggaaaauaggagacaaaaaucccaaauguaugcaacuucuuuuucauauuucauuuccuuugucuuuaauuacagcaguuauuuuuacauucuagguuuuaauuaaauugcacacauaaaaaggaagguucuacauggcuauaauauuugggagaauauuaauacuacguaguuguaguauuugggagaaaaaaauuggccgggagcaguggcucacaccugcaaucccggcacuuugggaggucgaggcaggcaggucaccugagguugggaguuugagaccagccugaccaacauggagaaaccucgucucuacuaaaaauacaaaaucagcugggugugguggcacaugccuguaaucccagcuacuugggaggcugaggcaggagaaucucuugagcccgggaggcaaagguugcagugagacaagacggcaccauuguacuccagccugggcaauaagcguaaaacucugucucaaaaaaaaaaaaaaaaaaaaaaagaaauuaacccuucugguuuuaauacugugauguuaaauuaggagaugauuucauugauucaagaaaauaucucuaggaaaacauugcuuaugcuuuaaacauaagaauaauuagaccagggcagggcaugguggcucauaccuguaaucccagcacuuugggaggcugaagcagguagaucacuugagcccaggaguucaagaccagccugggcaacaugagaaaaccccaucucuauuaaaaauacacaacaaaaauuagcuaggcaugguggcacaugccuguggucccagcuacucaggaggcugaggcaugagaaccucuugaagccgggaggcagagguugcagugagccaugaucgcgccacugcacuccagccuggaagacagagugagacccugucucacaaaaaaauaaaaauaaaaauaaaaauaaaaaauauaugccacuugggaagugauggauagugugcugcuuaguaagaauagacuggcucugcucucaggagcuucaugacucuaagcaagugagaaaggaggaaaagucuuuuaaaaaaguguuuuaagaguagugacaggaucucacuauauugcccaggcuggucuuggacuccuggccucaagcaauacucccaccucauccucccaaagugcuaggauuacaggcaugagccaccacgccuggccaaaaaaucuuucugaaugaaauuauauuauggaaauuuucuuuucucauuaaauucauugucaguauuuggauuguuuaguuggacaguaaaauauaacuagagauauuaauauauaauacauucuauacuuauuuuauacuauacauuaaaaucaaauaauucauugccaguuuaauauuuagggcuguugaagagcaucaguaacagacuucgacuuccaaugacauauaugaaaguucucacaaagcugcagauucuacacccuguuccugggcaaguccuagauauacuugguaggcaagaggccauccaaaguccuucugcuauccuugcguugcuuuuucaggccuuucuuaagaaugguagaaucauagaugguucaaguucggagggagcagugacugggccaugccuucuauuuuucaagauaaacaacuaagucucauaaguuuguaagaguagaaucaaacauuguuuaucucuguaccuuguccuuuuucuuuucccaccgucuagccucagcaccuagugcagaaccugauauaauaugguggaauucaauuuuuuuggaugagaagacuuuacacucacacauagcaaugugauaacguauuaacaacauuuauugagauuaugugaaaccgcucuaaacacguuucccauauuaacuuaucuaauccucacaucaacccuuugggaaagguauuauuauuaccccuugacaauaauuggugaaaaauuggggcacagauaggcuaaaugacucacagcuacuaaguggcgaagacaggaauugaacccaguuccacuccagcaccagagccugagcccuuaaccacaacacuguauugucgauauuauaaugggcuucuguuuaacuaaaaaaggucuaggucagaaaaauauggaauaggcucauauuuuaccuugaacuuagguuccaaacuuggaugaaagguaugaauucuuagcaauaacuaaagauaauuggagaauucuaaaauaugcucacuuucuguaggguuuacuccauucugguuuuuguuuguuuuguuuuuuguuuuuugagguggaaucucgcucugucgcccaggcuggagugcaguggcacaaucucagcucacugcaacaucugccucccggguucaaaugauucuccugccucagccucccgaguagcugggacuacaggugcgugcugccacacccagcuaauuuuugcauuucuuguagaaguagggucucaccauguuggccaggcuggucuugaacuccuggccucaguugauccacccaccucggccucccaaauugcugggauuacaggugugaaccaccgcgcccagccccauucuguuuuuaacauuaaaacucuauacuugcaucauccaauauuauagcuucuaguuauacguagucauuuaacuuuaauuaaaauuaaauaaaauaaagauuucauuccucagcuguacuaguccauuuuagguauucacuagccacauguggcuaguggcaaccauauaggacugggaaaaagaacauuuccaucauuacaggaaguuccauuggacagugcugcucuaugcgcuuuauucauauuaauagauuggucuguuguaaggauuaaccaacauuguggcucccuucguacauggggauuugcuaacugcacaguacuccacuaccuucuuuaauaugacagguuugcaaccauguuuuaguaauauuugugaaugauuuaaguauagcucauucuaaugaugguucaucaggaucaaacugaauuggggauuuuaucuuuuaaaagacuguccaaggaaucauagcugugugucuaaaaggaaccagaggaauaauuuucaauaucuaaguagguucauuuguggagaaucuaaaaaaugaaauuagauuacugcuaccaucauuccuugaagcuccuaaucauagcacuaguguaggugaaaggcagaaaccuaggggagggcuaauggaggaaaaggugaauaggaacagaaguuuuaccaaaucaccagaaguaugugucacuucucagaggagacuguauuacagauaaccaggacaaaagcuccaggaugaacaaagcacuccugacucuggauccaaugucgaauuuuaauagagcaguaacuaaagccaaauuagugagagauccuauuguuuuagacuuuuacauuucuugugacuuacuguuguuuuugcucacagaaguaguccugagcuuuaauuuuuaaaguaaugauucaaucaagaugauacucuagaaaaugugugauagaacauuuugagcuuuaccaacaauagaaauuugaaauugucaaagauuggccauuuuucacuugucuuaugucacuguuuuggaaugacucugugcuagaguguaauccauacccauuguuuaauuauucauugaggguaguuucaauuucuacucccaauauauagcugaaauuugcagacugcuaaaggauccuagauaaaucccaucuguccaaaaugaggaugacaaggaagaacaucaauaaauauuaauuauugauucuaagugcuaaaaaaugauaaauauauaagacaguucuaauggaaagaaaaauaaauguaaaauaauaaacuauuugugacagaaaacaauauguagucucucaauacaaaugauaaauauauaagacaguucuaauggaaagaaaaauaaaugcaaaauaauaaacuauuugugacagaaaacaauauguagucccucaauacaaagguuaauauuacaaagguagaauuuaaagacauauuuaggcugggcaugguggcucacaccuguagucccagcacuuugggaggccgaggugggaggaugaccugagguccagaguucgagaccagccuggccaacguggugaaaccccauaucuacuaaaaauacaaaaauuaguugggcguguuguacacaccuguagucccagcuacucgggaggcugaggcaggagaaucacuugaaccugggagguggaagcugcagugagcugagaucaugccaccgcauuccagccugggcaacagaaugagauucugucucaaaaaaaaaaaaaaaaaaaaagacauaacugccucccuuuaggaaucauaauuugaauucauuacaagugcacaugguuucauuaagugcuccuaaaaaguugcauauaaaucacauuuuuaaaauaacauuuaaaaaucacuaauagaaauuacuauuugaaguaucacugauaaaucuacuugcaaaaugaagaauccuucugaaaugcuaaugauuguuuuauuauuguacuuguuugcuuaauuugaauuuucuguuguuucaaugucugguauuaguuguuuaauuaaaugucaauuucauagcucucaauaaauuucccugaguaggugguauguccagcaaaucuaccugagaagucaguauuugucaugggcuuggaaaccaugugcccaaacauguuagaacugugugcaaaauaacaguaauaagauuuuguacaaaggcuugaugacucuucauaugaguaaacugugagguuuuguacauggguuuugugacguacauucuggcuaugugcaaauguuuuucccuucauuuucugauuuuuuuuucuguguucuaaauaacugauugcaaauucauguguaugcaugucuagcuguucuugaaucaugguauaaucuacaguuaggacaucucauaaaguaaggacaagaaaagacaacucuacuugaagaagccaggaaaaaccaagggcccuuuuaccuaacacuuugcuuccgaugauagcuuugaagggggagucauuguuuuuugugacaucuguuuacaaaaggaauggguauaacauaaacaucacuuacuucucuuaauauuccaugaaagaaucuuauucauaugcugaaccuuuuuuuuuuuuuuuuagacagagucuugcucugucacccaggcuggagugcagcggugugaucuuaguucacugcaaccucugccuccugaguucaagcgauucuccugccucagccuccuaaguaucugggauuacaggcgcccgccacaaugccuggcuaauuuuuguauuuucaguagagacgggguuucuccauguuggccaggcugguuuugaacugcugaccucaggugauccacccaccucggccucccaaaguguugggauuacaggcaugagccaccacaccuggccuauuuuuuaauuuuuaaaaauugacacauaauaauuguacauuguuaugggauacauagugauguuucaauacauacaauacauagugagcagauugggguaauuagcauauacaucaucuugaacauuuaucuuuuuuuguguugggaacauuaaaauauucucuuuucuagcuauuugggaauauauauuauuguuaacgauagucauccuacagugcugugggacgcuauagcuguagaauuuauuccuccuaucuagcuauaauuuuguauccuuuaacaaaucccucccugucuauccuccccagccucuagaauccucuguucugcucuuuacuccuaugaguuuaacuuucuuagcuucugcguaugaaugagaacaugugguguuuaacuuucuguuacuggcuuguuucacuuaacauaauguccucuaggccagggauccccagcucccagaccgcagacugguacugguuuguggcuuguuaagaaccaggcugcacagcaggaggugagcagcaggcgagcgaguauuacugccugagcucugccucccaucaggucagcagcagcguuagauucucacaggagggcaaacccuauugugaacugcacauucgagggaucucauaagguugugcgcgccuuaugagacucuaacuaaugccugaugaucugaggugggacaguuucauccucaaaccauucccacccaccacccaccacaucccuagucuguggaaaaauugucuacuacgaaacugguccauggugccaagaagguuggggacugcugcucuaggcucauccauguugcugcaaauaacaggauuuaauucuuuuuuuauggcugaauaguauucaauuguguacauauaccacauuuucuuuauccauucuucuauugucggacauggguugauucauaccuuggcuaucaugaauaguccugcaauaaacauaggggugcagauaucucuucaguauacugguucauuuuccuuuggguaaauacucaguagugggguugcuggaccauauggcaguucuauguguguuuuuuugaggaacgcucauacuguucuccauagugcuguacuaguuuacauuccuaccaacagugcauaacaguuccauuuucuaugcauccuugccagcguuuauguuuuuaucuuuuugauaauagucauuuuaaugggugagaugauaucucauugugguuuugauuuguacuucccugauaaucagagauauuaagcuuauuuuaaauuaauuaauuagagacagggucucgcucuguagcccaggcuggagugcaguggugugaccucaguucacugugaccuccgccuccuggguucaaacaauucuucugccucagacucccaaguagcugggacuacaggcacacaccaccacgccuggcuaauuuuuguauuuuugguagagacgggguuucaccauauuggccaggcugcucuugaacuccugaccucaagugaucugccugcuuuggccucccaaagugcugggaugacaggcaugagccaccaggccuggccuccagucugcaauucuaaggcaggacacacgcuccuugaaucaucucaguugcccuuguuugaucuauguccaacucuaguccaccuuuuuauauacauauauauuuauuuauuuauacauuucauugguagacgccuucugaugaugcccaaugugguagugaguuggccaaaaacagcacacagagcaaauuucaugacuaaccucccauuagugcaagguugcccuaggacuguaauaaaucagaucguaaugaagccugguauauuauaaauaguuguugucccauguuuauuacauaaugcuuaugaugugcuguaauugcaaagagugcagguuuucaaaucagaaauaccuuguuugauuccuagccacuuaucugcugugaagucuuugacaguuauguaaauauucugaauucuaguugccucacuuguauacaggauauacuaaaccucccuuuugggguuguuguagaugcaaaucaaacuaaucggcuucuuuuuuuuuuuuaagauggagucucacucuguuuuccaggcuggagugcaguggcaugauuucggcucacugcaaccuauaccaucagaguucaagugauucuucugccucagccuccugaguagcugggaucacaggcaugcgccaccaugcccggcuaauuuuuguacuuuuagaggagauggcauuucaccauguuggccaggcuggucucaaacuccugaccucaagagauccacccgccucagccucccaaggggauuacaggcugggauuacaggugugagccaccgcaccuggccgaauuggcauuuuauugagagcuuaccauaaauaagacccugaaagcuucaaaugguuucucucaugaaauaaguuugauuucaacugcaaaauuggaagauuucacucuauacucccacuuucugauuuuuuuccuguaaaacuauuaaacaagauuucuaguuaaaugugauagguugaacauaaacauuuuaucucugcucugcccaugccagacgcuacuaagauaaaaguaaggcagaaaaaaaaaguggcucacaccuguaaucccaguauuuugggaggccgaggugggaggaucacuugagcgcaggaguucaaggcuacagugagcuaugaccaugcccccucacuccagccuuggugacaaagcaagacccacacucaaaaaaaaaaaaaaaaaaaaaaaaauucucaaaauucuacaaggaaaucuaaaaugagcaaagacaaaaggcuacauauuguauaauuccauuuauaugaaauccauuuacagaaaagacaacacuauaaggacagaaaccaaauaauaggggccaggugugggaacugauuaauaggggcaagguguggggaagagggaacacacuugagcuuucuucccccuuaauuccaccgcugaaauuggcaaaacgcacucugaagcuaaaguccccacgcuguccugagcaauaguagaaucaccagaaggcaucaacaagcugcuggacacugauacuuuuccugauacuuugucaaagacacuuaagaagucuuugacaaaauccauuuaauugcgcaugguguggcaaacuuuguuaaaaugcagucacucugcuuuauaguuauaacguucuauuuuguguauauagaguuaauuuuguauuuagaauccuuuagcaccauuugagacagagguaccccugaguguuuccaaaugaaaauuaauaaucauaggucuagacagcaaaaugagguaagaguuuagcacagucacgauuacauaucuuuagaaucugaaagccaaccuuagagauucccacuccagaaaguggagguggguuaaggcucaagaucuagggucuggugguggcaaaaaaugguuuaaaaaagaaacauuauuuauauccaagguucacagacaaauagauaaucagcucauguacaauuuccgucauuuacugaggcaaaucaacuuagaguguccuucccauauaaucuuuagaguuucuacuguucuuuuguaauuuucuuuucuuucuaggcaugcuuuuaauauaaaauuuuaaucuuuauuuuacuggauaaaaauguugugagaauauaccccacaucucuucuggaaugauccagccccacucuaugauuucuggcuuucauuucaaggcuuuuuuccacagauccccuuuuuacuugccuagcaugaaaacaagccgguucauuagugagaauaguuauugcaauagggcauccauucaaucucagaagacgaaaaugaauugagcaccaaaauuuaaaauaugaaaauaagucauuauuaaauaccuaugggaaaaaucacaaaauccuuacauauagucuguuaaaugaccuucuucacauaauaacugaaaugacaauagggcuagaauaguaccaaaaucuuagaaauuaagccaucuacaauacuuuguaccaucuaggcuuugggauuaguggcuuuuucccuuagccuacauaugucuaaucccauuugacaaaauuagaaggcaugcuuggcugugguuacagacaagcucagagaauagucugauuauuuuuuaaucccaguagauucagauucagauucugauuuauucccucuuucuuucuuacaaaagaaucaagagagaagacuuaaauugcacaauagcuagaauuuaguuugagaguuaaaguguuagcauaaaaaugcacuuagcauacuucuaaauaugccuuccauguuacuggcuuuauuucaaggcuuuucuugacauggcaguacaauuuaauuaaggaaggugcuacaaaaagaauggcugggaacuaaauugccggcuaggaagggcuaaauuaagagucaaguggcacccugggcuuccuguuuuucugacuucaaacuguuuuagguaauuuuuccuggcuacucugggaccuuccaauccuuuuaaacucuucugauauugaacucuuacuacucuuucacccagggucgugacauuguauaauucuagggggccucauucccacugacagcccugcuuuuauuauuucucucuuacaaaaaugcuucuaaaagucaaaacuauuucuaacaagaucaacugacgucaacuagcuguuucacuuuagagaauuaacacucagugcuuuuccaguucccucacucaguaaacauguauugagcaugugccagacaucacguuaugaugccauggaugauggaauagacccggucagauaguccuacccucaaggagcauacaaacuagugugucagauaagcaaguaagcaaguacaauguaaggcagacuuuagccuucaagcacaguauaagcacagcaagggaagcagcaacuaugauugaguuaccagagaaaacuucacagaaaaagagacauuugagcaagaaagugaggccuugaagaaagaaucagaguuacaccagugaagaacgagugaaggauggagagagaugaggcugcugucuggaagaagacauauauucuggccaaaagaacugcgcaaagaaaagaauggagggcaagaaaauaaauagcauuuuccaagaauagcaaacagucuggaagagcuggaacauaaggugcauacagaacagugaucagcacugcuguaacuauaggguggugccacaucauaaaagguuuugaaugcugggcuaacgagucucuuuucuuugaucaaaagaauuuggccucauagaaaacauuacucauuacuuaugcaaugaucagaaagcuuuuguucaagaccacaguaauuggaaugugcaaauguguaguuucugaauuuaugcgauuacauuaaauaaugcauauauaccuuaauagcaaaauaacauuguuugauggcauaaaauugaggcugaguuucucuuaagucauucauuggcagggacacauucuucagaaccacuucuagaaaucuaacaguagucagguagaaauaagcaugcuggccuuagagcaaaaaaaggcaugacacaagaaauauucaauguacugaaaugcauugcuagugagaacaucaacuaagaacuuacaauuuuauacauugccaguaggaugggcuacaaaauuugcagggccaguacaaacuaaaaaaugaaagaccccuuguuuaagaauuauuaagaauuucaagauggagauaacagaguauuaaaccaagcauagggcugcgcgcgguggcucaugccuguaaucccaacacuuugggaggccgaggcgaggcgggcggaucaccugaggucaggaguuugagaccagccuggccaacauggugaaaccccaucuguacuaaaaauacaaaaauuagccgggcgugguggcgggcaccuguaaucccaccuauuugggagguugaggcaggagaaucacuugaacccagaaggcugagguugcagagagccaauauuaagcuacuacacuccagccuaggugacagagcaagauucuaucuugaaaaaauuuuuaaaaaauuaaaccaagcgugggucccugugcaacugcauagguuacauacccaugaagcuggucugauugccaaccccaacuuuuaaggacaauccauuccguuuccauagccugacguauguaaaccagcucucacgcucaaguguaaacuuugccaucaauuugcccccagaauugaucucaucuccaucacugugcuuuccucccugccuucacuggcaguggggaccacaaaagaguuccucuuagagaaaugcugacaccuucaucuguucuuacaaugcuauuuucugcuuacugaaaacagguuuuguuuccuugaucuuuuguguuuaaaauuuccccucuuuauaaagucuucacuaaucacagguaagguaauaaguucuuaucuauuuccaguauuuaaucuuacacucacgcacuauccaggcuacuguuuaugcagaguguaaguauggcugcuacugcugcagauaauguuaauggcagugguaguggcagguaucacuugcugagugccuaggcacugugcugggcauuuuacaguccuaaaaauugaucauuaaaugaucccauuguuaucugauguccuuguucuuuauauuuuaguccuauucuucagcaccuucuccaaaguaaaaggaaaggaaggagggggaaaaaagcaaaccuuaggucagauaauuuugcuacuuguuaauagaguugauaacaaaacugugacuuuuuaaagaaagauauaaauaauuaccugauuacagcuucuauauuaucuaugcauuucauuuauucuccugaccugugauggauaaaccagccauuagguuuaucuguauauauaaguuggccauuuucgguaauaaaaccauagaggaaagauaucaugucuucuuguuuuuguuuuccagcuuuacugagguauaacugacaaauaaaaauuauauuuacaguaaaaaauaaauugacaaaaauuguacagugugauguuuugagauauauguacauugugaugauuaccacaaucaaguuaauuagcauauccaucaccucaccauaucuuuuugaauuacauuaguacaacauacacauaguccuaauugugaauggaaaaaaacuaaaacagagcauuuacuauagccauaaauucuauucaaccaauuaauaaguauguacauuauguugugccuuaugcuucaugcuauauuuaaaaaguucaaguuuucauaaauguuaguguauuaucaccucugaagaaauucagaaaagaccacucuguggcccugaaucaaucaaggagauguauguugguucagagugggguuaauuuguuuagacuucagcaauuuccgaacagcagcagaucuaaagucagauacucucaacugaucugaauuaaacucuuuugauuagauuacgccuaucuacuuuagcuagauagaaauuauuucagucuacuaacaauuuccaaagcacucuauguauagcugagguuuggcacgguuuuucuuaucuccauuuugccuuuuauuuuuugauuugggaagacuauauaccaguaucuucuaaauaugagaaauagggagguuuugccuuuugcaugcgucagauauaucuaguaccucaggacguuuugucuccugggccacagcuuaacaguauuagcaaaagcaguucagccaggggggaauugaacagcagcugagucagucuaauaauuuacacuggggaaagcccuuggaauucagaggcacauugcccagcuggagagacaaaucuaaucucugcuaaugauguuccucccucucuuuccuaucagggcuggguuuuuuacacaugcgcacauaauuauauaugcacacucagaguccaaugaagccaaacaacacagcgcccaggauuaaauuacacaguaagauuuccaggcaucaucuggccucuacguccuaauaaaugcuguccaugguucacaccguggagauguuagagaucuuaagaauucaacagcacagacaauaaauacuaaaauucaaaggcgagaacauuaugauuuuauaaugagacuggauauaauaagcuugacuucuuaaacagacuuaaauuuuaaaaguacacacuagaagaaaggacacagacuccagacaaagauguacaugguaauagguaaagaggugaagaaacaacacaaagaaaauguuuuaaaaaaccacccaaagcaaaaaccaguagauaaaaauaauuuguagaaaaaaaacccugacaauaaauaaauaaauaaauugugauacuacuaccaugaauaauaauuuguaugugcuaaggcccgagaggcuuuucuuucauugauauacccagaaugaggauaaaguagccucaacaauagcuucccagcaaauacaguggcgucuuuccuaggaccguuuuuaagagcaccuguccacccaaggugagauuccccaaaugccagaaaagcaacacuuauaguagggagaguccaaguaaauaauucuugaaaaucugauuuaauccagaaggggauggauugcaucuccuucgggaacucuuccuugagcaucauuuaucacacucaagcuuucaagaauauugaguaacuaaaaauuauagguuauauuuucugguaggacccugggaugcaaauaauccggguuuccagguaagaggucgcuccauaagcuuuaauaaucuaccaaaaagaaagagcugacacucuccuaugaaaauccaggaaucucaccagaaaucgugccucaaaaccucauuuccacauggaaguaugccaagaaaaauaagccugaccaugugguuguuuauauuuuauuacaaugcauaauguucuucauauacugaugaaacuuuacuuacuaaaauguuuuaauaaguacguguauuuuuauauaaagcccuuugcaaaugacaucaauuauuuuaaaaagagggaagcaauuuaauaguuaaugccucugccgcuuuacugaaguaaauagggaguggugggguagggagucaccaucuggggcuauaaauuauaauccugcuacaugguaauggacagagggcugauccaugaagcuccccgaggagauuccaucuaucagugcagccauccauagaaggggcugaagacaagggcagcccugagcccagacagggaggggaccugucccagcagcaggauacagugcugucagauuuucaaaagcaacucucacucaccugcucccacacgaacucaucaauucaggaaauuauagggaaaaugcucccccuuuacauuuuggcaauuagaggguaauuuaggauucaaagagcccugggcaaauaaaguccucaaaugagagaaaacaaguaauaggcuuagggcugcuucauccauaguuuguuaacuugcaaauaucacuugaaaagaaaauggugauauuauuuaccaucaaaugaaaacugcugaugauguguucaccuggcaagaggcagcacuaccugcacgcaugagcuuguauaaaccugcagagcccccaaacaaggugcccuaguggcccaugauucucuucugccucuugcagcaagguaagcuuagcugcuuuggauuauuucccaaauauaacaauguuaaagacaguauuagcagaucaaaagaagacaaaaaaaaaaaaaaaaacaaacaaacacccagaauuauccuaauaagaagagaaacagugcagaaaaucaaguuuauugaaacaaucaaaaauuacaagucaaaaaaaaaaaaacaccuagcagccuuauaagcacuugagaucauucuuagaaagauaauauaauuagaagugcuaaaacaacuguuuuuuucuugcaugcugcuuaaauacuuaaaauuuagaucuuucgugucuuugaaaauauucaaggacuuuuauagacguccucacaucaguucucaccacagcccugugagaaaagcacccauccgauuugcuacugaaaucacaaggcuacaccuaaaaacucccauuucugugaggaaaguggucacuuagauauuugcuauucugcucacugacucaacaaaugcuauguuaaucaucuauguuaaucaucuguguuaagcaauaacgaugaugcgaagaugaacaaaacaguggaccccugcucuagaggagucuauuagaggaaaaauggaugaauaaauaguuaccauguaaugugagaagcuuucuaagggagauggguacaaauuauugaaguacaaagaagggaaaaauccccauccaggaugaccagggaagggguauggagaauaucauccagaggggcagggugcgcagacgcagggaggcgggaaggaaaucacgugguuguuuggggagacgcacaaacaucagcagggcuggugagaggugaugagagaugucgaaaauagggcuggaaagguggauucgaggauuuuuuucuuuucuccuguggacagagaacuauggagaggugaagggaggugacaugauucgauuugaaagaugauucuguuucaggguagaaaauggagggagggcgaaugggguguggaaagagcucuagggagaauggaaagaaucugagcaacacuuuggagacagaauuaacaggauagagugacuggcuggaugugauggugacagaggguuuucugguguggaggauucaaugcuaccacuaauugaggcaggaccuccagcagagggggugcagggcggaggagcugcagggaggagguaacgagccaggguuuauccuuuccuauacgccaucaggcagggagggaaauaaggaacuagcuaaacuguaacuggggcaaagaacuacaaauauuguuagagagaugaauacaaggaaaagcuuccuuccuuccuuccuuccuuccuuccuuccuuccuuccuucccuccuuuuuuccucccucccuccccccccccccccgccuuucucucucuuucuuucugacggagucucacccuaugcccaggcuggagugcaauggugugaucuccgcucacugcaaccuuugccuccuggguucaagagauucuccuaccucagccucccgaguagcugggauuacaggcacgugccaccacgcccggcuaaaauuuuuuuuguaucuuuaguagagacggaguuucaccauguuggccaggcuggucuggaacuccugaccucaugauccgcgggccucggccucccaaagugcugggauuacaggcgugagccaccgcaccuggcaucauaucauuuuuauauucaggucaggagaguuacaaauuuuauggacccauuuuauccucagcuuggugaucagcauuuuuuucucaaggguaauuuugucacuuuccuuuguuucuuuuuccuccccucacuaacacuaauauacacaugaauaaucuccuccuauccuuuccucaacccaacaguguuccuuucuucgaaacccucugucuuccaagagucacacuuugguuugcucaauaaaucacugauggcuaaaggaugcgauggugaacauaaaaaaaacuacuagcaucaaagcccaaauccauauucccauuagcuacauauagcuuuauuguuucacugcuuucuuuaaccuuuaagucuucugaauaggacacuuggcuaccucuuagcuguaaugacaaucaacaggacugucuaacgugggcaccacuguuccaaaggcauuucagaccagcuauuauuuccauggauaucagaguauauuuguauugacucugagcacuuagcaucuagagaaaaugagucugauucaacauaaucugcaaggaauagaagaaaugagugcauacguauaagaaggaaguagguaccacaauucagcaaaucuuuccugugugccugcuacaugcuaggcaccauguuucucagaagccauauggggcuguaaugguguaaagauaacaucuuccuuaucuuuugguaugccugacauacuaaauaauuuuuuaaaaagaaagaaauagucccugcucuucagaacucaagucuaaccuaguaggggauaugguaauaucuuguaggggagauagccacaaacgcaauuaguucuaaugaagggagacugugcuauagaggcacuaaguauagugagauucaauaggaauagagagauuacucuuucugcuuuuggggaauaagaggcugcucaucugccuucacaggauaggagaucaaaaguuugaaauuuuuuuuuguggaggacugucuuucuuucuggugcaucugauaaacccuaaaugaauauuuucacaucuauaacuaaaaaggcauuagggcuacuggcucacagaugcaaagacaguaucagguucccuuucuuaggcucucgguuauuucucagaacagacagcauugcuugucaguucuucaggucacacucuuucgaauguuccucuccucacccccacaagucuguccaauaccucaaaacccucccagagucuguaggcuucucucaucauagcccaucaguguacuguccccuucuugccaccagcucuccccacuccacagggccaggggugacccuaaagcuuccagcaaguaauuucacaagacagaaagguugccaguucccuuuaugugcagcccuuccaggaggcagggcagaccaggcgaccuuucaaagucuuacuggcauaugggcaggcuccgcuccagucucauccacacggccacugacaggccgggaaccaacgccugacaggaauauaaaaaagccccuggcuccgguccaccccacaacccucauggcaggcagagaaauguguuuuugugucucuucuaacaauaagacauccuagauauauuauaagggucagacugauuacuucuuucuccccccuguaaaaaggaaaggaaagaaaaaaacaguccuauuuaaaggagggaguuucucagagagcuuuaaggagaucuuuguaaacaauuaauaaaauagucacauuuucuccaucgaaauagaaauaaguuuaucuauagagcaacauaaguauuuucuaugcuaaaauaugcuacauacuaaagcauuuauauacugcauaauagcauuuaaugcuacucaauauuuaugaauucaacaauuuuguaguuuaaugauuuugaaagaaguuaccaugaaccaggagucccagcugggccauaaauuauuuguuuggccuugggcaagucacuuaaccucuccaggccucaauuuccucaucugcaaacugaaggaauuggacuagaaugaucucuaagguccuauaagcaauuagaaaaaacauucugugaauauaagaaauuagaacaauccaauaauggaauaggauaucucacaauugauuagcucuccaucacuggaaaugcucaauguggggcacaucuaucagauaaauugcacaaaagauuuuugcuuugggaaagaggauugaaccgaaugaccucuccuaugucuuucaauuguaagauucucuuaucuuaugaauugguucuggaaaccaugaaaaaaaaacaaacaagaaugaauacgaaaagcaggggaugaaaugucauccucuagguauagaaaauguuugauguuauguuaacagaacaaugacacguauagcaagucacugcuuugcuaauagggacuguucaccuuggguuagguugcugggugguguaaauaacugcaaacacaacacccagcaaugaaaaggucugcaugccuucagucacuccagacugagcacauaggguuucaccacaccgacccuucugacugucagaaaaaauaagggaaggagggaagaggaucacagucagcucucauuuguuuggggacaacuagaugcucccuacagcaggugugcuccaucggccuauguccuuaggaacaauguaucaaaacagcagcaaauaacaguaaucacuguuaucuuacauuuguauauugaguugcauuuccaaaguaauuucauacauuuuaauuucauuugagccucauaauagccauguaggguggacagagcagguauaauugaucuuucuuugaggaaaauugagguguauuacccuuuccuuaacaaugggaaacagcucaaaucauuauucuaucacuuccaacuccuucaaaugcuuuuaucaccaagaggucuggaaggauguaccuauuuuuaauuauuuauuuauuuauuuuugagacagagucuuccucugucacccaggccagagugcaguggcacaaucugggcucacugcaacccccgccucccggguucaugcaauucuccugcuuagccuccugacuagcugggacuacagaugcgcaccaccacgccaggcuaauuuuuguauuuuuaguagagacgggguuucaccauguuggccaagcuggucuugaacuucugaccucaagugaucuacccgccucagccucccaaagugcugggauuacaggcgugagccaccgcaccuggccgaauauaccuauuugugauuucaguauauuuguauauacucagaaaauggccaaaaaaggaaaccaguaauaaucucaaauuguaaugguguuuuuaaaagcuaaauuagggccagacgcaguggcucaugccuguaaucccaacacuuugggagacuaagaugggcagauugcuuugagcucgggaguucaagaccagccugggcaacauggcgaaacccugucucuacuaaaaauacaaaauucaccgagcaugcgugccuguaaucccagcuacuugggaggcugaggcaggagaaucgcuugaaccugggaggcagaaguugcagaaagccgagacugcaccacugcacuccagccugagugacacagcaagacuccgucucaaaaauaaaaauaaaaauaaaagaugaauuagaaauaauauugaaggccgggcacgguggcucacgccuguaaucccagcacuuugggaggccgaggcgggcggaucacgaggucaggagaucgagaccaucccggcuaaaacggugaaaccccgucucugcuaaaaauacaaaaaauuagccgggcgugguggcgggugccuguagucccagcuacuugggaggcugaggcaggagaauggcgugaacccgggaggcggagcuugcagugagccgagaucgcaccacugcacuccagccugggcgacagagcgagacuccgucucaaaaaaaaaaaaaaaaaaagaaauaauauugaauuagaaaugccuguugcaucugagaaauaauaaaggggaccaaacaaaacaaaccuaauuuaaguuauaauacagcgaugucauucuggaagcaugcaaugguaguuugguauaguggaaagaaaaaagaaaagucaauagacugggaagaaagagagaaaagcaaaguauuugaaacucaugauaccuauaucaagaaacaagaaucuuucugcagaaauuauauugaaaaaacuacauuuagauuuaucaagaauuaagcaaaggagaucaguacuaaauauaucccacguucaaaaaaagacauauuuugauauaaaguuggcaugcaaaaacuuuauaccuuagaauuaaaaauaucaacuuccaugaagucaucuauuaugcuuacauuuuucuauaguuuaucucauuuagucuuuaugucaguaucaucaucauuuuauagaugagauaaugagguacagagagguuaaauaacuucucuaauguuacacagucaguagauugcuuguucaguccaucugauuucaaauuaggucuuucuagaaaguuuccucuccuuagagcggaaauauauccaaauuuugcaguuauauuuaguuacuggaaacaugauaaauuaagaaauaaagaaauacuuuaaaaaccuuuccuaauaaauggaaggcugaaaauuccaugagauguuggaauuuaacucccccauccuagugauugagcauuagaguaauaagaacugguauacuuacguaguauacccuggaauaguuauguagcuauaugaucugggguaagcccuugaacucuuuaggccauaauccaacauauacgucuuucauucuauauauguacuaaauauaauugcuggauguuaugcuaaacaucccaggcauagaaagaugcuugagacauguuucucuauacuuagaguuuauuuucauuaaaucgacuuaguuaagucaaaauuaccuucuuaaucaacaucauucuuuuacguuucuacuccaagcaagcagguacucagggacuuguacccagagggacacaggauaaaacaaaaauucuaaaugagaagucacugacaccugugaaucagaggacuacugggaauaauuuuucaaaccuauagccagcuaaucccaccuugcaucacauuccuguucuccuuuguuacuuccaaagauguaagucccucugguuuuuagucucaacccuauauuucuucaggcauccucuucccugaccccaccucucauucucccuugccuccaaaacuuuccccuuguacccuccuguuccaacauccacaucuuggcuaaaugcccccucaaccuccuugaauaaguggccacacuugacuuuucucuuucauuccuccuugcuaaccgucaucacauccaauuaaucaccaaaaucuugcugauaucuucuugucagggaagauugaaagacuuugaaaugggcagaaaaaaugacuggguauucugccuaaggaaauagguuaaaaaaagaugauugaguacucuugcccagggcaugacucccaguuuuuugugagccuuuccuuguuuuuaagauauuuacggcugggcgcgguggcucacaccuguaaucccagcacuuuggaggccgaggcggguggaucacgaggucaagagaucaagaccauccuggcuaacacggugaaaccccaacucuacuaaaaauacaaaaaauuagccgggugcaguggugggcaccuguagucccagcuacucaggaggcugaggcaggagaauggcgugaacccgggagguagagcuugcagugagcugagaucacgccacugcacuccagccuggacaacagagcgagacuccgucucaaaaaaaaaaaaaagauacuuacaacucuguaaauauagcaaauaguaaugcagcugauucuuauccauagaaaugcaacugaauugugccuucuggcggaauguaauugguuauugcccuguggauauugacuaguuuugccccuaauuauacauuaauugcagcauuuccgcauuccugauugcguauaugcuuugaauuuuucuuauaacaucuuacuaguuuccucauuaauuaaugaguuaaauaaaaucuuugacucauuuuauguguguaugacuuauuuuucucuuauaaaaagcauccuuuaacauucugaauaucucuuacauuugcauacuucuccccaccccaauaaccccuucuagcacaggucauuagcaucuuugccuagauuauuuuauuuuacuuauuuauuuuuuuugagauggagucucacuccaucacccaggcuggagugcaguggcgugaucucggcucacugcaaccuccaucuacugaguucaagugauucuccucucucagccucccgaguagcuaggauuacaggcacccaccaccaggccuagcuaauuuuuguauuuuuuuuuauagagacaggguuucaucauguuggccaggguggucucgaacuccugaccucaggugaucugucugccucaggcucccaaagugcugggauuacaagcaugagccaccacacccggucagccuagauuauuuuaauucucacuaauuguaccguugucuguagucucuuuauccuauuccaugaucuccauaaccagagugauuucuucagcauguaauucugaacaugccacucaacuucauaaaaucuccugcucccagaacaaagugcagcccucuaggccgauuuugcuucuccagccucaugugugacauugaccugcaguucucagucagauucauuucaguucucugaauucacugccuccucugucaccucuagaauaaaguacuugcaauugcuuugcaugcaacacacuccacaugccucucuucucccaauucuugccuguucuuuagggcucaucucuguuaccacuuccuucagcaagccucucucuagucuggguuagaugcuccacuuauguccuccuguggagccuguauuccgucagcccuuuaccuccuccccuaauagcacauaucacgcuguauuauaauugcucuuuaaugaucuccucugcuagucuuuaagcucugugcaggcaggugccauguucagguuugaauccugaaauccuuacuuaagcagcuguauaaucugggguaaauccuugaacucauuaggccauaauccaauauauaaugucuuucauaaauuuuaucuuauauccaacauguucaaaccugcuauuguuuaccacuacauccccagggcauagcauagcauguaaaagucaugcaagaacauauucugaaagucgaauucucuauauggucccaggauaauaauagaaacuucacuauaaaaauccuucucaaggacuaugaccuaccccaccuacccaugcucaccucccccacccgcaccccaaaacacagguuauacuuaaauagaauguacuucaguuuauuuagguuuuuauuuuacagauaucuaaccuaucugcuuuuuaauugugaacaguuccauagaauggccauccuaggagagaugaaacagaguuuuguuuuacuuuaugauagggaaaagggauugggaacagaaaaaagcaggagaaaaggaaaagaaggucagaauuacaugaaauggcuacaguagauaugauggauuccagcuguugcucaaccauuaaaaaaaaucuguugauuuccuauguucaaccaaguaauaucaugaguuuuagaauaaauguagaaaacaguaacuuuguaauaaggcacagaaacaguacauuagagguccuuucuguguuccuuucuuuauacuauuuuauauuuguuuuugaaauuaacugauauuuauuuagguccuguguuuacgguuuauccuuaacagacaaaauccuugagauguauuauuuagccuuaaaaagaaaggaagugacagcacaugcuacaauauggauaagucuugaagacauuaugcuaagugaaauaagccaguugcaaaaagacaaauauuguaugauuucauuuauaugugguacuuacaguacucaaauucauagagacagaaaauaggauggugguugccaggguguguggggagggggaauggggaguuacugguuaauggguacggaguaucaguuuuacaaaaugaaaagaguucuguggauggauggcaguggugaugguugcacaacaacaucaauguacuuaaugccguugaacuggacacuucaaauggcuaaaacuguaaauguuaugcuauggguauuuuaucauaacaaaaaaagaaagggcaaaauccugccuucaguauugaaauugcaguaacuggcagcuauugguaugaaccuuggacagaccgggauguguaggauggugcuguugaugcagguauaagaaaggaaaauaucggcccagcgcaguggcucacgccuguaaucccagcacuuugugaggccgaggcaggccgaucaugaggucaaaagaucgagaccauccuggccaacaugguaaaccccaucucuaccaaaaauacaaaaauuagcugggcgugguggugggcgccuguagucccagcuacucaggaggcugaggcaggagaaucacuugaaccugggaggcagagguuacagugagcugagauugugccacugcacuccagccuggcgacagagcaagacucugucucaaaaaaaaaaaaaaaaaaaaauucugacuguaaagugauuucaaagaaacuuaggagauaaagcugaagguugaaaacauucacaagaauaaaauccugcuuuguaaugaguaacaauaaacuauucucuaaggguugucuauuagaaccuccaucuuugcguagccuuuaagaaaaauguuauuuucucuaugaaacugugcucacuugccaaggagggaggcugcgcaguggcacagaaaagaguuuggacccugaagccagacagucugaaacugaaugcugacuccaccuugaugaauuuacucucuuugugcuuugguuucaacuggaaauuagagauaauaacaauagcacccaccacacagagcugcugugagaauuaaauauguaaagcacugugaacagugucuggcacacacuaaauccaauagagauauuagcuauuacucacacccuacgcaauggugcuuauaguaugcucugggaacuccuggggaccucugagaucuuucagggggucugugaauuauuuacauaauaauaagauauuauuuuccuguuuaucacauucucucacaaguagacaguggagaucccccguggccacuauauaccauuugauaucacaacagauugaaagcagaagcagauaugagaauccaguuaucaucuauuaagucggacauuaaagacauuugcaaagaccucuuuucacaauaccacucuccucacaaaaaauugugaagguuuggaaacuguaguucuuuuuucaugaaagaaaauguucuuuauguuacuguaugauagguuuauuauuuuuaaaauaaauuaauaaauacuuaacaaauuuuuuguuuuaguuucuaauaugguaaauauagacgauauaacucacauaaacaaaagcccuuugguuugggguccucauuuuuuuuuuuuaucgguccugaaaccaaaaaguuugagaauugcugcccgacuaaaauacggcguaugugucaaucucuccaaguagacugugaauucuuguggacaggaauacuauuguauuuuuuuucuuuuucuuuucuaucuuuuuuuaaaaaaaaauuucccccagguaucaacuggcagucuuuuuuacaugguuagacaauaaaugaaaagaaagaagcuaauauauauuagcaacuaucauuuguucagggcuuaguauuugugaugcauuaugcucagacuuuauguaccuuaucucauuuaaccccuguuagguucuguaauuauuccuauuauauacauaggagaaacuuagagacuuuaaauaacuuacccaaggcauacagcuaauaaauggaaauacuaagacucaacuagcauugucucacuuuagaggccaaacuuguaaccccuuugaaagaaugggauuguguacagaaauuuggaaggcuaugauuaggcaagacaaaucauuuacaaagcauggugcucauaguaucuauuaaguaccuaguuuaccuuuaccagagguuuguaauucugaaugacucuuggauguucauauugucaauuagagcaacuuuuauuuuguuuaacgcagagaacauacucucauacacugaugucuaaaaggucuuuucuaagaaggucaacucccuaaccagaauguacugccucugcugcucagggaaguaaaaaagagguaccucugaaagaacgaauaugacacaaauuuuaagguguaacauuuaaaaaacaauguaacaauauuaugaaaauuugagaaaugaauuuauuucugguucuauucuauccauuggucugugugucuguuuuuauaccaauaccauguuguuuugguuacuaugccuuuguaguguauuuuggagucagguuuugugaugccuccagcuuuguucuuuuuguucaguauugcuuuggcuauucagggucuuuugugguuccguaugaauuuuaggauugcuucgucuauuucugugaagaacaucauugguauuuugauagggauggcauugacucucuagauugcuuuggguaauauggccauuuuuaacaauauuaauucuuccgauccaugagcaugugauagcuguccauuuguuuguguucucuucaauuuucuucuucuuuuuucuuuuuuugagccagggucucacucugucaccuaggcuggagugcagugcugugaucauggcucgcuacagccucggccuccugggcucaagcaaugcucccaucucauccucccgaguagcuggaacuacaggugcaugccaccacauccggcuacuuuuuguauuuuuuguagagacaaaauuuugccucguuucccagguuggucuggaacuccaggacucaagugauccaccugccucagccucccaaaaugcuaggauuacaggcauaaguuauggugccuggccucuuuaauuucuuuuauaaguguuuuguagcuuucuuguauaagucuuuuaccuccuugguuacauuuauuccuaguugggauuuuuuuuuuuuugguagcaauuguaaaugggauuguuuucuugauuauuuuucagcuaguuuguuguugguauauauuuuguguaaacuacugauuuuugugcacugauuuuuaaacuuuuuuaaccaccuaaguucuugucucauguauguugauuuucguauccugcaacuucccugaauuuguuaaucaguucugugaguuuuuuagugaagucuuuaggauuuucuauauauaagagcauguuaucugcaaagaggaaaaaucugacuuccucuuuuccaauuuggaugcuguuuauuuccuucuuuugcuugauugcucaggcuaggacuucccaugcuauguugaaugagacuggugaaagugaccauauuguucuaguucuuagaggaaaggcuuucaccuuuccccauucagugugaugauagcugugaguuucucucauguggucuuuauuauguugagguaugauccuucuaugacuaauuuguugaaaguuuuugaucaugaagggauguugaauuuuaucaauaauuuuucugcaucuauugaggugaucauauggugucuuaguccauuuuguguucuuaaaaaggaauacccgaggcuggguaauuuauuuuuuaaaaaaagguuucccuggcuccugauucugaugccucaaaaaguucaagacugggcaucuucaucuggugagggcauuaggcugcuuccacucacgguggaaagcaaagggaagccaacuugugcagagaucacauagagagagaggaagcaacagagagguggggaggugccaggcucuuuuuaacaagcagcacucacaggcacuaauagagugagaacucacugauccgaaaggaagagcauuaguauauucaugagggaucugccccaugacccaaacaucucccauuaggccccaccuccaacacugaaaaucaaauuucaaaaugaaauuuggugggaacaaauaaaccauauccaaacuauggcauauguccuucauucugcugauguugaugugauguaucacauuuauuuauuuuuccuuucuuucuucaacuuuuauuuuaaguucagagauacaugugcaggaugcgcaggucuguuacauagguaaaugugugccaugguaguuugcugcacacaucaucccauuccccaggcauuaagcccagcauccacuagcuuauucuuccugauccuccucccucucccacccccugcccucugacaggauucaguauguguuguuccccaccauguguccauguguucucaucauuuaguucccacuuauaagugagaacaugugguauuugguuuucuauuccugcauuaguuugcuaaagauaauggccuccagcuccauccaugucucugcaaagaacaugaucuuauuccuuuuuauggcugcauaguguuccacgguguauauguaccacauuuucuuuauccaaucuaucauugaugggcauuuagguugacucccugucuuugcuauugugaauagugcugcaaugaacauacgcgugcauguguuuuuagaguagagugauuuauauuccuuuggguauauacccaguaauaggauugcugggucaaaugguauuuuuaccucuacguguuuuaggaauagccacauuaucuuccacuaguuuacacucccaccaacaguaucagagcauucccuuuucuccacuaccuugccagcaucaguuguuuuuugacuuuuuaauagccauucugauugguaugaggugguauuucaucaugguuuugauuugcauuucucuaaugaucagugauguugagauuuuuuugauauguuuguuggccacauguaugucuucuuuugagaagugucuguucauguccuuugcccacuuuuuaaugggaauguuuguuuuuuuucuuguaaauuuguuuaagcuccuuauagaugcugaauauuagaccuuuguuggaugcauagauugcaaaaauuuucucccauuccguagauugucuguuuauucuguugacaguuuuuuuugcugguaucacauuuauugauuugcauaugcugauccaucuuaauaaguuccacuugaucauguguauuaagcauauuaacuuuuuuuuuuuuuaagauagggucugcuuugucacccaggcuggaaugcagcggugugauacuggcucacugcaaccucugccucccagguucaaacaauucuccugccucagccuccugaguacguuggacuauaggcacccaccaccacgacuggcuaauuucuguauuucuaguagagacagaauuuugcaguguuggacaagcuggucucgaacuccugaccucaggugaucagcccaccuuggccucccaaagugcugggacuauaggcgugagccaccacacccagccauguauuaacuuuuugauguuuuguuggauuugguuuccuaguguuauguuggggauuuuugcaucuauguucaucagagauacuggcuuguaguuuucuuuuuuuguuguguucuugccuaguuuuugauaucaggguaauucuggccucacagaaugaauuaggaagaauucccuccucuucauuuuuuuuggaauaguuugagaagaauucguguuaguucuucuuuauaagauugguagaauucagccaggcauggugguucccaccugcaaucccagcacuuugugaagcugaggugaguggaucacuugaggccaggaguucgagaccagccuggccaacauggcaaaaccccaucucuacuaaacaacaacaacaacaacaacaaaaauacaaaaauuaguuggacaugguggugcaugccuguaaucccagccacucgggaggcugaggcaggagaaucacuugaauccgggaggcagagguugcagugagccaagauugcaccacugcacuccagccugagagacagagugagacuuugccuccaaaaaaaaagauugcuagaauucagcaguaaagccaccaguccugggcuuuucuuauuaaaaaacuaaucaaaauggauugacaacuuaugaccugaaacuauaaaacuacuagaaaaaaauaucaaggaaaugcuucaguacaugggucuaggcaaagauuuuacagcuaagacuucaaaagcacaguaaacaaaaaauagaaaaacaggacuacacugaauuuaaaaacuucuacacagcaaaggaaacaaucagccaagugaagagauaacuuguagagugaaagaaaauauguacaaacuauucauccaacaagggaccaauaugcagaauauacaaacaacucaacaacaaaaacuaauaauaauaaucccauuacaaagugggcaagggaucugaauagacauuucucaaaagaagacuuaaauagcaaauggguauaugaaaagaugcucagcaucacuaacuaccagggaaaugcaaaucaaaccacagugagauauaucgcaguuagaauggcuauuaucaaaaaaauaacaaaaguuggugaggauguggugaaagggaaacucuuauacacuguuggugggaacaucaauaaauacagccauuauggaaaacaauauggagguuucucaaaaaacuacaaauagaacuaccauaugauccagcaaucucacuaugggguauuuauccaaaggaaaggaaaucaguguaucaaagggauaccugcauccccauguuuacugcagcacuguuuacaauaucaagauauggaaucaacucaaguauucaucaaugguuaaauggauagagacaaugugucucacacacacacacacacacacacacacacagaauggaauacuauuuagucauaaaaaagaauggaaugcagucauuugcagcagagguagagcuggaggucauuauguuaagugaaauaagccaggcacauaaagacaaauaccagguuuucucauucauaugugggagcuaaaaaaaaguugaccucauggagguagguaguagaacaauaguuaccagaagcugggaagaguggagaagaggggaugaagagaggcugguuaacagauacaaacauacuguuacgaagaaggaauaaguuuuaguguuugauagcacaguagggugacuauaguuaacaacaauuuauuguauauuucaaagcagcuaaaagaagauuugaaauguuccuaacacaagaaacugguaauuguucaaugauggacauccuaaauacccugauacgaucacacauuauauacauguauuaaaauaucauauguaucccauaaguguguaauuauuauguauacuuaaaaauuuuaaaaacuauugguauaugucuuagucucuuuguguugccauaaaagaauaccugagacuggguaauuuauaaagaaaaaagguuuauuugauucaugauucugcuggcuagaaggcugggcaucuggugaaagccucagguugcuuccacuuauggcagauggugaagggguaccaguaugugcagaaauuacauggcaagaaaggaagcaagagugagguggaagguaccaggcuuuuuuuuuuuuuuuuuugagacagagucucacucugucgcccaggcuggagugcaguggcacgaucuugacucacagcaagcuccgccucccggguucacgccauucuccugccucagccucccgaguagcugggacuacaggugcccgccaccacgcccagcuaauuuuuuaaaaaauauuuuuaguaaaaucccauuacugguauauacccaaaggacuauaaaucaugcuguuauaaaaacacaugcacacguauguuuauuguggcauuacucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaaccaaacaccgcauauucucacucauaggugggaauugaacaaugagaacacauggacacaggaaggggaacaucacacucuggggacuguuguggguuggggggaggggggagggauagcauugggagauauaccuaaugcuagaugacgaguuagugggugcagcgcaccagcauggcacauguauacacauguaacuaaccugcacauugagcacauguacccuaaaacuuaaaguauaauaauaauaaauuaauuaauuaaaaaauauuuuuaguagagaugggguuucaccguguuagccaggauggucuugaucuccugaccucgugauccacccgccucggccuacccaaagugcugggauuacaggcaugagccaccgcgcccggccgguaccaggcucuuuuuuaacaaccagcucuugugggaacuaauagagugaaaacccacuuauucccaugaggauggugccaagcucuucaugagggaucugcccccaugacccaaacaccucccacuaggccucaccuccaacacuggggaccaaauuucaagauggguuuggaggggcaaacauccaaucuguaguuuuauacuaccuucaauuuucuuaccugaaaaaauuuuaaauguaacucuaauuguaauauacuugacaauuuuucuccuguuucuugucucuuaucacuacaucauauacaguagucuuaacuuauuugcaguuucauuuuccacaguuucaguuaccuuggucaaccaugguccgaaaauagaugaguaagauauuuugaugaguaagauauuggauaaguaacauauuuugagagagagaaagagaucacauucacaaaguuuuauuagucuauuguuauaauuuuucuauguuauuaguuauuguugcuaaucucuuacuauuccuaauuuauaaauuaaacuuuaucauagguauauauguuuaggaaaaauaucugguauguauaggguucgauacuaucugcaguuucagguaucuacugggaggucuugaaccauauccccuauggauaaggggggacuaguguacauuuuuuauauuauuggauagacuucaucaucauccuuuuaaaauggcagcauauugauuauuaacuacaguuaagucuuguuauucauaauagcuacauucuauaaagccucagugagcacugaacuagugaauauugagccauugcuccuaggggaaguauaggguuagguuucuguaagccucuggucacaacaugcuugucaacugaucaauacauaaccuuguuuuaugugugcuucuguuuaaggacacuuugcauaaucuauauuguugauuuauuauuaucaaacucauggccaacugcacaauaacucaugccuaaauggaacuucucuguaaggcacaucauagccuucuugggcucaggaacacuagacagcauuucaacacuaugcuuuggcaccauuuuaaacagugaaaucaccaacaaaaaugcaaaaaacagggcacuaaguagaccucaagaaggacaguuguuuacaauaggagagcuaaaacaagaaggcagagccucaucuuguucgaccccagcugggaguguguuaugucaggugacucaguuuuuuugcuguugugugcaugucugcaaaugacuuuaaaagcaccaggaguauugauuugggaguuaaaaauagauucuagccacuaggugaauuugcaaauauaguaucugugaauaacgaggauuaacuaacuauauuucccuauuauugagcaguuaagcuauuuauuuucuauuaaaauaaaugcuaugaucaauacucuaugcaugaaacucuuccucuuggcuggacgccguggcucaugccuguaauccuagcacuuugggaggccgaggugggugcaucacuugagucaggaguucgagaucagccuggccaacauggugaaacucugucucuacuaaaaauagaaaaauuagccgggcgugguagcacacgccuguaaucccagcuacuggggaggcugaggcaggagaaucaguugaaucugggaggcggagguugcagugagcugagaucuugccacugcacuccagccuggguaacagagcgagacuucaucucaaaaagaaaaacaaaaaaaaacaaaaaaaaaacaaaaaaaccuucuuccucuuuuaggaguauuuccuaggagcuacugggaaauuuagaauuuugauacagccugcuucucguaguaguucuuggagugccugccuuaugacaguucuucagauccuugcuacucacaaaaugugguccuaggaccagcagcguuagcaucacuugggagcuaauuagaaauguugacaaaaaucauuccaggccaagcgaucagaauuuguuuuuuuagcaaaaucugcaggugauuucuaggcacauuaaaagucugagaaacucugcuauaaaucaaggauuccugaaauuuagcacgcaucagcauuaccuagccagcuuguuaaacacagauggcugggccccacccucaacauuucugacugcgaaugucuggggaguggccugagaaugagcacuuuuuuuuuuuuuuuuuuugagauggagucucgcucugucgccaggcuggagugcggugacgugaucucggcucacugcaaccucugccucccggguucaagcgauucuccugccucagccuccugaguagcugggacugcaggcacgcaacaccaugcccaguuaauuuuuguauuuuuaguagagaugggguuucaccauguuggccaggauggucucuaucucuuaaccucgugauccuccugccuuggcuucccaaagugcugggauuacagauuugagccaccacgcccggccugagaaugagcacuucuucuguuuuuuuguuuuguuuuguuuuuugagacggagccucacuuugucgccuaggcuguagggcaauggcgcaaccucagcucacugcaaccucugccuccuggguucaagugauucucccaccucagccucuugaguagcugggacuaaaggcaccugccaucaugcccggcuaauuuuuguauuuuuaguugagaugggguuucaccauguuggccaggcugguauugaacaccugaccucaggugauccacccgccucggccccccaaagugcuuggauuacaggcgugagccacugcacccggccaagaaugagcacuucuaacaaguucccaggugauggugaugguccugguccccggaccacacuuugagaaccacagccuuagcugguucauggguaggucucuugcagaguugauguuuuuaaauugcuaauucaucuuucuuggugagauggagggaaaaaaauaaugaauguauaacucaucaaaagaaauccggcugacuccuuuuucagacucagcccgccugcaccaggugaaauaaacagccuuguggcucacacaaagccuguuuaguggucucuucacacagacacgugagacacuuggugccaaagacccgggucagugggacuccuucgggagaccaguccccuguccucacccucacuccaugaagagauccaccuacaaccucggguccucagaccaaccagcccaaggaacaucucacugauuuuaaauuggguaaguggccucuuuuuacucucuucuccaaccucucucacuaucccucaaccucuuucuccuuucaaucuuggagccauccuucaaucucucccuucucuuaauuucaauuccuuucauuuucugguagagacaaaggagacaccuuuuauccguggacccaaaacuccggcgucugucacggacucgggaagacagccuuuccuugguguuuaaucacugcggggaugccucucugauuauucgcccacguuccauuggugucugaucuccgcagggacgccugccuuggucauucacccacauucccuugguggcaagucaauugcagggacaccugcuuuggcugcucacccacgcugcagccuggggcugcugcccgcccccuuucuccgugucucuacccuucucuuuaaacuugccuccuucaccaugggcaaccuuccacccuucauuccuccuuuucccuuagccuauguucucaagaacuuaaaaccucuucaacucuugccugaccuaaaaucuaagcgucuuauuuucuucugcaacacugcuuggccccaauacaaacacgacaaugguucuaaauggccagaaaauggcacuuuugauuucuccauccuacaagaccuagauaauuuuugucaaaaaaugggcaaauggucugaggugccugacauccaggcauucuuuuacacgucggucccucccuagucucugcucccaaugcgacucaucccaaaucuuucuucuuucucuccugucuguuccuucagucuccaccccaagcucugaguccuuugaauccuucuuuucuauggacucaugugaccucuccccuucuccccaggcugcuccucgccaggccaagccaggucccaauucuuccucagccucugcuccccgacccuauaauccuucuaucaccuccccuccucacaccggucuggcuuacaguuucauuccgugacuagcccuccccaaccugcccagcaauuuccucuuuaaaggguggcuggagcuaaaggcauagucaagguuagugcucuuuuuucuuuaucccaaaucagauagcguuuaggcucuuuuucaucaaauauaaaaacccagcccaguucauggcccguuuggcagcaacccugagaugcuuuauagcccuagacccuguaaggucagaaggccgucuuauucucaauaugcauuuuauuuuauuacccaaucugcucccgauauuaaauaaagcuccaaaaauuaugaaaccccacaacaggacuuaauuaaccucgccuucaagguguacaauaauagaguagaggcagccaaguagcaauguauuucuaaguuguaauuccuugccuccacugugagacaaaccccagccacaucuccagcacacaagaacuccaaacaccugaaccgcagcugccagggguuccuccagaaccuccccccaccccaggagcuugcuacaagugccggaaaucuggccacugggccaaggaaugcccgcagcccgggauuccucccaagccaugucccaucugugcgggaccccacuggaaaucggacuguccaacucgcccggcagccacucccagagccccuggaacucuggcccaaggccccuucccagaucuucucggcuuagcggcugaagacugacacugcccgaucgccucggaagccuccuggaccaucacagaugcuuuagguaauucuuacaguggaggguaaguccauccccuucuuaaucaauacggaggcuaccuacuccacauuaccuucuuuugaagggccuguuucccuugccuccauaacuguuguggguauugacggccaggcuucuaaaucucuuaaaacuccccaacucuggugccaacuuggacaacauucuuuuaugcacuccuuuuuaguuauccccaccugcccagcucccuuauuaggucaagacauuuuaacuaaauuaucugcuucccugacuauuccugggcuacagccacaccucauugccgcccuuuucuccaguucaaagccuccuucacauccucuccuuguaucuccccaccuuaaaccacaaguauaggacaccucuacucccuccuuggugaccgaucaugcaccccuuaccaucccauuaaaaccuaaucacccuuacccugcucaaugccaauaucccaucccacagcaugcuuuaaaaggauuaaagccuguuaucacucgccuguuacagcauggccuuuuaaagccuauaaacucuucuuacaguucccccauuuuaccuguccaaaaaccggacacgacuugcagguuaguucaggaucugugccuuaucaaccaaauugucuugccuaugcaccccaugaugccaaagccauauacucuccuauccucaauaccucccuccacaaccucuccacaacccaguauucuauucuggauuucaaacaugucuucuuuacuauuccuugcacccuucaucccagccucucuuugcuuucacuuggacugacccugacacccaucaggcucagcaaauuaccugggcuguacuccacaaggcuucacagacagcccccauuacuuuagucaaacccaaauuucuucaucauccauuaccuaucucgacauaauucugcaugaaaacacacgugcucucccugcugaucacguccgguuaaucucccaaaccccaaccccuucuacaaaacaacaacuccuuuccuuccugggcaugguuagguacuucugccuuuggauaucuaguuuugccauccugacuaaaccauuauauaaacucacaaaagcaaaccuaguugaccccacagauccuaaauccuuucccuacuccccuuuccauuccuuaaaaaacagcccuaaaagcugcucccacacuggcucucccuaacucaucacucccuuuucauuacauacagccgaagugcagggcuguguggucggaguucucacacaagagccgggacugcgcccuguagccuuucuguccaaacaacuugaccuuacuguuuuagccuagcccucacgucugcgugcaguggcugccgcugccuuaauacuuuuagaggcccucaaaaucacaaacuaugcucaacucacucucuacaguucucauaacuuccaaaaucuauuuucuuccucacaccugacacauauacuuucugcuccccggcuucuucagcuguacucacucuuuguugagucucccacaguuaucgucguuccuggcccggacuucauuccagccucacacauuauucuggauaccacaccugacccccaugacuguaucucucugauccaccugacauccacuccauuuccccauguuuccuucauuccuguuuaucacccugaucacacuugguuuauugauggcaguucuaccaggccuaaucaccacucaccagcaaaggcaagcuaugcuauaguaucauucaggcuaccgcucugccccccuccacuaccucucagcaagccaaacugacugccuuaacuugagcucucacucuugcaaagcgacuaugcgucaauauuuauacugacucuaaauaugccuuucacauccugcaccaccaugcuguuauaugggcagaaagaaauuuccucacuaggcaaggguccuccaucauuaaugccuccuuaauaaaaacucuucucaaggccccuuuacuuccaaagaaagauggagucauucacugcaaaggccaucaaaaggcaucagaucccauugcucaggacaaugcuuaugcugauaagauagcuaaaaaagcagcuagcguuccaacuuguaucccucacggcaguuuuucuccuucucaucgggccacucccaccuacucccucgcugaaacuuccaccuaucucuucccgcacaaggcaaaugguuccuggaccaaagaaaauaucuccuuccaaccucacaggcccauucuauucuguugucauuucauaaccucuuccauguagguuacaagccgcuagccugccucuuagaaccucucauuuccuuuucauugugggaaucuauccucaaggaaaucacuucucaguguuccaucugcuauucuacuacuccucaagaauuucucaggcccccucccuucccuacacaucaaguucggggauuugcccacccaggacuggcaaauugaccuuacucagaugccucgugucaggaaacuaaaauaacucuuggccuggguagacacuuucacuggauggguagaggccuuucccacagggucuaagaagccacugcagucauuucuucccuucugucagacauaauuccucgguuugggcuucccaccuuuauacaguccaauaauggaccagccuuuacuagucaaaucacccaagcaguuucucaggcucuugguauucaguggugccugguuuuaccucaaacugccacccuuaagucucuaaguggauagaagaucuucagugacaaaguacccuccaacaguuucacccugaugaaguccuguucuuuacuuuuaugcuuacucuuauucucauucccauucuuaugccacccucuaccucucuccagcuaucuccaccacacuaucaaucucagucacucucuccuagccauuucuaauccuuuuugcuggcuuuguauuucucuuuccuccaaaaucaccaagguauugacuuacucacugcuaaaaaaaaagggggacucuauguuuuuaaaugaagagugcuguuuuuaccuaaaucaaucuggccugguauaugacgacauuaaaaaaaacucaaagauagagccuaaaagcuugccaaccaaguaaguaauuacgcuaaccccgcuuggacccccuuggacacucuaauuggauguccuggguccucccgauucuuaguccuuuaauaccuguuuuucuccuucucuuauucggaccucguaucuuccguuuaguuucucaauucauccaaaacuguauccaggccaucagcaaucauucuauaugacaaauguuucuucuaacaaccccacaauaucaccccuuaccacaaaaucuuccuucagcuuaaucucucccacucuagguucccacgccgccccuaaucccgcucgaagcagcacugagaaacaucgcccauuaucucuccauacaacccccaaaaauuuucgccaccccaacacuuuaccacuauuuuguuuuauuuuucuuauuaauauaagaagacaggaaugucaggccucugagccuaagccaagccaucauauccccagugaccugcaguauacaucuagauggccugaaguaacugaagauccacaaaaaggagugaaaauagccuuaacugaugacauuccaccauugugauuuguuucugccccagccuaacugaucaauguacuuuguagucucccccacccuuaagaagguucuuuguaaucuccccaccuuugagaauguacuuugugagauccacccccugcccccaaaacauuguucuuaacuccaccgcccaucccaaaaccuauaagaacuaaugauaaucccaccacccuuugcugacuccuuuugcggacucagcccgccugcacccaggugaaauaaacagccgcuguugcucaaaaaaaaaaaaaaaaaaaaaaaaauccuuuucacuguauaggaccaggcuaaccagguugagaacaugucaugguuggcagggguagggcaauauggaugggaauugagaaacagaaauagaaaaaaaaguuuuguucucuuguuauuuaggcacacucuaucauuaaaguaucagaaaaauauucuuuuuguuuguuuguuuuuugaaauggaggcucucucugucacccaggcuggagugcaguggcaugaucuccgcucacugcaaccuccgccuccuggguucaagugauucuagugccucggccucuugaguagcugggauuacaggcguaugccaccacaccuggcuaauuuuuguauuuuuagcagagucgggguuuccucauguuggccaggcuagucucgaacuccugacuucaagugaaccacccgccucagccuccugaagugcuggaauuacaagcgugagccagcugaaaaacauugaguaguuuuucauaaacuauauuuuaugaauuacauacaaaaauaggagaaucugaggaauuuggaaaaaguaucaaagauacauuuuuguucguuuguuucuacuuuuucaguuuccugugaugaaaaauaauauacagcuaugaaagcacagguccaaaacaaggcccagaagcuuagcuucccagucucugacaaauccuuggcuaucacuacccaagaauaaaccagaagugauuucuuagaacauggaacucucaagacuaucauuuccuuaccccaaaacuucaaguccagcacacagccaauucaaguccauaacuauuugucaauguaaagaauuucuggguacaaguucuauguauuucagguagaucaaaaugaucauuucauauuucucaugagcuuggugaagcuuuagcaggacagucucagguacagguauucccuuggagugacuuccuuuuccuggcaggggaaaaagaggaaccuuaucuuaggguccucuuugcucugcauuaauaauaagguuaucuuaucaucucucuuuacguuucagauauggucaaagucuauuagaacugguuggcucuucuuuguuuuuaaagccauuccauagccuauuaaauaguuagcagaaaaaagauaagggcuguuuauaagaaaauuugugacaaaagcagauuggcuuuaacaaaaucugguaucaaaggucuaagauucaguuaaaagaaauccuuaucaucaauguagauaaccuuuuaaucaaaggagagcagaugaugagugaguacuuuucaauguguuaugguggaagcccugauuggagaaaagaaauuauuacagaaaauauaaaagauuaugugacuguuuuucuuucuccaagaaaccuggucuagucugucucuaggucuuugagaauacuuaaaagacuagauuggggcauagcuucaaucauuaacacaagcaaaugaucuauuauuuuuucuuagacaaacagauggaaggaauccuacuccaaaauggccagaaaaaggaggaggaaggggaagggagaaccuggcaaagucguaaaaugucuuuguaaaugggcucuugagcccuaauggcuguaacaucaggugaguauuucccagcaguuucuaugcuuagcaaaaaugaaagugggucuguaauuuaggucuggaagcaguggcuggaaauauccaaagguauguugcaucuguuccuucuuagugugcauaguaucuaaauuuguuaugggagaggaaauaauuggugaguaauuaguaaaaugcuuaaccuaacuuuaaucaagagauuauuuucccuggaaaaagcaaucauggcuuugcauuuuggugagcuuuaucucacuagucucaauuauccaugguuauccaagccugcagauagccuaaugugucccauuaaaggcaggcaggccagcuacuaaaaaugcaggcacaaugccucaggguaauaaggagccuuagugggcuuauuuugcaaauugagcccucuuuaguaauggcaacugugacagccccccuuuaggacuccaaagagucuuuuucagucugagucccagauccacucccuucuguuuaagguggaaacggcuguccuggcugccaccugccucaucagcugagcuaccgucucccugggcucugcucuccuuuuuuucugucaucuuucuccaguccuucaucuuuggcuaccuuaaccuugaaucaauucauucuuucacuucucuggccuuuugugaauccagaauuucacuaaaauguccucagaauugcucaauucuacuauuaccccagcccaggaauucacaaugcaaauuagcacacugaagacaaucaccaucugucagcaggauguucuacauuguuuuuccugaaaauuuuuaaacaauuaaaauuguacaguuacugcacauucucuuaggguugcccugcaacacaugauugcauuuuguaagauguuuuuaccacacugcuacacagauauguauuguuacuaaaugaaaaugcuauaugaaaauuauuauagcuguuaggacuagacaucagcccucuuggcuugacaauuauacaaaugaagaaggguguaagaaaaauuccaaacugaugaaaugaacauacaaaugaaaagggaguuuuuuguuuuguaauuuuaaaauuuaucuuuuuuuuuugacaaaaucuacaaauuuaaaauaccaaucuaucgaccaacuuguuauugggaaaauuaugaaagaacaauuuucaaaagcuagcaauuaucauacagaauaauaucuuauuuuuacaaaggcugguuauaauauuuaugaauuuagugggucuucauuuuuucaauuuaauauagucuucauccuucaucuaacuucagcucgaguuagaagacaaaaggagguagugagagaugggcagaaagagguaauaggaugaauuuuguuaggagcacuaacaaagguuauuucaggaaaaggcuacaacguacaaccaaacugaggcuacuggauuaucgguagccacauccccuauuagcccagaucaccaaaucacuagucuaauggaagcuuuuuuuuuuuuuuuuuuuuuugacuacagagaacaauggucaagacaauugacauuuauaaugggcaugccuaaagguguugaagucauaacugaucaggaaucuauuuccugcuuauaaggaaagugcgugggcaaaucugaaggugauuuaaccuauaauccaucaccuagaugucuccaucugaacaauucugacacuuucuccuccuccccagcugucgcagcaugccauggaggcuaaauuucuauaaaaauacugugaaaggaccgggcgcagugggucacgccuguaaucccagcacuuugggcggccaaggcaggcagaucacuugaggucaggaguucaagaccagccuggccaacauggugaaacccugucucuacuaaaaaauacaaaaauuaacugggcaugguggcacaugccuguaaucccagcuacucaggaggcuguggcaggagaaucgcuugaacccaggagacggagguugcagugagcugagaucacgccagugcacuccagccugggcaacaagagcaaaacuccaucucgagaaaacaaaaaacaaaaaauacuaugaaagaauuggaauaaaaguagauuuuagccagauugccuuagaaauugucccuugcuuauuuaauguuguuaauuaacauccagguuccaagaaucuuacaauguuagcauuaaaaagaacaucugagaucacuaagaacaauuuuuucaucucucauguuaaaaccaaagcuuaggaaaauuuuuaaaaagcuaaguggguaacugccuugcuaaggaugaccugguaaggacgaccugauugcuacauagacuccuacagucuuaguccaauucuuuuuccauugcauccucaugccuugcaguagguaaagagaaaacauguugauuuuauccauuuuaguguaagaaucuucuagauaaagaaggcagguaaauggaugaaugauagaaccucuuuauuaaaaacuuuacuauacaccaaggguucaauucaaccucuguucaagguggugagugugaaacuccugcuaaaguguuuuuaaaagcaaaagaaauuuaaguguuuucaauauugccuacaucagugguucucugcccaauucaucugagaagcagaacacaucccacccauuaacuaugccuuacuaugcagugauucucaguggugauacuaugggagggcacacaucugcauccacacacuuauguaggaggaucuauucuaauagagaagcaugcgaguuuaaaagagcucuccaagcaccacccuugcccuguucuucacccaacagaaacaucacuaaucuccccaaaauggcacuuauacaauaaaguuaauacugaauauucacuuugacuuuuaggacuuagaagaaacucucuuuacaucucagggugccugacuaggucaaccacugaccccuuuguuugaugguucaccaucucuuugaggaaucaauauccgcacauaaacaauacaaugcaaaagucccauuuuaaauuuaccccacucccagcacgcucuauuccccucccaucuuuauuuuucuccuuaacauuuaucacugucuaaacauaauuuacuuacuuacuguucaucuccuuucauuagauuaaacuaaguuccaagagggcaacaauuuuugucuguuuuauucacugcugcguaccuaauacuuagaacucauaguaaaugcucaaucaauauuguugauuaaaugaauagaaaaaugaugacaacaccuuuauacuugcuaauucuacuugguuuuuuuuuuuuuugagauggaguuucacucuuauugcccaggcuggagugcaguggugcaaucucggcucaccgcaaccucugccucccggguucaagugauucuucugccucagccucccgaguagcugggauuacaggcaugcaccaccaugccuggcuaauuuuuuuguauuuuuaguagagacaggguuucuccguguuggucaggcuggucucaaacuccugaccucaggugauccgccugccuuggccucucagagugcugggcuuacaggugugagccaccgcaccugaaaguucaucuuuucuaucauucccuucaaucauucucucaugcccgguacaugggcccuccacccucuuagggcuuuuucugcuagcuacgucuagggagaguauagccugucuaggcuccaugguuauuaugugauaauccucauuuaccuccaacuucuuaccuuccacugcaccugcugugccaacacuuaacccuauauaacccccaacaucuaacuuaccuuacucuuucuuugcccauuccagagcagugcuacagaagauuuuaaauucaugcuggacuggaccgagagcaauucauggcaauacuuaauguucacaauccauaguaaacagaagaaagagaacagaacuaggaauuaaagcuggguuugaaaauuagauauaacauauacuaccuggugucuuugguuaagucagugaccuaucugagccuuuuuuuccucaucuguacagugggaauacuacuaccuacuucauaucacaaagauuacauuuaauuaauuaauuuuuugagacagggucuguucuguuacccaggcuggagugcaguggcauaaucaaggcucacugcaaccucugccuccuggguucaagcaguucucaugccucagccucccucccgagugacugggacuacaggcgugugccaccacauccggcuaauuuuuguauuuuuuguagacccaggguuuugccauguugcccaggauggaugaagauuauauuuuaauaaaauaauguauauaaaagcucccaacagguuuauagccauguaggcugggcacaguggcucacgucuguaauuacaacauuguggaaggccaaggcaggaggaucacuugagcacaggaguuugagaccagccugggugacauagggagaccucaucucuauaaaaaauuuaagaaauagccagcuauaguggcaugugucugugggcccagguauucggagccugaggugggaagauggcuugagcccaggaggcugaggcugcagggagcugugaucaagccaccauauuccagucuggguaacagagggagaccuuguuuaaaaaaaaaaaaaauuuacagacacguagaaagugcuuaauaaauguuagcuccuccucuuuaacauauuucauuaacuuccaaugauacccucacucuuugagugaauaacaagaaaacucaagcuuucugguaugaaucuucuuaauuuuccuuucuucccuccuuuucauaucagaaugcuauguuuucgcucauuuucuuuccugauucugaaagucucucucucucuucuguucuaagacccugcaugucaauaguuuucaagcccggcugcacauuagacucagcugggaagcuuuuuaaaaauacaucaucacugggucccaucacaaaccaauuaaauauaaaucucuggagguggaagcauggcaucaguauuuuuuuuaaguucccugguagggugccaagacaauuuaaugggggaaagaauagucuuuuaaacaaauauuacucaaacaacugaauauccagauucaaaagaauaaaguugaacccugucuuuauagcacacacaaaaaauaacucaaaaugagucacagaucuaaauguggagcuaaaacuauaaaacucuuagaagaaaacauagaaguaaaucuuuaugaccuugagucaggcaaagccaacuuagauaugacaccaaaagcauaggcaacaaaagaaaauaaaacugaacuucaucaaaauuaaaaauuuuuauaccauaaacaauauuaucaagaaaguggaggcaaccuauggaaugagagaaaauauuugcaaaguauacaucugauaaagagcuuguguccagaauauauaaaggacacuugcaagucaggauuaaaagauaauuuaauuuuuaauguggacaaugugucuaaauagauauuuuuccaaagaagauauacagauggccaauaagcacauaaaaagauccuugacaucauucacuuuuagggaaauauaaaccaaaaccacaaugagauuccauuucaaacuuguuaagaugguucuaauagaaaagauagauaauaacaaguguugaagaggaugugcugaaacuggacccucauacauugcugaugggaauguaaaauggugcaaccacuuuggaaaacaauuuggcaucuccugaaaauguuaaacauauaguaaucauaaugacccagcaauucaagucccagguauauacccaagagaaauuaaaacaaauucacacaaaaauguguacacaaauguucauagaagcauuauuccuaauagucaaaaagcggaagcccaaauaucuaucaacugaugaauggauaaguaaaauauggugcacuggaauauuucuugggaauaaaaagauaagaaguacugauauaggcuacaacauggacaaacuuugaaaacauuaugcuaagugaaauaagcuaguuacaaaagagcauguacuguaugauuucauuuacaugaaauauccagacugagcaaaucuauauauagagaaagcagauuggcgguugucuagggcuggggggugaagagaaaugaggagugacugcuaauggguaugugguuucuuuuugugaugaugaaaauguucuaaaauggauugugaugauuguacaacucugugaacauacuaaaaaccauuaaauaggaaaaaagaaaagagaaaagaaaggaaggaaggaagggagggagggagggagggagggaagggaaaggggaggggaagagaggggaggggaggggaggggaggggaggggaggggaggggaggggaggggaggggauggggagaaagagguagggagggaagggaaaaagguuccacagguaauucuaauacugaaguuuauuuccggcauuuuccuuucuagauuccuucagaguaaagacugcauuuucuaaauuuuuuucucccccauauucuuacagaauaguaacacagagcaagggugugauuuuuuuauuuuuauuuuuuugcaacaaacuguucuuggggaauguucuuuauuuuaaucaaaauugcaagaucaggcugccaccuggcagaauuggucaucuuggcuaucuugaacuauuugagcucuccaagcacuuaauucagcugaagcacacagaaagaggauaggcacacaacgcaaaccaaacugaccgguuuugccaucugaaguaugguuguucugucaucuaccaguggauguggccucuggcccuuaggaaccauucuuuugacaguuccccaggacauggcucugguuugacugacuuuguuuacuaaauaaauuaauuccuacuucuggaguagcuucaguuuuuaaacagaaagccaucuauugacagucacugauacacaggauuuuauuguuugauauuaaacaauuaagaguuauuguuuuuuucccuacaaguacacuauacaugaagauaaauauaauguagaauacagucacuaggaguggggagagagggggauucuauaucugcucugugccuuaaaguaacaguuuuacuuuaguaaauccaaaguacauacuguauuucuuucacagaaauaaggcucucuuuuggcaaaaugugcaucaaagacagagucugaugaacauuuuuuaagaugaguuugauuauuaaacaacauuuuuuaaauauccuaagaauuugaccuuucgugcuaguagacuucaauaauuuaaaauuacuuggaaauugcuacuuucaacaaacucucugaagauauacaaaaaaggaaaaugcugaaauaagucaagauguuuacaaauauuaugucuaaaauguuaucucauuuguuaaacccagaaaauaaaaaauaauaaaauaugaaaccauaauuguccgaguauaggacaaagaucugauuuagaaucaggcagagguuuucccucuauuacuccagcaaguucaaauguacucagaaauacaaaaugauugacgguaauaucaagaugagaaacaaaagacaauguuacauccucagguaugauaaguuugaaauuagaugaguuuacaguuggaagauucauuaagaacaacaauucaaaagauauuauagccauaauuuagaagucuugcuucacgagaaaagauaauauaaaaaucuaaaaauuaaguauugauuuuacaagguaaacauggcagccuggauuauaagaaauaucaggcauuuugcuuucucaggagaaagaacaacuggguacaugcugcagacuggcauauaaaucgcucaaagugaagcaguugggaaaugcugucagauuauucggguugaggagcugccccaggggcagaacaugucacaaugucacaucccucuucuuuacucucacaacuuucaccagaauaaacagacccuuggaaaacaaauucaaucacaaauaguaacuuuuuguuaaaacuacaguagcaaacuaccaaaccaacuuuauacauggaacauaucagaacuuuuccauguuuccccaacacaguggaauaaacuauuuucagcuaauaaguucaucuuaggaaaacacucaugugcauuucuaugcaauauaauuguggaacauuguaaccacuucuuaguuuucauuagaggauauugaaaaacccaaguuuaaggauaauucccccuuucccucgaaugcagcuuuuuaaguuuuugacacuauaaaguguagagagugacauaaagaagagcuaugaauauauauaaauacaccacuauggcucccgucauaagagcuuuugaaaaaugguugaacaaguauucaucuucaccaaauugcaaucgcaagauacugacuguuacacaauaugaaacaaaggcaaggugaagggugaggaacggcagaaaggacggucgcaaggaagacaagugccccacaggauagaaccugcucugucuugcgggccccgcuuuucucagcaccuuucugguguucugggcuuuucugcuaauaccauccacaucaucucucagagaaaugaaucucccuuuaaggaaagccaagcaggcauccgagguaacgugcagaaccguaaaugaaaaauguccacgucuagcaggcagacaagcaaaggaaaaccagcugucaguuucagaggcuccuagcuguaacgggguuucggguuucucuccgccucugucucucugucucucucacggugucgcccucaauaauaucagcuuucuaaucaccucaaaucacacauucucugucuguccuugugaaauaaauacugaagaaacaggaaaaacagagugcaauacucacaacaacgaagaauuccuacacaugcuguuccauuuucuugcuuugaaaagauguaaggugaauuuuaaaagccuugcagaauuggaaaaauaaaggggagggggauuccacccacacaauccuccagcccaccgcaaaggagcccaaaggcuugcugacgucacagauucaugaauggauguaaauugggcugguuuaggauuccgcacagacuucgcuguggugugugucaugaaaaaaaaaagaggggcggguccagaguaggcccagccaauaggcuucaggcagacauggccuuccuucuuuuagaaggaaucuggucacagaauaaacagagcccgccaaucaggcaucugccacugccuuaagacagacuggcagcuugagugugugugugugugugugugugugcguguguguguguguguguguguguguuucaagcugugauagucauaaaaacauuauuauuguuauugaaugaaggaaucaaaauagaauuucuguggaaucaaggauaacaaaaaugcauauagaagaaaucccaucuuuuauucauuagaacucuuuucuucaacccuuuucuuacuguucagcaauaugccugaugcgaucaaaacaaaucaaagucaggaaaaccauuucuaaaacuagcagacuaguggacauguaugcccugcucaccacgacuuguaaaagcaaaauugucgggacuuguaaaagcaaaauugucgggaagaacgcaugggaacaauaaucuaguaacuaagaaaacagacauauggaaaauaauauuacacgaauguagcuguuuugcacagcaguaacaucuugcugaccuucaugauguaucaaaaguggauauggaagaaaaauuuacugcuacuuuuaaguaggguacaguguuuccucauugguuuauucaacuucuggcagucgauuaagacacagcuccaaaagggcacuuaaugaaacuuugaacaaauuuugguuucaguaagauguuuuauuauuaacagcaaaaacagcuguauuaaauucacucaagaggcaucucuuucuucuuuauuuuuacacuuuucaguuauacaaaauuggagaugaauauauuuauugucccuacuccccaucacuacacuucacaaugacuaauacuugacaaauacugaucaugauuuuucugaacuugggaaauggccucaauccuugaaacuagaacgaucgugguuaauauaaagccucaguuaugagguguccagugaccaagaacauucugaacagagaucugcucuauuucucaaucagauuauuuauacaacugugagagaaggaaagugguggccuguuucuaagugguucuggagggucuaaaccugaccacuaguaaguauugcacacuucuuagcucauuuggaaaaggaaaacuuuucaggauaauuuuacacacagcaaagauauucaguguacugucuauauugaagcaauagaauaucguuggcaaacaacauaguuaacaaacuucucuaaaggagcuuauuguggaauaucacuacaaaaaagauagaccaaagaaguuuacacauguaacaugggagugcucaaggcaaauacggcauugguacacgcccaguaggccucaguguaccacauuauuuaagaacgaacaugcaaggcacgguggcucaugccuguaaucccaacacuuugggaggccaaggugggcggaucacgaggucagggaucgagaccauccuggcuaacauggugaaaccccgucucuacuaaaaauacaaaaacaaaauuagccgggcgugauggugggcgccuguagccccagcuacucgggaggcugaggcaggagaauggcgugaacccgggaggcggagcuugcagugagccgagaucuugccacugcacuccagccugggugacagagcaagacuccgucucaaagaaaaaagaaaaaaaaaaaacaaaaaacgaacaaauggaaagcugaagaauauacaucucuauuuaacaacaaccaaagccaaucaggauacauuaaaagaaucagauuuauggaaaacauuuuuuucuuccaaaacaauacagacuaacuaauggaaagaggcaaacuuuuuguggacuaugucaauaaaauagccaagaaacaucaauuuguguguguguguauauauauauauaauauauacacacacauauaaaaucuguauauauguauauguauauauguguguauacacacacacacacacacacacacauauauauauauacacauacacauauacauauaaaaucugaggucaggaguuugagacaagccuggccaacauggugaaaccccaucucuacuaaaaauacaaaaauuagcugggcaugguggcacacaucuguaaucccagcuacucgggaagcugaggcaugagaaucgcuugaaucugggaggcagagguugcagugagcugagaucacaccacugcacuccagccuggugacagagugagacucccucucucaaaaaaaaaaaaaaaaaaaaaaaaagcuaaagcuguuguagaaguuuuucuguaaguuuugacagcaacaaaauuacuaauaaguccacuauggaugggaguagucucugaagcaauucaacaaaacagggucuauaaaugcuucuaauaacagucaccuaagauucuuggcucaauauauaaccuggaaaauaaaaacuugggggcuuuauggacuugccacuucaguaagaugauaaacuuggccucaguuagcaugcuuccuguaccacaggaacaucagcuaggccaacaaagacuccuccaugucaacuaucaugggaaaucauuggaaagauaagcugucucaccaaauuauggaagauauagaagucagucuuggaggaagucauuaucauuuuagaagcagaagguaggaagggauauagaggcaugaaaaauguacacucuagagaaguacagcccaagagaacuugcugugauuauggagcauuccauagauuugaaagauggcuaguguucuugaggaagugaauuuuuaauguaaagugauuuaaauuuauuuaacuccaaaauagucacauuuagcugguggcuaugguaugcaacaaugcaacucuagagauaucaagccaagucccaucauuauaaguaauuuuuaauugcagcacaugggcauacuaaguguggaggacugcaaagccauuaucaaggugaguaagcucuuuuaagaaccaaaugaaucuccucaaacuucaguaauaacuggaaaaugacucuagucucauuaugcaagaagauauuuaaaacucauuauuagauaaaaaucuauauauagaaauuaagguacaauaauucugcuauaaaauauaagcuauucuuguuuuggaguuuuuuuuuuuugaggaaaaaaauguguuuuuaaaaaaggaaaacaacucauuuaagccagaaucgaaguccaaaguaucaugacccaugggcaauuuuugucagaaauaccaggaaaaagaaagaguuuagugaucucaaaugcuaauacguggagacucaaauuuccuucacagauaaguguguagugguuaaaagcugguaaagagaucugggcucaaauccuauuucugccacuuauuaguuaugaauauucagguaaaccugaguuucaguuuucucauuauuagaauggggauuauaauagccuauauuauugugugaagguuaaaguaauauuauaacacauguaaagauuugcacacaguaccuacauacagaaguuacucaguaaaugauacugguagcugguuuuauuuuguuauugagacccugcuacucucucaacaagggaaauuucaacaacugugcagauccaggaaucagaaccacaggaacuaauacaacaucuuuauuuugcuuauaauaaaucuugaacagaucugauaugguuuggcucuguguccccacccaaaucucaucuugaauuguaaucccauaauccccauguguugugggagggaucuggugggggguaauugaaucaugggggcaguuccuccauacuguucucaugguagugaauaggucucacaagaucugaugguuuuaucagggguuuccacuuuugcaucuuccucacucucucuuugccugcugccguccguguaagauauaacuugcucuuccuugccuuccaccauaauugcgagguuuccccagccauguggaacuguaaguccaauuaaaccucuuucuuuuguaaauugcccagucucagguacguuuuuaucaucagcgugaaaacagacuaauacaaaaucuuuucaggaaauucuaaaaauaucuauuagugacccaacuuccaaagggaaguucauccaagucauuuuccuucaggugguuggggaauaucuuugggguucugaaacagaucaggggaaccuucagguaguuaugcuagcugaucaagagcucuauucauuguuuuuaaaaagcagcuacauuuuucuacauaaagauguaguuuguauaaaaugaugugaauuaaucuggaaaacaaucugucuccuaguugggaauacuggucagaauucuccacuuucauaucagaauguuaacccuauuuccacuccaaaguauauggagccuuggucaauaacugaauuucaauauucaaagaccucagcagauuauuauuaauacugccauuuuucucuguccagcucccauuaaaugccuaucugagaaagugauuuuuaagaaacaucuaaggaaaaacauucuuauaaguucacucaaaucuauccuugugucaagggagaucaucagaaagcuacaugcuaucuaaauaucauuagccuaauaccccuuagaagaauaacuaucauugaguguuguggucuugcuuuuauuaaaaauuauuauaaggaagauucauauugcuucuguguuguccauuaucuugaaugauaucucccauguaaggaauucacauggagaauuuguuuuacaacuuaauaugaaggaaaaauuuucuguucuugaagaauuauuaggugucugucuaccuuuuagaugauaacaguguaauccacugaauuuucauuuuuucgacccugcugcugggaagcucagagccaacuuuaaaauucauaugcuuuaaaauaagcuaagcacaaaaguauauauuuacaugcauacuugcuuucucuuccuuguuuuggguuggauuacucuaugguuaaccuuauuauauacauucuuuuuuaugauaagcacuucaaacacuuuuugaaaagguaugcuauaaauaaaaauuugcacuaaauacauaucuguaaacuuuuaagaagauuaaagccucauguuaaauucuacagucaucuuuauauuaaagguacacauuauggcaaacuuuaaagaauauugugaguuaauuagacuuaacuauucaauauuuuuaauuaaaggauaauaaaauaucuagccagcuggagaaaagcaauugcuugagauuuuaugugcuauucagaauaagucuuaacagcuuaaugaagcuuuaauguguuauuccugucaaaaggaugauuaccaaugagggauauaagauucuucucugacugauaacacaaauguacugaagcaaaucaaaagcagauggauuucucaauuaauaaaauauuuaccauccccaaaauacaccauuccauaacauacaaauucuggcaaaauaccauaaaccaaaccuuugcaggauuaaaaauaauauacugaguuugcaaagguacuuuauacacugaaagagcaaaagaagacuuuauagauuacuuuacucauccacauagaauucauacuacuuucuuucuuucuuuuucuuuuuuucuuuuuuuuuuuuuuuuuuuuagauggaguuucacucuuguugcccaggcuggagugcaauggcgcgaucuuggcucaccguaaccuccgccucccggguucaagcaauucuccugccucagccuccugaguagcugagauuacaggcgcccgccaccacaugcagcuaauuuuuuuuguauuuuuaguugagauggggugucaccauuuuggccaggcuggucuuaaacuccugaccucaggugauccgcccgccucggccucccaaagugcugggauuacgggcgugagccacugcacccggccuagaauucauaauacuuucuuagagcucauguaaaaagagagagagagagagaaaaaaaaaaaacuucuuaacucucuaacuucuauucuuugauucuguuuuaauuucuccccuucuuuagcuagacacaaguuggcauuuccacuguagccacacauugcaugcaauauaauuaaagaccaaaacaucagaguaguggauaucugccuuuuaaagucgggcggcagagcgagacuccgucucaauacauaaauacauacauacauacauacauacauacauacauacauacauacaugaagucugccucuguaucauccccauuugaaggaaauaucucucccccacuuuuaguccauaugguucagauagggaugaccccaucugaagcgagugcuccaagagugagcacguggcacaaggauggccaacucaacucccuggucguaauaauuagugaaaggauagacacauccuccaagccagccaauaagcauaaucugagucauccccaggauguuugacaacuauuggcugggugggggcugaacauuuguuucaucaggauacuagcuguaaggacaaguaggcagagggcugucgucuccauccauauaucgggcagaggaaagcagaccagagauaaaggaaagaagacagauuccugaaaaaggccacuggacaucuaacuucagucuugucugaagccaguuacucugcuggaccucccaauuacauaagccaaucaaucccucccuccuuacucccuuuaaaaaacacacaaacaaacaaguuugauaaagguuucugucacuugcagccaaaagaguacuuauuaacacaaugucauuaauugauucucuuucauccuauucaagaaaaccaaauuaaaaucagauucccuguacuauagaauuccuuuucugacauuaauaauuucaauauauugguagacuaacuuucaaauucugucuucuaacucucacaugguguuuacacuuuauuauuauuaucuuugucaccaucaaaaguucgacauuuuaaagacccaguauuuccucucaauagcaagcuguaucuuugauauuuugaagucagugaccuucacagaaaucuuuuuaccguuuaucucaauucauccaggcuuuaagauacauuaauucugaagcccugggcaagguuacuuaaauguucacuuaaaugacucacuguaaaauggaaguaauuacagguauagcacagcaccucagcaugguaaacaauguuaguuauguuacucaauaaccucauaaucaaaacuauaacuaaacauauuuuauauuucugaauuucaugcauuuucucuuagguuauucuuauucugugguugacagauuauaacuuugaaucucuuaauuuuuuuuucuauuucucucuauucaaagguuauaaaaguguauuuuuccugugaccuauccuuuuucugaccuucauuuuaaagucaauucugaguucucuuugcuuuuuguuuguuugguugguuuuuuugagacggagucucacucugucguccaggcuggaguacagcagcgugaucucagcucacugaaaccucugccuccuagguucaagugauucuccugccucagccuucugaguagcuggggauuucagguguacgccacuauguccggcuaauuuuuuuuuuuuuuuuuugagacagaguuucgcucugacacccaggcuggagugcaguggcacgaucuuggcucacugcaaccuccgccucucggguucaagugauucuccugccucagccucuggaguagcugggauuacaggcacgcaccaccaugccaggcuaauuuuuguauuuuuaguagagauggguuuucgccauguuggccagucucaaacuccugaccucaagugaucugcccgccucagccucccaaagugcugggauuacaggcaugaaccaccgugcccggccuuaauguaucuucauuauauuacacucuuuuggaguuucagauaucuaaauuccagaaauaauaauugggagcaaaucugguccuagacauucuuuguaaacgaucuuauacugcacuuuacaguuuacaacuuucuuuaaaauaggguaguuguugguuccauuuuacuugugagaaaauuagggccccgggaagauuggcucgucuaauauagcuuuuaucuaaacucuguuaucuauugaaacugacuauacuuuuaaauucuauccauuaccuguuaacccucccccuuuaaagaccuguuuuucaucauccaaugaguaaaauuaaggauaaauuuuuaagaaguagcaaugcaaagauuaaaaagccaguuucuaaguaucaaggagcuuuggugagaugaguaacaauacaaaaugguguagauguuaaauuagugggguagacaggaauguuuuacuugaauuugggauacaauacuagaagaaagguaacugaaauuugggggcaagaauagacuuccuugaaugggaccauccuacacacagcaacacauuuaguacccugccccccccccauacuuauaacagucccaguguuguucuugaggcucuugaugagcucuacuugaggcaucuuuauucuugucacauuugucuccagggcacuuagauguuucccuaagggacaggacauaucuaucugcuaagggucugcuccuaccucucuaugucaacagagggcagcggagagcaucacccgguagccuaaccuauaggcuucaaacgggggcaaugcguacacuccccaggcauuugcuucccuaggcacuuggauugccguugccccgguuugaagccuacagguuaggcuaccgggugaugcucucugcugcccucuguugacacagagagguaggagcagacccuuagcagauagauauguccugucccuuagggaaacaucuaaguccccuggagacaaauaugacaagaacaaagaugccccaaguugaggcucaucaagagcucugggaaugugaagugaggcugagucaaggccaagagccgcucuuccuagaccagaugauagccgauacuuacgauuuacuuaucuuuggcaaguuggcacgcuugugaagggaauaaaggcuuguccuuacacaaacacagccuggucuaaugcugcaguuugcucuacuagucccagucugcacugccacccucuuacccagagcuugaauuaagucuuucuucucuuugauggaaugaccauuugggguuggcgggggcggggugugguuauggucaguuucaacaaggagguagaccuugaaggggaaggauuuggggaaacuggauaugagagagcagggacaauucccccaagguccauaucaaauguaaaacugguaaggcauacauuaguacuuuucauucuaauauaagauuacagugugugaguacagcaagugaagaacuagaagucaaagaugauaagauauuaacacugaaucaguaaauugugaagucaguuuuaaaaugagccuuauaugaccauccauaaacagguccauacuauguagagucauacuguuaagucaaguuuagccuaaagcugccuccuuauguauuuaaguuuggccuaaagauuuuucuguauauuguaaacuguaacaaguagagguguaaaccgaccguagcccacaccuaugccaaucacuggguuuuggccaaucaaauguagccaacuguucgaaccauguucaaauaaggcaaauacugagcuggaaccaacccagcuguuucugccccucgcuuccguuuucuguacugucacuuuccuuuugcuguccauaaauccucuuccaucccauggcugugcuggagucucucugaaucugcugugauucugggggcugccaaguucacaaauuguucauugcucaauuaaacuccuuuaaauuuaauuuggcugaaguuuuuaacaauacccagcacuauagucaucucuuuacuauaaacacugaugaaggggacagagggggaaggacucaaaaaucuuucagggaaaaacucuguuuuaaaguguacucaugaauguaauuauacguuauguccaggaaauacacuuacaauuaaauaaugaagccgcauuggaaagcucuugguuuuccauuacguguaauuguacuaccucaagauaggauaguaauaucuuuaccucaaguaguaaaagauaguaguugcuacuagcagcaaccugcccugaaucaaucaauuuauauuguauuuuuaaacuuuuacuucauagguuccaauccagucuguucaacuagguugagaauuaaagcuguacagguagcauucauuaaacagguaauaaguagauacaggagaauauaggaaugaggaagggggcuggccauagugcuuuuuuagauacucugaacaucaauauauaaaucaaguauacauuuuuuuaaugcaugccaucuauguucaagauaacauaugcugguguauuuacacagagggauaaaucacagagccugaucucagccuauuucacuagacaagaaacacaauaaauaggaaaauaaaaauuguuuuaguggcuuaaaauuauaacagaagguagagugguagagauuguccucgaauauccaaucuuuccucuuuccuuuugguaagagaauccuugauccccacuccuacuuuuuuucuuuuuuuuuucuuuuuuagacagaguuuugcucuuguugcccaggguggagugcaauggcacgaucuuggcucaccacaaccucugccuccuggguucaagugauucuccugacucagccuccugaguagcugggauuacaggcaugcaccaccacacccggcuaauuuuguauuuuuaguagagaugggguuucuccauguuggucaggcuggucucaaacucccaaccucaggugaucugcccgccuuggccucccaaagugcugggauuacaggagugagccaccgcgcccggcccccacucuuacuuuuaaaguuuuagguggguacguggccacucugcuaaauaguucuguacuuuccuggcuguacacgugaccacaugacuaaguucuagucaaugagaugugagugagugagugauguuugcaacuuccgggucuuguuagagaugaagcugcuguccuggacucuuuuuccucauugccacacugagucaacuuguaccaugcagaugaugacaacacccuaggcaauggcagaacaaauagaaguaacccugggcuuugaauauucuaaugaaucaaagcugucuaucuguccugaauuaccugccugcuuuaggguugcuaaugaugaguguucuuccuuuuaugaggcaccaaauuuuuugagacucuguuacugcuacuuacucuaccccacuaauauauccugcuacuugguguuacguggcuauucauuaaaugagauaaguaaaugauugcucuagacauucugagaauuaguuacucagagaaccaagauacugggagaaaucuuaaaacucaaucuacucugucuuccuuuuuuuaacauaugaauaaaugcaaguucagagauuuguccauagucuuggaauucauggcagagccaggaauugauuaccagucuccugggaucuucuuugcaugacaucaucccaucuguggauaacagugaccacuaacacugccucuuucuuuggcagagucaguuaacauucacucgguaauccugggacauagaaaacuguccucaauucuaaaggaaagccaacaagauuuuuaaaaucacauuuuaaaaaacuuuuauucuaguuucaggcauauaugugcagguuuguuauauagauaaauugugugucauggggguucaguguacagauuauuucaucacccagguaauaaacauagugcccaauagguaguuuuucagucugcauccuccucccauccuccaccuucaaauaggcccugaugucuauuguccauguguacucaauguuuagcucccacuuauaagugagaacacgugguguuuagugcucuguuccuguauuaguucacauaggauaauggccuccagcuccauccauguugcugcacggaauauuaucucaugcuuuuuuauggcuguguaguauuccaugguguacauguaccacauuuucuuuaucuagucuacgguugauagguugauuccacguuugugcuauagugaagagugcuaugaugauuauaugcauguaugugucuuuaggaaagaacgauuuauuuuccuuugaguguauacagaauaaugggacugcuaugucgaaugguaguucuguuuuaaguucuuugagaaauugccaaacugcuuuccacaaugguugaacuaauuuacauuccugccaacaguguauacacguucccuuuucucugugaccuugccagcaucuguuauuuuuugacuuuuuguaauagccauucugauuggugugagaugguaucuuauugaaaaaucacacauuuugucucaaaaguaucugaaauguaacauaagagaaaauacuagcauaccauauaguaugauuaaaacaaggaugaacaaacaagaaacauggacccaagcaauuauagucagagauccaacaagauauaagugacaauggucauaaaagugucauaggaagccaggcgcaguggcucacgccuguaaucccagcgcuuugggaugccaaggcagguggaucaucugaggucgugaguuugagcccagccugaccaacauggugaaacccagucucuacuaaaaauaagaaaaauuagccaggcaugguaaugcaugccuguaaucccagcuacucaggaggcugaggcaggagaaccgcuugaacccgggaggcggagguugccgugagccgagaucgcgccacugcacuccagccugggcaacaagagcaaagcuccaucucaaaaaaagagaaagugucauagaagcaguugugauaacagaagugcuuuggaaauauagaaaauacgauucaagaauccuuggaucaauucauaagugcucuguugaaccuaauaaaacaugcuagggucuggaaauauauuuuaaauucuuauaaaaauuucuauuuuucuguggccuggaaaauuuugaugcuuuaaucuuuuaaaaaccaccucagaaggcuuuggccccagggucucccuugugcugacuaaccaacaauagacauucuuuacuagaaaccugucuucuaagcuguguccuugcugaagagaaagaguuccugccuacugcaguguacgcacacagcaugcuaagagcauaugaaaagaaggggagucuuagggagacaugaaaggaaagagucaccauaaagcaguuaacuucauuuauucauucaggagacaguucagagcacuugguaugugcuagcacugagcugagaucugaugauaaacacacaguccucgcccugaagaagcuuacagucuagaacuggaaaguuuccuuucuuaauacgucucacauacagaauuugggcugggauggaauuaagggugaaaaaauuauucauuccaaaauacaguuuuugaaaaccacuccagaccaucuucaguuaguugaaucccaaucuguucuuucucauuuugagacagucuuaagauuggguagaucauauacaccauggaauuccacagacccauaaaaagaaugaagucauguccuuugcugcaacauggaugcagcuggaggccauuauccugaguggaugaaugcagaaagagagaaccaaauacuacacguuuucacuuauacgugagagcuaaacaauggggacacauguacguaaagauggaaauaagagacauugaggaagggagggaggagagcaaggacugaaaaaccaucuccuggguauuaaguucaauauuagcaugauggguucaauagaagcccaaaccccaccaugacacaauauaccaauguaacaaaccugcacaugugccccuugaaucuaaaauuaaaaaaaaaaaagaauaaguagaaauggaagccuuugauuacaguaccauaugcuuacagcugcugcuuguuccuaguucagaacaaucugauuucucugccuuugaaaucaccauuagcuuucaaccggccagaguaccaagugcuccucuuuucuuuucaaaacccauaaccacuaggccuaucuuuuauuuauuuauuuauuuauuuguuuguuuguuuugagacagagucucgcucuguugccaggcugcagugcagugccgcgaucucagcucacugcaaccuccgccuccuggguucaagcgauuguccugccucagccuccugaguagcugggacuacaggcgcccgccaccacgcccagcuaauuuuuguauuuuuaguaaagacaggguuucaccauguuggccaggauggucucgaucucuugaucucgugauccacccgccucggccucccaaagugcugggauuacaagcgugagccaccaugccuggccaggccuaucuuauagccacuccucguggucuaggggacagaauauccaccugucaguauaguuuggaaagaaaagcagcauguccauagguccccuaugguaguguugcuugcuccuguuaugagugaauuacagaaaaugcuugucuaacuuuagggggaauguuaugaucuagagaaaacuauuauaaauacucgagagauguauugggccuaaauuucaaaaugagcaaaaugaagcuccauugaauaucauucaaaauggaagcaguggccuaaaaaggccacauuuucuuagauguguuuuuaguucauuaaauuacucgaggcuccauaauaaauggucaucuucaaaaggccauuugucuagaaaagaggcuggugucuugaaguggcuuccacuauaaguaaauauaaagagagguaggaggaaaaaguagaauuccagaaaaccaguaaaauauacuguaauuaguaaacaaugcaacauuugaaaaauuaaaugcauuuuccccaggagauuauuuguuggagcucacugcuuaguuggaguauaaaauagucgccaauuucaugcuacauuuauauuucuuuuucuuuucuuucuuucuuuuuuuuuuuuuuugagacggaguuuugcuuuuguugcccaggauggagugcaaugaugcaaucucggcucacugcaaccgccgccucccagauucaagcaauucuccugccucagccuccuaaguagcugggauuacaggugugcaccaccacacacaccuggcuaauuuuguauuuuuaguagagacaggguuucaccauguuggccaggcuguucucgaacuccugaccucaggugauccacccgccucgacuucccaaagugcggggauuacaggugugcgccacuacgccuggcuacauugauauuucugaaaucgccuccauuacaaguucuucacauuuagggcaaguucuuuuguauuguucccucaaaaugccuggugacauuuucaaucgaaugaaagaaugcuuucugcugcugccaucuacugcaaacuuaaaaaauguguuuuaaaaaugugaaagagaaaaugggcuaguauuaaagaauaauuuauaagucggacaaguagaccgagaucaaugucaugcuuuacuuuuaacuaaacuauuaauuauuccaggccucugaaugaugaucaauaaggcaauguauaagaaauagaguaaauagagauguauaaagaaauagauuaagcuacacagaacaguauuaaauggcuuuguaaagcuacaccuugauauaucuguaucuguauacauaaucuguagucuguccaauauauaaaagcaaaucucggccaggugcagugguucaugccuguaaucccagcacuuugggaggcugagguggguggaucauaaggucaagagaucaagaccauccuggccaacauggugaaaccccgucucuacuaaaaauacaaaaauuagcugggugugguagugcacaccuguaaucccagcuacucaggaggcugacgcaggagaauagcuugaacccgggagguagagguugcagugagccgagauugcgccacugcacuccagccuggugauggagugagacucugucuaaaaaaaaaaaaaaaaaaacuuccuuugugcuaugaacaccucaguucaaaaguagugcaaaaugcacuuuuacuaauuugaacaaaugugaguucaaaaauuaucaagguagauagauaagcauacuaauaaggcagagggaggaggaggaaaaggucaugaacaagcaauucacagaaaaaaucuugcacccuuuggaaaggguaaggcaaaauagauacucuuauacacugcugauggcuaaauaauugcugcaucuuuuuugaaguacaauuuggcaauagguaucaguaggcuuaaaauguagauaucuuuugacccaaaauucaaguuugagaaguuaauucuaaauaaauaaucaguacuuugcaaaacgaucuagcuacaaggacuucaucacauaauuauuuaaaacaaaaauaacugggaauaauauaauacuccuaacaauggaagguauuaaauaaauuaugauaaaacuauucaauagaacacuuaaaaccuuuacagguuguauacuaaaauguauaggaacagguaaaaauauucaugacaaagugugaaaaaaggcaguccacacaauaauagauaccaggugaucuaacauguauagaugacuagaagguugaaggauacagaucauacauauaucaugccuaucucuggauauagagagacuggugauuuuauuuucuucucuuuuaguauaaauuucuagauuaucugugaaguacaaauguauugcuuuugggaaaaguuacaaaaauugauaagauaagaaaaguucacugcuauuuuaaccaaauuauuuuaacuuuaagaaaacgcguuauugggguuuuggggagauguuggucaaaggauacaaaauuucaguuagaaggaauaaguucaggagaucucuuguauaacacagugacuauaguuaauaacaauguauuccacacaugaaaauugcuagaauagauuuuaaauauuucaccacaaauaaauaauagguaugugagguaaaacaaaaacaaaacuuguuacaauuuuuucccuucuaauuuaagcaagauagccugaaaaugauucuguaauacacuaugucagcaguucccaaccuuuuuggcaccagggaccgguuucaugaagagaauuuuuccauggauuuagggggcgggaugggagggggugguuucaggaugauucaagugcauuacauuuauugcgcacuuuauuucuauuauuacauuguaauauauaaugaaauaauuacacaacucacaguaauguagaaucagugggagcccugugcuuuuuuuccugcaacuagacagucccaucuggaggugaugggagacaaugacagaucaucaggcauuagauucucauaaagggcacgcaaucaagaucugucacaugugcaguucacaauagguuuccugcuccuaugaaaaucuaaugccaccgcugaucugacaggagggggaacucagggaauaaugcaagugauggggagcagcuguaaauaccagaugaagcuuacuuacuggccugcugcucaucugcugugcaguccaguuccuaauaggccacagaccagcaucagucaguggccaggggguuggggaccccugcacuaugcuguaauagauagugugucuuuucacuagagugagggauggucauggcugagauauacauugaggaggugggaggauuuggaaugaaaagccuuaaccggaagaagguguaugcguuuacguguguguguguguguauguguguguguauacuuuuuugagagaaaacagaaaagugcagauggcaauaaaagaugaugagauuaguagaaauggggccgggugcaguggcucaugccuauaaucccagcauuuugggaggccaaggcaggcgaucaccugaggucaggaguucaagaccagccuggccaacauagugaaacccugucuuuacuaacaauacaaaaauuagcugggcaugguggcgcaugccuguaaucccagcuacuugggaggcugaggcaggagaaucauuugaaccugggaggcagagguugcagugcacuccagccugggagacagagcgagacucugucucaaaaaaaaaaaauaaauuaugagauuaguagaaaugaaguugcgagaucccauuuccaauaacauuauagaaggcagaucaccuggugaaaggaaaaggugacagauuugggauucuauggagcaagagagguuucaacagccacugugggaaacagucgcuagaaaugaaaggccaccaaucagccaugagggccuaacugaggaugcaaagcaaucaacgugguagcugaaaauacgauuaaggcgguacucuguguugggcauagucagaggaggaaggaccaaaggcugauaaggggggcggaagugauuauuaaauggcuaaugauauuuccaaguuggauggggcauaaauggaaaggggucaagugcauauucaguuugguaucuacugccauguauaguguauagcagagcaggguaauauauguuuaagaaaaaagaagugaggagaaacuguguaaggagagggguaagauaauuaacugagcaccuauuauguaacagauucuuuugucacagaucaucaagucucuucuuauuggcuggguuucuccuuugccuauaagcccguccaugucucuccuuuucaaaauuuccuucugacuuaucuauucacuccccuuuucuuuaccaccaaacuucuugaaaaaacacuauauaccaggacuagcagauacuaggcacaugugccucuaugccucuucccagacccauagcagguauagacaguagaugguggcacucuuucccacagacauacuccaucaacauaugcaaaauuggguagcaucuagcaaagggccuuguguaugggaaacauucaauagcaauuuucuaaaugaaugaacacaugcauaucuuauagcaagguagauuugugauccaucacauuuauuggaacaaauaagaaauguuuuuccacuguaucuuugaucuccuggaaauggguucccuuuaggcuccuaaaaauagcaccuuuggcuccuuacaggcaggaagcccuugcuuaggucaaucuaguuagcugcaugccaagcuguuucuaacuacaguacauuccaguuugaagguauguuuugggaucauguauaucuuuuacccuccugauuuuuauuauuccauuucuagucauuaaaaaauauccagccaggcgcaguggcuuacaccuguaaucccagcacuuugggaggccaaggcgggcagaucacaaggucaagagaucgagaccauccuggccaacacggugaaaccccaucucuacuaaaaauaccaaaacuagcugggcaugguggcacgugccuguagucccagcuauucgggaggcugaggcaggagaaucacuugauccugggagguggagguugcagugacccaagaucacaccacugcacuccagccuggcgacagagcgagaugccgucucaaauaaauaaauaaauaaacauacccugcugagagucguccguuugcagcacagaggaggaaaaaaauaaaaacaaggcacuccguugccuuuuuagguacagaaaccaucuuugauaaggcauuaauuccacccugcaaguaggauuuguguaaucuccaggcccauuauggcagacaaacucuuaaggugccccucaugauccuuaccuucucguguucacacccuugugugauuccccucuuugaguguaauacuugcuuccaaucaauauaauacagaaaaggugcugggaugaacaugauuacgugcacguaauaugugaauaugcuauauaaaacuggagcauuugucuggagucucuccuucccucgcuagcuauaaggaggcuaguggccauguuggggaaccccgcauggcaaggaaauguggguggccucuaugaccuaagggcagacuuuagccaacagggagaaaaaaacaaaauaaaaaaaacuguaguucucgguacuacaaccacacccuaaaaccacaaggaagugaaugguguuaauaacuuaugucuaugaguuccccaguuaagcauccagagaacgcagcccugacugaagcuaugugagacccucagagaaggacaaagcuaggccaugcccaguaacugaggugacaaauguguauuguuuugagccacugaguuugugauuauauuguuacgcaguaagagaaaauuaauacaccuacagaacuucacacuauuccaucuagagacaacuugcuuuacauuuacaggaaacauuuacaaaaagcaccuaauaaagauuauaauggcauacucuaauacuccuuuuuguauaaauaauagugaguaacauaacaaacaucuugccuggugacucaagcaugauuuauagaccuaauaucaguagcaauaaucauaucuaguacuguauuagauagagaauuaugaaaauauucuugccuuccaauguccuuuguuuccuaaaagucuugucuaugucaucuuggaguuucuuuauauaaaagucucguuuuccaguauguuucuaaaauagcaaaagccuguggcauagauaagacagacagagcagcuugcagguugcauugaaaacugcagaagggacagaugaguauacuacuugugcacugcagcaugcagauugccccaaaacguaacaacucaaagcaacuaacauuuauuuucucauacagucucugaggggcaggaaucucggagcagcaugggugagugguucuggcucagggucucucauuaaguugcagucaagcaguugaccagggauguagucaccugaaggcuggaggaacuacuuccaaaauuguucacucacauggcuguuugcaggaggccuugguuacuugucacgugggccuuucugcagggacaucugagucuccucaugacaaggcagcuggcuuccccuagagcaaguuauucacagcaagcaaaaagcugcagugcuucuuaugaccuaguucagggcuuggcaaacuuuuucuuaaagugcuagauaguaaauauuuuagauuuguaugccuuauagucuguaucacagcuacucaucucaguuguugucauguaaaaacagccacauagaauacacaaauaaauaggcauggcguguuccaauaaaacuuuauuuauaaaauaggcagucagccuguggacuauaguuugccaaucucugaccuggucuccaaggcuggaaacuugaagccucuugcuccuucuuuauucuauucauuagaagcuagucauuagguccagcccacacccaaggggagaggaauuaggcuauaccucuuaaagggaggaauaaaaaagaaaauuuagacaugccuuaaaaucacuaccacaggcuuaacacagaaagcagaauguggguuaaacguugcauuaguuucccgggcauauuucaacaaauuaucacaaacugguggcuuaaaacaacagaaauuuuuucuuuuacaguucuagaggcuagaacuccaaaaucaagguguuggcaggcccaugcuccugcugaaggcuuugggaaaaaaccguuccuugccucuucauagcuucugauggcuccuggaaaucuuugaugcuccuuggcuuauagcuucuucacuccagucucaaccucugucuuuacaugguccucuucucuauauauuucucuguguguccucuccucuucuuauaaggauaccaguuguuggauuuagaguccacccuaacuacuaugaccucauauguaacuaauuacaucuauaaagagccuguuuccaaauacggucacauuuugaaguucugguggacgugaauuuuggggggacacuauuugguguugugguguguugaauaguaugcccccaaaauucacauuuacccagaaucucagaauguaacuuuauuuggaaauaaaguauuacauuaguuaaguuaauaugaagucagacuggauaggaugguguaauaguccuuucucacacugcuaugaagaaauagcagagaauggaucauuuauaaaggaaagauguuuaacugacucacaguuccgcauugcuggggaggccucaggaaacuuacaaucaugguggaaggcaaaagagaagcaagcaccuucuucacagcauggcagaacagagugagugccagcaggggaaaugccagacccuuauaaaaccaucagaucuugugagacuuacucacuaucacaagaacggcauagagcaaacuacccccgugaucuaauuaccuccaccuggucccgcccuugacacgugaggauuauggggauuacaauucaagaugaaauuuuggguggggacacagccaaccauaucagaugggcucuaaauccagugacugguguccuuauaaaaagaaaagggacacuuaagcccugaaauaucuuagggaaguuucucaucauccucaggauaaaguacacauuccuuaacuugguaccuaaagccauuccugaugcgucuuuagcaacuucucuguccucauuuccugccacuuccuuaauauucacucuagucaaaugcaacugcuccuucucccaaccuauuaggcugcauggccucacugcuucuucucccuacagugcccugucgccucuuuuccuuggauacagggaaguaccccauaguuuacaucagguuuuauuugcaauaagaaugucaccuaaugugaacugcauacuuuauuccacaccuuuuguaucauuaaaaaaucuuugauuauauauucuuuacauacauuaaacucauaaucucgugcucaguauaaugcugacaaugcuauacauucauguaaccaccacccaaaacaagaccuaaaacauuuuuauaaccucuagaaaguucccuggugcaucuuuccagucaauaagacaccuccccuccaccccuuaccaaauauauuuugacaaaaaaaaaaaggaaaagaaauaauuaaaggucacaaaacaauaauaacuuuucccauugguuauuaaaacugcuuugcauaguuucagcuugcaugaucauuuuuagagucccauauaacuaagugagggcugucuguauguuuuaauguuuccuuuuauuuucuuuucaccauuuuagcuguaucugugugugaauaguugcuguaaagcagagguagacaaacuauagcccacgggccaaauccagcuggcugcuuauuuuuacaaauaacacuucauuagaacacagccucucuccuucauuuauuuauugucuauagcugcauuugugcuacaauggcagaauuagguaguugcuacagagacuacauggcucacaaaaccugaagauauuuauauguggcccuuuauagaaaaaaauuucccagccccugcucuaaagcaauguuuuguaaaguuuagcaugcaucacagucacagaaaaacaaaucaugguaccauacccccagaguuucugauucaguuaggccugggguggagcccaaaaauuucaucucuaacaagaucccagguaauauugaugcugcuggucugcagaacacacuucgagaacacacuguucuagagauagcauuuuauuucauuucauuucauuucauuauuuuaguuuaguuuaguaguuuuuugagacagagucucgcucugucacccaggcuggagugcaguggcacgaucucaucucacugcaaccuccgccucccugguucaagcaauucuccugccucaaccuccucaguaccugggauuacaggcacccaccaccacaccuggcuauuuuuguauuuuuaauagagacgggguuucuccauguuggccagacuggucucaaacucuugaccucaggugacccacccgccucagcuucccaaaguauugggauuauaggugucagccaccacgcccagccuagagauagcauuuuauaauuuuaacuuauuacacuuauuauaccucauauaccacacuauuuuguuuccaccuuuugugcucuuguuauuaugucuuuuacuuccuuauacacucuuaacucuauuauacauuguuauuauuuuugcuuuaaacaggccagaaucucauucuuuguaaauuaacacaaguaaaauugacuuuuuaugguguauaguucuaagaguuuuaacuuauauguggauucauguaacugccaucacaauuauucccucuguuaaaggauguagcaggaaaggggagcaugaacaaauggggaaguugaccacagagauggaaaguauaaaaaagaaucaagaagaaaugcuagaaauaaaaaauaucaaaauugaagaauuaauuugauaggcauagggguaauguuauauaaugaaggcaacuucuguacuaaguuguaagguuuucauaauauuuuccuuauucagugaaccagcacuauuaacauccacuuauauguuaguaauuuccaacuugcuacuuauggcuucuaagucauuucuuguauaauuucuuaaguacauuguuugaacacuugauucuugagccuuuugacugggaaaaguucuagcaaaauuauuuucuuuuuuacaguuucuuaaaacacccauaugagccacuuguuuuucaugucuuuuuuuuuuuuuuuuuuuugagagagucucacucugucacccaggcuggaaugcaauggcacgaucuugguucacugcaaccucugccuccuggguucaagagauucuccugccucagccucccguguagcugggauuauaggagcacgccaccauacccagcuaauuuuuuguauuuuuaguagagacgggguuucaccauguuggccaggcuggucucgaacuccugggcucaaguuuucugcccgccuuggcaucccaaagugcugggauuacaggugugagccgcugcgacuggccauugcuuuucauguuuauuccuaugggucucauuaucaaaucauuuuucagauaauaguuuauacaggcagcccuuuacaauuuuucagugaaugacuuuuuauggucuuuccuugaugagcuuguuuccuaguuuguguuaaccuaguuauuuuagggaguuuuagugaggaaaauuuguaguuuccuagauacuugggagcuauuguguccccuccccacccccaccauauuauuaaauucugaaaacuggacagacaauggaaagacagccuagaggugaggcccaguaguucuuaaaccuucugauuauaaauaauaaagaaucagguugcuagaaaagagaucaaguuucagugacuagguccagguuaauaaguauuagaguuauauaagccucuuuccuuucaccuccuacaacccccuauaugccuucuguggaauuucucaucuucuaaacacccauuuuauguuaacacaggcccgaaaucaguuuucaaguucugaugugaaauucuuuucauuaucaucugcguuggcauucugccuccacuuauuugccuaaguguuucucuugcccauuuuucuuagaugagaugugucauaaaauaccguaaagcguguguuuacuuuguguugccuuuauugaaaauuagagaaaaggcugcuguacuuuccagguguucugugagugucugugaaacauccuguguaaguugcuucuucuaaguuuguauugcaaguguauuuugaaaugaauuuuaccaggauucaucacaucauuuugcuauggaaaccacugcuacgcaucucacaacauggcauuaaagaccgagucauuaggccggcugcgauggcuuacaccuguaauccuagcacuuugggaggcugaggugggaggaucacuugagcucaggaguucaagaccagccugggcaacauagugagaacucaucucuauuuuuauuuaaaauuuuuuuuaaaaaagauuuagucuuuaaauuacagagucaugcucaaaguaguauauuuuauuguuucauuauaaucacguuuguuguucugugaggaaggcagaaugagauauuauuaucccauuuuccagguugaggagcugagacacagacagaugauuaaauaagauggcacaugaggaaguaucuaggacagauccugguguacauguacauagauacagacauaaacacacauauauucauacuuuuuuuguaauaaggggagggcaauaauuuuuuucuuuaaaagaguauauuuugcuaucaaaaggcaaauuaguggcagaucuaaaguuaaagccuuuuaacuuccagucauguauagucuaucuaguaagcccuauucagaugacauugaugacauuuccauaucucauuauuagcuuuccacauucaggagaaacugauaucuauaacaguaguucaauuuuaaaaauacaauccagaaauauuauuccuuaaacuuucuuuucuuuuuuuuuuuuuuuugagacagagucucacucugucacccaggcuggagugcaauggcgccaucucggcuuacugcagccuccgccuccuauguucaagugguuuuccugccucagccuccugaguagcugcaacuauaggcaugugccaccaugcccagcuaauuuuuguauuuuuaguagagaugggguuucaccauguuggccaggcuggucuugaacuccagaccucaagcuaucugcccaccucagccucccaaagugcugggauuacaggugugagccaccacacccagccaauuucuuuucuuuuuauauuuauucugacauuacauuccauuuugacuucuuuuugagauuuauuuuccugaacaggaugggccuugggucaaauucugguuaaggugaaguuuggccucuacucucucuucugguuccucuccuacuucuuaugugacaacucauauuccauaaaacuucaguucaugggcagcaacagcagguaggggaaucugauucaucaguaaacuaugagucagagaccaggcaugcuacagaaucuagaaugcauaaagacugucagucuacagcccuucaagccauuaggaacuaggacuauaggagcugaguacagagaagcaaaggguuaauaaccuggaguuugcuaggcagugagagaggagggcugagcaggccaagccaguacaguuggcccuccuuauccuccucacuaucuguaaauugaaaauauuuggggaaaaaauugcaucuguacugaacauguauaggcuuucuuauuucauaaauaauaaaguauaacaaugauucacauagcauuuacauugcauuagguauuauaaauaauuagagaugauuuaaaguauaugagaggaugugcauagguuacauagguuuuauauaaggaaucugaacauccuuggauuuuguuaucccuaggaggucguggaaccaauccuccaccgauacugagggacaauauauauggaaccugcagcaaggaaaaugaaaaaugcuuugcaccuuuagucacucuuugccccucuuacuagggugaauucugcuguaaugugacauuagccuagaguaacugcaacaguuggcuggccaaccagcaaauaggggaugggguguaaucacagcucuuugggcagaaggguuuucuuuacucgaguuguugaagggaaggggauccaauuacauuauuuuguaucaaagagggggcuuauuauagcucucaaaaauacuauauuuugaggagagaaucaaagcaacacuucuccaaguauguuccauguuccagaugaauaaaggauucugugaucaaacacuuuagaaaaugcugcaugguccucuuacuagaaacauuaacauauuaaagguccuaagaaguucuugcaauaaguucauuuaauuguauuuaauguacuauuaugguuagugcuuuuaguguccuucucaagaaaucuuugcauaacccaagauugcuguuuuuuuuuuuuuaagguuucugguucuauguuuagaucuaugauccaugucuauuuaucaguacauccaugucuauugcaguuuuguguagagugagagaggcaugaaauuuuuucccccuauaagaaaauccauuuguuggcugggcgagguggcucaugccuguaaucccagcacuuugggaggccgaggcaggcagaucacuugagguuaggaauucgagacuagccuggccaacauggugaaacaccgucucuacuaaaaauacaaaaauuagccacgugugguggcacucaccuguaaucccagcuacucgggaggcugaggcaggagaauugcuugaacccaggaggcggauugcagugagccgagauggcaccacuggacuccagccugggugacagagcgagacuucaucucaaagaaaaaaagaaaaaaaaaaaaagaaaauccauuguuucagcaacauguuaaagaaaacuacucuuuuuucauugaacugacucaccaccugaucaaaaaucaauugaccuuauaugugugaaucuauuucugauuucccuauucuguuccaccgacaaaucugccuguccucaaggcaauaucacacugucuugauuauuguuucagaguuaaguguucaagucacguauuauaagucauuuaccuuuuuguuacuuuucaagauuguuuuagcuauuguauaucuuuuguauuuucacaaaaaauuuagaaauagcuugucaauuucgucaauauugccugcugaaauuuugauugggaaugcauuagaucuacagacugauuuagggagaaauggcaccuuaacaauuuauauccaugaucaugguauauauauauugcacuuucuauuucugaguuguuaaguuuuucucagcaauguuuuacagucuugaguauagagguguugugcucuuuugaaagauuuauuccuguguguuagguauuuuuucuuauuuucuuucuuucuuuuugagacagggucucacucugucacccagacuggagugcaguggcaugaccauagcucacuacaaccuccaccuccugggcucaagcgauccucucaccucacccuccugaguagcugagacuacaggugcgugccucuaugcugggcuaauuuuuguauuuuuuguagacacagcguuuugucauguugcuuaggauggucuugaacuccugagcucaggcaauccaucugccucagccucccaaagugcuagguuuauaggcaugggccaccacacccagccucuuuuucuuucuauuuuuuucauauuuuuaauuuuuuuaaauggauaugaagucuugcuauguugcccaggcuggucuuuaacuccuggccucaagugauccuccgggcucagccucucaaaauguugggauuacaggcuugagcccacugugcccagccagauauuuuuaauggugauauuuucaccuauuuuagcuguuguuucuaguaugauuuuuauguugacucuaaccuguggccuuacuaaguucauuaauuaguucaaguuuuuuuuauagauuguauaagguuuuuuaugcauacaaucaugucaucuguuaaugacaguuuuauuucuuuucugcacuuuaggucuuuuaauuucuuuuuccuuuuuuguuuuugccuuaucauacuagcccuauacuaaguaucuaauauacaucaucucaucuuuacaacaauccaauguuauuccaauuuaacaaauaagaaaauguggcucagaaagguucaguaacuuguccaaucaagauugcacagcuauuaguagaucuagaauucaaacccagguagucuuauuccauaccuguauguacgacuacuagacuagcuuauaaauuuggaaaacucaagggcacaagaacaaaaaauguuaucaaauuaaaaauaggaaaaaaauuccauuacuggcaaagaauaugaagaguucacagaagaaaaaggcauuuauuuuaaauaugaaaagaugcucaaccccucucauaaugaaagaaauacaaauuaaaacuaugauaaaaugguauagcugcuauggaaaacguauggugguuccucaaaaaauuaaaaauagaauuaccauaugauccaacaaucccauugcuggguauauagccaaaagaacugaaagcaggaccucaaagagauaucugcacauccauguucacagaggccuuauucgcaauagccaagagguagaagcaacccaaauaucuauugaugaaugaauggauaaacaggacauggcauauacauacaaugggauauuguucaccuuacaaaugaaggaaauccugccauauacuacaucacggauaagccuugaggacauuaggcuaagugaaauaagccagccacaaaaggauaauuacugugugauuccacuuacaugagauagcuacuagucauucauugaaacagaaaguagaaugguaguugcuaggaguuagcaggaggaggaaguggagaguuguuauuuaaugaguauagaauuucaguuucacaagacagaaguguccuggaaaucuguugcacaagaacgugaauauacuuaacacuaccgaacuguacacuuaaaaaugguuaccuauguuauaggauuuuuaaccacaauuaaaaaugaaaauuaguuuuuaaaacuucaacacaaauuuuauuguaaauucuaaaaaacaaacacuaugcugaaaccauuauuuaaccuaucaaacuggcaaaaauccaaaagucugaugauucuguuggcaaggauaugagaaacaguacucuuauaauggggggggggaguacacauugguacaaucccuaaagaaggcaguuaggcaauauuuaugauaccuuuugauccaguaauucuacuuuggggaauuuagucauauggauauacuguaugcauguauaaaaugauacauguacaaggcuaugaacuucagcauuguuuacaauaggaagacacuggaaacaaccaaaaugucuaucaacaggugacugguuauauaaauuacaguacauccguacaauggauuaguaggcagcuauuuaaaaaugaggacacucucuauguacuuacauggaaagagauucaacauauauuacaacugaaaacauuuagaacauuacguauaauguuauguguaaaaaggagggaaauaagaaucuauuuauacuuuuauauuuccuuacuacauauaucaagaaacucuggaaagauacauggaaaaauaauagccgugguuuggggacccugaaugggagcugaauggauggagaacuggcuggagugggaaguugauauguuuuggucuuggaaaugugaauauaucaucuauucaaaaaauuccuaugguuggaaauaaauuuuaaugacaccaguugucauacaacgauuuaccaagugucuacuacaugucaagcaggcacuauccuaggcacugacaauauggcccugaacaagacaaaguucuuacauucuagagggaaagaccaaauauauauccuacauaacacaacacacacacacauacacacacaggcauacauauauguacacacauuuuuuaauuuauaaaauaaauacugccagguggcuacuuaaaaaaaaagaaaagaaaagaaaaggccaggcgcagugguucacgccuguaaucccagcacuuugggaggccaaggcaggcagaucaccugaggucgggaguucgagaccagccugaccaacauggagaaaccccaucuccuuacuaaaaauacaaaauuagcugggcaugguggcgcaugucuguaaucccagcuacuggggaggcugaggcaggagaaucgcuugaacccgggaggcagagguugcagugagccgagaucccaccauugcacuccagccugggcaacaagagugaaacuccgucucaaaaaaaaaaaaaaaaaagguaaauuagguuaaaagaaaaaaaguguuaugguggaaguggaguagggugccauuuuaguuaggguagucugggaaggccucucugaggaggagcuauuugaauagagacccgaaugaaggcugggaagaaacaaugagggggaagagcuuucuaggcagcagcugcccuaaggcaagagcaggucugauguguucaagagaaagcaaaacaccuuuguagcuagagcaaccugagugagaacaauggcaggcaaugauguaaaacacaugcuugaaagccagauccugagggcugguuuguagggcacgagcaguggucuggaugguaugggcaccuacuggagguuaaaaacauuguuuucaaaggggcuuguuaccaugcggcuaguacacaccuguauggccuuccagguuguuaaaagacugaaacauuucaagucccaugagaaaaauagcugcuucccuaguaacaauguuaccugccacacuggcuucuuucccaggacaccccccagcccuccacuccuucuccucaaccaacaaguaaaugaggaacuuggcccagcagaagcuauugacuuggagaaguuaaucagcucaagaggcuagaaucacgagauucagaaagcuagagggugaguuaagguuuucaguucauuguagcccuagagccuuaggacaacgcguccuggauuccaucucaccgagauucaguuggggcccagcaccaugaucugagcucccgcucaguacagcagaaacaagaagcaggauagagaaacagacugaggucugagaugaagacagaggaaggggaaacccagugaacgucuauauaaauaaucucucuucugagcacuccuccagugauuugaaaggcuacuggcuaggccgggcgcgguggcucacgccuguaaucccagcacuuugggaggccgaggcggguggaucacgaggucaggagaucgagaccauccuggcuaacauggugaaaccccaucucuacuaaaaaaaaaaaaaaaaaaaaaaaaaaaaaaaaaaaauuagccaggcaugguggcgggcgccuauaauccaagcuacuugggaggcugaagcaggagaaucacuugaacacgggaggcggaccuugcagucagccaagauugugccacugcagagcgagacuccgucucaaaaaaaaaaaaaaaaaaaaaggcuacuggcuaauucgaccuuuuauauaguuaaaagucauauaauugucauguaccagguuuuuuaaaaaugcauugugguaaaagggaaauagaaaauaccaaccuuuccaacaccacaugcgaccuuaacauucucauggcugcauuaauaaagucaauauguuuguguaacaauguguaguuccuggauccuaaucucaagacagaagagcugaaacacggcaacucuaauuucauauaugaaacucauuuuacgcaccauaguacugggaauuuagucugaaaaauccauacagaugucaaaucuuaagaaaacagauuucuccgaaguugcgugaaaccucaggcugcuugccacuucuguuuuacaaaguucuuccucuuugaaaauacauucugcugcucuuaaaucuuggaucccaacaucuuguuacaggauauuaaguucuacuuuauucucauucuuuuaauuucuuugaacaucaaaaccuccaauuuaaugaucugagagacugcuaaauauuugcugacaugaaucuguaacuaugaaucuaaaccagaggaaaagcaacuggaaagaacaugaggauaaaucuaagcacugcuuagaaacaaucucucggcacuagguacauacucacuuuuauuuucuaacuguaaacacuugcacucaacauaagacauuagaaaucauuucgugcacacgggaccuguuuuagcagcacacuugcugauacaccucacggcuuucuuuuccauuaaaaaaaaauaaaacuacugcugagugcugaaacuuucuuuucaguaguucuaaucccuaagauuuagagccagguagaaacuugauuuaaucuuugauggaaauuauucuuacaauccuuuuuauaugaaaaugucauaauaguuuuuuuuaaaaaaaacuacuuacaccaagcugaagucugaacagacagcauggaacuaccagcagccgccaguuuccucacagacuaaacuaaacuuugcucccuuccuggcuguuucuggaucagguucacacugauacacauuuacaguggccuuggaagcuaccaaccaacacagcgaggugggaggguuuguuacucuaacucuuguuugauaacugcuuaucagcaacuucucaaaggucgacuuaaauguguuuaaagagacaaauguaaggaagauuauaaggaaagccugaaaaaucuuaaaaucuccgauggcugggcuuugguuuccgaggggauuucuuucccauauguuccuggaaaaaagaaaaaagaaaaggauaguccucugagcuucaaauaucuugcuuuccucucauaaaacuuucccagccaccugcaguggcucucgccuguaaucccagcacuuugagaggccgagacgggcggaucaccugaggucaagaguucaagacaagccuggccaacauggugaaacucugucucuauuaaaaauacaaaaauuagcugggugugguggugggugccuguaaucccagcuacucgggaggcugaggcuccuuuuugaaacuccauuucaaaaaacaaaaaacaaaaagacaacuuucccuuccuccucagaagcuauacauuguacaaucauggcagaaaagggccagaaaguuguuucuccacuauaguccucccccaucuccauucucccugacuuuuuuacuagugaaagaaaguucuugguaaacguaguauuuucugacauucaaaccaccggcugaucugauguaaagugagaacauggaucccaaauucuauucuuugcaagauaaaauaugauacugcuucaucucuugccacauuccuaagcuucuuucccuucugagcuaccauauuucuuuauuuuauuccuuccuuccuuccuucccucccuccuucccccuucuuuccuuccuuucuucccucccucccucccuccuuccugcuuccuuccuuccuuucuuuucuuucuuuuuucugacagagucucacucuguugucccggcuggagugcaguggcacgaucuuggcucacugcaaccucugccucccagguucaaaggauucuccugccucagccucccgaauaccugagacuacagacgcccgccaccguguccagcuaauuuuuguacuuuuaguaaagacgggguuucaccauguugaccaggcuggucgcaaacuccugaccucaggugauuugcccgccuuggccucccaaagugcugguauuacaggugugagccacugcgcccagccuuguaauuucuaccauuagccuuugaagcagcaaccauuuauuacauacuuacugcacuaaucacuuuaugaacauuauuuuauucucucccaggcaauaaauuuggagaucaucuuaauucuuuucagucugacucucugaguccaauuugaccccuucacuauccuggggaucuucugcaacaagcaccgugauaggcaaaauaaugcaccccucaaagauguccauguccuaauccugagaaccugugaauauguuaccuuccauggcaaaagggacuuugcagaugugauuaacguuuaaggacuuugaaauggggagauuauccggaggaguccaaccuagucacaugaauccuugaaaagcagugaacuuuucccucccagcuguggucagggagaugugauaggaggacuugacuagcucucgcuggcuucgaagauggaggaaggggccucagaggacugcagguggccucuagaagcuaggaauggcaaggaaacugauuuuuccccagaguguccgcccugaugacacccugguuuagccuagugagacccauguuggucuuuugaccuacagaacuauaagauaaacuuguguuguuuuuaaaccacaaaguuuuugauaauuuguuaugggagcaauagaaaaauaauacagguacuuuaauuucaagcuccuuuaaaauauaauacucaagacugaacagaauacgcaaaugaaaacugaugcagaaaaaaaguuguggaacuaucaaauucauuaaucugggugcuguacuuuuauaaaugcaaaucaagauuauuucaaauuuuuaaagcauuauacucuuaacuuaguggccuccuaagucuuuggcccaugagcuacauuaaaccaagugccuagcuguacccucauuuuuuuuuuucuuuccuguguugggaucaaacacacacaaguuucccaagugugaauccugguucuaucccuuacuugcugagugauuuuagguaauuugcuuaaccucucugggucucagcugacucaucuguaaaacgggcacaauauuucaccuacuuuuuagguaggaugaagugauguagcucauacaaaguaguuggaccugugccuggaacauaguaacugcuggguaaaugucagcugcuacuguaaggacgggcuuucuugugggagcugaggaacaggcuaagauucgugucuggaucaauagauaagcugcuccagggcagaggugcccuggagaacaggagccacuccagauucugcuaaaauccugggggcguggugggguuugaggcuuuuaaguauauguggaaagggcuugagcugauccuaguuggauuucaugggucugagaaucccacuuuccccuggaguugcaaaguaaacacuugcuaccugccaggcacugugcuagcaaugaauccaucugacaagacuccuauucucccgggacggacauuccagcaggaggguggagaauagacaaaccaggaaauuucauggggugccaaguacugugaugauaagagaacagggugacuggggaaaacucaauauucaggacucacugagaaggagggaaguuugagcugagaggaacaugaacugaggagugaggggaagaaacaguguuucaagcgaaggaaccaagcgugaagcaaguagaaaggaacaguguuucagccaaaggaacagccaauguaaagguucagaggcaagaaugaccuuggcuugcucaagaaccaagaggacgaaggccaguguggccaaagcagagaucaaggaccaaaugugaggcccaaaaaaguagucagggacccuguaacuguggggagagguuuggauuucauacacugagaugccaugggaagguuuucagcagccaaaggacagaaugugauugacaagggaacacuugaaccugacaggaagcugguccugcccaaagccucugcuucaaguuccagaauccccuucacagccagucugaucauaccugguccuucuuaccuucucagcuuuuaaccaccccucuaccucccaaaaccaaauaggcaguuuugaggugacacugagccaagguagcagucuaugaggaggagagagcaagggaugcaaagcgacacacgugacggcugcaaguuccucuuuguaguaggcugaaugguggccccucagaaagaacccaugucaaauccccggaaucuaugaaugugacuguauuuggaaaaggaggcuuugcugaugugacuaaggaucucaaaaugagaucauccuggauuaucuaagugggcucuaaauccaaugaccuguccuugugagagaacccccucauucuuuucucaguuaauuuuagaaaugaaacacaggguccuacauacaaccuuuuuacauuucacauuuugguuuuagcccacuuuuccaaauuauuaagaucauuuugaaucaugcuggcuguccucugucauaguaaguaaccuuuucagccuaacuacgucuacuuaaugaccaugauuucacccaaauuauuaguaaauaaacauugaacagucaagauugagaauagaguucugaaacauguuauuagagaccuuuaguuugauacugauccauaaaucaauauucuuugggugcacauguuugaucagcuacaaaaccaccuauucucauacagcuuauauuuuuguaguuccucaaauaugucaggagaacaaaauaccuuguaaguaaagacauguccacagcaucccaaucuugucaaacucuaauggaaaugaagauguaguuuguuugagcaguuuuuuuuuuuuuaauugugccgguucuuagugauuaucauuuuuuuaaagaguuuacaaacuauaaguuaauucuuuuuucuagaagucuccuugagguuaaaaggaaguuuacacaaauggaggaaaugacaugaaucucugucucaaaauaggagauauaaguggaggagaaaaguaggggaacauuagaaaagaaagcauggcggaaggggcaagcacggugugccccugggagagggaagaaaccaggcuggucauagcaggggugguuguugaaaaguacugggaaaucggaauugaaacauagaauguaaagucuagaaaaagggacuaggauuuaaaauuaaaauaucagaaaaugggaggaaucaaaagauuuuaaagcgagaaaauaaaauaauaaaggugcuuuaauaaacaaccuaauugaaaagugggcaaaguacaugaacaguucagagaagaaauauaaauggcucuuaaauauauaaaaaggcacucggcugggcgcgguggcucacgccuguaaucccagcacuuugggaggccgaggcaggcggaucacgaggucaggagauagagaccauccuggcuaacaugguaaaaccccgucucuacuaaaaauaaaaaauaaaaaaaaauuagccgggcgugguggcgggugccuguagucccagcuacucuggaagcugaggcaggagaauggcgugaacccaggaggcagagcuggcagugagcugagaucgcaccacugcacucuagccugggcgacagagcaagacuccgucucaaaaaaaugaauaaauaaaaauaaaaauaaaaagacacucaaccucacucauuauaagagaaaucaaaauuaaaaguacaaugacgucaucuuaaccuauauuuucaccuaacaaauuggcaaaguuaaaaaaguuucauaagauacaauguuggugagguuaugggaaaauaauggaggauaaauugauagaaccucucugaagagcaaauuggcaaucaaauuaugaacacauacacuuucacccagcaauaacuaaaaacauacacauguacgugaauauuaacugcagcauuguuggcaaaagaaaaagauggaaaucaggaaggaacugguaaauuaaauuauaguacagauaucuaauaggauacuggaauuuaaaaauuaggugacuguggccaggcacgguggcucacgccuggaaucccagcacuuugggaggccgaggcgggcagaucaccugaggucgggaguucgagaccagccugaccuacacugaaaaaccccaucucuacuaaaaauacaaaauuagcuggacguggaggugcaugccuguaaucccagcuacucgggaggcagaggcagaauugcuugaacccgggagguggagguugcggugagccaagaucgcgccauugcacuccggccugggcaacaagagcaaaacuccgucucaaaaaaaaaaaaaaaaaaaagguaugccaaauguaaugugguacgcuggauuagauccuggaauagaaaaacuacagucauggaaaaacuggugaaaaccaaauaaagucuggcuuuuaguuaauagucauguaccaauguuaauuucuuaauuuugauaaaugagccauaguuauguaagauguuaacaucaggagaagguggguaaaguuucuacaggaacuuucuguacuaucuuagcagauuuucuauacaucucuaacuauuucaaaaacaaaaaguuuauuaaaacaauagauagacuuuuuucccaauaaacaaacauuuuaaaaauuauuagaacagcuauagugaaaauggcuuggagaaaggagaaguuagaaccaaaaaggucagaugggcaacuguggaaguaaucuuggcaugaggugacgagggccuacauuaggguaaagauaaugaaauuacagugaaaauaaucaaauauaaaauguauuucaaaagaaaaaauaaaaaauacuugcaauaucaaagagagaucagaacagugacaccagugacaaaagacagaaaugagaugaagggagugagauucauuuaacucauucauucaauaaauauuuguugguaccuacugugcaaggcaccggggaugugagagugaguuuauaaaggcaaagugugaagugacucuaaaauguccuaguugaauuguccaaaaggcaucuggauacacaguaugagagaacagaacugagauaacugagaaagauuauacagagugaggaaggagcggccaaaacugagcugugaaauauaaacacaggguaauaccagagaagcauggaaaacagaguagggauggacagaggauuuugaaaaggagcaggaugguguaauuuccuggcaaccaagacaaaagaaagaucuaggaaaaaggguuccaucaaaugcacugucuaagaaacaaagauacacaaaagaugacaagaugaucacaaaaagagacagagaccacugauggccaaagucacccaagaaacuucuuucacuuucagugaagccuaaacggaacccagauuacagaagucaacauuuuccuagaagaaagcccuucugauuuaaaggccuuuggcaaauagaauuccacuuaacgugcuccucaaacugggguauaugaagccgcagaacagaucuuucuguaguaucaacuuuauauaggggaaaauauauugaaacagaaugaaaaaugcaaauuuuacaugagcuuuuaaagacaaauccugacauuucaagcauagaauguucuuacaggaggucaucuuccuauuucuagggcuauaaauugacuuaccauuuccguaaggggauacuuggguagaaauuaaagaagcacuuauauaauagccagcuauaggaaaauguguacuugcuauuaaaacucagucacggccgggcgugguggcucacgccuauaaucccagcacuuugggaggcugagguggacagaucaccugaggucaagaguuccaaacaaucauggccaacauggugaaaccuugucucuacuaaaaauacaaaaauuagccgggcaugguggcgcaugccuguaaucccagauacucgggaggcugaggcaggagaauugcuugaacccaggaggcagagguuacagugagccaagauugagccacugcacugcagucuuggcaacagagugagacuccaucucaaacaaacaaacaaacaaacaucaaaaaacucgguuacuuauaauaaaaaaauaagaauauggccacauguggcaaaucacaauaaacacuuuguauucaaaggagaaaaauaaugaaaaaaaucuugaauguaucguucauauuuaccacuauuuugcuauugagucucauuuauuauguauccuauaugucuguagcuagagcuuagcuacaugcugagagugaaguuacagaacugacuauaaccagaugcuuaaugaaugcuauuugauaguguugaauaugcauugagccucaaucaauacuauacacacacauacauauguaaaacacgagagcaugguaugugcauaucugugugugcauauauauaauauacacguguauaugugugugcacgcauaugugugugcaugcauauauaauauacacauguguauaugugugugcacgcauaugugugugcacgcauauauguaauauacacauguguauaugugugugcacgcauaugugugugcacgcauguguauaugugugcacgcauaugugugugcaugcauguguauaugugugcacgcauauaauauauacacacauauguauauauacaugcauguauauaugcacgcacacacacaugcacuacugucacauacuauagguguuaauuccagaauugguacuaugcuuccaauccuaauuuauauaaaaacaacugagacccugacuuaaguguaguacacaguauaccaguaaaaugaaaaugcaguuuuaaucuguauuuaaauugcaguuuaaucucugccaaauaaauuaaaauacaaauuuggcauuagauuuucauaaaccaggguaagcaugaguuugaaaucuuugcucucauauuuuccaucuaauuuaaaauauccucagccugcaagccggaagguaauacucccaccaaguaaaaauuucuuuuacauuugucuaugagcaagccauuagaaugguaaccguggagguaauguccagaagcuucuugaaaaugccaugggaaaccuaugucagguuguaauuuuucuaaaaucaaucaucuagucugaugucauuugaauggagaaauuauuaucauuuauuaaccuaauguaauucugauugagaucucuacuguuuaaaagaaaaccaauuuuaagaguagucaagauaaacuagcucguuucuuaagguuugccuuucuacacuaaaagucacuuacuuaggccgggcacaauggcucaugccuguaaucccaguacuuugggaggcugagguggguggaucaccugaggucaggaguuugagaccagccuggccaacauggugagaccuuaucucuacuaaaaauacaaaaauuagcugggcgugguggcgggcgccuguaaucccagcuacuugggaggcugaggcaggagaauugcuugaauccgggagguggagguugcagugagcugagaucgcaccacuccacuccagccugggcgacagagcaagacuccuucucaaaaaaaaaaaaaaaguuacuuacauagcaaauaguuuucauuacuccaucuuguauacauuaucugaaaacagucccugaggcuaagaaacaaaaagccaaugcaauacccaacuuggaagacagaauuacagcucucauaaguaauucauuucgcuuaagcuguggcuuucacaauuaauaacaacuacggggcauguugucacuuuuuaacauugccuacuaccuacaacucucugcugucacauugucaaagaauuuugauauuaucauguuucgagaaagcaaaucugaauugauauccuagggaauaauuauuucuuuuccuacuuaacauucauaauuaggagguugguagaauucucaaaucuuguugauuuaaauauauuuagagaacgugaauugauacaaacacuuuagaugucaguuaagugaaauaauuaauaccaccaugcaauuugguaucuagccuagaaggacugaagaagcauucaccuauaaucagcaauucuacucccaggcacacacacuagcagagcuucccaacuggugugccaaggcacccuaguaugcaaugaaugggugacaggugugcccagauauggaacucagcucucuaguucagcagaagcccccaggccaggacauagcuuuacuucuuuaaccugguguauugcacacauaucaucuaucauuuucuaugugugccgugacacaagaaagguuagggaacauugauggagaaaugauugcauauaugcgguagauacaaacacaggaauauauguauacuuaggugcaauguuuguaauaacuaacaacugaaacaucacaaugcucauccaucaacucaucugcuaggaaauucuguaauacuccuacaaugcuacauuauacagcagugaaaacuaaugaggaaugcuauaagcguugacauggauaaaucuaaggcuauaauguagauuuuuuuuuaaaaaaaggcaugucccagaaaaagacauacaauaggauuucauuuuuauaaaguucaaaaacaugaaaaacuaaucaauauacuguuuagggauauauagaaaugugauaaaaccauugagaaccgcaagagaauuauuaacacaaaauuuaaaacucugguuacuucugaggguacaagaaaaguauagaaucaggaaugagcccacaggagacacuagaaguaaugguaauauugcuuucuuaaacuaggcuguagguacacaaauguucucuguauaguuauuccauaagccuuacagauguuuuauaaauauuuuguaucuacucaacauuuaauaaacauuuuuuaaaagcucuauuuuguccaaaguagacaaugaauguaucugccaucucugcagcaguaugagucuguggaacaggagggacugaaagcauaaauuauauagaaacuuucacagaagccccuacagacucacacaacuccaacaaaaaagauuugaaagcuaccaacauaauuaaaauuaaaacuaaauucaaugugcuaucauuuuaugaggcaccauaugugagaauuuuaacauuaaaugaaauaugaauuucaagauucaggacugaauaaacugccagccuagggaugaauaacugcuuuugcuauuuucuaaacagucaacauuucacuguguaucuagaccucacaaaagacauuuacagaaugacaauacuuuaauucaucauguauuuccagcaauguuugcuuagucaaaugacugucugucaggcagguuuauaaagcugcaagagcaagaacuugguauguuucaacugauauaacuaccaaggauaacauaccacagacgcuuuaagaauuccuuccugccuguacucugucucuuguauuuugugggcugcacaaugggaagccauuuuuuuuaaagcauuggauauuuugccaacccagaagagauauaauaaaccacaaagguauaaacuuaacuucuaaauuaauuaaauuuauuauuugugauuugaaauauuuaaaaaaccaguuugaacucucccuuuaauauuaaaaaaauuaaacaaaaagaaccacuuaaaagcagauagguuaauguuuacacaaaggcaauuuuuuuccuucgcuuuuuuuuuuuucuuuaaaguuuuaaugggugaaugaccuugcuggaauuccccugucaguucuggaguaucuauuuggaacuuucaaauagaaaccacuuuuguaaguggcauuagaaugguaugccaaguaguaucugucucaauaccuugaacuugaauguuacaccacagaugaaucaauaaacuuuacacaaaaugaaagguuucccuuccccacuuaggccauuuaagaagagaucaaguauaaauauauuugacauuaucacgauguagggucaauuauacauagaaaacuucacguuuacccacuucaagaaauuuacucuugauauggcuuuaaguuauucaaagacaggucuauuuucaagucugucagacauuuaauauaucaugcuaaaguuagaaucugaguccauacguaauuccugugaccuuaguauaacuaccuaaaagucuagauaauauaaagcauuuaucauuuuuguuuuacuuuagaauuucuaagauaccuauuuucacugacagaaaucacuucagauaaacuaugaaaaggcuucaggaaaccuuuccuuuccagcaugagccaaguaugaaacuaacccuaaagcacugaagaucauuccagucauaggcaacaggaaggacaauuuagagcagaaacaaaauauuuccccgaccuggccacaccucuaguuucacccuuggcacuucucucccccauuuucagaaggcgaaagaacaauaaagauugcucuggaauuuuagccuagucaucuagcuuccucuccaaagcuguuuucagggcugaaaaaacguaacucagauuucauaaucugaguuucuacagaacauauugguguuucagaaguugacaugaagggcacacaagagugaauggagaaagaguggaguaucagggaaauccagcaaaggaagcacugcuuuuuaauauuuuuccuagaauauuucaauacacuauuuuauaacaguggcuggaauauuuucaauauuacaagucuuuuaacaagaauguuuaaacuauuaacaugacaucauaauaauuauaggaucaaauuaaaaacccagucaucguccuuccugcccaagcucacaauguuuccuaucccuaucgucuccaauuuaggaugggauacuaaugccacauauaaccgcaaucuugauuuuuaaaauaaaacuggaauuaaauuguugugguuggggacagagggagagaaaagacuagauaaucaaauugcuuuuucccaaggacuucucucuuccauuccuaccucccuacucccaucuagucagcaaaacaaaaaaacuguuuuuuccuuuuuugagacaggucugucacccaggcuggaguguaauggugugaucuuggcucacugcaacuuccaccucccgggcuuaagugaaccuccugccucagccucccaaguagcugggacuauaggcaugugccaccacacccagcuaauuuuuguauuuuuuguagagacgggguuucgccauguugcccagccuggucuugaacuccugggcucaagugacuugcacaccucagccuuccaaaguguugggauuaauggugugagccaccccacccagccaaaaaagaacuuuugaugaugcuauuuuggauauuaauaaaauauuuaacauaaagaauuuguaacuauuuccuaaccuuuacuuucccaaacacuuucuuuaaaaguuauugcaauauagagagaugucugaaaggauauuaauaaaaauguuggcaucccaggagguggggaguggaauuucaagaacaucucuucuuuuauuuuuuacauauuuuagcucaaauauauuuguaaccaaaaaauuccaauaaaauaauuuuuuuucaaugcaaagguuuuuaugugaaguuaucuaucaaacaguaaacucucaaaugcaaaaucaagacgcacuuugcccucuaagauacaauuucauuuuuauaaguaagcaaaaauauauugccuuucuguucagggcuuucucuaauugaucuucuauaccuuaaugacucauaaauuaauaucuccuauucagaacuucucucuuucucacuuuucugugguuaguuuugauguaucuuaaccaaaaauauuaauauaauaauagcaauauauauuaauccacuguucugaacacuugauaauuuaauccucacaacccugugagauauuucuaguuaaaagauacacuguuauccucauuuuacagauuaggucccugaaaguaaaggugguuaauaucccauuugcaauaggguacacuaacaaaauuuguuaaguguuauagugaaacaauuugcuuguuuuggauuucuuuggaagccauucccaaaggaaugauacuugaaggaaagggauauuugauuuuguuauuuucauuauguauuuccauauuuuuucccaugauuuuucuaaugcagucguucucaauuaauggucgcuggaccagcaguaucagcaucaccuggaagcuucuuagaaaugcagauucucagaccccaaccagaccuacugaaucagaaacucuaggguagaacccagcaaucuguuuuuguuaagacauacacacauacauucucuccccuuuuuguuaaguuacuccucuagggugguucugaugcauacuaaaguuugaggaccauuguucuauguguaauauauuuauaguuuuuuuuuucuuuuuugaguuggagucuugcucugucacccaggcuggagugcaguggugcgaucucagcucacugcaaccuccgccucccagguucaagcaauucuccugccucagccucacgauuagcugggauuacaagugcaugccaccacaccuggcuaauuuuuuuguauucuuagagacuggguuucaccuuguuggucaggcuggucucaaacuccugacuucgugaugcgccugccucagccucccaaagugcugggauuacaggcaugagccaccgcaccuggccaacauguaucaguuauuuuuuaaaaauuguggccagguguggugguucacacuuguaauccaagugcuaugggaggccgagaugggaggaucucuugaggccaggaguuugagaccagccugggcaagaagaugagacccccaucucuacaaaaaauguuuaaaaauuagcuggauguggugguguguaccuguagugcuagcuacuugggaggcugaggcaggaggaucacuugaggcaggagggucaccugagcccugaaguucuagguuacaaugagcuaaugauugcagcacuguacuccagcuugggugacagagugggaucuuguuucuuuuuuuuuuacuuuucuuuuuugagacguggaguugcucucacccaggcuggaaugcaguggugugaucucggcucacugcaaccuccgccuccugggcucaagcaauucucccgccucagccuccugaguagcugggauuacaggcaugcaucacgaugcccagcuaauuuuuguauuuuuaguagagauggggcuucaacauguuggccaggcuggucucaaacuucugaccucaagugauccacccaccucggccucccaaagugcuaggauuacaggcgugagccacugcccccagucagaaugagaacuuguuucuaaauaaaacaaauaaauucucauuuagccacauauuucauguauugcgguauaaucaauuuuuuuuuaccacuuuuauuccaugucuuacaagggagcacucacuugcauuuauuccacauuuauuaagcacccucuauggccaaagaaugagugcuugaauaaccaauagccuaggaagacaggcagaaaugcaggauucgcaaugucagcugguaauacagcaacagaagugcacagcgugcagaggaggggcaaacugcaguaggucaaggacugaaucuggaucucuuagaaaaucuugcacucuacuucugagaaacauuguuucuuggcaacacauucugcugcccuaaaccccagggauccaagcccaaaacagaggcauugccagagcagcauuccccaucagauagggauuaacaaacucaguaaggucauuccuccuugguuagagugcagaggccgugagagacaaguagagaagguagccaguuucuggguuaccaaaggguccaaagagcuucccaauucuaaucuaucauuaacuucacaauaauucacccuucuuuuuuuuuuucaccacuacuucauguuuuucaugucuguaucagguauuuuacaaaauuuuuacuuuucaaacuuggaaaggaaacuguacuuuuccaaguucauauucuccucccuaauacuuuaaucacuauucugaauuugguguuuaccucuccaaauaaaaauuguacuauuggcagggugcaguggcucaugccuguaaucccagcacuuugggaggccgaggugggcagaucacgaggugaagacaucgagaccauccuggcuaacacagcgaaacuccgucucugcuaaaaauacaaaaaauuagcugggcaugguggcgagcgccuguagucccagcuacucagaaggcugaggcagaagaaucgcuugaacccaggaggcaaagguugcagugagccgagaucacgccacugcacuccagccuggaugaaagagugcgacuccauuucaaaaaaaaaaaaaaaaaacuuguacuauuguucauuuuugugaaaauaugaaaugcuucugaaauuuguuuuauucuacauuuuccccuuuuuuuuuuugagauggagucucacucugucucucaggcuggagugcaaaggugcaauaucagcucacugcaaccuccaccuccuggguucaagugauucuccugccucagccuccugagagcugaaacuacaggcacacaccaccacgccuggcuaauuuuuguauuuuuaguagagacaggguuuugccauguugaguaggcuggucuugaacuucugggcucagaugaucugccugccuuagcuauuuuucuaauuuucuauuucuuuauuauuuuuauuaugaaauucagaaaguauguccguauguacuguuagaauuuuauauucaucuaacauacuuucaaauguacuuuuucucaauggcuaucaacaggggauaggccuucuaauaaucaugcugcuuuauaaacugucaggcauuuucauuagagaacuuuauuaucuauuucuacuuuauucaaaauaucaucccacacugauaguuugcauauaauuauguaaucuauuugcaucaagaugcuuuugauuucagcauacuauauuuccacaauugauaucucauauauaauuacuugauaaauguuaauuuguuuagaagugccccgauugcauuuaauccccuuccuagggcagcacaaagugggaaaucucugcauuguauaaccccaaauacuucuucacuggauaacucucugccaagauaauaugaauccuuccugccccucaaaacauuaaaauccccaacagaauccugcugagauagaaccagagggguaauccccaauuucuguccaagcaucucucugcgugacccuugaaacacacaugcauggauagacucauaacagcacagccaaagaaacaaaauuggaacugauauccgagcuucuaucuucugucugcaucuuggagagugaaaagcagcaguaauucuggagggucaugugaccugacuggaggagguagcuaccagucagaaguauacaaguaaauacuucuccuuggcuugcagccuggggcaaagguuagucaguuuucagaauacccaguagaggaaggaguuccucuucacguggaaaaauggaauucaaaaaucccacuguuuccccaguuuccugaaaucacucaugauaccaaagacacaguggcuauuuacccaaugccuuucuaaauaacauuuaggcucuuacaaggccaauaaguuucacaacuuauauucaacaugauuuuugagacugaucuauguugauacgugaagcccuauaauucauuguuaaauuuuauuccaaugaaugaauaguccagcaaagcucauucauucacuuuccuuuugaugacuguguaggcuguuuccuuuuuuuucuuuuaaaacaguaaugcaaugaacauuuuuguagauuacuuggguaagcaugaaagacuaccauauuuucuaaaacaugugccuaaguaucugcccacuuugcuuucaaccaaaaauguaguucuuucaaaauagccaaaugagaaggagaggggagccuagacaauaacuaaaggucuacauaccaauuugggggacucugagacaucagggaaccuugaugagccugaggaccuccccaggcugccaagaaaauaaguaaaggugauucuggguuggggcuuaugguagacacaugagauuacaggaugauaugguuuggcugugucuccauucaaaucucaacuucaauuguaucucccagaauucccaugcauugugggagggacccagggggagguaauugaaucaugggggcuggucuuucccaugcuauucucaugauagugaauaaucucuuaugagaucugauggguuuaucagggguuuucacuuuugcuucuucuucauuuucucuugccgccacccuguaagaagugccuuuugccucccgccaugauucugaggucuccccagccauguggaacuguaaguccaauuaaaccucuuuuucuucccagucuuagguaugucuuuauuagcagcaugaaaaugaacuaauacacaggauuaacuacgaaaggaggaaacaaaggcuacuaugacuuggaguaggaauauuccuaggaaacucauucuauaauaaaagaaaaucaacauaccacuuguugagugcuuuagagacauaugauuuagagaaacacaaaauagcuuaauucaaagugacuucugacucaacuucugcaaaguugucuuaaguuccaccauagagccuggauguguucuggaaugugaguacgaccuuugcuuaucacugugaauauugaaagcagaaaacagcaagaacagagaagcacuaaggaauacagaauugaacaaagaaaaauggcaaugauagcauaguggcagguauugacuccucugccuaucacaggaauaaauggauaguugaagaguuauaucaaguuauuuucauuucuuucucauauaucuuuuuuucccuuuccauaucacucuuuuuuucucuuugugcuucaguuugaauaacuucuauggaucugccuucaaauuuauuuauucauuccucaccucuuuccagucuguugaaaugccugucaaaagaguucuucaucccagauaucauguuuuuuuauuuuaguguguccauaugacucuuuuuagaguuuacauuucucugcugaaauuccccaacuguucaugcaugaggccuacuuuuucuacuuguuccuguaauauaucaaucauaauuaaaguccucaucugguauuuccaacaucugagucaucucugggucugggucuguugauugcuuuaucucuugaaaaugguuguguuuuuuuucauauauuucauaauuuuuuauagaauuccaaauauuguccauagaauaacaguauaaacugaaggaaagaauaguuauuccuggaaauggagaugccuauucugucaggcaaccaggugaacaaauuccaaagagagagaaucuagucagugguugagauguuguuucccuguugcuguaguuaccuucugugcaccuuccucuagcagugggcagcuacuaucuugugcuucauguggagucuacaguguucaagggauuuuacucaguguuccugcuccaaucucagcuuucagcagucacugcauaucugugccauagaggggguucucucucuccauccuugucccucccucagcaguaggcuacagcuguuuuuaacuccagucuauuaacagaacucauuguucuccugauaucucaguguuagcuaggcccugugcaccuaggccucggguaugcggcuuucugugccccuaccccaaccucuuggcaaugaaauuuugccuuauaucuguggaggaacacuguaaaaacaaaacaaaacaaaaacccuccaguaucccacggaucacacuaaauacaaaauaguagcagcuacugcuggagaauguucugugccuucccuaagggcaggcagcuuuugcuucuacccugcccccauaaucagugaaucuuugccuggacugaggacaaaaggguuuccuuucauuuaaaguuuuugcuccauaugagagaauagcugauaauuuaggcaggguauguaauuauguaucgcuaaagaguggcucucuucagucugcugacuugccccaaucuuuuuguuucuuuuuucuuucuuuuuuuuuuuuuuuuuugugagacaaggucucgcuuugucaccaggcuggagugcaguggugugaucucugcucacugcagccuugaccucuugggcucaagcgacccucgcaccucccagccucuggaguagcugggacuacaggcauguggcaccacacccagcuaauuuauuuuuucuuuuuguagaggcaggguuucaccauguugcccaggcuggucuuaaacuccugggcugaagcaauccacccaccaccuuguggccucccaaagugcugggaucacagagugagcauccagccucaaucuuuuuaugagcagugguggaaguuauuguagguucaguuauguaccccuaaaagauaaguuaaagcccuaaccccuggcaccugugaaugugaccuuauuuggaaauaggcucuuugcagauauaaucaaguuaagaugagaucacacuggaauagugugcggcccuaauccaacaugacuggcauccuuauaagaagagaaaacacgguggaauaggaauccccagaccucauucccccacagagauacugacuuaacaacaacauauggcccaaaaagacuuuaugagaacuccagaaaccaguuaaaaagucacaguaucccaggcaagcucaaagccaagaacagccacauugaaacaggcaagaaaagcuaaugcauuucacccauaauaggccuuccccaagccaguccagcccuacauaauugcaaguaaaugccaaacuugcaucuucucaucagaagggaaagaaaaggauagaaugugcauccaaaguucuagcuuuuuagggaagugcccaagggaaugguuacuguccagcuugauguggaacacugacagaaccagaauacuuuggaugcuugggguccacugagaacagcggagaguucagcagcuaacugcagcaccugagaaccugcagcacagccgacagaagacaacagaacucaguguuauugggagaaaaugcccaacucauggccuuucucucaugaagaaaagagaagaguagaaaguauauccaaccuuucagcuuuucuggggacugccuaagagauggcuuucugucuuaccugacuuggaaugcugacagaacuggcaacuuuugcaugccugggaacugcugagaacaaaagagaccuaggcagcuuguaggaacaccagaaaaccagcaguaccauggaaagacaccagagggagcaagugccuaaaaaagaaaccagcaaacuucuguaauugggaaauuacaggcacaguucagaggagauacaaccccauuaaagguuugagaggcccuaagacucuauagcugggcuaaagagagucuuaacaucucuuccucccuguaugaagccaguccagaagacugggagcguggcuguuuuuuaaaaaugugcaaaucccagcaaaaaauaaucaagaauacaaagaaauaagggcccgaccaagggaacaaaguaagucucaaaaaaaaaaaaaaaaaaaaaaagaccccaaagaaaugaaagucuaugaaucaccagacaaagaacucaaaauaguugucuuaaagaaacucaaugcacuacaagaggacagauagacaaauaaaggaagucaggaaaaugauacaugaacaaaaugaaaauaccaacaaagagauaaaaacuauuuuaaaggcugggugugguggcucaugccuguaaucccagcacuuugggaggccgaggcgggcagaucacaaggucaggaguucaagaccagccuggccaacauggugaaaccccaucucuacuaaaaauacaaaaauuagcugggugugguggcaugcgccuguaaucccagcuacuugggcagcagaggcaggagaauugcuuuaaccugggaggcggagguugcagggagccgagaucacaccauugcacuacagcucugggcgacagaguaagacugcaucucgggguggcgggggaggggguggugcaccaaauggaaauuauagagcugaagaauauaaaacugaauuaaaaauuacacuaagcagauucaacagcaaacuugaucaaacagaagacaaaaucagcaaacccauuaagaauuauccagcuccugcuugauaauucaacaaaaaguaaaaagaaugaagaaaagugaagaaugccuaagggacuuauggaacaccaucuaguugaccaauauaugcauuaacuggauuaucaaaagaaggagagagagagagaaaaggacagagagguuacuugaaaaaauaauggcugaaaaugucccaaacaugaagaaagaaauggaaaucuaaauugaacaagcugaaaggacuccaacuaggaugaauccaaagaggcccacagagacacauuguaaccgaacuaucaaaagccagacacaaagaaucuugaaagcagcaagagaaaagugacuugucacauacaagagaacucgcaugagauuauuauuggauuucucaggagaaacacugcagacgagagagugguaugauacauucaaacugcuaaaagaaaaaacugccaaucagaaauacuguagccagcaaaacuguccuucaaaacugaaggaguuuaaauaagaccucaaacuguaauaauccuagaagaaaaccuaggaaacacuauccuggacauuagccuugguaaagcauguauuauuaaguccucaaaaccaauugcaacaaaaacaaaaauugacaaguggaaccuaauuaaacuaaagagcuucuguacagcaaaugaaacuaucaacagaguaaaaagacaaccuacagaaugggagaaaauauucacaaacuauucaaccaccaaaaggucuaauauccagaaucuauaaggaacuuaaagaauucaacaagcaaaagucaaauaaccccauuaaaagugugcaaaggaacuuugaacagacacuucucaaaacaagacauacaugcagcccaacaaacaugaaaaaagcuuaccaucacuaaucaucagagaaaugcaaaucaaaaccacaaugagauaccaucucacaccagucagaaugacuauuacaaaaaagucaaaagacaacagaugcuaauaaggcuguggagaaaagagaauacuuaugcacuguuggugggaauguugauuaguucagccacuguggaaagcaguuuggagauuucucaaagaacuuaaaacagaacuaccauucaaccuagcaauuccauuucuggguauacauccaaaagaaaauaaauuguuauaccaaaaagacacaugcacucauguacaucacagcacuauucacaauaucaaagacaugaaaucaaccuaggugcccaucaaugguggauuggauaaagaaaauuugauauauguauaccaugaaaugcuaugcagucauaaaaaaaggaugaaaucauguucuuugcagcaacaugaaugcagcuugaggccauuaugcuaagagaauuaacacaaggauagaaaaccaaauacuacauguucucacuuacaaguggaagcuaaacauuggguacacauagacauaaagauggcaacaguagacacuggggacuagcagacaggagaggaaggggaggaagggagacaagaguugaaacacuaacuauuggguacuaugcucacuaccugggugacaggaucaacuguaucccaaaccauagcaucaugcaauauacccauguaacaaaccugcacauauauccucuaaaucuaaaauaaaaguugaaauuauaaaaauaaauauauacaauuucaaaaauuuuaaugaaggaaaaaaauagaccuuuccagaucaucaaaagcugaaggaguucagcacuagagcugccuuacaagaaaugcgaaaggaagucccucggguugaaauaaaaggauaguagauaacaacuugaaagcauauaaacacguaaagcucucuguaaagguaaauacacagguaaauacagaaucauguaauacuguaaugauggcacauaaaucacuuuuaauucccauguagaauuuaaaagauaaaagcauaaaaaaacuauaacuaugaaauuauauuacuagauacaaaguauaaaagacauaauuugugagauugauaaaguagaggauaugugaaggaguagaguuuuuguacaugguuuaaauuaagcugacaucaguuuaaaauagauuguuacaauuauaagauguuuuauguaauccccauuguaaacaccaagaaaauaccuuuagaagauacacgagagaaagugagaaaggugucaaagcaugucucucucuacaaaaagucaacagaacaaaaaggcaagcagcaagagaggaaaacagguacaaaagaacuacgagacauauagaaaagaaauauuaaaauggcaauaguaaguccuucccuaacaauaauuacuucaaauguaaacagaacucucaaucaaaagacauagaaaauggauuuuaaagaaagacccaacuauaagcuauguauaagaaacuuacuuuagauauaagaacacacauagacugaaagugaaaggauggaaaaagauauuccaugcaaaugauaaccaaaagagaacagggguggccgggugcgguggcucacgccuguaaucccagcacuuugggaggccgaagggggcggaucacaaagucaagagauugagaccaucuuggccaacauugugaaaccccaucucuacuaaaaauacaaaaauuagcugggcaugguggcgcaugucuguagucccagcugcucgggaggcugaggcaggagaaucgcuugaacccgggaggcagagguugcacugagccaagaucgcgccacuguacuccagccugggugacaaugagagacucugucucaaaaaaaagagaacauaaguggccacacuaauaucagauaaaagagacuugaaauuaaaaaaaauugucaagagacaaagaaggacauuauauaauaaagggucaauucacuaggaagaaauagcaauuauaaauauguauuuauauuuguaacagcagaacacccaaauauauaaaggaaacauugacagacugaaagaaaaaccagaugguaacacaauaauaguaggagauuucaaugccccacuuuuaauaauggauagaacaaccaggcagauaaucaauaagagaacagaugacuuauacaacccuacagaccaauugguauuaacagacguacagaauauucuacuccacaacagcagaacacauauucuucucaagggcauauggaacauccucugggacagauaacacguuaggccacaugacaagucuuaacaaauuuaagaagacugaaaccauaccaagcaucuuuuccaaucacaaggaaacaaaacgagaaaucaacagcaaaaggaaaacuggaaaacucacaaauauguguaaaauaaacaauaugcucaauaacuaauuggucaaacaagaaaucacaaaaaauuaggaaauaucuugaggacaaaugaaaacaaaagcacaacauaccaaaagguaugggaugcaucaaaaguaguacuaagggggaaaguuauuagugguaaacacacaauaaaaaagaagaaagaucugaaaucaacaaccuaauuuugcaccucaaggaaccaaaaaaaaauuauaaacuaaacccaguauuaguauuaggaaggaaauaauaaaaaauagaacauaaauaaauaaaauagaggauagaaaaauaauagaaagaaaucagcaaaacuaagaacuugucuuuuuaaaaaaggcaacaaaauugacaaauccuuagcuagacuaagguaaaaaauagagaagauucaaauaacaaaaauuaaaaacaaaagagaagacauuacaacugaugccacagaaauaaaaaggauuguaagagaguacuaugaauaauuauaugcaaacaaauuggauaacauagaaaaaaugauagauuucuagaaacauacaaccuaccaagacugaaucauaaaaaaaaaaaaauuggaaaagaccuguaacuaguaaggagagugaaucaguaaucaaacaccucccaacaacaacaaaaacagccaggaccagaugccuucaauggacaauucuaccacacauuuaaagaagaauuaacacugauccuucucaaacucuuucaaaaaauugaagaggauaaaacacuuccaaacuaauuaccacuacccugauacuaaaagcagacaaugauacucuaggaaaacuacagacugauaucccugaugaacacugauguaaaaauccugaacaaaauauuagcaaacagaauucaacagcauauuaaagggauuauacauuaugauaaagugggauuuauucucggaacacaaggauggcuuaacauaugaaaucaaucaauauaauauaccacauuaacacaaugaaggccaaaaaccauaugaccgucucaacugauucagaaaaagcaugauaaacuucaaucuccuuucaugauaaaaacacccaacaaacuaaaaauagaaggauauuaucuuaauacaauaaaggccauuuaugaaaaguccacagccaaugucacacuccauggugaaauacugaaaacuuucccuuuaauaucaggaaaaagggaaggaugcccaccuucaccacuucuacucaacauaguauuggaaguauuggccagggcaauuauacaagaaaaagaaauaaaaggcauguaaauuggaaagaaagaaguaaaauuaucucuguucacagauggcuugauuauauauguagaaaaaccaaaagauuccacaaaaaauuaaugaauucagcaaaguugcagaauacaaaaucaaugauucagaauacaaaacacaaaaaucaguguguuucuauacacuaacaaugaccaaucugaaaaacgaaacuaagaaaacaaacccauuuauaauagcaucaaaaagaauaaaauaauuaggaauaaauguaaagaaggagggaaaagacuuguacauugaaaacuauaaaacauugcugaaagaaauuaaagaagacacaaauaaaugaaaagacaucccauacucauggagugaagacuuaauauuauuuauuuguuaauuuauuuauuuacuuuuucagacagucucgcucugucacccagguuggagugcaguagugggaucucagcucacugcaaccucugccccccagauucaagcaauucuccugcuucagccucccagguagcugggauuacaggugugcaccaccacacucagcuaauuuuuuuuuuuuuuuguauuuuuaguagagacaggguuucauuauguuggccaggcuggucucgaacuccugaccucaaguaauccacccgccuuggccucccaaagugcugggauuacaggcguaagccacugcgccuggcaagacuuauuauuaaaauguccauacuaccuagagggaccuacagauauuauuaaaauguccauacuaccuaaagugaccuacagauucacgcaaucccuaucaaaauccuaacaacauuuuugcagaaauagaaaacaaaaauuuuuaauucauaugaaaucucaaaaggcucugaauagccuuaaaaaauaugagaaagaagaaaaagcugaaggccucaaacuuccugacuucaacauauauuacaaaacuuuaguaaucaaaacagaauaguacuggcauaaacagacauauuguccaauggaacagaauagccccaaaaugaacccucauguauauggucaaaugaucuuugacaagggugcugaggucacacaaugggaaaaggacagucucuucaacaaauggcauugggaaaacuggauguccacaugcaaaagaaugaaguuggacccuugccauacaaagguccuauaaaauuugacuacaaagaugaacucagaauggaucauaggccuaacuguaagaccugaaacuauaacacuccuggaagauaacacaggggaaaagcuuaaugacauuggguuuggcaauuauuauuuggauauugacaugaaaagcacaggcaacaagugcaaaaauuagacaaaugggacuacagcgaacuuacaaacuuacaugcagcaaaggaaauaaucuaagagugaaaaggcaaccuuaaaaaguuucucaagagaacuugacaaaaauccagaauauauuaauauaaugaagucuuacaacucaauaauaaaaaaaaaaaaauccaauuuaaaaaugggcaaagaacuugacagacauuucuccaaagaagagauacaaaugaccgacaaacauaugaaaagauccucaacaucaauaaccaucagggaaagggaaauuaaaaccagaauaguaucaccucauaccuauuaggaugaccacuguuaaaaaauuaauuaauuaaaaauaaauaaauaaauaaaaauaauaaguguugguaaggauguagaguacuuggagucucuguacacuguuggugggaauguaaaauagugcagcugcuauggaaaacaguagggaaguuccucaaaaaauuaaaaauagaauuaccauaugaccuagcaaucccacuucuggguauauauccaaaagaauucaaaacaagauuucaaagagauauucacacgcucauguucauugcaguauuggucacaauagccaacaaccuaaauguccaccaacagaugaauaaagaaaauuugguauauucacacaauggauauuauucagccuuaaaaaagaagguaggccaggcgugguggcucaugucuguaaucccagcacuuugggaggcugagacagguggaucacuugaggucaggaguuugagaccagccugaccaacauggugaaucccugucucuacuaaaaauacaaaaauuagccagcgugaugccaggcaccuguggucccagcuagucaggaggcugaggcagaauaauugcuugaaccugggaggcuggagguugcagugagccgagauggcgccauugcacuccagccugggcaacaaagcuacacuccaucugaaaaagaaaaaaaagaaaaaaaaaauaaggaaauagggccgggcgugguggcucacgccuguaaucccagcacuuugggaggccaaggcagguggaucaccugugaucaggaguucgagacaagugaaaccccaucucuacuaaaaauacaaaaacuuagcugggcgugguggcgggugccugucccagcuacucgggaggcugaggcaggagaauagcuugaaccggggaggcggagguugcaauaagccgagaucgugccacugcacucuagccugggcaacagagugaaacucugucugaaaaaaaaaaaaaaaaaagaaaagaaggaaauccuaucauaugcuacaacacagaugaacucugaggacacuguguuaagugaaacgaaccagccacaaaaagaaaaauauugcaugauuccacuuaugugaaguaucaaaaauagucaaacucuuagaaaugggaaguagaauggugcuacuaguagaauggggaagagagaaaaggugaguuauucaagggguacagaguuucaguuuugcaagaugaagaaguucuagagaucuguuucacaacaauauauauaccguuaacacuacuguacuguaucuuuaaaaauuguuuuaaaaagagagagagagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaggcggagcuugcagugagccgagauugcgccacugcaguccgcaguccggccugggcgacagagcgagacuccgucucaaaaaaaaaaaaaaaaaaaaaaaagagagagagagagaaaacagacagacauacagagaagauagcaauaugaagauggggucaucgacugaaauguuguuacacagcacauugcuguacuucauucuggcagcccuaggaaaguaacacaagggcccacagaagaaagcuugcaagugagugcaggcuccuuuugugacuggggcuucccguuauucugaaauguuacauuagcccacauucagccuuuaagaauucauuacaguuuuagcugcuuucuucuuaccuaccuuuacggugccuucucuuccuccuaugcucugccaaagguaacacaguuucuguguccugucucucuucaaaagggcuugccucucuuuggaauuucaguucaucugauugccuugugaccucaacucucugaugagcucaagaagcaucaugacuuuguggauuaucaagauuuuucucauuguuaugaugggaacaauguucucuugcaacauucuacauccuaaacagaagcaaaauuuucagcauuuccugaaagaugauuccaaggguuauuaauagauuuuaugagcgaaaaagaauugugauuacacguuuggaacguguuaagauacacuauaaacuuucaaaaaagacugcaacauuuuccaaacaugucauuacagaacccuuuuggcuuacaaaaucucuugcaguugugucagacauucuguguaccauaguuuaggagauaaugaguuaaacgccuagacauguuuuuuuuguccucacuauauggcaaaauuagugucagcaaaccaguugggggauauuuucuuucugccacuucaccacuuugacugaaaauaagaucuuucuguuucuacaucacuuaugcuggaagauacggugaccuuugcauuacuucugucucuucucagguuuucucccguuacucaucaaaugccaaaaugaggagauacuugacuucuuaaaaaaugaacauaaaguuccaucaaauaaauaaaauauguaaaguaaauucaauaaacauauuuuaaauuaguuaggauaauguauacuuacacauuaaauauaacaacacaaauuuaaucagcaacauguuauacauaaugcuuuugguaaaauacuuucccuuugaguuguccauuuuaaugguucugugguguucuuaauguuucuccucauuuccuuuccuugaaauacguggaacauaaaugguuuuuuuaaaacauacauauuuccauuauuucccuaagucuaugguucauuuaguuuuccucuuucaacccugaaaaaaauggugugggacagaugugacuucaaauguaauauuuaucucuaaguaaaagauagaaaagagaaagcuuucuaagaaagaagaaaaaaaucaaauaagaacuagcacauuuugcaaguggaacaccauuuagcuaaauauucuuaucuuuugccucaaaaauaccagcuuuguuuagugagguacugcagaguuuacugaaaggccuguaguccgucgccacguucccugcuuuaucucuggccugcagacauggcaauaauucucagacucaguuuuaaaagacaaaaaaaaaaaaagacagaauuaggaaacuauacauaccaugaacagaaagacauguacuguacaauaucuauuaauuguaugcacacagagagagagagagagaguagcucuuauuuugguuacuguauuggugaaaaauuucuugaagucuaauucaucuaacucccaaucuuccuacccuguuuaguugugacuacauaagaaccuguuucuuuuucuuuucuuuucuuuuuuuuuuuuuuugagacggagucucacuguguugcccagacuggagugcaguggcacggucucagcucauugcaaccuccgccuccuggguucaagagauucucccaccucagucucccgaguagcugggauuacaggcaugugccaccacaccuggcugauuuuuguauuauuaguagagacaggguuucaccauguuggccaggcuggucucgaacuccugaccucaggugaucugccugccuuguccucccaaaaugcugggauuacaggugugagucacugcgcccagccaauaaccuauuucuaaguugccaauuaucuaccucaaaaggaaggaagccacaaccacuggacucucaugcuaccucaugauuagaggaggagaaacugggguaauugaugugcugguugguauuuuucacagcuuucaaaaauauccaauuacuagguuuaaaucaaccuugggaauguccuggacaugacauaagcagagguaguagcugugacuaccaucucucaaauguagcagagccuuuguaauggacagacuguguacauuuuaugccaauaggaaauuuccuaauacagaaagcaaguuuuuuuuuagaagaguaacugcacaaugucuuauaguuaaauagguuuucuggguuucuauguaagacucaaauaucugugaccugugccagagaacaaauucuugauuccaguucaaucauuucugagcaaccuaacucucuaauaagucaaauuuauaacaugacuuuagccacugugcaggaccuucuguacauuaacuuuacccacuuuaauacuauuacauuugcuuugucuuauucucuuuauguccccauccuacauacuauaugcauuuuaaaauauuuuuuagaacaaggcaggauauaaauaaauuuaauuaauucaucuuguaaaaucaucuugaaauauuaaguccucauaauuugggcuacaggucucauugucccaaauaugcaucucugugaguacagguuaaauucacucaacuaauaaauaaguucuaagggcccaccaugugucagucacuguucucaacacuggggaaaauaccuaugaagagaaugccaaucagagauaaguacaauggagaacaguaaagcagagaagacuagggaugccauguagugagguuacaauuuuaaauaagauggucaaagagggccucacugaggucacauaaccugaagggccuaaagaagaugagagauuaaaccagauagauaucuaaggcaaggguauuccaggcacagggaauaucaaguacaaagguccugaggcagaaggaagcuuggcauuucuaaggaucagcuaagagaucugggcuggguaguccaauagaugguagagagguaaggagagagcagaggcauaucagguaaggcccuggagaccauuauaaggacuugggcucauacuuggagugagaugagaagcaacugaaggguuuugguuuguguguuugagacagggucuugcucuguuacccaggcuggagugcaguggcacaaucauggcucaccgcagccuggaccuccugggcuccagcaauccuuccaccucagccuccugaguagcugggacuacaggugugugccacaaugcccggcucauuuuuaaauuauuuuuauuuuguagagacuggagucucacuguguugcuggucuugaacuccuggccucaagcaauccuccugccuuggccuccgaaagugcuggaauugcagucgugagcacugcagucagucaagaggaggguuuugaacagaggaaguuaaacaacccagaacuuacaguacugaaauaucuaagugaagagugguggcugugggaagaaucaguugacaaauauuuacugaaucccuacuauuugccaggaaauuuccuaaacacugggcauacaguguaauaaaacaugcaccagucauugcccuccugaagguugucuuguaagauuauuaauaaaugauuauauaugagaaauaauuacaacuaugcuagaugugagaaaaaaaugggugauuuaugacagaaugauagagaagggaggucuaaucuagucugagauauggaggaaggcuucuuggaaaaaauaauauuuaaagugagacugguaguaugaguagaaguggguuaugugaagaggaacaggagagaggagggcauuccaagcagaaaguaucugcucugcaaaagcccuaaagaaggcugggcgcuguggcuuacgccuguaaucccagcacuuugggaggcccagguggguggaucacgaggucaggaguucaagaccagccuggcccacauggugaaaccccaucucuacuaaaaauacaaaaauuagccaggcauaguggcgggcgccuauaaucccagcuacuugggaggcagaggcagagaacugcuugaaccugggaggcggagguugcagugagccaagauugcaccacugcacuccagccugggcgacagagcaaaacuccgucucaaaaacaacaacaacaacaacaacaaaaacaacaacaaauacccugaagaaaaaaaaauggcauugucagagaauuggaagaccauuauggcuugagcuuaguagacaaagaaugauugaagauuuggggcugaauucuaagggcaauaagauaauaagaguuuagauuggaggaccaaaaagauuagaauuguauuuuuaaaaaucagucuaaaagcaaugagauuagaggggggaggaguaaauacaaaaaaccauugaagaguuauugcaaaaauguaggcgaagaugauaaaauaaauaaggauggacauggaaacaggugaauaauuugaaagauauuuaggaaguagaaaagacagaauuuugcaauggauuaguuucaugaggguuguggaagaaggucagggauagcugaaguugcuuaacuacucucuugaacuuucucauagguagauccuacuuccuacauggagagguaguaauaccaaugccauuuuuuggcaaaggaguggaggaagaaggaacaacaaaaugucaauuacauauaguaaugagccuuuuaugccacagcugccaauugucauaaacauaacagccucgauuuauacaaccuuugcaauucauucugucuccauuaaugcaagaaguuuggccauggcuguucaggaagaaugaggcaguuggauucuacauuauacaucuucugauaaauauucauauugcuaggacuauguacauucauauaauuuauaagcagagaaaaguaauaccuuguacaaccuucuaucacaguuuaaauaaguaauuccagggcacuaaagacagcauuucaguacacuaaagcacuaaaaaauuaguucuucaucaaugaauuggaaagcacaaccaugcccuauuguucacggacacuauaauaaagucaccuaugcuaaccuaaccaaugcuaucaucaaagagggagauaucuauuuuuaggaguaacaguugaacaaguuaaugucagugacuuauuuaucuuaaaucauuaaacuaaagauaaaccuaguuacucagagaaagaaaagaaauggcauuuucuuuuccagagaccaucaaauucccagucaugcuaacuacauucucgauagccucucucuacuuaguccucaaguaaugcuaaaaggaggguuuuguuugccauuaggccagaaagauacaaguaaaaaaaaauuaaaaagcaaaauauuugacacaauccuucugcuaguagagguugaagcaaccuuuuaaaugcuauuaucagaauagauauuaaaauauuaaauauccauaaggcauauaggcuuucucugugcuacaaaauaaaaaauauuucaauuacaccauaagucaaauugauauuaaauucuuugucacgaguaguagcauaaagugaaaaaaaaugcugagucuccuaggaauccaaauguguaggaaggcauuagugccaaaaugguacuccaagaacagcaacugaugggcgggcacaguggcucaugucuguaaucccagcacuuugggaggccaaggcggguggaucgcuugagcucaggaguucaagaccagccuggguaacaugaugaaaccccaucucuacaaaaaauacaaaaauuagcugggugugguggcaugugccuguagucccagcuaccuggggaggcugaggugagaggaccacuugagccuggugggucaaggcugaagugagccaugaucaugccgcugcuguagccugugccauugcacuccagccugggugauaaagugagacccugucucaaaaagaaaaagaggccaggcaugguggcucacgccuguaaucccagggaggcugaggcagguagaucaccugaggucaggaauuugagaccagccuggccaacauggcgaaaccccaucucuacuaaaaauauaaaaauuagccaggcgcaguggcgagugccuguagucccagcuacucgggaggcugaggcaggagaaucgcuugaacccaggaggcagagguugcagugaaccaagauugcgccacuacacuccagccugggugacagagccagacucugucucaaaaaaaagaaaaagaaaaaggaaaaggaaaagaaagaaagaacagcaagugcaacucacaggaaaaaaaaaaguacauuuuauuuaaugaccaaguacacacacguucacacacacacauuuguacauauaacuaaaacaauuuuuuauucuuaccacgugggaugcauugugaaauauucuauguucuuucauguaaagaaaaaugagggucacauuuuaguaaaaaaguuucacaaaucacuaauauguuauaaucuauaacucccauaacugcucuaaagcauugacaaugcuaagcuauaauuuuaggggaauauauauucgugcuccuucuuagaauuagcccaugauaguauuuuagggacucaacucagagaaaaaaaauuuaacauagccuuguugccauguauccaaccuggacaugguacaugcuuucagugaguuuaaaucaccuaccuuccuaggcccaaaaucugagggaaugacuuccaacuguguaacaggacccuuugucuguauuauacauuuuauauaugucuuuucauguacauuauuucauuugauccucacaacaacccugugagguaggccggggggaaaauguuagauucacuuuauagaugacgaaguuaagguucagagagguuaagugacuuucucaguuaccauauaccuaguacgaagcagacagaauaagaaccacuaacuuuugugguugggggcccuuuucucuaaaccacauagcuucugagaguauaauguaacccaaaacauuuuuaccgcuucauccucauuuccuuauuguuaauucaacuuuuuuuuuuuuuuuagacggagucucgcucugucacccaggcuggaaugcaguggcgugaucuuggcucacugcagcccccgccuccugguuucaagugauucuccugccucagucucucgaguagcugggauuacaggcgccugccaccaugccuggcuaauuuuuguauuuuuaguagagaugggguuucgccauguuggccaggcuggucucaaaugccugaccuuggggcauccagcugccuuggccucccaaagugcugggauuacaggcaugagccaccgugcccagccuguuaacucaacuuuuuauaggauaugauaaaagaccuaauucuaaauucaccaaauuuaugcuucucuaucaaugaaaacuuauggccacagaacacauuuuuuuuuuuuuuuuuuuuggaaagcacugucuccuuggcucuagucuaaaggaacguaagcaauaugaaggacccuagaggccaaggaaauugaagagaagucagaggaagggauauaaaauggaauguauuaauggauuuuagccccuuuaagcuuguacuuuugugagaggguucaauggagagcuuuaaugcagaugagacuugaagcuucugaagaagaucuaagucuugaugagguuauucaaacucaaaucuugaaugcauaaugaugauaggccauggucuucaaaaacgugguacuugaugcuugaaaacaaaacaaaacacaaaaaaauucuacuacaagucuaauaauuuuuuuaagggaaauuaaaaacuacuuuugggucaguaauuaaucagauuacuagauaccaugcugaaagaacaaaaggagaaaaucaaaaacaaagaaaaggaaaaaaauuuuuuugaaaagguacaguagacaaaauggcugaauauguucauuggcuuaucucuuugauuaauacccuucacugaaaauugcaacagaauuuaaaguucuuacagaaucucccuggggcuguagucagauacacugauuugaugauaauuuauuguaugucuuugaucucuauccaugauaucaaauugucuuaaagagcuuuugaucucugaaagcauagccaaaaugcuuguuggaagagauagcauaaaaugauguucacuuugugggguagggaaauaaacugauguggaaguauuaugguucaaaaauauuguaauauuuaaacagggagaaaaagaaacaaugccuucaaauagaaaaauucagaucccuuugcaagguucaaaugaaaaacauaguaaaaauauuguaaacaugugcaugaugcaacaaaagacagguuauagcccucugaaauuucagcacaguaaauaauuaucagaggccucugucccucaggguauacuagccucuguuccauaccucucccuucucuuuuucagaagagguuuuuaaucucacugacuuaauuuugugcucauucuguuuaucuuauaugcuuguauaaaccugccuaaaaacuaauaauaauagcagcuaauauuuacugaaucuauacuuugugccaggcacugcucuagacacuuuauguagauuaauuccuuuaauccucacaacaguccaugaauuagauacuacuaaugucuccuauuuacagauaaagaaacugaaguacaaaaaaauuaagaaauucagguaauuaccgagcugguaaauaguagagacaggauucaaacuugggcucucuggcuccagaacagaaagcaacacccaccacucuacaaaauugguuucaauacaacagaauuuaccaggacccgggcuuuaucuuaaucagcauugugccaugucacaaucuuucacuucauguuaugauuagaaagcacagugacuaauguaaauuccccaacaggaguaauauagaauccauuucagcagucacugcucagaagugacacccugugggaaugucaaagcaguuuaaaaaugaagcacgcacuaaaauauuauagugauaaaggauucugacaacuuuacuccuuuuuuugcuuagguauauuuucuauaaccuaauuuuuguaaaguggauaugaauuacuuguauaauuuuuuuaaaguuuuuucaagcaugccaucaccauuauuggcauuauauauauugaacuuacgcuaaaacuauuagauaaguuuguucuugcucuacuugaauagccaaaaaaaacguuauucaagauaaaguaagcuuuaugguaauaaugaaauaauaauaauagcuauuuuuacuuaggcaagccuuuauauacauuaaccuucagcaaauuccuuuuuacaguugaggaaauugaggcuugaaaugaauaauaaaacuuaauuaauagacuggagcccagauucaaaucugucuguauuacucuagaguuugcgcucuuuccacuauacaacgcagccucuccaaaugccaaaauaucuguccgacugucuuuuguuauuaaacacacugaagagaucuuucuaaaauucagguauucuuccuuucuucaauagaaaauaccaaacauaaauuauuucuguucagucaggguuaucauauugaauauccauuaauauagagcuguuuucaucuuaucaaaaggacucagguugcuacaauuuuaaauuagcuggucugcuuuaugguuuuuucuuuuuuucuuugccucuaauagaagcaccuggacucuucaugguuuguuacuucuaauaucucauggaguuagaugccagcuaauuaagccuaucagaauugugucuaaaauaaaaguaaacugaguaaggaccugagaaaagcauguuaauuuuaugucuuauaauuugaaguucaaguaauuuaaaauuuauguccugguuaugggugagguaagguugguggauaagugaccaguggauauguuagcuaucaguauuuaaauauaggaauaagagauuaaacccaucgacaauaaaucacuuuauuacacuauaaaaaaguuuuuaggauuugaaagaggccuccggaauaaucuaguacacucucccauacaaugaaaaauucccucuacaauguuccugauguucaaauucugcuuaagcaacccuaauuaccaggaguucacugccucucaacacagucugcuucacugcuaacuauuaauaguucuauacuuucucuuauuuugaaugaaauuuggccucaaauaacagagaacaagcauacuuccuauggaguuucuccaacccuuccaaagucuucuaaaaauucccaguccccucaaucuagaucaucacaauuacccuuuuauaggaucaaaacguugaguaaaaacaguucuccuguucugcaagguaaucaaaucuguuuuuguguauuaauguuuuacagguuaaagugaucuguuuaaucuugguuaaucuugaucauaaacaauuggaaugcuaggaaagacuuauguucuaguucaauucaaauugaacagcaauaaauuuuugaguucucucuucuuucugcccuccccaaaacaacacaaaacagaaucucaaaagauaugguuaacauaauaauuuauguugcuacauuuuaauuuucucacuuaggcuuaggucugccuuccugucauuucgacucugugaauaaucuuaaaacuucgaaaauuauuuaagcuacucgcaaaaucaucaauuagccuaugacaggcccagcucuaaggccuuaaugcacuuauuuauuuauuuauuuuuucucauugacuaacucaauaacuuccuaucugguuuucuggaauauauauauacacacaaacacacacacacauauucucuuuuucucucucuauauauauacacacacauauauuucuggaauauauauauucucucuauauaaauuauauauauuuuucuggaauauauauauucucucuauauaaauauauauauuucuggaacauauauauguauguaauauacauagauguagguauaauauacuauguaucuauguacacacauauauacacacacauacagaagcagcuuuccucauuucuguguuuucuacauguaacuuuuacauucagguucaucuccuuucuuuccaugucaccuuuaccauauucuauccucuugauuuaggaaaagaaucuguccuuggauucaauucauugcuauccauucacuuagcaagaauaaggagucuuaaucuaggcaucccacucacugauuuccccuucaugaugauagugauuaaucccaaggacauuaggaaacaaagcaucauuuaacagaaaugacuauaugcaaaauacucugccaaguuugcccaggauggaguccaauggcgcgaucuuggcucacagcaaccucugccucccgaguucaaaugauucuccuaccucagccucccaaguagcugggauuacaggcaugugccaccaugcccagcuaauuuuuuguauuuuuaguugagaugggguuucuccaugguugucaggcuggucucgaacucccgaccucaggugauuugccugccucggccucccaaagugcuaggauuacaggcaugagccuauaacuucuuuuauucuacuaaucaugacucaaccccuaguuagcagccuucauuauuaauuuuaacagacacacaauaagugguaucauauagguauguaucuuauaaagccuauucucaagcaaguuucuaauaaaaucucuauuaaaaaauaaagauuauuauuuaaauuuucauauaauuaauuuuacuuaucuauuacuacuacuccaaauauccuacaauaaaagugugggaagacaaaaaugauuaucgaaguaaaagucaccagaauuuucugcugcauucccaaggcagauaaucagccaauucaaaguaauacaaaaugagauugccaauuauauaaauuauuuuucugguuugcugauuuuacuaacagaacaagcuauucuucgaaaugccuuaagccaguucuaaacaucaagaacaaaguaaaauaauaagaguuguuuaaaaagucccuaaauagcaauucaaauaaaacaaaguucauccuauucaguaauacugugaaguucagaacuaugccacugcaauacuaaccuagcuugcaaacaaagguaacacccacgguaucaccuggucaggucagcaacaugcaauauacuguaaaugaauacugaauucagcaagacuaagcacugaguauucuuaagaucuuaauaguaacaaucuaacgucaagguuuaaaauauauuacaauggacuggaauagauugcagcucugaaaaaaacuuaacucauuuguguaacccuacuucuucuaaauaguccaaguauuauaagaacagaaagucauaagggaauaguaaaaggcucucauaauuguuaaauuauccuaaagccuugcuguuuguuuccuagcauuaugaaaauacaaacaugcucauaguaaaaaaaaaaaaucaacccagcagaaauaguauauggaaaaaaugugagauguaagucucuucuuccuacucuaggccucuagucucauuccccaggguaaucugucaauaauuccuuacacugguuugaagaaguuuuguauguauguauauaaauguaugcucuauauaaacacaaaugaaaacauacuauauguaaaguucuuuuuauuguuuucccaguuaauaagguauauuagagauuuuuccauaucugcaucucugcaccuacuuuauccuaagagcugcaaaguauuacucuguauaaaggcagucauuuaacuagaccucuguugaagcacaggcuauuucuagcagguugauuuuuuuuuuuuuuaauuucaaacaauauggugaaaaaaaucuuuguaugcaaauuucuguguguaaggccaaauagaucugaaagaugaauuccuagaaguacugccugcuauagaauuaaacaaauucuaaacaagaaaccaguguaucuacaaaggagaccagcaaaaaccuguaaguuuaauguuuagugauuaaaaggugacaaauauuaucauaaaguuagaaguuuagguucugaaaaugaacaaacugaucaauuaaaaaaggcaaaaugggagaaaagaaauuuugcccccuugagacagaaagauaaaaggccuggagaaucaaccaccuaacaaauuuuuuuuaaaagaagaagaaagaaaaaauaaaauaguauaaauaaggcagaauaaagaaacgaagacauuuuuuggccucuuuucuugcuuaaaccugaggcacaagauaaaacuaaucaguagauuugauacauauacuauuacacagcgaaacuuggaugcaagauaauuuaaaugacuauuugaggccucauuucuacacgggauccacagauuaaauuauuucuacccggauguaaaguguugaaaggaagcuccccccuaaaaaaagaaagcagagcaguagccuuccaggaacaauauaaauauagcuugccaaucuuaaauuucuuaucaacuuuacaggaaaauaagaacaauugcuucauauauacaaaacaaaccucucuuuggaagguccugauuaaaacauaaagagauuaagaacuguacuuuucaauuacaauccuauaauuuccuaggcaaauuuaagauuggucuaccaucucaccaaacauaaaacacagucaacuacuuaccucucccagagugcuaggauuugaaugccacaauacauauugacucauguuuuuguccauuaaugguccguggguuucuuuaaaugaaguccauuuuagaguccauagauuucaguguucugcaaaacuaaaaaccucaagaaugucaauguacagaccuaagguaccacugagauaccaacucauuaugaauaaaaguuauacuacacagacauuuagauguccaaaauuuaguggacaucacauugaacagcagauugacacugaacaggagacugagguagcaaaauuagacugcauuuuuaaguaagacaauaauauuaacauaaaucuacaggaucucaaaacaugacuuuguaccauaauuuuauguauucuaaggguggcaccacgguaacaguauacacaaaugggcaugauucugggcacuuuccagaaaucgggaacacaagguuuaaggguauguaaacuuaaaauuuaaauagugcaauaauauauuuacaugucaacuuuuuggaguuuucagccuauuuuaagaacaucuuagauuuuuacaucuaaaaaaugcuuacgaguuucaucuuuguaaaacacacacacacacacacacacccguaugacauaaauucaggguuuccuaccccacuauaccccaucuaacaguaagauucugaaaccagagcugcuaucucauuauguagcccaucaacauucaccucacuggacuagguaguaauucaugccaagauuucauuacauagccugacgacagucucaucugcacuuuuuuuccauuugacaaccaaaaccaaucugguuacaguaguuguuuuuuaggucccugcccacuuuuuaucacauuuuuaaaauuaauuuuuauuuuuuaaauuuuauuuauuuauuuauauuuuauauuuauuuauuuauaguuccugaggaguuaacucugucgcccaggcuggagugcaguggcacaaccucugcuccugcaaccucccccucccggcuucaagcgauucucgcgccucagcucccaaguagcugggauuacaggcucgagccccgcccggcuaauuuuuuccauauuuuuaguagagaugggguuucaccauguuggccaggcuggucucgaacuccugaccucaagugauccgcccaccuuggccucgcaaagugcugggauuacaggugugagccaccgugcccggccccacacuuuaucacauuuaagacaccuaagcaaguacuuccaacaaaggaaacaguuuaaucuucuuuuggggacccucuauuaauacaacuguucagaaggaguuaaccuuacuuauaaacaccagcuguaaucucuggauuuuuauaaauuacuauuuucauuuuuauaauggaaaauauaagauauauucucaauuauaacauauuuuuagugaguuaaaauucucacaucucaaauguaaguaguacacuuacuuauaagauaaggaagaaaacauuaagaaaaaggaaaguggccgcgcguagugguucacgcccguaaucccagcacuuugggaggccgaggcucuacuaaaaauacaaaaauuagcugggggugguggcgcgugccuguaaucccagcuacucgggaggcugagggaggagaaucacuugaaccagggggucggagguugcagugagccgagaucgccacuguacuucagccuggcgacagagcgagacuccgucucagaaaaaaaaaaaaaaaaaaagaaagaaagaaagaaaaaggaaaguaaguuuacuuugcuuaaaagaaagcauuaagaacagucagugcuacaacagcaguuuauuuacaacgguccaacuccucccugguaucauuucccuacaaguucuucccagaaaaguaaaggaaccugaaagaagccaaaguaaaugacucauccucuccacccggauaagaauacuaagacacauuucugaauuucaauaaccauaaaaaacaaaacuaacaaaaaccaacaauguacuggguaucuccugcaccagcauccucauaaaccccugguuagcaaacuaaacuggagucauuucuacauucagagguuagaauacugaaauuugggagagguucugccgggaagccagaaacagguugguugguucauucauucauucauucauucauuccuucgacaacaucuaaagcaugccuacuugucgcaaggcacuaugcuacgaguuaagagacaaaaagucgaggucccuguccccuauuagcagaacaggucgggguaggugaacccuaggucaacucaucucagugccccaggcuccgucucuccaacauaagcgccagugaucggaaacccaugacccccagccaugucugauuccuagaagacucaaccugucuguauuuccucgacgacuucgggccccaagaccaaguucccaagaguucuccauauccucaaccccucagagagucuaaugccaaggagccuuuucuucagccgccaccuaaugcuguccauuaccuaaccuguguccacccgcgcuuagggccccgagcgaucuaggccaucaacuccagcugccacccucgccccccguucagauccgcccgcagguuaccugucggggauccuaggcucccagcgcaucccagacgcuccgccccacccauggcgucacccuccacaaccagguaccgccucccgu

SEQ ID NO: 192620 - RNA, 16609 nt, Homo sapiens
accggcguauucccgcccugcuuuucgcccgccguuccguggcgggaacugaggcgacuguggggacaucagugaucguaagucuccugggcccguuauucucagauuaggugacggagcuaagacuucgagaccaucucguccuuuuuguaucgcggaaaccugaggaacgagccggcggcggugaccugcacgagaagccaggcuaacugguaaccugcuggaggaacugcaagcccgcuucgccuuccccacuccugcccuugaugccccuugugaggucuuccaccuccuucggggccccagccuaguggcccuuucaugcccuggccgcgcccuuuggugaaauggugguuccggacagcaucuugcaggccccggcuuugggcuguauuaauguuuaacagcccgaggcagggauggacuaauccaguaacguuauaaaaaccuuggcugcuaacagauauuaaaaauuuauuuuauugagcauauccccauaugccaagcaaggaacuauguauuugcauacauucuuuuauuuaacucaguuguccuguggaauaggccuuagcuccuuuaacagaaaaggaaaccggguaucauagaugguaauucauucaccaaauauuacggagcaucuaccauguaccaggcacuguucuaggcaccagggcauguagcagugaaaaaaauagaauuaaccggggacuuuucaggcgagcuaaugaugcuuuuuaucccugaaaacagccuggaagaauguuuaccugcauguuagaaauaguuaccuucugggugggauuuuguauuacuuuuuuaaaucucucaugcuuuuaugcauuguuuugauuucuucaagugaguguguuaugagaaaaacagcuguuucuauuuuaacaacagagucccccaccuucccuuccccacagaaagucucugaagguagguaagcauugacucugccaugaaaauaggucccuggccaggcgagauggcucacaccuguaaucccagcacuuugggaggccggggcaggaggauuacuugagcccaggaguuccagaccagccuaggcaacauggugaaacccugucucuaccaaaaauuuaaaaaauuagccgggggugguggcacgcaccuguaguccuagcuacuggggaggcugaagugggaagaugacaggagccugggaugucaaggcugcagugaaccaugauuccgccacugcacuccauccuaggcaaaagagugagacccugucucaaaaacaacaacaacaaaaaaaggucuuugaguucugacccaaggaaaggagugaagguucucauuuguggugcaagcagagcaccuuuaauugccgaagaguccauuucagggucugagcuagagcuaggcccaugacugugaaagaaaccauggaggcccaugugguuuggucauuagcaacaucauauuuaucaaugcauuuggaacucauuaaacauuuuugugacauaugaucuuuguucuauaacuccugcacuagaaauagauucuaaguucguuagggacuuugaccacuuuucuguucuuguagcccucaguacagugcauucagaguguccuaggucauggggugauguccuuuauuauguaacaucuuugcacaaggcuaaguuuauuuucgggcuguacuuucucauaaugguuccccaccaccacccccgcuuuccuauggugcugauucgcaauaaaaguuucaauaaaagcuuuuuuuuucugucuugcaccugaccagggugaaguaccaugcaagcauuucuuaaagguacauccaucaguacuaaacccccgcugaccaaggaucgaggaguagcugccagugcgggaaguagcggagagaacaagaaagccaaacccguucccuggguggaaaaauaguaagaacacuugugucuuuguuaaaauaauucauaaauuaucucucuaaccaguacugaucacuuuuuuuuuuuuuuaacuuauggaggaaugcuuuguucuguuuagaaguugucuuugaaaaaaaaucacccacuuauauaagucauagaacccuggaacuaaaguuaccugagaauaaucuaguuuaacucccuuauuuuguagauaaacugagaucucuacaagcagaggcuuccauuuuaggggcugggauacagaagugaagaaaacaaaaguuucuguaaacuggcuauaaauacuaggucaggaguucuacuuaaauccaaauauguaaucuguuccuccuucuucucauuacaauagguggaaaguauuauuauuauuauuacuauuuuugagacggagucucacucuguugcccaggcuggcgugcaguggcauggucucgacucacugcaaccuccaccuccuggguucaggugauuauccugccucagccucccaaauaguagggauuacaggugcccaccaccacaccuggcuaauuuuuuguauuuuuaguagagacgggguuucaccauguuggucaggucgaucgcaaacuccugaccucaagugauccaccugccuuggcuucccaaagugcugggauuacaugcaugagccaccgcgcccagcccuggaaauucaguuuugguuagcucauacauuuuuguccaaacaacacuugaauuagcauuuaaauugucagucaccaccuggcaugguggcucaugccuauaauccuguauguaaucccagcaauuugggaggccaaggugggaggaucacuugaggccaggaguuccagaccagccuggccaacaugucgaaacccccucuuuacugggaaaaaaaaaaaaaaaaaauuagccaggcauguuggcgggcaccuguaaucccagcuacuugggaggcugaggcacgagaaucacuugaaccugggaggcagaaauugcagugagcugagaucacaccacugcauuccagccugggugacagaacgagacucugucucaaauaaauaaauaaaauugucagucaucuaagugauauuaccacaaguaauuguaacuauugguugaauguagccucgguaauuaccaauguuuacagauuacuuauaggccgaguaaggcccucauauguuuuuuguguuuuuguuuuuugcuugccuuuuuguuuguuuguuuuuuugggacagauucucacuuugucacccaggcuggagugcaguggcgcaaugucagcucacugcaaccucugccucccagguucaagugauucuccugccucagccucccgaguagcugggauuacagacaugccccaccacacucagcuaauuuuuguauuuuuaauagagacaagguuucaucguguugaccaggcuggucuucaacuccugaucucaggugaucugccugccuuggccucccaaagugcugggauuacaggcgugagucacugcgcccagccccuuauauguuuuguuuggcaccaauaaaccucaugaaaaucuagauuuuuuuaauuauguggaggagggucuggauuuucagcuucucaggagaucaggcaacacugggggcagguucucacaugacaggaguuauauggacuuguguacugcuucuccuuuuggaaaggucguguguuccucaauuugccauggucccuacuauaucuugcaucacacucugccuuccucacucuuguuaucugcuuaaucucugcagguauuugaauaugagucccugcuuuauaacauauacuggauucccaagagaagacauuaaaaaaaaaaaucauaauuccuaccuaguguuaaccugauuuaucgaaaaguauggaucaaagaacuuuugauuaguuaacuaagcacaaagccuaagcuuagaguuggaaguguaacuuuguucuagcuucucuuaaaaaucacuguuguaagaugaaaauuauauaugauacuucauauugguucagcuuguuguuuuuguuagcccucaaugaauugaauaggucuucauuuuuuuaugcaguuagaugauggaaaaaauuggcauuaaccaguuaacacauacuaaguauauauguaacuacauuaaccaaaauaguuaccuauacuaagguuacuaaaugguuuucccuuuucaucuuaagauucaugaucuuauuuugucaaaguggaacaaugcuuuuuuuuuuucuuuugagacagagucuugcucugucgcccaggcugaagugcaguggugcgaucuuggcucacugcaacuucugccuccuggguucaaaugggacuacaggcaugugccaccacgcccaccuaauuuuuuuuguauuuuuaauacagacgggguuucaccauguugaccaggcuggucucaaacuccugaucucaggugaucugccucccaaagugcugggauuacaggcgugagccaccgcauccggccaauaauaaugcuuucuaagcagguguucacuuuaauuuuuuuuuuuuuuuuuuuuuugagauaaaguuucgcucuugugacccagguuggagugcaaugauacgaucucggcucaccacaaccucugccuccaggguucaagcgcuucuccuuccucagccucccgaguagcuggcauuacaggcaugcaccaccaugcccggcuaauuuuauauuuuuaguagagacaguguuucuccguguuggucaggcuggucuugaacuccugaccucaggugauccaccugcuucagccucccuaaguguugggauuagugugagccaucgcacccagccccacuuuaauuucuuuuuuuuuuuuuuuuuuuuugagacagagucucccucugucacccaggcuggagugcaguggugcgaucucagcucacugcaagcucugccucccagguucgugccguucuccugccucagccucccaaguagcugggacuacaggcgcucaccaccacgccuggcuaauuuuuuguguuuuuaguagagacgggguuucacuguguuagccaggauggucuuaaucccccacuuuaauuucuaauuaguguuuguagcauauaaaauaaaauccuuuuucuuuaauuuuuguggguauaacagauucgagcaaugcagaaaggaaguaaaacauuauuucacucuuucagaauguguuugguuacgguaaaaacaagugggguuuccaccuauuuccgauuaugaaaaaguuucucauuucauugcugauguuuaagaauggucauugguauuuuaguagaaggaacacuugagaguuuucuguggcuacuauaauauacuaaauaaccucuuuccuccuucucaccccgcaagucgcccaaaauguguggaugaaguugcuuuccaggaagaagugguugcagugcugaaaaaaucuuuagaaggagcagaugugaguugcaaaugguguuuaaugucauugggauauuuaagacuuaauuuauucacccucuuucuuccuuuauaacuucuagcccucguuaaauaucuugcucuguguacaguagguccuugauaacuauuuguacaaugauaauuaguucaaauauuuauugagcaucuccuauuuaaucuuacauagcaguguuaccuaguauucaaguaaaagucauaguaauuaagacaaacuaugaaacauagacauagaacaagacauaaaacauagaacaagacaaacuaugccccuuuuuucauggguuuuuauugguaaggaaagauagaauaaacaaguaaaccaauaaauaauuauagguaguaauaugugcuauaaagaagagccagagauuccucuaaaguauaauugcuuacuaacuuuaggauuuggauugaccuauaauacaaaaaaaaaaucgagcuuugaauucugcuuauagcucucucuucugcugugaucugggggauaaaguauccauggauaacuugcauuguaaauuauucugagauaagauaaacccaugugaaaaauuagcaacuuaaaguuguguuaugaugaaugcccaaagugcuuuaacagcucaguaaagugcugaagugggaugugguuuuugcuuuaguuucaagauuugcuuccuuccucucaaucuggcugcuuuuaauuagaaguucuuuuggguuuugcugccaucauucccuugcugaaauuauauuacuacaguacacauuuugaaagaaguuaaauuuauaaaacuauuuagaaucuuuuucuuuaccaguauguguuuugauuugacucgcauacucuuauaccuuuuuggccggccacaguggcucacgccuguaauccuagcguuucgggaggcugagaugggaagaucacuugaggucaggaguucaagaccagccuggccaacauggugaaaccccaucucuaccaaaaauuagaaaaaguagccaggcgugguggcacacaccuguagucccagcuacucaggaggcuaaagcgggagaaucauuugaaccugggaggcggagggguugcagugagccaagauugugccacuguacuccagccugggugacagagugagacucuggucucaaaaauaaauaaauaaauaaguaauaaaaaauaaauaacacaaauacucuuauaccuuuuaauuuuauaauaguauagcauuuuauuuuuugguauauucugcuugcauaucuugguaacaguauauaccauuuuaauugcaguugcauaguaauuacacagauugcaggacaauaucuaauuuaauuacuaguaucuucagcaaauguagugagauuaagauccaguucuuuuguuuuuuuguuuuuuuuuguaauugagacagagucuugcucugucacgcaggcuggagugcaguggcgugauaccagcucacugcaaccuccgccucccaggcucaagugauccucccaccucagccucccaaguagcugggacuacaggcaugcaccaccacacacagcucauuuuuguauuuuuaguagagaugguguuuagccaugucaagugaccugcccgcuuuggccaccuaaaaugcugggauuacaggcaugagccaucaugcccagccuaagaucuaguucuugacuuuaugccacguaauuuaugaggcugaaguaagaacuucaguuuaauauuuugugcaccuuuucagacuaaguuuuguaaagaggugaaauaguuuuuuuaauucaaaagaguaaaggaaaacaauucauucaauuuauuuugaaagguuuuaaagaauuauaagaagauaauuuuuucagaaauugauuuuaagaacugguauuccacauacaguucuugaauguacuacauauauuagacuaguguauaauuaagguuuaauaauuuuacccuguuucaaagaauuuaaauuauuguaucugauaguuaaccuggaugaaucguuacauuguuaagggaugcacagaucaaaauaauaguuguagaccuuaauuacuaagaagccugggagguuuuuaaguuaugaaucucauaguuuguucuguaagcuauauguuaugaauguaacaguaauagucuucuaauuaacauauuugucuauguauugguuuauucauucauuuggccaacauugacuacuguaguagaugcuagaauacagaugugaauagaacaaauaagguucuuggucuuuuaaugaaguagacaggcauuuuacaauuaagccccacagugaaauaacaauaaaccaaugcaaaaugcaacaaacacuaaugagagaauaggagaggagaccuacuuuagacugaaugguuucugauuuguaaugcauuaggaguuggccaggcagaaagaagaggaucagacuccaggucaugggagcaacauauguucgggccagaaagugccaagcuguuagaagccauuguaagcuagagccuggaaggugaaggaggugguaggcagaucauggaaguccuuuaggccaugguaaaaagcugaggguuuuuugguuuguuuuuguuuuucuaaguggaauaguuuuaaguagcaagcagagugguaucugauuuaggugaagaaugaauggacaggaagagggaggguuaggcaagaguggaaacaaacucuaaugccuaguuuccuguguacacugauuuccuuaugugacaggacauacugaagauugcacaguaucauaacagagcucauuagaauuuaguugacuuauuaauuuucaccacggaucagucgacugcuugauaggagccaaacuagcuagauacaagguauaaaagaagguagcuagugauuuaauuuuauccuuuccucuucuaaugaauucucccugauacaugcaagcauccuuacagagugcauaaucaugauguggagcagugccuaguacuuaauauauaucuaguuuuggauuuuuuguuaauauuucuguucuugguacuucugcucauccaaagcccuaauuaugucuuuuuuaguccuuuuuccucaguuuuggccaaaucccauuacucuuuuggucugcuuccccuuugaagcagcugacauuuuguguaauauaaaaucuuaccuaaucuugagcauagaggugggauaggaaacugagauucccuuuagaaauaaaagguuucucauuccagcuuugaaaauuucaccuaaguggauuagcuauagagcaagcauaaauauugguucagcuuaagagauuaaaaagacacuuggggaaaaaagugguaguauaugaaaaagcaggauuuaaaucugucaguacuaugauaucaguuauauuaagaaaacuuuauacuuagaaauuacgugcccuauuagagaagucauugcacuauuccacagacauuuuuuucgaucuuccuuuucaucuauuugugccagaauaccauuuauuaaaaauaaaauuuaauuucuacagcuuccuaaucucuuguuuuacggaccaccuggaacuggaaaaacauccacuauuuuggcagcagcuagagaacucuuuggguacguugaaaucagucuguuuuucuuuuuuuaaagauuugacaccaaaauucucugauauugcuuuuuuuccucuaaaaauuugcguuucguuuucuguaggauaguuuucuauuucugauuuuuaaaaaucccaugagccauuuuguuccucccucacuccccugaagaaaucagcuugccugcgucuuuugugaccuucauugugaaucuuguucaaguguggggagccuaugauuuuuuccaucacuuucuuuaaauuuuccauuauaacuuuggaguccagagggcccaacuuaauguccaguugugcugauaguuuuaucacccucuuaaugauuguguucacaucuguguggcuacaugauagaaucugcuguuucugauggcacuauuugcaccauccauucuugaguccugcucuggacuuccuaggcucugacucuggaguggccaguccagcuccuugccucaggucuccugagcacaagugaugguugauguagugugauuccagguacaccagaaaaucuuccugugagucaccuucuuauguuccucuuccuagauugaccaucuuggcuuaaccagccauucuagaggagcccuuuaccuagaguuaaaagauguguagugggcugggucugauauacaugaaacaugcaccaacauaacaaaggcuguuuugaguuuauccagaauuaauaucagacauacaacugauagaaauaucugaaauccuacauaugaaaauaggcugggugugguggcucacaucuguaaucccagcacuuugggaggccgaggcagguggaucaccuggggugaggaguucgaaaccagccuggccaacauggugaaaccccaucucuacuaaaaauacaaaaauuugccaggcaugguggcaugcaccuguagucccagcuacucggcaggcugaggcaggagaaucacuugaaccugggaggcagagguugcagugagccgagaucacgccacugcacuccagccugggugacagagcgagacuccgucucaaaaaaaaaaagacgccacugaaaucaccaaauguguaaggauuauuaguuaugucaaaauguaaaagacaaagggagaagcugcuaugugccuaauauuuuauuugacagcaauuuuuuauucucaguaaaauuauagaagaacuuuuuugauuauuccacaacucaaucagauagaaccaaucugaaucagccuuaacaguuguuuauuauuacuuagaguaggucaguccagauuauacaacuuuuucuauauccuuuaugaaauaauguuugucuuuaaagaacuuacuuuaacagugaauuucauauuuaauauuguggcuuuaaaauagaaaauagaugcauguaaauguuuauguccauaaacaugcuuaggauaccaugcugauuaggaaaaauagagaugaaacuaaaucacaacucuuguuuuuuauuuaaauguguguguguguguguguguguguguguaaaagacuagagggaaguuucaaaaacagugcuuugacagugugcccacuuuuuucuuuugauuucucaaauuucucuacaguaagcauauauuacuuuuaguaauuuuuauuaaaacucacuuuaaaaaccugcucauguuuuaauccauuaauuuuccuuaauccaguagguuuccuuauagcaaacuacccuguggaauuuauuuauuuauuuguuuauuuauuuauuuuugagacagugucucgcucuauugcccaggcuggagugcaguggugcgaucucggcucacugcaaccuccacaucccggguucaagcaauccuccugccucagccuccugaguagcuggcacuacaggugccuguaaccacgcccagcuaauuuuuguauuuuuaguagagacaggguuucaccacguuggucaggcuggucucgaacuccugaccucgugauccacccgccucggccucccaaagugcugggauuacaggcaugagccaccacauccggccggaaauaauuuaaaaugugcuauauuauaacauuauuuaaaauuacaguauuuaaaacuaucuagaugucuaacaauagaagaaugugaaguaaaugaugguacagucauaggauggaauaucauaugacuauuaaaauguuauuuacagugguuuugauaauaugccaagauacuuauuauaaaugcaaaguggaaaaucgauuuaaaauuuuauauguggggccagguguggugccucacaccuguaaucccaacauuuugggaggccaagguggaaggaucaccugagaccagccuggccacauaaugagucccugccucuacaaaaaguaaacaaaauuagccaggugugauggcaugugccuauagucccagcuaguugggaagcuaaggugggaggaucauuugagcccaggaguucaaggcugcagugagccaucaucaugccacuguucuccagccugagugacagagcaagaccuugucuccaaaaaaauaaaaagaaaagaaauuguauauguuauguaaugucuacauuuuuuuaaaugcauggaaaaaagccaaaauguuaacugcagcacucugcugaagcgagaaugcaaaagugauugugugccuucuauccauguuguuuacuagguggauuuuaaacgucugcaaagugugcaaauguuaaaaugugauuuaagccuacuugugcucuauguuucauauuuguuucauuuugagauaggccugaacuuuuccgauuaagaguucuugaguuaaaugcaucugaugaacguggaauacaaguaguucgagagaaagugaaaaauuuugcucaauuaacugugucaggaagucgcucagaguaaguaaauuugcccucccuccuccauagcauguauuauuuuaaauauguauuucugccaucgcuccucagccuuuuggcuaagaucaaguguauuucugccaaauugucaacuuuucauguuagaagacuauccugccugagguaaacagggauuuaaucaacuacuuaugcuccuuagguggcaaagguccaggauuacauuggugguaccuagacauauguguaaauuuuacaugagcacauuucaaaauuugugaaagugaaugacuaauuuuugauaugcaccuuaaauugauggugcagucagucacaaccgcuauagcaccuaauguauuuuuaugugaaaugaagacugggagguggacuaaaagacucugagaucccuucuaccauuaauacuugaaaucuguuuucuugguauaauuuucauacaauuauguuaaugccacuuuuggugggagaaaaacuuuaauggcagauuaccaaaaaucaauguacagaagguaauaacccgcaacgugggagaaaauauuuacaaaucauauaccuaaaaagguacuuauaucuagaacauaugaagaacuuuaaaaacucaguaauaaaaacaaauaacccaauuaaaaaaugggcaaaggccgggcgcagugguucacaccuguaaucccagcacuuugggaggccgaggcagguggaucacaaggucaggagaucgagaccauccuggcgaacauggugaaaccccaucucuacuaaaaauacaaaaaauuagcugggugugguggcgggcgccuguagucccagcuacucgggaggcugaggcaggaguauggcgugaacccaggaggcagagcuugcagugagccaagaucgcaccacugcacuccagccugggcgacagagcaagacucuaucucaaaaaaaaaaaaaaggcaaaggaucugcauagacauuucgugcauguguaauaagcacauuaaaagaugcucaucaacaucauuauccauuugggaaaugaaaaucaaagccacauugaaauaccacguaacucccacuaggauggcuaugauaaaaaauacagaaaauaacuagcauugacaaggauguggagaaaugguaaaccgcauacauugcugguuggaauguaaaaugguacagccucuuggaagacaugucugcucaaaaacauguacacaaauguucacagcagcauuauucuuaauagccaaaacauggaaacagcccaaauguccaaccgauuaauggaugaauaaaugugguguaucuauuugccauaguauuugacaauacaaaggaaugacgcaaacacaugcuacaauauggaugaaccuuuaaaauauguuaaguggaagaagucagccacaaaagacugcauauuauauguuccauucauaucauguccagaauaggcaaaucuauagagaugaaaguagacuaaugauugccuagagcugggaaugacugggggaagaagagugacuccuaauagguacaaaguuucuuuuaggagugauaaaaauguucuaaaauuagauugugguaaugguugcacaacuuugugaacauacagaaaaacacugaauuguacauuuuaaaugggugaauuguaugguacguguaucuuucaacaaagcuguuaaaaccaauauacauauuaauguucaacucuuauguguuucucugaaucagugggaagccguguccgccuuuuaagauugugauucuggaugaagcagauucuaugaccucagcugcucaggcagcuuuaagacguaccauggagaaggagucgaaaaccacccgauucugucuuaucuguaacuaugucagucgguauguauauugcccugaagacagaugcuaggcagccuuauuuucauaacccaauuagggaaaggaaauuuaggauuuucaaggcuacauuaauuuuuccuccaucaaaucuugauuuguucuugauaaaaaugaguucuuuuggggaaauucuuucuuuagacaccaacuugguuuuucucaucuuccacagaauaauugaaccccugaccucuagauguucaaaauuccgcuucaagccucugucagauaaaauucaacagcagcgauuacuagacauugccaagaaggaaaaugucaaaauuagugaugagguaauuacuaauuauuacaauuauuagaguuacuaauuccuuugaugaaugcauauaaagaggcccugaaagauuuaaauguguguugccucaauccugaugccaguucuucagacaaacuuaagcuaaaggggcaacaauugaaauguguaggaauuacaagguuuagcuuuucuauuacuuuuugaguuaauuaucuuuuaauauaucagagacccgaaacugagguggauuucauacauauaaugcaaauucugcaacauaaaucucugcaugaugacaagauuuuagucuucuagcuaauacuucaguacuucccuaaaauugauagaaacauaaggcccuuauucauuauaacagaauuuaaccauaauuugaauuugcuuuacgugagcaagaaaaugggauaaauauggaacauuuuuucaucucugcaaauuuauuucagaagcaagagaucucuauccuuccauuguacccggccccuagacugaucauauuuucucccaaaacagaaauguuuuuucucauuaacucuagacuaaaacaggguuuuucacuuuuauuaaacauuuuaaaauuaaaguuauaaauccuuaauuggccaucauagguuaaaaacaacucuuuucucuucagggaauagcuuaucuuguuaaagugucagaaggagacuuaagaaaagccauuacauuucuucaaagcgcuacucgauuaacagguggaaaggagaucacagagaaagugauuacagacauugccgggguaagaguacuggauauucugaauuucuuuuuaguuggcuuuuuuguggcuuuuaggaaauuuucauccaacaaauacuggguguuuagcaagugccaaguacugcacuaggaaguauaagggaauaaccugggaguaucagaguguuugaggugaggagauagcacugacuuuucaguuugucaggcauguaacagacauuucaggaaagaaaaggacacuuucaguuguuaguuuuuuuguuuuuuuuuuuuugagacagagucuugcugugucgcccaggcuggagugcagugacgcaauaccgacucacugcaaccuccaccucccgccucacccucccaauuagcugggauuacaggcaccugccaccaugcccagcuaauuuguauauuuuuaguagagacgggguuucacgauguugguugaccaggcugguauggaacuccugaccucaggugauccgccccccgcuuagccuuccaaagugcugggauuauaggugggagccaccgcacccagccuucaguuuuuagauuuuauaagagaugccuuuggcaguuaaaucaauuuuagcagauguucuuauacaugaaaacuauuuugccaguuguauauaaacaaaaggcauauccaacuuacaguaaucauuuauuaaagagaauggaguaccccacuugucuuuggauacucccauguaaaaacucacuucagaaucacuacuacuuaacaacuuuuguuucugugacauuuuucaccugcacgguaggccuuccauaugacaagacugguaccacuaauccucuuuguuucuaugacguuuuucaccuucacgguaggccuuccauaugacaagacugguaccacuaauccucuuuaauuuucuggauauuguggacuuuuuaaaccaaucucauuaguggcaucuuuacauggagacauugagagaaagggcacuuccccuuuaaagaaaucagucuuuuugauugaucuuggccacuguucugaggaaucguuauagccgcuaggggaaaacuuaaucuucauccacugaccagaacaagcuauaauccaugugugcccaaacuuggaaguucacaaagccauuaaagggcuuuaaaagcacaguuguuagcaccuugguugcuuaguggugacuggaguuacucuggcccuuuccguucucccaaagccuucccaggaaaguauggaacuuagguguggaacagaaaugacugggggcacgggggccaguuggcagaguguaugucuagucucaccuagaaacaucuuuaauaccgaacauucaauuaccuagguaauaccagcugagaaaauugauggaguauuugcugccugucagaguggcucuuuugacaaacuagaagcuguggucaagguaaagucagcuuacuaacuuuggggaaaggaauauuaagucaucauaccaaaaguuuuuuuuauuauaggauuuaauagaugagggucaugcagcaacucagcucgucaaucaacuccaugaugugguuguagaaaauaacuuaucugauaaacagaagucuauuaucacagaaaaacuugccguaaguagguacuuugcacaugucaauggaacauuuaacuaccugaaggaugcuaauuucuuaaauuuuucucguaggaaguugacaaaugccuagcagauggugcugaugaacauuugcaacucaucagccuuugugcaacugugaugcagcaguuaucucagaauuguuaacgugaauauaucuggaugggggguuuuguaaauaaugaaguuguaauaaaaauaaaaugaccaaaagcaccuuuaa

SEQ ID NO: 192621 - RNA, 256017 nt, Homo sapiens
guuggaaacggcacugcugagugagguugaggggugucucgguaugugcgccuuggaucugguguaggcgaggucacgccucucuucagacagcccgagccuucccggccuggcgcguuuaguucggaacugcgggacgcgccggugggcuagggcaagguaaaggcgggcuccuccagggccaccccgggccaccuguggaguccgaguguuaacuccuuuguucucagagccacuucagcggccgcccuuuuaagcgaagagguucccuuaggaugcuccccggguaccccuuccguuccccugcccucccccgacccgccucccccuuccaacccgaagguagcagcgcggggagcccggggcucggcgcgagccgccuccucacuucccauuggcugagagcgccgggaaagcggucacgugggagcgcggcaggccagcucgggggccgccaucuuggcggaaaguuucgggggagagcgguugggggcgcggaaggaggcgagguuccggggguggggcgugcggcagcaacugggcgagcgggccggggggccgcggcgagcgaggaggcggcgcggccgagaaggaggacgaggccgcgggggugcggcggcccaggggagcuccucccccgucccuucgcccccuccgcucggcuccgcgggccccgggcggggcggggguacguggagcggggccgggcuggggagcugcuccgagucuggccggggcgcaccccaguuccgagcgcacgccgcucaccggaacuuuguggcggcgccgcaggugugggggcccgcggaggugugcaugcggggcgcgagggcgucgcggagagcggccgcugcccuguccggcccccgcuggagcagcccggaggcagcgagcaaggagaaaggcaagcgagaggagggggcccgagcagggcgggcggccagucccgcugguccccucucagcgcucugcggccgcugcuggcucaggggccaagggucggagcgcuucacccgcccguacccaguagcagguggggaguguggauacuugugcgggggaagaggcggccucaggucuaggcucuuuggggaggggacgcuuucgaggagaguuuggaagccgacuucugucuguucuuaauuuggagggguacccacuccaaggaaaagcuuuccacguugacagacaacugcugcguuuugagacucuuucuuugacuugguaaaacuuuggaacgugggguuuucaaauaggcugcgaggguuuucuauuucgauaggggaaaaugcuaguuuaacaugauucuauccuuuuuccuuuccguuguguguuuuaaaggugugugcccucuuccugauucuggagaaaaaugccgguccggaagcaaggugagaguuuauuccguaacucuguugucgaugucacuugcuuuuccgugugucaguuuuuugauugccguuuuagaaucguuuguguaacuuugaugagacagcacgguccuagcuuuauugcuuagggaaucuaagccucauaucauuucagaagauggaaacacgaaaauguuuguuaaacuuucuuaacauuucucuagugauuaagagaggcaguuagcccccccccaacagauguccuuaauaacccugaauugguguuuuaguauuucacucuaucauucuuacuaagcacuauucuguaagcaacugugggauacuaagaauuuguauuuugaaauguuaaaaauuuggauuaugaugacaaauuguagauaaucugcuuuugcauuaucagguaaucugaaacuguugcuaauacuuugaucuuuuacuuuggcaaacuaccaguacacauuuauuccaaacugcucacucuccuccguuuucuaaugugauauauguuuaaauuuuucuuguauuucuuuaauuuuuuuuuuuauuuuuuggucauucuaaggaauauguguacaugaacauagugacaucaauugaccugaaggauuugcggaacuauuuagaugucaugcagaauuauuugcacuaguaugugauacuuuuuuuguaaauagagaguuuuaaucaggcucugcuuuuucuucucagauacccagagagcauugcaccuuuuggaggaauaucguucaaaacuaagccaaacugaagacagacagcucagaaguuccauagaacggguuauuaacauauuucagagcaaccucuuucaggcuuuaauaggugggaauuaaaacuucguaacuauuaugccagcuaggcuuuaugcuccucucaauucauuuauuuuaaacuuaagaaaaugauguacuuaauucucugaggcauucgguaacuugaacaucuucagugaguuguguguuuuucauaggccaguguccuuucuuaaaauaacuaguaaccaaaaaacuuucaggauuauuucaguggcuuuugagaacauuguuucacaucuuaauagcauuaacuauuaaaagauguugcacagauguuuaaggaccuaaaagguaugacugaguuacugugagcuuguuucuguauuugacuggcaugucucugaagucauugaaagcgugugaaggguucugcuguguugaagaacauucauucccuuaauguagauuucuguuugagcuuggcauucauggagucagaauuuuagaccuggaaaauaaucuuagagaugaucuugucuaguaaccguauuuuacaggcaagaaaauggaaaguuuuauucuuaauuguaacuuaauuugaaguggugcauuguuugaaagaacuggaaaaauaagaguccugaguucuuuugccacuaauugaaugauauaucccaagucauuuaaucuuuucuaugccaccauauuagcuguagaauguagcuguugaaaugacagaauggguuuaaagccuuuuuuaaguagauaaaucauuuuuaaaagcaucaucucauauuuuguguauaaucuccuauguauaaaacaaggugacuugucuggcucuuuuguccagguaccucaaaaaguuugcaaaccaccgaacuagaaaguuugucucuuccaauucuaagaaugaaguuuuuuuuuuuuguuuuaguuaucaacuauauaacauuuuaacauaagaagacauauacuuaauuauauuacauuuauuucuucaguaacuuccagucagauauggccuuacaucuaucuguugauagaauaauuguuggugugauuugaagacuacuuucaagucaguguguccugucagguacauuauugauaaauggaugcucucuacgguuuuagaaugaaagauuuuuguaaagaccacuugaugcaccugaacaauuuugaaaaauguaacauuuuaauagacuuuuaaaaacauaaggauacauagcacaguguaaugaacugccuuuuaacuguuacccagcuccagaaauucacauuuugccauuuuuguuuacauugauggacauuuuuuacacauuugaauuucugagguuuaagguccgaauggaugaucaaauuggauuccucuggaaaaacagcaaaaagcauuuuuuaguuauuuguuuucuaaaucaacauugagccuaguaauuuggugcaguuacuguugcaaaaaaaguauguuuuuucgcaacaguauagagauauauauauacauauauguauagauaggcagauagauagacugcagacuuuucuuugugugauggcuguaacuuaagaaaauuaaaucguuagugaaauaacagaaucuacauuuauauuucugucuagauuggggauggguuugcuguguucagagacauuuuugaccuauucugccuugccuguuuugaaugugucuauucuuacguacaauugaacuuugauagaguuagcuuucuucucuuuuuuuuuuuuuuuuuuuuugaggcagagucucacucugucacccaggcuggagugcaguggcgagaucuccgcucacugcaagcuccgccugccagguucacgccauucuccugccucagccuccugaguagcugggaccaaaggugcccaccaccacguccggcuaauuuuuuauuuuuuguauuguauuuuuaguaaagacgggguuucacuguguaagccaggauggucucgaucuccugaccucgugauccacccaccucggccucccaaaauguugggauuacaggcgugagccaccgcgucuggccuagaguuagcuuccuaauuacuaaguuuauauuugugaaucuucuaauuucauugguugugaauuuacuuugacauuuaaauuuacuuauauuuaauguucuauaggaugugguacuauaucacauuuugguguaagacaaguaauagauuuuaggaguuuugaaauagauaacguuuaauagagguucuguguguuuccaugcuauaauuguugauacuacggaauaaauacauucucuuguguuuccugaauaacuuuuaauacuuagucugaaaauguuuagucugauaagauuuucuuuguauuuugcaacucuaccauuguuuugaaacagugucauaaauguacuuuaagcuuguaaacugcccuaagcuaaaccaguucauuguguccauaguguuugcagaaaaauccgacucagaagacagagugccacuuacugaaagguuuuuucucucaguaaguggcacucugucuucugaguugguaccuguggaccacuggauuaaaggagaacaggggucuuggccaccugagcuguuuggagucauugagugcuuagauuuuucacuuccuuaauuuggaaaucacuuguuuaggccgcagugaguuaucuaguuaucuguuuggggugccaagugucuuuggauuuucagucugcauugaucauuuauugauugauucuuugaacugguaguuuauauugacuuuucaugcauuuaaaaaaguuugagucucuagggguuuggugucccccccuguaguugauacauagauuagguuccuguacuuuuggauuauucagagggacaagcauguacguacuguauuauauuuguucuaaaauaccaacuguuaaauauuucaauaucugguauaugucauuuuuaauugacaguguuucuguguucugacacaugaaauagugcauuuuauaauugauacucgcaauguaauauagaaaucauuggucuagugcugauagauacuugguaguaucuuugaaggauggcuuaaagauuuaaaaauuauugaaagcagaaaaguuuuuacuaauuuugaauuucagcugauguauuguuucuuuagagcuaaauauuuaaaguuguaucuuaacaaaaguccaugaacugcacauuuguuuaaaauuuacucccaaaacauaccuggugauuauuuuuguauaaaggaagauaaagucugcuuaauuucacucugugauuuaggugagagcaauuugaaaacuugcuuuuguauuccaguuuuuugugcuuaaguuugaaaauuuuuugaguagacgggauaugguuugauuauaaucagagcccagguauucagguccauagugguuucaguucauucaugauucuaaggugugugggaucugagaugacacugcuaguccauagagacuucauaccagucuaaaccccugcaguuauuucuuacgggaucagagaacucaucugcuuuccuugugcaugagaaaaacuggggcccaagauuaggcuggcuuuagagacuugaguaaguugagucaugugauuuguauauuuugucugcaauaaauaagcuuauucuaaugcaguguuuuauuucugcagagauuucagaaugaaaguggauuauguaauaauacuguccauuuaugaguuuaguuaccaguucauuuguugccacucuauuaaaaucuaauaguuucacuagcccuuauaaaaggacauuacccuaucuuuauuuguagauacuaguuucaaaaguaugaccccuuugccaucuucaccaucuuuaaauguacaguucaggagugugaaauguauucauauuguugugaaacaaaucuucagaacacuuucgucuugcaaaacugaaauccuauaccgaauaaacaacugcuccccuuuccucucacuucccagccccuugugaccaacgugcugcuuucuguuucagugaauuugaucauguuagaaaccucauagaaguauuugucuuuuugcgacuggcuuauuucacucaguguagaguccgcaagguucauucauguuguaguuguugacaggauuuucuuccuuuuucaggcugaauaauauuccguuguauguauauaccgcauuuuaucuagccauccauugauggacaguuggguugcuuccuccuccuggcuguugugaauaaugcuguuaggaaugugagugugcaaauauuucuucaagacccugcuuucaguucuuuuggauauuuacccagaaauaggauugugggaucauacggcaguuacauuuuuaauuuuuugagggcccaccauaauguuuuccauagugauugcagcauuuuacagucucaccagcagcacacaggauuuccaguuucuccacauccuugccgauacuuaauuuuuuuccuuucuuuuuuugauaauagccauccuaauaagugugaguauaugacuccucuucaaguguauguaaaacauaauaaccaacauuuauugagcacuuucuaugugcuaauacaaauauaucauuuagucauuguaauccugugagguguacauucaccuguaugagguguuuguacuguuuuauagacuggaaaacugaagcacugagaaaugaccaaucuugcccuuggacccucagaugcuaaauugcggagccagaaauugaacucaacuaaucugaauccauagauacuucucaccgucaaccauugggauauucuuuaucguuguuuuucagaacugaguauuuuaaucugauaaagaauacuaaaugacaagcaugcuuaagacagauagcaaucuuuaggguuaguaaucuuuaaaugauugucacuuugaaggaaaauauuuauaauggugcauuauguuuaugaugauggaaaucacacauuuugaaaacaguguuuaguaaucaggguuugagaucuuccagcuauagugguaaaaugucaaaauuucuuaaauuucuuuugcauuauauuagucccacugauguuacauuuuagucucuugcuaacuguguguguguguguguguguguguguguguguguguguguaacuuuguaggcuagauuugaguaaggaaaacaggauauggaucacaucguuggcugaaacuuccugaaauggagaauuuuaguaacuucucacuugaugguuuugauucaauuagauugaguucuuugcucauaguuugcuuacuacugcucugaagcaguguuuugauuauguugaaucuggcugaauucucuuuagaaccuuggaaucagaguuguaaaggcaucuaaauauuucuucuaagccauuuccucucugcagggucauauuuuuccucagugcagaauccagacuuggaccagauauuaccguuaguugucacgucucuuuacuuagggcacauuuccacagcuuuucuuugucuugugugagacugacuuuuuuuuuuuuuuuuuuuuuuuuacuauuuggagacagggucuugcucugccacccaggcuggagugcagugguggcuuacugcaaccucugcuucccaggcucaagcaauccuccugccucaggcuccugaguagcugggacuacaggugugagcccccacgccuggcuaacuuuuucuagagacagguguugcccaggcuggucucgaacuccugagcaaaguucugggauuacaggugugagccacugcgcccagcugagauugaugauuuugaaaaacgcaguuccuuccacucuuacuuuuuuuuaauauaauuuucucauuuuggguuugucugauguuuccuugugauuagauucagguuuuguauuccuggcuuaggauucuguacauccagagguacacagagucaucugcucuuuguugaugauacugauuuugauuaccuaguuggguguugucugaauucuguauccuauagucauuguuuuuuaccccuuguggcuuauaggcaauaugugggggagacacuuuaacaccauguacauauccuacuccuuagcaaaauuuccacccauauuuagcauccauugaugauucuugaaccgguuuauaauaugguuguugaaaaguaagauuucuaacaguaacacuccuagguuuaccaguuaacacuuugcauuuuauucuaaacaagagccuuccuucuuuuuuucccgugucuuucaugaacuugcagauaccuguuuuuuuuucaaugacuuaucauuuauuaccauccuuaaugacauuugugcucugagugauccagugggggcccuuucaagcuuguguccuuaugagaugcccucaucauuuuuuggagcacuuucuuaauuuuuggcauaacaagauguuccagguuuaucuuguaccucuccugccccagcccuggaaucagccauuucucugagaagcucugguuccuuuuaguacacaccuuguuuuauggaauaugcuugugagucauguaugauucuuagucuaauaguaucuaaaguauucaagugauuuauuuuugccuacuagcuugacaucuuuccuuucuuuagugugugaaacaauaguacaaacuuuuaaauuuuauaggauauucuuucuucuaggggucaaaaaugacuuuuuaaaugaacauugguuuagaagaaagaguauuugugcuugaguagauuugacuauugugguauuaucuuaguaugucaucugcccuucacugaugauguuaauuuugauuacucaauuggguauugucugaauaaucauacuugcuuuuaguaaaugaacugauagaauuuuuuuccucugaaaugguaggguuauauuucaguguucuucagcuuucuaguugccuuuccuguaacccuccaaaauaaauuuauuauaaaaaugaugcauguucuauauaaaacauuugagaucagauuauuauauguaaaauaccauaagaaaauauucacaccagagguuaccuccuacuucauccaugggaugaauauccuggaauguuauuuguguguguguguguguguguguguguaugcgcguguauacacgccaccccccaccuucauuuugcaaaacaaacuucuaaguaaaacaguuauuucccuugugagaauugauacuuaaaaucagcauguaaggugaaaaaccucaucuaguuaaaauuaucccugaaaagccuucagaaauuuaacacuagcucuuguuaauuacagcacaauuguuuuuuuuccucuaguggaaaggaaugauuucuucacuugagcccuagacgaagcaacuggcuuguuugacuucuuguacuaaaaacacguaauuauagaaucacacucagcacagugagauauagcaagaagcucacauuuugagaggcacaugaaaacucagacuaccuaaaggaagaaucuucuuccuucucauuuuuuuauuugugacagucacuuauuggguagacagaguugcccuuuuuugcaggggagauauacugcaguuguauuuguauaagugugaauaguaugauuucucuguacuauacauauuguuuuuaucuucuaaaguuuaucgacaaaugucuuuccaugucaguagauuucuaccauuuuauguauguauguauguauguauguauguauuuuuuuuuuuuuuuuuuuuuuuuugagacaguuucacucuuguugcccaggcuggagugcaauggcuugaucucagcucaccacaaccuccgccuccuagguucaagcgauucuccugccucagccuccugaauagcugggauuacaggcaugugccaccacgccuggcuaauuuuguauuuuuaauacagacaggguuucuucauguuggucagguuggucucgaacuccugaccucaggugauccgcccgccucagccucucgaagugcugggauuacaugcaugaaccacugugccuggccagauucguaccauuuuaagugacuguguauauagauuuuuuuuuuccuuuucuuuucuuuuuuuuuuuuuuuuuuuugagacggagucuugaucugucaccaggcuggaguguaguggugcaaucucggcucacugcuaccucugccuccuggguucaagugauucuccugccucagccuccugaguagcugggauuacaggcgugcgccaccacgccuagcuaguuuuugcauuuuuaguagagacaggguuucaccauguuggccaggauggucucgaucucuugaccuccugaucugccugcuucaggcucccaaagugcugggauuacaggugugagccacugcacccggccuauauagauuuucuguaguuuuuuuaaugguuuccuaggagcauuuagguuuguaauuuuugugaauuauaaauauuguauuugcauaugcauuuuuguuucaauucuuuacuauauucuuaggacaaacuccuagaaaugaauuguuuggucaaagggagugugcauuuuaaggcuauugagguaauuuguuaaauacucuuaggaauguuguauuuauuuuuuaggaaguauguggaagaaugaccaauucaccauaccuuaagcaauacagaguguuauccaucuuuuaaauauuuucuacucugauauauggaauauaccuuuagucauuuuucuguuuuauugugcauuuuguugauuaaagaaauauccaaagcuguaagaaagucuuuaauuauuuuaauuucuuuuguaaauuaucuguuuaauuugugccccuuccuccuccuuuuuccuuuuucuuagagguauaaaaucuacauuaggccugucaacucugccguguaaauugcaaauaacuucccguguuacuugcuuuuaaacuuggcuuuuaaagaaaacauauauauauaugguuggguuuaucaauauuuuucuuuaucaauauacugcuuucugcccuuaauacguuuggaaacauucccaaugcucuaagccccaacauuauuauaaucuauugccaagauuguaaaaaccuguauucaaauucuuucaagacuuuaacauuuuaaugcauuugaaaauuaucuugauauaaaguaugagauugccuuuuaauauaaguuuauuuaucucucaugcaguuuaagaaauuaauagauuuuuuucagcaguuuugaauuuacagaagaauugaguggaaaguacaguucccauaucccaaagccccacuucccuuuuccaucuuguaggccaugugugguggcucaacgcauguaaucccaacauuuugggaggccagggugggaggauccuugagcccaggaguuugagaccagccugggcaacauaguaagacccugucuuaggaaaaaaaaaaauuuaaccaggcaugguggcaugcaccugucgucccagcugcuugggagccugagguaggaggauuuguugagcccaggaggugaaggcgcuacuguacugcagcuugagugacagagugagacucugucucuuuaaaaaaaaaaaaggccugagcucagguggcucuuguauauaaucccagcacuugaggaggccaaggugguggaauugcuggagccagggagauaacagcugcaaugagcaugaucauaccauugcacuccagccugagugacccugucucaaaaacaaaccuugcauuagugugguauauuuguuaaaauugauaagccaauauuaauauauugucauuagcuaaagcccauacuuuacauuaguagucacucuuugcauuguacauugacaaaucugaugugcacauuuuuugcuuugacacguauccacuauugccguauuguacagcagggguccccaacucccgugccacagaccuguaccugagcggcaggcgagcgauugccaccugagcucugccucccgucaggucaguagcggcguuacauucucacaggagcaugaacccugucgugaacugcgcgugcaagggaucuagauugugcacuccuuaugagagaaucuaaugccugaugaucugagguggaacaguuucacugcagaagcucccccacccucuuuucuguggaaaaauugucuuccauaaaaccggucuuuggugccaaaaagguuggagaccgcuguuguuuuucaccacccuaaaaauccugugugcucuucuucuucuccgguaccccacuucuacaccccccacacaaacuccugaaaaccacugaucuuuuuacugucuccauaguuuugccuuuuccagaaugucauaauuggaaucauaaguauguaaccuuuuuagauuggcuuuuuucaguuaguaauauauuuacgguuccuccaugccuuuucauaccuaauagcucguaucuuuuuaugacugaauaauauuccauuguguggacauacuacaguuuaucuacucaccuguuaaagaacauauugguugcuucaaaguuuuaucaguuaguauaaagcuacugugagcguuugugugcagggucuugaguugacuuaaguuuucagcuuguuugggugaauaccaaggagcgcaauugcuggagcauauauaguaugaguauguauaguuuuuaagaaaugccaaaagugccuuccaaagugguuguaccauuuugcauuccugucagcaauguguugcccuguguccucaccagcauuugguaguguuggugcuuuggauuuuagccauuuuaauagguguguaguaguaucuuguuuuaauuugaaauucccuggugauauuugauauaugcucacuugccaucucugucuuuggugaagugucugucuguaucuuuugccuauuuuuuuauuggauugucuucuuauuguugagucuuaaagaauuuuuuguccacuugaauauuaguccuuuauuggguauguguuuugccaguauuuucucccugucuguggcuuaucuuuucauucucuuuuccccaucaaauaaaauuauuaucuucucauagauuagaaaugucaccgguauuauguuaaauuauuacauacucuugggccuguauuuagauuuucuccccugacccuaaguuaguauugccuuauuucuuuaguuugagaaauguuucuuggcuuguggguuucucuguuuaagauuauguaaguugucaccaaaagcuagaauguuucuuugccuauuugaaaguucccuuucucccauuccucacccccuuugagaguauuucugggauucugcacuuucccuuuacucccauuguuugcaaacuuugaauucuagcaagaaaauaacaaagguaaugaaaaauuuuuauguaaaagaaaauuauauauuugaaggcuucugaaaugugugaucuuggagauuuccaguuuuuuuuuuuuuuuuuuuaauagauaagaaugauucuggccucuucuguuggaccuaacugcuuuucuucaaguuugauuuuuggagguuucuuaguguacauguuagagcuuuguguggucuuguuuagaucugcguucaggaaucggacuuguggaaacccaguuuaggccaaaacagggaaagcacuugcagauuaugaauggaaaaugaggaauagacugugauaagauugaccgaguagguuucaacaaaauuaauguuuucaguugugagucaaccaaaaucuaauuuuuuccuaauacauauuuuaguauuucugcauuuucuuguuuucucuucuugcuugcuguaguguaucauuauuuucaaagaaaauaauuuuucgcaggguaguaaauaaaaauguaauaggugauuucaauucuuugguauuugguaagcuuucuggaucuucagaugaauauagaaucacuuguagcuauuggcagucucuugacuaccccucugugcucccauuuucuuuacauuuucauggugaagauuuaaguuuagaguuguacucaaguuaaauuuuugcauagguuuauugaaagacuaucauuuuauacuagguaguaaauuuggcaauuccugauaaaauaguauugagagagaugacuuuugaagcauuauuuugcuauaguuggauuuuguuuuacauagugugauguguguguguuugcguguaugcauagcacauaugugugugugcguauguguguauauaauauucuuaacacccugugagguagguuaauauuauccucacuguacaaguguuaguuuuuaccagcccuuuacuuggaaaguuuugcaauuccacugguuauuaaaacugaaagggggcugggugcacuggcucacaccuguaaucccagcacuuugggagccugaagcgggcagaucaccugaggucaggaguucgagaccugccuggccaacauggugaaacccugucucuacuaaaaguacaaaaauuagccaggcaugguggcacgugccugaagucccagcuacucggaggcugagucaggagaaucgcaugaacccaggagguggagguugccgugagccaagaucauaccacugcacuccagccugggcgacagagcgagacucugucucaaaaaaaaaaaaaaaaaaaacaacccaacugaaaagggaguuaaguuugucucuauuuugugaaguuuguuuuuaaaaggacuaaugcuuuuaaaauaaugagaagcaagaagucuaaguuauucugucuaaauguugcuuacaguuaugaauuauucuauacaggguaaugcccacuuuuacuauucccuuauccaaaauuauacaaguuggugaauaaggaauuaagcguggugaaucuaagcguuauauaacugcuacuuacagcuucggaauagcgggaauaauuaguguuaauaaguuuuuauaauucuagcugauugcaaagucauuugaucuuuuaaauuauccugugcuauuauaaauaaauuuaucauuuauuuuagaguuuugucaugacuuuaacugauuguuucuaaaguaguauaaaauauuuaauuuacuauuauaaaauauucagacuagaggauauccgaaagcccuucuaguucuuugauuuuaauuuccucuuuuuuuuuggcuuuggcuuuggcuagaagggcaauuaaaaccacuugagggauuuacauucccagcuuagauauugguggugaacgguaauaacuccuaucuguagaauucacaguaaugauauuagcuaccaucuguuaggagccuauucugugcuauagugcuaggcaucuuauauguauuauacuugagccuugaaacaauucacagugcuaagaggcaaguuaccagagguuaaguaguuugccugaacuuguagcuaguuggugauggaguugggauuugaaucaagugcugacuuugaaguguaaaaagccuaugaauuuuacacugugcccugcagguucugauaugauugugauauaaugaaauaagauaauauucacuguuuaaguacauuauacgaugggaauugauuuacuaaucuagaguaaaaauugugcuuuugaguuauguuguuauagcauugcauaauuuaguuagaaaauauaaauacuuaugaauuuuuauuuuccuucuucuagauauucaagaauuuuaugaagugaccuuacuggauaauccaaaauguauagaucguucaaagccgucugaaccaauucaaccugugaauacuugggagauuuccagccuuccaagcucuacugugacuucagagacacugccaagcagccuuagcccuaguguagaggugagauaaaaaauguguucugaagcuguuuuuuggugaucaauuuauuuauguuacuauguuucuuuauuuuauuaaaauaauauuuuauacaaguggauuuuguuauggaaguauaauuuauaauagaauaaagagaaugggguuaaaaauauuuuugaaaagcaaagcucagauucucuguugccccuguuuuaaaauguuaugaauguuugaagucugaaauacuugauuuagacuauuaaaaaauucuuugcaugauagaccucaacaaggcuucaucugugugguaauuaaaauggaaaugguacuuugaaaagaugguuuugcucugguauucuuuccuagaaauaggauauaguuuuguggucugggcugcuaaguuguacccauuuaccucaaggaaucucuucuuuauuggcuugaaggauggcauucaaacucacuagagacugaagaguaaaccugaacaucagcacugguuucuacauuuucuguaaaguuauuucuuugaguauucauaacuaucuuaguaauauacuuuuuuguguguguuauacuguugcccaguuggauaugguauagcagagguaugaagcaguuuguaacaaagauucugccuaagaagcauuagucauuugaaagugguuauuugucugaauuugaaucuaguccuuucuaguuaguguaagauggugcugugccuggaaaaugcgauguuucuguuuggugaauaauaaaucagggaaaaguggugguaggccucaaccagauagcacuuugguaaagaaguuagauggcuucucaguuuuaaguaacagaacuauagaauuuuagagcaggaagaaucggagcacaucugaucccuugucuucauguuaaagaugaggaaacugagauccauaauagaauaacuugacccacuuuauuuagcuaguuugggcaauuauaccuuugaauuucaggacucuuaacacccaacucacaguucucuuuauuaauccuagaccuuguauguuucuuuuugauuaguguaauguuuauuguguauauccuuauuuucuuuacacuuuuuuuccaucacuuuuuccaggauaauuuccauuuccauacucuuuggguuaauacaucacuugcuuuuauaauagucugaggucuauuucaaauggauuuuuaaaaugucuucagucagucacugcugugguuugaauguguccccuccaaaauucagguguugccaaugugaagauaaugagaggugggaccuuuaggaggugauuaggccaugaggacuccuccauccuucaugggauuaaggcccuuauaaaagagccuccacagcuugggcacgguggcucauguuuauaaucccagcacuuugggaggccaaggcggguggauugcuugaggucaggaguuugagaccagccuggccaacauggugaaaccacgucucacgucuaaaauacaaaaauuagcugagcauggugucaugcaccuguaaucccagcuaccagggaggcugaggcaggagaauugcuugaaccugggaggcggagguugcagcgagcugagacggcaucacugcacuccagucugggcaacaagcgagacuggcgauaagcgagacuccgucucaaaaaaaaaaaaaaaaaagagccuccacaaaaaguuuagcauguuagcuuaacuuuuugcuuucugccauguugagauguaacaagaaggcccuuaccagaucagauaccuggaucuuggacuucccagccuccagaauugugagaaauuauuuucuguuuuucauaaauuacccagucucagguaugcagcuguagcaacacagaagggacuaagacaguuauuucacauuuauugucuuaguucuagguuagaaaauugcuuauguaaaaaacauguuaaacuuuaagagaauugaauugcuuacuaguauuuuuuauuguccgauuuaugauacccuugauuauaaagccucgaauucuuauacucgauuuacuuauuuuuauaggcgauuguuuaaguaauguaaccauugaaagugaauauuugacauuauugguggaaauguaaauuauuacagccauuauggaaaacaguaugcagguuucucaaaaaaacuaaaaauagaacugcccaccagcaaucccauuaguggguaucuguccaagagaaaggauaucagaauaucaaagggauaccugcacccccauguuuauugcagcacuauucacaguggccaagauaucaaaucaaucuaaauaucuaucaacaggugaauggauaaagugugauacacacacacacacacacacacacacacacaaaauggacuacuauucagccauaaaaagaaugaaauccugucauuugcagcaacauggauggaacuggaggucauuaugugaaauuaagccaggcacagaaagauaaauaucacauguucucaugugggagcuaaaaauguugaucucauggagguaaagaguagaaugauaguuaccagagacugggaagggugggagagggaaaagaugaagagaggaugguuaaugaguucaaaaauaguuagaaggaauacauucuacuguucaguagcacaguagggugacuaccguuaacaacaauuuauugucuauuucagaaugguuuagaagauuugaaauguucccaacacaaauaaaugauaaauguuugaggugauggauauucuaaauacccugauuugaccauuacacauuguaugcacguaccaaauaucgcauguacccuauaaauacauaccauuauauaucaauaauaauauuuuuaacuguaaguauucuuuaagauuggaaaaguggacaguuuuguaagcugaaaguuuuuuuccauauagauuucauucaggaagaucaguagugcauugaauuucaucaaaaauggcauugguaacacuucaauuuuuauaaaaugaugaggcacucauaucuagaacgcuauuugcagcucugguuucuacaccuccugaaagauauauuaugaacaugguaaaggcaccucaagggaauaggagaaaaagaacuuucauauugugagcgucagaucuuauuaguuuggaaaguagaugagaagagaauauggucacagaguguuguuuagcgcauggcacauggaaaaugcuguaguaauguuugaaaucuguucauauucaugaauagacucuaaggggaacauugggauauguccaucaaggccuagauguuuaaaaaguagcaaaaaccuguauauaucaaacuggagugagcaaagucaguuaguaggaaguaccaucuuauagagaugacagaaaauccugacaaauguuugucugaaaauguaaauaguuuugaaacacacugauggaugauauuuauaaugauuuuuuaaaaaaccuggaauguuuggggauuuaauugcuacuuuuugaaggugcuaugagagaaaguaagcauguucccuuucacccauccauucaugcuucauuuggaaaacuuggcuaagugaucauuugaucucuuguuucauuugcuacuuuagacucuuggggcaugauguuuaggacuaaaaagggacuuagagaauccacuugcucaaaacaaauaacuuaaaacuuaaaguuuauuguacuauaacuugaaaaauuugaaaaucaaaaccauuuugucuuaaacagaauuuagguuauacuuguguacuaauucuuggauauaguaaucuuuuccaacaaaauugcaugcaacaugccucuuugacuucauguuugcuuuugcaggacuaaaaagaggauuauuuuugcuaaaaguaguuaagauugcucaauuuucacaaagccuugacuguuauucucuuaaaaugcaaaucuucaucuuuaaagcagcuauccaguuuugucuuuuuuuuuuuuaaguucacugaucuaauucuugccaggucauuugucaguuacuuugugaccuuauaacuuuguuuguucuauuucuucugauguaguaaauuuaaagggacaggauuaguaucccauuuucuuaaaaaaauuuuuuuuguauauauuaucuuuuacuuugagcauaugucuagugagauguuuggaauaauguuuguuuaguguuuaaugauuguuucagagugauagggauuuuuuucuuuuuuguacuacuuuuuuuguuuuuuuagaaacugugucucacucugucacccaggcugaagugcaguggugcgaucauagcucacuguauccucaaaacuugggggcuccagggaucauccugccucagccuacugaguagcugggccuacaugugugcaccaccacacccagcuaaaaucauuucuuuuuuuuuuuuuuuuuuuuuuuuuuuuugggacagagucuugcucucccaccgaggcuagagugcaaugguacgaucucgucucacugcaaccuccaccucccagguucaggugauucuuccaccucagccucccgaguagcugggauuacagcacccaccaucauacacggcuaauuuuuguauuuuuguagagaugggguuucaccauguuggccaggcuggucucaaacucuugaccucaggugauccaccugccuuggccucccaaagugcugggauuacaggcuucagccaccaugcccgaccccaaaaccauuucuuuaaacaguuuuuugaagacugggucucacuauguugccuaggcuagucucagacuccuggugguggucuccagcaguccucccaccucagccuccagaguagcugggauuacagguguaagguaccacacccggcucucucucuuaauuuuaaaaaauaacacaucauuuuuauaagaacaacucuauucuaaaauaagagugaguuaguuuuagagauuauaagaaaggauauagacuuaaaaaaaagcaagaguaaagaguaggaggaauugccugauuuaaugggauauuucaguagaaaaggguugauuuauaaggaaggauagaugacucuuaaaaagaugaggccaggccuggugguucacaccuguaauccuagcacuuuuggaggcccaggcaggugaaucaccugaggucaggaguucaagaccagccugagcaacauggcaaaaccccgccucuacuaaaaauacaaaaauuagccaggugugguggugcgugccugugguuccagcugcuugggaggcagagacgugagaaucgcaugaaccuaggaagcggagguugccaaagaacccaggaaggcaagaucguaccacugcacuccagccugggugacagggugagacucccucuggaaaaaaaggcaagaugaaagaguaggaggaauuuccugauuuaaugggacauuucaguagaaaaggaugcacccuacuccuaacaucacaauacauuucaacuagacuagagauucaaagguuaaaaaaaaaaaaaccauaaaaguaagauuuuggggcugggcgcaguggcucaugccuguaauuccagcacuuugggaggccaagcugggcagaucgcuuaagcucagaaguucgaaaccagccugggaaacauggugaaacuccaucucuacaaaaaaugcaaaaauuagcuggguguaguggcucccuccuguggucccagcuacucaggaggcugaggugggaagaucgcuugaguccuggaggucaaggcuggagugagccaagaucguaccaccgcacuccagccugggcgacagagcgagacccugucuccaaacaagaaaaaaaaaguuaaaaauuaaaaaaaauaaaaauuuugauuuuuaauaaggaaggcuuuucuaaccaugaccaaaaaacaccacaaaaauuaaaagguuaaaaaugcugcugacuuuauagaauuucuuuguggacuuugacuucaaauuuugauuguagaacuucugaaucuugaaagauauaauacaaagauaaauuauauauuaggaugaaaauuugucacauauaugaaaaaggauuaauuuuaauuuccaguccuuucaacuuaagaaacuucuuauagaaacuaagaaaaaggcccguguucaauaggaaacugacuuaacagugugaguauuguaguuugaagaagaagaaauaaaugugggccaauaagccuaugaagaaaugcucagccacacuuaaaaaugcaaauuacauugacagcaaggauauuuuuaacaaauuugauugucagagauuaaauaaauaggaggaaacagaagcuccuguacaguuaguaagggagaauacaguagugcaacuaauuugaaagacaacuuuauauucguaucguuugauccagcauaugcuccagauucaccacagauuauugaagguauuuguacagggaugcucacugcagccuuaauuaguagaaaccaacaagggauauaaaagauuaucgguaagagaucggauaaacacauuaugguagagccauuuaaugcaagauaaaguagcaggcaaaauauauucuguguauccauuauguguuauuaaaugagugaaagcagguuacaugucaggaggcauaguaugacugugugugaaaagaaaaccaugagguuaggcaugucuggaagaauauacacauagucugcuuucaauaguacucuuuuaaaauugauaaauaauuauacauauuuauauggugcuugugguauuuugauacaugcauaccauguuuaaugaucaaaucaggguaauugggauauccaucaucucaagcauuuaucauuucuuuguguugagaauauuccagauuuucucuucuagcuauuuugaaauauacaauaaauuguuguuaccuauagucaccuacugugcuauugaacacuucuaauuguauuuuuguacccauuaaccaacuugucuuccuccccuccuucacuguacccuucucagccucugauaaacuaccauucuacucuccaacuccaugggaucagcuuuuuagcuuccacauaugagugacaacaugugauauuugccuuucuuugucuggcuuauuucucauaagauauccuucaggcucauccaugaugcugcagaugacaggacuucaugcuguguuauggcuaaauaauauucuauugucuauauaugcuacauuuuauuuaucuauucgucuguugagggacacuuaggcuaauucccuaucguggcaguggugaauaguggugcgauaaacaugggcauguagaucucucuuugauauacugguuuguuuucuuuuggguguauaccucgcagugagagugcuggauuaaauggugguugagaaaugaccaugcuguuuuccguaauagcuguacuaauuuauauucccaucagcaguguaccagagugucccuuucuuuacauccguagccagaaucuguuauuuauggucuuuuugauaauagccauauuaagugggguaagagaauaucuuuuuucuuuuuuuuuuuuuugagacagagucuugcucugucgcccaggcuggggugcaguggcgugaucuuugcucacugcaagcuccaccucccagguccaagcaauucuucugccucagccaccugaguagcugggacuacaagugugcucugccaugcccggcuaauuuuuuaaauauuuuuaguagacacaggguuucacuaugcuggcugagcuggucuugaaguccugaccucgugaucugccugccucggccucccaugugcugggauuacaggcgugagccaccgugcccagcuuauuaugguuuugauuuccauuucccugaguauuauuaguaauguugaacauuuuuucauauaccaauuaaccauuuguaugucuucugagaaaugucuaaucugaucauuugugcauuucaaaaucagauacuugcuuuuuuguugcuccuuauauauucugguuauuaauacuugucagauaaauugcagauauuuucucccauucuguaaguuguuucaucacucuguuggucguuuccuuugcuguacaggaucuuuuuagcucgauguuaucucauuuaccuauuuuugcuuuuguugccugugcuuuugaagcauuaccuaaaaaauacuugcccugaccaacauccugaagcauuuccccaauguuuucguaucguaucgugucgugucgugucgugucguauuguaucuuuucaggucuuagauuuaagucuuuaaucuauuuugauuuguuuuuuguuacguuuucauauugugaguaaugggagucuagauucauucuacauauggauauccagauuuucccagcaccauuuaucgaagagacuguccuuuucccauuguguguuuuuggcuucuuuuucaaaaaugaguuggcuuaaauguguggauuuauuucuguguucucuguuguguuccguuggucuguguguguuuuuacaucaguaccaugcucacuuggugacuguagcuuuguaguaggucagguaaugugaugccuccaguuuuauuauuucugcucaggauuguucuggguauucggaguguuuuaugauuguauaugaauuuuaggcuuguuuuuucuauuucuaugaagaaugucacugguauuuuauuagggauugcauugaaucuguauauugcuuugguuaguauggacauuuuaacaauauuaguuuuuccaaucuaugaacaugggauaucuuuccauuuuuuuuguguccucuucacuuugucuuagcaguguucuagaguuuucauuguugagaucuuuuacuacuuugguuaaauuuauuccuagguuuguuuugguuuuuuuuuuuuuuuugguagcuauuauaaaugugauuguauuccugauuucuuuuuuggauuguuugguguuggucuauagaaauacuacugauuuuuuuauguuaauuuuugcauacagcuuuuuaaaaguugugccuguuauuuacaaguccccccuuucagcccuucaguguuuaucuuauugggaggggaguuuucugacugaaugguguuaagggauacuuuucccuuucucuuugaccuugugguuuaauauuuuaaaauaagccaucugcuuuaauuugaguggaguuuuaggaggcaguagaguuaaaaguauauauucagccgggugcgguggcucacgccuguaaucccagcacuuugggaggcagaggcgggcagaucacuugaggucaggaguucgaaaccagccuggccaacauggugaaaccccaucucugcuaaaaauacaaaaauuagccgguuguuguggcgggcaccuguaaucccagcuacuugggaggcugaggcaggaggccugggaagcagagguugcagugagccgagaucacaucacugucuuccagccuggcuggcagagcaagacacugucucaaaaaaaaauaaaaauaaaaauaaagaaaaaaauauauauauauacacacacauacacacacacacacacacacacauauauucaguguaccagguuuaaucugaaguccucuaaacauugacaaaaaauuuacugaaauacuguauaauauucuuacauaaagauacacaaauaauaaaggaauagguugauuaauuacugcauugugaauauaccaggucaagaaaaagaacauggaaugacugcuaacagguucuggaauuagauagugaugguaguuguacaagucuaugaaaauaucaaaaaucacugaauuguacacuuuaaaauuuggugaauuuuauagcauguccauuuuaucucaguuuaaaaaagaaaaauaccaguaccccagaagucuuccuuguacucucccuauuuacuaccuauccccucuuccucagaggaccauccaaauuuccaacaucauagauuaguuuugcguucuuuuaaauugcauauaaagagacuuacacaguguauauacccccuugugugcuucuuuuuucuuauauuugugcauuucaucuauguagguaaaguuuuuucauccuuacuguuguaugauauuccauuguaugauauaccagaauauauuuacacauucugccauugauggucauguggauuguuuccaguuuugauuaguguugcauugaacauucuuuuacauucaggucugcuguaacaacagauaacuuuccuaaaaaucaccacacuaugaaaaauggcacaaugaaaaccacagguguuauuucaaaaaugagggcagggaccaaacacuuaaaacuuugugagugacauauuaaaagagauuaaaaccuaauaaaaacaacagcacaguuuuaugcuuuuuuuuuucuuuuuuuuuuccuuagaggaggucuugcuuuguucuucaggcuagugugagguggugugaucauagcugacugcacccuugaacuaacgggcucaagcuauccucugccucagccucccaaguagcugaguuuauaggcgugagccacugugcccaguuuaugcauguuaaguggugaauaaauaugugaauacuacaaucaauuuggcaucuuaccuuggaaaaaaacucagcuuugcuuauaggaguguguugcaaagaguugcagcuugugaguuacugugauguguuagcugggggagcuaucugaaauuggaugagaacuuauaguagcaccaguuguagaggaguguggaucauaaaacucccauaaacuaaagucgcugguagaugucugaggugugugcauuuuguguauucuuagguggcucguauccucuggguacaguuuuuugccuucaccuagucuuucucacagacaagauugugcuugcuuuuccuguauguguguauuuuuuggaacuauuugaaaaucagucguagacaucaugcacuuaaacuauuaaaacuucagcacgcaucucguaagaguaagaauaguuagauauucuucuguguuaucuuaguaccauuaccacaucugagaaaauuagcaauaauuguucaguuuucucuccaaucucuauucaaaauuguccccagucuauuuugugggacuugaaaaaaaucagauaaagcagauaaaucaaauacauaccauuuaugcauuugauuguuaggugucaguacacaugccauuuaugcauuugauuguuaggugucuguuuuuaacuggguuuuccuaaaagcagaaccugaggcagagggcuuaggugcuauuaauuuauuuagagaguucauuccuagagagcagaagugagggaaagugugaagauaguauaggaaggggaaaaacuaauacaaggaugcuuccugccacuaagugugacugauuuuuguauccuugguauugcaucccugagaagccauuuguacugcauguuaggacucugcaaggaaagagaaagaauuuaucuacuggcuucuagugggcagcaguucccccauacuuuaggguuguggauuugucaguguaggugauuuaucaggaaagccccaagugagggggugagaggaggagauguggacugggggccacaggcaugaaguguuccuggggcugcucaggaugaaagguaggugugaagaucugggggugacuguuggaauggguugggaauacacauaccaaaucugguacagugucucuagucuuuuguaaucugauagaauagucuuccuuaucuucuuuucccccccuuuaaaugacauuaccuuuuugaagagaccaugccaguuguuuuauagacuaucacacauucuuuauuugucucauuuguuuccuuauguuauuuaacucauuccacuaauccuuguauuucugguaagaggaaguuagguguaaagguugaugagacucguuuuugguaagcagaccucacagugauacacaguguuguauuucauauugcaucaucaggaggcucacaauaucagguuguugcucuuguggugcugaguuggauugcguaaagguggggaccuccagaucuuccacgggaaagguacguuuuucuuguugauauugugaaguguguaugggguuguacuuuggcaccuuguagugagucaguuuccccccauuggugaucauugccaaaucacuacauuugagguuucaaaauguuauuuuucucccuaauuuaaucauucuguuuguaguuauuaguuggcauucuucuauaacacucuuuuucuucaucaacuagggaugaacuucuguuccuucuaaaaagacaggcuaaaguuuacauuacuuucuuuuaaugaucaguuauuugaguagcuugugugauaauccccuccagagguugcuaaguucccccuuuuucuugaucucucucuuuacaaaguuaucacuguauaccgagaaauuuuuauuuacuaaauguuuacauacauuuaaguuugggugcucauauuacuucauauuugacuagacgaaucacuugaaggaguaucuguguuuucuuaggauaugcuuuacuagucuuugagcauguccuugccuuccaacaauuuucccaaguuuauuuugaguuuucacugcuccugaacuagaauccacgcauaacgaugguuuccauuuuucuauuccuagggguugcuuuuucuuugagguguuauuuuugagagguaagaaaguggacaggcaggugacacauucuuccaacuuuagccuuuugccccagaacugguaaaauaaaauuugagaaauaucgcgugagaagaaagcacauauuguauucauuuuaaaauauuaaugcaaaauauuguauuaauaguuuacaauauuaauauuuuaaaaugaauacaauaugcuuugucuuccuuucuuaaacucacguguuccacaggaacggauuaaaauaauaaccuuauuuuucaaauagcauaguuuuaaaaggcacaucacauacauuguaauaauuugggauguuagaggagcaugaauucauucuugcuauagccuccuaacauacacgaggugagccagauuuugguucuuaauacguggagcuuauacuguguuuacuuuagaauugaucaaacugucauucagggauauugguacugcccaacguugcaguauuaaccuauagaaaaacugauuagaauucagaacuucaggcuucaagacugauguuuccauuuuuguuuaguaacuuucuuggcaauuggacuuguuaccuagacaaaggaaaauacugcaauaaaguuaaaauaaggagagaaagaacuaauuuuaauagagauagaaauguaacaggcaacguuuauuuuuuuaaaaaagcuauagaaauacaguaauaugugguaugaugauguuuuggccagccacagaccauguuaaguagggaucccuuaagguuauaaucaagcugagaaauuuauaucuccuagugacaucuuugcugucauaacauuguagcaugacguauaucaaguguuuguggugaugcugguguaaauaaaccuguucugccagucauaaaagcauagcacguauaauuagguacaguacauaauacuugauaaauauuaacaauuauguuacuaguuuaucuacuguacuuuuaguaguuauuuuauagagugcacuucuacuuauuuuagaaaaaaguaaaguguaaaacggccucaggcaggcccuucaggagguauuccagaagaagacauuguuuucguagguggcgauagcuccaugcaugcuauugccucugaagaccuuucagugguacuguccagugauacugaugauucuggccuuggguaggcuuaaguuaacggguguguguguguuuguuuuuaacaguauuuaaaaguguguguuuguauuuaaacaguaaaaaaaaaaauuaaaaaauagaaaaaagcuuauagaaucagaauauaaagaaagaaaaaauuuuguaccucuauacaguguauuuguguuuuaagcuaaauguuaaggugaaagagucaaaaaguuaaaaaauuuaauuuauaaaguaaaaagguuacaguaagccaagguuaauuuauuacugaagaaagaaaaacauuuuucuauaaauuuaguauagaucagccugggcagcauagggagaccccaucccuacaaaaaaaaaaaauuaggcgugguuggugccuucaugccuguagucccagcuacgugggaggaugaggugggagaauugcuugagcccaggaggucaaggcugcagugagcugugaucaguccacugcauuccagccugggcgacggaucaagacccugucuccaaaaaaagaaauguuauaagagaaguggaacaacugucauauuaugccaaaaaaaaagcuguuaaucuaggagaaaacucagcaaaacuuuacacaguuacugagaaaaugaaaggcuaugugaaagcuuaaguaugucacauugguuagacuuauguguuccuagaagacacccccaauuaguuuugaauuaugaguuuugauuaugugacauuuucaguaacucaucauuuaaauaaucuugauugcucuauaucuguaucugugcuuauuacuauuuuuaguauuagagcagugauaucucaugugcuccuaaaccuccucaccucuccuguuuuuuggauuuccaaagugauacauguuuauugcaaaauuuccuaacuuuauauguuuucaauuaugugaaagucauaucagagaauaaauacuaacagcucuguuaugcucuuaauccuuuuuucuuuuagaaucccacuguccuuuuucauuauggaauaucuauaaccucuuucucugucuugggccucuguuccccucuuuauuuuauccuguaaauauguucaaagauuccauuagaaaaacagacaaacagaaaaaaguacuucucaguaggacccaaaguaauaauaaacauauaggauuagcugaacaaauacauaccaaaugguuaaaagagguuaucucgggaaaagaauauaaaaaaagacuucagcauuaugcaucugucuuuguaaguauguuuaaggugugccugaauuaccuguguaguuagauaauuuuuuuuaagguaaauaaaggaaaaaagagaacaguuacuguggagaaggagggucagaaucuggguuacagaauauugggaaugggaagaaaaaaaggcaaacuacguuuucaagaagcuuagcuaagaagagaaggaaugcuauaggguccuacuaagaagugcuuucucccccugucuuucuccuaauggccucugugaacauauuauauuuacaagauaaagugaagaagggaacagaggcccaagauggaaaaagagauuauagacauuguaugaagggagagugagauuccaaaagagaaaaggauccaagggcaaaacagaagcuguucgcauauguuaucugauuuuuugguggcauuugcuacucucuacucugcuuuugaaaauuuuuuaucuucuuggcaacuauuugaccuguugguuuuccuucauuuuguguuauuuuuuaaaaaaauauuuuaaucauggagaaacuguagugaauauuauaaauauccauguauuuacuacuaccuuaagaagauaacauaguguaaguauagcugaagucucuuguguuuuccacuguaaucacguucuccugccuuguuccccagaauuaaccucugucuugaauuuggugcuugucacucacauguacuguuuauaguuacaguuuucuuuaccuuucuugugccugggauucauugaguuucuuggaucuguggguuuauaguuuuuaccuacuuuagacguuuuucaccaauuauuucugcaaauauuuuuucucuuccuuccccuuugcuuucagggauuccaguacuuguauauugguuugguugacuuugucugcaguucacugauaugauuaaucuuuuuucagucuuuuucguugguauguuaaauuuuagacaauugcuguugcuaugucuucaaguucauuaaucuucucaaguaucuaguauacuauuaaucucagucaguuuuuuauuucagacaguuuaccucuagaagcuugauuuaguuucucuucucuucuccucucccucuccuucuuuuuggagacagggucuugcugcgucgcccaggcugcagugcagugauguggucauggcccacugcauccucagccuccuggcuucaagcaguccugcugccucagccuccccaaguaccuggggcuacacauguauaccaccaggcugggcaauuuuuuuuuuuaauuuuuuggcagagauggggucuugcuggauugcccagguuggucucgauaguuucguuuuuauuuuugucuaauuaacacacucuauccuucucugucuucauaaacauaagggacagaguuaaaguaacuuuuaaaauguuuuugucuacugauucuauuaugugucauuucugggucaguuuuuauugauugauuuuuuuucucuucucuggaucguguuuccuugcuucuuuacaugcuugauaauuuggaugaauuuggcagacguugugaauuuuaccuuuugggggccuagauauuuuuuuauucuuuuaaauauucuugagcuuuguuuugggauguaguuaaaugacuuggaaagaguuugaugccauucagacugcuuuuuuguuuguuuuugagacggagucuugccccguugcccaggcuggagugccguggcaugaucucggcucacugcaaccuccgcuuccuggguucaagugauucuccuaccucagccuccugaguagcugggauuacaggcaugugccaccacgccuggcuaauuuuuguauuuuugguagagacgggguuucaccauguuggucaggcuggucuugaguuccugaccucgugauccacucuccuuggccucccagagugcugggauuacaggugugagccaccgcgccuggcugcuuuuaagcuuuuucagugggacugagcaacauuugguuguagaaggcuauccccacugcccaguauauuaugaguuuucauuauucuuggccuugcgugagcucuggguuuuguuccauuugcugcuuucuaagauuuuuuccucaccuugaaguuuccuuacaugcauguacugaucaaaacuaaucugaagacucgaggggaacucugcagaucucuggagcuuuuucugucccgcucucuccuuucugguacucuuaccugugaguuuuagcucuguuuauucucaacgcuuucuccucaacuuaaggcugcuggguuucguugaguuucccccuucugcuacagccaggaaacuuuuucugggcauuuacaggacucaccucauuaguuucucuucucacaggguccagugucugaaagucagucuuuuuuuuuauuccauuaugguuggcagcaauugcuuguuuauggaaagccauugguauucuaaaauacuguuaauuaucuuaugugccuauuaggugaaguguugccaucccaaaaggcuuauauuucaaguccuucuaaaguagcucauauuacagggugauuucuaaauuacuuuuaacagcaaaugaccaucugaagagaacacauaggcuugaaauguaccuuacucagugccaguuggguacuuacagauacuuacagaagaugcaguuaguguagaauuuaacacaaauugaauaaucauucccugaguacagccuuaaaaccuguaaguauuagaucuaugcaagcuuuuuugaaggauuauuagguauauuaaaaaauaauauaguaagggguuaguuacaucaugaagguuauaaauacacgccuacaguacaggggaaaguggcuuccucuucugugaaugagcacuacaaguugaguguuccuuauccaaaauacuugggaccagaagcguuuuggauuuuggauuuauuuggauuuugauauuugcauuauacuuguugguugaauaucccugaucugaaaauucaaaaucuggaacguggcuaggcacaguggcucacccuuguaaucccagcacuuugggaggccgaggcagguggaucgccugaggucaggaguuugagaccagccuggccaacaugucaaaaccccgucucuacuaaagauacaaaaauuagcugggcgugguggcaggcaucuguaaucccagcuacucgggaggcugaggcaggagaaucaucgcuugaaccugggaggcaaagguugcaguaaguugagauugugccauuggacuccagccuggguaacaagagugaaacuccaucucaaaaaacaaaagauaacaaaaucugaaaugcuccaacgaguauugucuuugaguguuaugcuggcacuuaaaagauuuuggauuuuggagcauuuggauuguggauuuuuggauuagggauacccaaucuguaguaguaauuagggauaaauggucaagugacguuguaguucagaaagggccauaucucaaacaacuuaaaccguauaaaacugauguuugaggucacagagauuagaucauuaaaaagugguugugguuaugaugacccuagacaucggagaugaaugugaggaguuuaacuaaaauuuguucuuugaaaugugacuggaauaauauauuagacauacuauuuuaauguguuguuaaguaauuauauguuaacugauuaauuuggauauuugacuauuucaucuuauucuuacagguuuguaauugaguuggcaaacuucuauuuuuacugggaaaauggaaugucuaauuuucaggauuguuucaggcuguuuucaauuuuguaaucaccuauaguuuaaauauuagaaaggccacucauuaauucagcaaacauuguggucacccugcuaucccccaagaugauggggauaaagugguagguauuugagacauuucuuuucuuuuuuuucuuuuucuuuugagauggagucccacuuugucgcccagccuggagugcaguggugagaucucggcucacugcaguguccaccuccuguguucaagugauucucccaccucagccucccgaguagcugggauuacaggcaugcgccaccacgccuggcuaauuuuuguauuuguaguagagaugggauuucaccauguuggccaggcuggucucgaacuccggaccucaagugauucucccaccuuggccucccaaagugcugggauuacaggugugagcuaccaugcccagccucaugagacauucuugagucuuguccuguuggaccuuagaauccaacggauuuaaaaacugaaacauaggcaugguauaaauucaaggacucuuaggagucauugaguuuuuuuauuuuacaaaagaggaaguugagacccuccucccacccccccgaagaaaaugacugcuuaaguuacacaggcugaaugauauuucuaacuugccguagugauuuucagccuuuucuauuaugaagucugccaaacuuagggaugccugcccucucugggcuagacuacucuagaugugauaaaaauuucacaagagaaacuucagaauacuaagagagcaaccagguaaaggguuuuacauaccuccuuauuuuucuucgcaaaaugcaaugccuagucaguacuuagauaucacuuccauuguuuucaguauucugcuuaaaaaugauaaacuuuauuuagggaguuaugagccuugagccuuauaugagcuuuacucuuucauguugggagcaaaugauaauugcaggggugggguggggaaaagggaguacucaacagagcauguaauuuccaggcuauauccugcaugggauaagggauguguuggcccaugaugacauuuacauagcuacauacauauguauuuaggucugagaggagaaaaaccauuuuuucccucugcucucaacacagcacacuucugugcugacuagaugugugaggagguuuuuggugaagcuuuuccaguggacaccuacuggguguccuauaauucaauucugacacuaucugcuuggagguaguaguagucucuacguaaauacaguucuggcagugucuacuuggagauaguaguagucucugaaguauagugucagaucccacagguugggggcucagccccacaagacugcccccauuuagauggaaauaguagauugugaccuaugcuucugacugacuaguuuuaaauugggguucacacaaccccuuccuuggguuugguuaauuugcuaggauggcuuacagaacucagggaaaugcguuuacuaguuuauuauaaaagauguuauaaaggauacagaugaacagccagaaaaagagauacauagggcaaggucuggaagggucccaagugcaggagcuucuauccugguagaguuggaguccucagccuucccagcuugccuuugccaacccaaaagcacaucacauguuguuaagaguuuuuauagagcuugaucuccagcccccaaccccugccccuuuccuggagguugguggguggagcugaaaguuccagcccucuaacccucuaauccucuaaucccguggucuuucuggugaugagccucauccugaggcuuucuaggggucucacuuuaaguuaccucauuagcauuagcugugauccaaagggcuugucaugaacaaaagaagaccuucccauuacuuaggaauuuccaagaguuuuaggcacucugacagaaacaaagaccgaauauauuucauauuauaccacaauagaucuauagcuguagcuggcauuuacugagcacuguugcacuauuuauugccacuauugaccuaacaagucagcauuauucuaagugcccuguguauauuauuuaauccucacacaacagccccauuagauaaaguaagguaaagucccauugggccugucucaaguauacccuguuaggcuuuaaauaaaaggcuguaauuugauacauacuaauaauaguaauaacaacauugauaaugcuuacuauuugauagguucuaccaaaugguaucuauguauuaacuccuuuucauaacgcuuaacagugaaaugugguuuagucugaaaguuguuagugcaguccauguguauuugaaauguuaggaggaggaaugggguauaagaggcaaguaggaacaguucaguuguuugaacuugaggucauucauaauaucuguaaacugugaggaaacuuuguggacaaaaauugcagauaauacucuuccuuauuaugcauuaaaaauuuguuagaaaauuucuuggauuuuaaagguuuuuacagacaggaucucacccuguugcccaggcuggagugcagugcugcaauuacagcucacugcauccucaaacuccugggcucaagccauuguccaguuucagccucccaaguagcuaggacuacaggcgcaggccaccacauguagcuaacuucacuauggcauuuguauaggggaguguggcuggaagcuuaugauacugaaagccaguugcauaucccucugccauguccccugugucuguuagccuaucuagcuccaguccuaaugaucuuggagacaggacaugaauucacaaaguuaguugacuuaaaaacaaagacuucuugaggaguuugaaagguuacauaguuguaacuaucuuuuuguggugguuuuuuuuggugugugggggaucagugaaauggauuuaguaaggcaguaaaguuaaaauuugccuuuguugguaaaauguuauuuauucacuuuuuuagcaaagaaaaaaaggcaaguuuuagagauaauauuuuaaauuauuguauuuuguuuuuccugcuccccuucucaaaaaaccacauggaauauuccauucauuacugcucgagaaagucauuacuuugcaggcugcaguugcugaaaugguuuaguggaagaaauguuugcuugcauauuuuuagugauuuuuuuuuuuuuuuuuuuuuuuuuuuuuuuuuuggugguugucauuugaguauccaaacuguagcuaacgaggagaagcagauuuaaauuuauaucgggggaaccucuuuguggagcauuucaucagaugacuuccugucaaccucauaucuugaaaagagggauuaaugaaacagcaucugaagaagcaguggacucuuguggaauaaacccugacaucuuccacaguguuuugugggauaauuucaaguucuucagauacagauuacauaaagaagauuguagggcacgugacagacucugguuucuuguauuuuagauaguagaaaaauugcuaccucuaagaauggauccuggagagaucuaguuacaguuauaacuucuucauuuaugguuuuaucucacagcuuuauuuauuuuuauuuacauguuuuguucaacuaggcaacuuaaaauaguuuugcuuuauguauaaaauauuguaaugguagaguaauggauugccugugcauuguaaccacaaagguaagauauaauaugcuuuucuguauuucauuguuagugacagaugugagagacccuuuguucagugucuuuuaaaaauaagguguaaccauuguuauagauuugaaaauagaugugugaauccaugugaugcuuaguuuauauccuuuagaaagggcgguauuuugaaauguguuuuagauagccaaaagcguguugcacagauguuuuuucccugagauuuacaggaagccuuucucccagcagcaagggucuguaaaguccugauuauauuuaaaucuucucaguguauucucagagcuacucuucuccccuuugugucccaacaugccaugcuaguugaaaguauaacucguuuugagagcauuuucuggacucuuccaucuauuauaauuauaguuaauuuuuuguuuuuuuaggaagaggaaaauagucaagugcugauuguguugccuuuagaaagauguugauguggauuuaaaaugauuagacuuguacaagcacuccuugaaaguacuuguuuugaagucuguuuugcucauuguguucaaagugcagcaugcuucacuuaaucucuaaguuuggcuucuuuuauuuuugagcaccaguuugcagacauugugugaugguguuauagauucagcgugcuuacauuuaaaauucauccauugguuuuuaaaauauggaauaauuuaccuuuuuuuauuucuaugcacuuacgaugucucauagugauugcuagacaaacuuguugagauuuuaaaauuacauucaguaauaaaagaguagguaaauuuguaaauucugaaaguagaggcuauuacucuuucuguauaaugaauuauuuuucauaagaggaaaagcaggaaaauugauggaaauuaguuuucuuuucuuguugcucagaguucuaguucaaacaguaguuucugaucggauacagacaugcccauuaucuguuuccauucccuguuuauaaggagaugucuucucuguaccucuagguaaacugucuuguugaaauauucuuacugaauguuuaaagggcacauaauccuggaaaacagggucguuguugcuuuuucccucucuaaauuuuuuucaugguugucuauguugguucuccccugugauuugccuuuuaucauuucauucauuuugguuuuauuuccaguauuauagcaagguuauuugaaaugaucuaucuccucucucugcuccaucuuccuugauagacuuugaauuuuuuuacauugacucuuuuagcaaaagagggucuauuuugcuuaaaaaauuagauguaaucauuauccuaaaguauuuauaaauuuuuauuauauaacuguuaaagcaaaaauagagaaggauguagguuggaaauuagaagccuaaaacauuguuuguaguugcuuuugaaaaaacuaaauuaaaauaauuuguucuauuauuagaaauaaacccuuugaacauauuuaaccaauggcucuagcaggaagagcaaaauucuugauuuucuuuugaacuaaaggcugcgguguguaccccaucccuuguucuuuucucccuuuucuggucuuagagagcuuugugauucuauauguguuuuaaaagucugacaguguaguugauguaauuuuaucauguuaauacuaaaacaccuuuccaagugaaauuuuuuucaucauccgccuccccucucucccacuuguguaggcacggugaacuagguaggcacguugcaucauugcuaccauggauacccuuaaguacaggcauguggguugagcuaaagcaaugaugauuaguuuuuugguuguucccccccgcccccccauaacuauauguucuucacaaugaagaaucugacuuuaaaacguuugcaaaugacaagguugugagaugugaugacuaaaccaucacugcuacugaacugccaaaucuuggucuccauuuacaguaguauuaaugccauuuacuaauuuaaggcugucauaaauagcucuguauuccuuuucugauuaauauguuuuaaauccaaguguaauguuuguuuuguuuugccuuuuagugaaaaugaaaauguacuucucuucgaguuaaaaaaaauacucuucuggauuuagauauuuugugggacaaaaagaugcuagugagcauuucuagcauggcagcguuucugauuauuguucauacacuuauauacauuuuuauguacuuuaaucagcuugguuacaguauuuugugcuuuuccacauaaugucuaagagagauuuauuuuuguguuuguaaguucuuguguucuuagcuagcugcuuugcaaacauguccguugagguggaguuaauauuguuagaggccaggcagugaagugucauuuuugucaggcucguaaucacuguaggaaaauuaacucagagcauaaaaggcccaacaagagugauuuaggauuauuguuauauaugguauauuuucuuauguuagcaauaaagcacucugcuuaaaccgcagcugagggcauuucguguucuuuagcauggagguuucccagcugucaaguaacuucugagaguaacuuuaguaccagaauuucuuguaauaggaucaugucuuucuuuaaguucagguguuucauuaaggcaagcuggagauaggaauaaaaggauuaugaaagagaaggagcuugaaagaugcuuuuacccauaccuguuucugcuuugucagccucuuuuugcugccuuuauuuuagauuuuagagugaugcuuugccuugucuucugaaacaguucccugaaucuccuacuugccaaaaguucaugauucuuuuggugauucuuuauauggguaaagaaaauguaugcccguguguggggauguuugucauuccagugggugcccagcaaauuuguuuuaacauaacugauagaauuuuaggaauuaagucaccagagaacuguugaauuguuuugguuuaucaguuugggaauuaugaauacaaaauuugacuccuuuggguaaaacagcuaucuuuuauuuaaauauucauauuuauauuaggguacuuucacuuguagguuguauuaaaauuguauguuagaagcuuugaaagggguauuaaauauguuaaaagaaagucucaguacagguauuucagauuuuuuagauuuuuuuuaaaagacuucaaauuuuuuaaguuagguuuuaauagugaauagaaaugcugcccucuacuguuggcugauuguuugacugccacguaaaaauguucaguaaccuguaauagaauuuuuuaguguagaucauauuacuguguugaaguauaauuauguuaaacguuuuccuuauaauuuaguuaaguuauaaucaaguguuuccuaauaaugcuaacuacuauuaaauaaguucauuaccauuuuggcuuuuagaaaaacuugaguccuggagaaaguuucguuuagucuuagcuccucauuuuauauggugagguuuuaguacuuccuagauugaucccuuaugguugugugacugaaagcucguauugauaacuuauaaccaaacuauagguaaagauacauuuuucuaaacuaauuauuuuuaguuuaugcuauguaaaaugucugaacuucugaaacuuauguuuuacauguaaaaaaauuuggaauuuaaaucacuauuaaaucuuugcauguuuauuaaaaugaggcacugcuuuaaaaaguaguacuguugagcaaauuuaaaccucugauugauguuuuucaccgugaguggagggauuagaagagacgguuuuaaagauuccuuuuagcuucgcugagugccuacugugugugaaguacuguagaaaauaaacacggaaaacaaaggcuauuauaguucuuccuuuagaucaggaguuggcagacuauggccagugggccaaauugggccacacucacucauuuacuuaccuuguauggcugcuuuagugcuacaguggcagaauuggguaguugcagcagugagcauauggccugcaaagcugaaaauacuuacucucuagacuuuuacagacaauguuugcuaaccccugccccagaugaacuucucaucuagugcagaagauauaucuaaaaagaaucauuuuaaacagauuuuuauaggacacauagaaugccaaauaaagcuagcaugucauuaaaauaugcuuucuuuauuagcgccauucuuccuguucaguaguaucuuaacaucaucuaauaauucccaaagauucuuguuuauuggccauuugcagauaucguaccucacagccugguuauuuucaucaucaucauuauuuuuucugugugaacugcacaaaucuaaguacgcagcuugaugccuuuuuauaacugcaaucacuauccauagaaagacacaaaacauuuccaguacuccagaaagacucccauuagcucuuuccaagacagcccacccuccccagagauaaucuuuuuuuuuuuuuuaacucauaucacuauagauuagguuugaacgucauauaaauggaaucaugcaguauauaugauuaauuauggcuucuuuuacucaguaucuguguuacugugcgugcugguagcuuguuccuuuuuauugcuguguaauauuccauggugggaauuugaauuguuucuacuuuuugguuguuaugaagaaagcuguguaaaacauuuuauacaaguccuuuuguguacauauccacuaauuucucucaaauauauaccugggagguaggauuuuuaauucacauuguagagcccuuaccacaaaguuuuuguuuaauaggacaaagcaggaggcaggaaucaaugacacacuuucacuuacuuuauaaguucaccuaguccccugcuucauuacaaaguggugacuuuacauuuuuucauaagcacugugauuaaggcaaccuacguuuugacuaaaucaaacagguuuuauuuccaaugccaccucuuauugguguuggugucuagaggucuuugcuaagaauucugauaacaaguugaaagugcugugauugucuaguagucuuugcuguguugagggauuagagaugugugggggaggcaugugacagaagaaugggaucauuuuuauuuaauauauuugaaaaauucuuacauauugaauauagugcauuuaaaauuaccucauugcuugaacaggucauagauuuuuuuuuuugagacagaaucucgcucuugucacccaggcuggaaugcaguagcgugaucucggcucacugcaaccuccaccuuccagguucaagugauucuccugccucauccuccugaguagcuaggauuacaagcacgugccaccacgcccggcuaauuuuuuuuucuuuguauuuuuaguaaacgugggguuucaccacauuggccaggcugucuugaacuccugaccucaggaggugauccaccaaccucucaaggugcugggauuacaggcaugagccaccacgcucagccuuugaauaggucauagauuucuuaauuucauuuauuguauuuuuaacuuuuagaaugucuguuugcucuuuuuagaguuucuauuucucuuaaauuugauauugcaucuaauuuguacaucuuuuccuguguauuuaaaaauugccauuuuaaaguucuuuucugcuauaauaguucuaacaucugugguucugcuguguggguuuucuuuugauuguuuuccucuuauguuauccuacuucuuuacaugucuuaaauuuuuuauugugcucuaaauaacguauaaaagaaccauugaaagcgaagcaguguucuuuccuuuucaggaagcugcagugaggcugauaaaauaggaguugaauuuguuuaggguuagguugcugcuuuaguuacuuucaccuggcuucuguuuucagcugucaugagggugggagaugaguuuugugucuuucauugguucuuuccacuagcaugacuuuaggguguaugaacugugagacugcagaaauguuucauggcuuuauagccccauucucagccugcuacacugcuguacccucaguaaaugccccaugaaggcgaucuaauguguggggacaaauaacucuccauuuuaggauccuccagauucuaacuggucaugccagcccacgucauuaaaggcuccacuccuuauaccaucaaagucacucaaucuguaucagguccauuccuuugcccaccugagucuaggcuugucagauacacuguuuagguaagugucugccuucuuacaaaaggcuucuuucuuugggguuuagauucuuuccuucgugugcagaaauuuccauuuccuuuuuuuuuuuaauuaaaccuuuaauuuuggguuaauuguagauacauguauguuuguaaaaaaauaauaauaaugcagaaaucacaugugccuuuaacccaguuuccucuaguaguaacucuagcauaguaucacuaaccaggauauugacguuaauagagucaaacuacagaacauuucugucaccacaaagaucacucgaggccuuuuuguagccacaccuacuuuccucucaccccauccccuucuuaacucaaagcaaccacugaucuguucucuauuuccauuauuuugucauuucagcaauucuauaugaauggaauaauaaauauauaaacuuucaggauuggcuuuuuucacugagcauaauuuucaagagauugccggggagugaaauugaugggucauaugauaguugcauguuugcuuguuuuuuuaaagaaacugcuaaaccgcuuuccagaguagcuguaugauuuuacauuuccaacagcaaugugugaaugaucgaguuuuuccacauccuugccagcauuugguguugccucauuuuauuuuagucauugucaucgauguguagccacauuucccugauggcaaaugauuuuggacaucuuuucaugugcuuauuugccaucuguguaucuuuuuuggugaaaugucucuucauggucuuuugcccauauucgaauugggugguucuuuuuacuacugaguuuugagaauucuuuauguaaucuauuauaguguacuaguccuuagucagauauaucauuuccagauauuuucucccaguauguggcuugucuuuucauccuuucuuuaaggaucuuucguggaacaaaaccuuuuaauuuugaugaaguccaauuuaucaaguuaggugacaaaucucauaacucuuugccuaacccuagguuuugaaaauuuucuccuguuucuccuguuuuuucagauuaaguucauaauccauuuuggguuaguauuuuuuuuauugugguaaaauauacauaacauacaauuuauuaugguaaccauuuuuaugagacugacaugcugcccacugcgcaaagaggacgauuauucuaaccauuuuaaaguguauaguaaaaugguauuaaauacauucaugagaugcagccacuaccacuauucaucuauagacucuguucuaaucuuguaaaacugaaacgaggacaauuauccuaaccauuuuaaguuuacaguuaagugguauuaaauacauuugugaaaugcagccguuaccacuauccaucuacagacucuuuucaucuugcaaagcugaaguuccauagucaucagacauaacuccucauucccucaucagacaauaacuccucauucccucagccaucauucuacuuuguuucucugauuuuaacuaccguaaguaccacauaaaaguauagucagaugguauuugucuucuugugacuggcuugguucacucagcaucauguccucaaguuucagccauguuauaguauaugucaaaauuuccuacccuuuuaaagcugaauaauauucuauuauaugucuauaccacauuuuucguauccauuauuucguuaauggauacuuuguuuccauauuuuagcuauugugaauaauauugcuaugaaaacaguauaaucucuuugagacacugcuuuuaaaauccaaaguaaaagcaguaaaagaagagguuuauaaaguagaaaaagaaauggguagaagcaucuuuaaaucuccucccuuucauauuccuuuuauuccuaccuccagcuugucucgaugauagaccuguacuuaaaccauccaccaccucucauaaggagagacaacuagcacacuagucauaaaaagcaaggaacaagaacuauaaaagagggaaaagagaaagaaugauucagaaaagacuguucuguacagccaggaaccuacauauuuuacuguuucauaaaaauuaucaaaaagaucuucuaacaauuagugaaucuuaccauguacugggcauuguuucccacacucgacaggucuauugagaaaugucuguucagaucauuugcccauuuuaaaugugcccauuuuaaaauaugauuauuuguuuuuuugcuauuaaguuguuuaagcucuuaauauauccugguuauuaaucccuugucagacggguaguuuggaaauauuuucucccauucugugaguuuucucuucacuuuguugauuguguuuuuuugcugugcagaagcuuuuuagcuugauguaaucucauuugucuuuuuuagcuuugguugccugugguuuugaggucuuaaccucaaaaaaucauucauucauucauucuuaugcauauggauauccaguguucccagcaucauuuauuaaagagacuguccuuuccccauuauauguucuuggcaucuuuguugaagaugaguuggcuauaaaugcaugaauuuauaccuggauucuuuuuucuuuucugugugucuguuuuuauuccaguaccgugcuuauuugguuacuguagcuuuguaguaaauuugaagucaaguagcgugaugccuccagcuuuguucuuugccuugaccauuuggggucuuuugugguuccauauaauuuuuaggguuuuuuuucuauuucuuuuucugugaagaaugucauugguaauuugauaggcauugccuagagucuguauuuuauuuauuuguuuuuuuguuuguuuuuguagagacuggguuucaccauguuguccaggcuguagucaagcaguccacccaccucggccucccaaaugcugggguuacaggcaugagccaccgugccugucccugaaucuguagauuacuuuguuuaguauuguuauuuuuacaguauuccuccacuucaugagcauggaauagcuuuccauuuuggggguccuauucaauuuccuuuuuuuuuuuuuuuuuuuugauggagucuugcucuguugcccaggcuggagugcaguggcaugaucuuggcucacugcaaccuuuaccucccagguucucuucacagccuccugaguaguugggauuacaggcaccugccacugcgccuggcuaauguuuguauuuuugguagagacaggguuucacuauguuguccaggcuggucuugaucuccugacuucaagugaucugccaccucagccucccaaagugcuggaaugacacgugugaguucauuuucuuuaguuaguguuuuauaguuuuccuguauagaucuuuaacuucuuugguucaauugauucccauacacuuuauauucuuuguagcuauuauaaaugugauugcuuuuuaaauuucuuucuucucuuuuucuuuuucuuuuuuuuuuuuugagacggagucucacucugucgccagggcuggagugcaguggcaugaucucggcucacugcaaccucugucuugcagguucaacugauuccccugccucagccuccugaguagcugggauuacaggugcccaccaugacgcccagcuaauuuuuuguauuuuuaguagaccugggguuucacaauguuggccaggcuggucucgaacuccugaccucgugauucaccugccucggccucccaaagugcugggauuacaggcaugagccgccgugcccggugcuuuuuaaauuucuuuucagauuguucacuguugguauauauaaugcuauugauuuuucauguugauuuuggauccugcagcuuuacuaagcauauguaucaguucuuacaguuuuuuuuggugaagucuuuagguuuuucuagguaugagaucaugccaucuguaaacaaggcuaauuugacuucuuccuuuucaauuuuggugcccuuuauuucuuuguuuuacuucacugcuuuuccaguacuauaugaaauaaaagcggugaaaguaggcauuuuugucuugguccagaccuuagaggaaagaccuucaauuuuuccccauucaguaugauguuagcuguggguuuauuauauauggcccuuuuaauuuugagcuauguuucaucuguaacaguuuguuaccgguuuuuaucacaaagguauauugaauuuuaucaagugcuuuuuuggcaucuauugaaauaaucaugguuuuuguuuucgguucuguuaaugugauguaucauguuuauugguuuguguaugucacaccauccuugcauuccugaggugaaucccacuugauuaugaugcgugauccuuuuaauaugugguugaaucugguuugcuaauauuuuguugaagauuuugcaucuaauuucauaaucagugguauuggccuguaguuuucuuuuuuuguuuuauccgugucugguuuuggaaucacagugaugcuggccuuguagaaugaauuccaaaacauucgauuuuuuuuuuaaagaguuugaguagaacugguagaauuuauuaggaagccauuagguccugggcuuuucuuuggugggagacuuaauuuuuuguuuuauuuuuaaaaauuuuaauauuuaguggaaugggagacuuuauuauggcuucaaucucauuacuuguuaucagcuuauugagguuuucuuucuucaugguucaaucuugaaagucauguauccaaguauuuauccauuucuucuaguuuuuaaauuuguuggcauauaguuguucauaauagucuguaaugauuuuuuuguauuucuguggucucaguuauguuuucuuuuucauuucugauuuuauuuauuugagucaucuuuuuuuuagccuagcuaaaagguaguugauuuuguuuuguugaucaucuguauuuuguuuuauucucaauuuuauuuauuacugcuaugauguuuauuauuucuuuucuucuaccaauuuuagauuugguuuguucuugcuuuucugguuccuucaggugcauuauuucuuugaagucuuucucauuuuuuuauuuuuugagacauagucuugcucuguagccuaggccagagugcaguggagugaucauaccucacucuugucuugaacuccugugcacaaguguuaggaacaguuucucuucaaacaaaggguuucacccuccuugucuuuuguucuaguauauaaguaaucuuucuugccuuuaacacacccaggcaugccuccguccaccaagcuuguagccgacccacgcugccuuacuuuaaguuguuagguacaaaaaauaaacuuccugguucuuuguccuauucuaaaugcuaaaucuagucagucgggaucaguuuagauugugugguccuaccccagauaacaaggggaggacacagaaacaggaauggcguuaggaauaaaaaccccugcuuuccuuuguucagugugcucuugugauuguaacugaugcaggcagcacccuucugaaauuugccuugcugagaagucuuuuguuugagugcucauuuucuuugugacuuugagcucuucuaacaaauuugggggcucaucugggaucccauucuccucuggggaaaggucuccaagcaucucucauuaggagacgugucccacugccucauugugguggccucagggguaagagauugagacccaccuggcaugacgaauaaacccgggaagaaaaguccuacaaguagauaccgcagcaaccaaguaacucugcacagaccaagguuagaaaagccgugggggcagugaaguauuuccuugguggucgagaucaaaguaagaaaagccagggggcggugaaguauaucuuggucagaacauaccaagguaagaaaagccgcaggggugguaaaguauuccuaguggucagguuaucuuggagguugaaagugcaugaaugagauucaggcacauuaaguguagagugaguaaguccaaucugcgguuccguggucaccucauauggcuucugauggcggcccuccuauaaaggagucaaagucaaaggcuuauacugaaccugccagugcuaagagggaccuaaagucccucuggggaaguggccauagagggugaagcgaaacaagaagagugcaagggaccuccaguaagugggguuaagccucuagggagagggaaggcaagaaaccucuaauaugaaggauugagccuaacaccaaaccuccaggauggggacuaucccaaguaagacaagaaacagaaaguauaaggcuaauaacauuccccuuaauagucccuuaggucucauguuaaaauaauacuggaaagauaaugagaggacuaaacauaagagaaagcaacagaugauaaaauauuguuguuucauuuggaccaaagaacccauccuugagcccucaguuuucuggccaaaguuuaggucaaaugaggauucaaauuugucaacuuuuaauaaaguaugucaaugacaagagucccguuucccaggagaaaauagauuaugcccuguguuggcagcagggaccuguccuccuuuacccccuaaagguauagggggcaagccagaaaccagcuccucugaaaggaguaaggucucuaccccugaacagcccacuaacaucuggacccacuagaccaccuguaucugccaaaucccccgccccaagugggugcacaggaaucuccucacucaguuccucccccauguaauccugaaucaauguucucuggccucccuaaccacacgccugagucuaugucuccccccaggaaggcuccagcgugagauaaaacagugcaacaaagauauucagaacuucccuuuccccuccaccucuaagcaaucaacuccaacucucuuucccuuaagggaagugccccuuggagaaggaagcaucggcuuuguuaauggucccuuaacuagcucagaaguccaaaguuuaaaagaggaacucagaucauuauuaaauaaccccuaugggacugcagaucaaauugaucaauucuuagggccacagcuguauacuugggcugagugaauguccauccugggcauccucuuuucaggggaagaaagaagcaugauccauagggccgcuauaauagucugggaaugugaacauccauccaaaacauuccugcagcagaccaaauauuuccagcccaagacccucaaugggaugguaacaauacagcucacccaagaaaagccugacccucuucuguggacuucugaugaaauccacuagguugagcagcuaaaacaccuacccaucgcuauuccugucuuagcgcugccaucccuagaaaaaucauuucaccuuuucauuaacgcaaacaagagggugacuuucagggugcuuacucaagaacaugggggucaccaacaaccuguggccuuccuaucaaaaguuuaaacccaguaaccuguggguggcccaaauuuauucagucuauuacagcuacugccuuaacugaagaaagcaggaagcuaaccuuugggggaaacuugauggugagcacaccccuucagguuaggacaaucuuaaaucaaaagguaggaagauggcccaccaacucaagaauuuuaaagugugaagcucccuuacuaaagagagaugacuuaacacuaaccacugacaguucacucaacacaccagguuuccugacagggaacccaaaccuaaaagggccuaaguguaagugcuuaaauuuaguuaauuaucgcacagaggucaggccugauuuaagggaccccuuucaaaacaagacaacagcuauucauagauggcuccucccagguaauugaaggaaaaaaacauaauggguauucaguggucgauggggaagcugucgcagaagucgagucagaaagacugcccaauaaucgguccgcucaaacaugugaauuguuugcaauaaaucaagccuuagaacauuuacaaaaucaagaaggaacuauuuauacuaauuccaaguaugccuucaggguagcccauaccuuuagaaaaauuuggacuaaacgaagucucaucaguagcaagggccaagaccuuguccacaguuaauuaaucacccagguacuggauaaccuucauuugccaccucccccccccccaaaaaaaaaaaaguauuguccaugucccaggacaucaaaaaaaaucucuuuuaaaagacgagggaauaaccucgcagaccaaagagccaaacaaacugcuuuuuccucugaaacaugcauuuuccaccaacucauugucuuucucccccaacugccauucccaucuucacucccgcugaaaaggagaaauuaauaaaaauaggagccaaagaaaacucagaagguaaauggguguuaccagaccaaagagaaaugcuaaccaaaucucucaugagggagguuuugucucagcuacaucaagaaacccacuggggaccucaggcuaugugugaugcaguucuuaaagucuauggauguauaggaauuuauacucuagcaaaacaaguuacagauaauugucuaauauguaagaaaacuaauaaacccuaagaaaaccaccccuuggaggaagaaacccaagauuaaggccacuccgaaguauccaaauugauuauaccaaaauacccccaacaggccgccuaaaguaucuacuggugauaguagaucaccuuacucacuggguaaaugcaauuucuuuuucaagugcaaccaccaacaauguaguuaagacacucauagaaaauguuauacccaaguuuggauuaauagaaaacauugauucagauaauggaauccauuucacugcacaugacaauauaaagcuagcccagauauuagaaauaaagugggaauaccauacccccuggcacccaccuucaucagaaagaguagaaagaaugaaccaaacccuaaaaagccaucuaaccaaauuaguuuuaaaaacucgauuaucauggaccaagugccuuccuauugccuuauuaaagguccgaacugucccucagaaagaaguuggcuuaucuccuugugaaaugcuguauaggcugccuuacucacacuucacuguugacauuccuacguuugaaacuaaaagucaguuucucaagagcuauguacuuggucucucuuccacuuucucuucccucaaagcuaaaggcuuuuuaguacagaugccacccuuggaguucccagcacaucagcaucagccuggggaugauguucucaucagaagcuggaaagaaggaaaacucaaaccagcuugggaaggacccuaucucgugcuucuaaccaccaagacugcaguccaaacaacaacaaaaaaaugcagacccaucauaccccagucaaaaaagcaucgccaucuucaaagucaugcgcuauuguuccgagaccaauuccuaccaagcuaaagauaaaaaaaaaaaagcuuaacccucuuauagugccuuuuuuucuuuccccucucuacugucagacaauuauccuuuccucacccaguaacaaaaccaaaguggccgucguagagguaaaagaucuaaaacaaaccuaaucauugaaacaggguaccgagaugcaaaugccuggcugaaauggauuaaauauucugucugcacucuaaacaaaaaugauugcuaugcuugugcgcacagcaggccaaaggcccagauuguccccuuuccacucgaaugguccuccagucuaccaggcaugaacuguaugguaguucccuuccaacaccucacauccugggguaauaaguuaugccaagcucccucucugcuauucccucaaguccagcacccugcgggucagcccccaagggccaucaagcuuccauuuccccaugccaguuuuaccucaugucucucacaacacggggaaaacuuggcauuucuuggagaccuaaagggaugcagugagcuuaagcccuuccaggagcuuacuaaucagucuccccuuauucauccccaagcaaauguaggaugguauugugguggacuauuacuggauacucugccaaguaacuggagcggcacuugcacucugauccaauuggauaucccuuucacucuggcauuucaucaaccagaaaagauaaaacaucguaaaacaagagaugucccucguggguccuuugacucucauguuuauauagacgccguuggagucccacgagggguacgaaaugaauuuaaagcccgaaaucagauaacugcagggucugaguccauguuauucugguggucaacaauuaauaaaaauguagauuggauaaauuauaucuacuauaaccaacaacgauuugucaguuauacuaggaaugccauuaaaagaauagcucaacaauuagggccuacuagccaaauggucugggaaaauaggauggcgcuagguaugauauuagcaaaaaaaaaagagguggagucugugucaugauaggaacccaguguuguaccuucaucccuauuaguugaaagacuuauuacaacagcccuuacugaaacuuuccugauuucuuuuccacccuaguuuaacaaacuuuuacuucuagacagugaggaacagcaaagucaggucauguuagguaaguuugaagaagaaaguguguaaauucaagaggggaaaauuguuaggaacaaacaguuucucuucaaaggguuucaccccccuuuuccuuuguucuauuacauaaguaguuuuuccugccuuuaacaggcccaggcaugccuccauccaccaaccuuguagcugacccaugccgccuuacucgaaguuguuagguucaaacaaugaauuuccugguucuuuuuccuuuucuaaaugcuaaaucuagucagucggaaucaguuuagauugugugguccuacccuaauuaacugggggaggacacagaaacaggaacggcauugggaauaaaaaccccugcuuuccuuuguuuggugugcucuugcgaucguaacuaacgcaggcagcacccuucugaaauuugccuugcugagaagucuuuuguuugagugcucauuuucuuugcaacucugagcucuuauuucuaacacaaggcauccucuugccuaauucuucaagcagcugggacuacaggcauguccagacugcaggaucuugaacuccuggucucaagcaauccugcugugaccucccaaagugcugagauuacaggcaugaaucaucaugcccagccuauuucuacuuuuuugaugcagguguuuauugccauaaaccugcuuaauacugcuuuugcuguauuccauagcuuugguauguuguguuuccauuuucauuuguuucaaguuuuuaaguuuccuucugaauuucuucauuguucaggagcauguugucuaauuuccauacguuuuugaaguucuugagguucuuuuuauugauauguauuuuuauucuuuuuguggucagaaaagauauuugauaugauuucuauuuuuuuuuuuauuuguucagacucauggccuaugauaaugguccauucuggagcauguuuuaugugcugauaaaaagaauguguauucuccagcaguuggguggaauguucuguaaaugucaguuaggccuauuaggucuaguuuguaguuuaacuccaguguuucuuuguuuauuuucugucuggguuaucuguccauuucugagaguaggguauuaaagucuccuacuauuauuguauugcagucuauccccuuggauguauuaauuuuuuuauauauacuugggagcucugaugggugaauauuuauaauuguuauauccucuugcugaauugacugacuccuuuaucaucauauagugaccuucuuugucuuuuuuuuacagucuuugauuuguaguccacuuuaucugauagaagcauaguugcuccugagcuuuuuugguuuccaguugcaugaaauaucuuuucccucccuuuuaauguauguguaucuuaauaggugaaguggguuucuuguagacagcauggaauugggucuuguuucuuucuuugccuuuuaauuggagaacugagugcauuuaccuucaguaguauuauugauaaguaaagacuacugccauuuuguugcuuguuuucugauuguuucguaacucuuccuuucuugugguuaagagauuuucucuggugguauguuuuaauguguugcuuuuuauuuuuagugaauuuguuauagguuuuugcaucgugguuaccaugagguuuacaaaaaaauaacaaauuaucuuaaagaguugacaacuuaucuuagaucacaaaagaauagaaacaaaggaaaauuugaaagaacuuccacaauuuaacuucaucccucccucuaagaauucauuagaggcuuuuaauugucucaguuuaucuauuuuuauauuaucugccacuuaacagguuguuguaacuguuacuguuuuugauagauuuaucuuuugggcuuuauauaauacuagagucgugaguggauugcauaccacaauuacaauaguaaaguauuuuggguuuuuuguguauacauaauuuuaccaguggguuuuacaccuucaaauguuuuuuuaguuuguuuuauuuuucaugguaguguuuuuuucuuccagauugaguaauuccuuuuagcauuuuuuuuguaauaugagucuugugguggugaauucucuuagcuuuuguuugugugggagucuuuaucuccccuucauaugugaaggguaauuuugcuggacaaggauauuccuggaugguaguuuugguuuuuuucuuugagcacauuaaaaauguuccugucccuuccuggccuguaugguuuccguugagaagucuguugucauacaagguagagcuucuuuauauguuauuuguuucuuuucuauugcugcuuuuaggauccucucuuugucuuugacuuuucaaauuugauuauuauaugccuuuggguaaucuuauuugggucaaauguguuuucugaccuuccuguacuaggauauuuacauuuuucucaaguuguggaaaguuuucuauuauuucuuugaauaagcuuucuaccucaugcuuuugcucaacuuucuuugaacacuaauaauucuuacauuuuuuuuuugagguaauuuucuauaucuuauaggcaaucuuuguugcuuuucauucuuuuuucuccuauguguguuuucauagccugucucugagccuaaugauuguuuacucugcuugauccucucuuaugucaagagccucuaaugaaucaguucagcaaguguauuucucaguuccaagauuucuguuugauuuuuuucuuuucuuuucuuuugguguuaugacuuggauaauuuuaaaaaauuacuuuaaucucuuuuuaaaauuuccugauaaauuucugaauugcauuucuguguuaucuuggagaucacugaguuuucuuaaaaauacuacuuugaauauuggucagagagcucauagaucacuaucucauuagugucaguuauugguuccuugcuuuguccauuuggggagaucauggguaccuguuuucuguuguuuguuguggcuguuuuauucagccuucucugucuggcuuguuuugguuuuuacuggauguauuugcuuagaaguucuuuacuguuagguugcugccuccuuuuuagcucucucuaguuaccuuaagcccagguucaccuagguucuaguaaagaaccagagcacuguucuucccgaaugagggagauuccaaaggggaugucccaguagugugggaaugcuggcuaggaguuccugcccaggggaccuguacaauaaaccuucuacagaugguguugaugaacaucuaaugaacaucuacucugauucagugucuugcuuggcugaguuacaguagaauuuccagagcuggagaugguagucuugccucccuuuuuuguuucugccuauccgcagggauauuuuucccuucuggcauuugagaugcauccugugggcuaagauaagggacagucuccugccagagaacauuagaugauggggaagcaugaguuauaucucagucucacuuuuuccaguguagaaacagugaguugugggaaaauuuuuugcccauuaggugcuggccagaaugaggggagggacaucauggauguggaaguccaauucuuucaccaucugcuagaauucuuuuuuuuuuuuuuaacuuuucuguggccccugaacugucgcaucuucauaugaguucugggauauuccugguaauaacaucggcucuguauauuuguuuuugguuuucugugagaggagugaagccagcuugcuucugugcugacauuuuggaacuggaaauccucuugauuaauuuuuguauguugauuuauucuauauuccaggaauaaaucccaaucccacugggucaugguguguaauccuuuuaauaugcugucaaucugauuugcuaguauuuuauugaggauuuuuguaucacuguucaugaaggauauuggucuguaguuuucuuuucuaguacuaucuuuggccuugguauuugguagcgcuggcuuaaugaaaugaguuuaggagugaguagucccuccuccuuaauuuuuuggaaaaguuugagaaggauuggcauuaauuuuucuuuaaaugguuggcagaauucaccagugaagccuucagguccaggacuuuucuuuguugaaagauuuuugauuacuuauucagugucucugcuaauuauagaucuauuuagauuuucucuuucuucaugguuuagucuugauagguuuuguguuucuaggaguuuuccauuucauuuagguuaucuaguuuguuggcauuuacuugcucuauauaggacucuguuauccuauuuauuucucuagaauugauugaaauguucucacuuucauuucugauuuuaguaauuugagucuucuuucucucuuaauuccauauaguuaaagguuuguguuuuuguuuauuuaaagaaacaacuuuugguuucauuaaguuuuuucuucuguuucucuguucucuauuuuguguaucucugcccucaucuuuauuauuuuuuuccuccugcuaaccuuguguuucguuuguucuuguuuuacuaguuccuuaaguuuuagacuagguucuugauuugagaucuuucuuguuuuguaauguaagcauuuagagcuauacauuuacuccuuagcacugcuuucacuuuauaccauaaauuuuguuauguuguguuuuuguguucauucauauguaaauaucuucuaauuuccuuuuugauuucuucuuugauucauugcuuguguaagaguguguuuaauuuccacaaauuggugaauuuuccaguuuuccuucuauuacugauuucugacuucauccaguuguagcuggagaugauaguucaugugcuauaucuaucuuuucaaauggauugacauucuguauggugucucacagaucccuuaggcuguauucacuuuucacuuaaaucuuuuuccucuguuguucacauugagucuuuaguguuauuguauuuucaguucugucauuuccauauaguucuuugugucuuguauuucuuugcuuagacuuucuauuucuuugcugugaguuuuuauuauuucauuuguuucauguauauuuguaauuguucauuaauuuuuuauaugacgccuacuuuaaacucuguuagguaagucuaacaucuguggugucuugauguuggcaucuccugauugucuuuuuauauucaguuugagauauuccugguucucagugauuuucaagggaaacuucgacauuuuuuguauuaugagacgcuagaucuuauuuaaacccuguguuuuggcucauuuucucugacgcugcucugacagugaaagguggggcacugcuuccuuacugcuuaguggagguaaaagucagguuucucacacugcuuccuuccacaccuaagagagaauacuccucacuccuguugggauaggguguuaguuauaguuccccauguggucuucacuaacacugcaugggguagaagcuuuuguuaccaguggauuuggaugcaagucuaggcuucccacgugucugcuuuuggaaucaagacaguacuaaaacuucauaaaaucaguugagaacugcugggugccagugggaguuccagcuccccguuaguucuccauuaauacuggcuagaaguuggaaugccucauuacugcuccucaugugacaguauguagaaguaggguugugcaccuuguuacugcuggauaguggggaaaaucccgucuccugacuauaccucuucuaacauucccucuacccccggccaguggagagggcugucucuuuauugcuggaugggaacaaaugucccagcuccuuaauuggccuucucugacccagccccaguuggggaagaugguugggacaccuuguuacagccucaugagaguggaauucuaggcuaccugcuggucuuugcugguguguauaugguuggugacagaguuuuuuucugugguguuuagcuggaauagagcaguugucaucuaaaaguuguaucuugcuaggcugccccuuucuguuccuguggcaacaaaagccuaaaagagcuucuauuggugucucucuuuuuuggcacaagguaggucuguaccauuggcguuucuggguugcucauuucuucagcugaaauccugggauagucugagguaaaaaagaaaacucagggacugacugccgugucuuccuuaggguucuacauuccuagcuagucugccacccucuuuucaccuuucagucuuauuuuuguuuuauauauaauggccaaagauuuuaguuguauguagcauguggcauaggaaagugucuacgcucucuuucaauuggaagcccucauugucuuuaaaagauauguuuaucuuuuuuuucuaguuguuaugguacaagccauugucugugugaccuuccacauucugaucugagcaggagcucccagacgcuaguuauuguggguuguuuuuguuuuuugcacucuuaaauuuuagucaauuaaaugacugccuguuuguucuccaguauguaaauuaaauaaccuuuccuaauucauaguuugguaguaacagaauucauuauggacagcaaaugauguuugaauaaaauaauauauuuauuuugaaagaugaauauucuugaauaaaacagcaaauguuaacagcuaaaguauacuuagcauuuguugaucugcuuccugguaagauuucuucccccaucugauuauagauugucuaccaccuccguuacuugguaaaacugugaaaaucgacuuuucuugacuuugguucugcagcuguagcuuuccccugucccccuuuagggacaacccaccuuugaaacuaggucuagugcuaguggagagagguaaugugauugggcguugagucccauaaacacugagcugaguaguuuggacuuuaucccauaggcaauguagggccagccaaaugaucauuuugaacaguaguucaaauaaaguuguuaauauucacacaguguuugauggucuuuauuuuaucuuguaggucaccugauguauuuuuuuucagcgugaagaacuucuuuaacauuucuugaaaugcauuucuucuggugaugaauucucucagcuguuguuuacuugaaagaaguauuuuuauuuugucuuuuuuuuaauuuuugagacaggaucucacucuguugcccaggauggagugcaguggugccaucucagcucacuggaaccuuuuccucccaggcuuaagugauccuccugcuucagccucccaaguagcuggaacuacaggcaugccccaccacacccagcugauuuuuuacuuuuuguagagacgggauuucgccauguugcucaugccacucuugaacuccuggucucaagcagucugccuaccuugggcucccagaguacugggauuacaggcaugagccaccaugacuagccugccuuuauuuuugaaugauaguuuugaugaaaaaaauucuggguugacagguuuuuuuucccagcacguuuaaaaccucauuccauuugguauguuuuuauugguuccauuucugucaugauauucauguuuuccuuuaaguccuugagcauacuuaaguuuuaugaguguuuuugaguuuuuaucugcuaauucugucauuuugcauuucuaagucuauuaugaacuggcuuuccuccucugauggcucacaguuuucugcuucuuugcauaucugguuauuuuucauuggaucccagacauugugaauguaauugaguguuccuaaguacuguuuucucuggaaaauacuguuguuuguuuuggaaggcaauuaagucauuugcagauaagguugaucaguucaagacuuuuuaaagcuuuuuaaaaguuggaucucaaguagccuuuucuuuaaggccagcuuagccuuaaugcuaaggcuugacugucuaggaguguccacugauuacuacaaguguuuauugaggccccucugcucuguauaaguuugaacacuccucagcuuacugugagcucugaagcuuguuuauaagucccuuacaguuuuauuugccuggccuuguugaauuuuaugcuguucacguguugauuaguauucagacugaagucucaaggguacucacuauuugauuucuggagcucuuuuucugcuuagccuucuucuuuccaguauucugccuugcacauuccagugcuuccgucuccuugaacaccagucuugauuuuugucaacccaguaagauggcuguauuggcuuggguuucuccaucaugugucaaguuccaaaaaauggccuccaggcaggaagccaggaagaucguagagcucacuuuguuuuccuucucucagguauuguaguccuguacugcuuguuguccagugcugaaaacuguuguggcauguauuuuuuuucuaguuuucuaguuguuuuaaggcagaaggucaaguucuguaccaguuaacuucuucauggccugacguagaaguuuuuucauauuuuguuuauuuagauccuguuuaauuucacaauagauuuaagcugguuacucuggaauagaaacuacuacuucaguaguuuccuuaaaaaacauaacuuuugacgugacuuuuugggaugagggagauacaauguauguucauuguagaguuuagaaauacacaaaaaugaaccuaagucucauguaaacucagacuccauaucuuaccucuauuaacauuuuucuguguucuagucauuuuucugugauuauauauauaaccccuuuuauacauaauuacggggcauaaacagacauacagcccucuuucuuuguucccccaguuuguauuguguuuuuguuuguuuguuuugcuaaaaggcaaaauuuuaguccaagguuaguuuuucauguuauuacauguucuuuaaaacuaugcuugucuguccauauuauaauggcaguuuaagauuucacaacaggaauauaucaucauuuauuuagagaaugugggauugauuagacauuuuuauucuuuucaaaaguaagaucuccagucaguuaaaacucuacuccuaaauucauccauuauacuuuuuggaaauguuuuguccuuguuuuauccauuuccuccucccugagaaaagcauucugcauugaaauuuuacacucaauuugguuugagaacugugcuuugcuuuucuuaauuggaucaucugggguuguaagccugucuguguauuagaacuggacagggagcucguuaaaaauaaagaucguuaggcuuaaauuagacuaaauaccugggaaucuucuuuggauaucucaccauuugggaaccacuguucaaaaccuuaucucugguauucuagguuuccuuaaagacuguguguugauuggcuuaguaggacauaagaugagacucauuggcgcucagccacagccucuuuguguucaucuauuucguuuuuuggggacuuccaccuaagaugcuguuucaaagaaguuuuaugcuagaagcaaauguguuuaccauggauauuguuuaucagagcuccgcuuccaguguauaauggauggauuucuuuaguuuccuugaacauggagaagccugaagcaaacuguaugagauaggagucauggcuuguagaagcuuacauaaaaccuuuaaggcugggcacgguggcuuacgccuguaaucccagcacuuugggaagcugaggugggcagaucacuugaggucaggaguucaagaccagccuggccaauauggugaaaccccgucucuacuaaaaauacaaaaauuagccaggcaugguggcucacaccuguaaucccagcacuuugggaggccaaggugggcagaucacccaaggucagggguuugaguccaaccuggccaacauggugaaaccccgucucuaccaaaaauacaaaaaagccgggcaucguggugcgcaccuguaaucccagcuacuugggagacugaggcaggagaauugcuugaaccugcgacguggagguugcagugagcugagaucccaccacugcacaccagccugggcgauggagcuagacucugucucaaaaaaagaauuuaaguuuuuaaaaaaccuuccaauagaaguaguugaaaaaugauaguugcuacuuuuacuuggcaguucuucuaauccaugaauauggaccaucuauuuauuuaaaucaucuuuaauuucuauuaauaaugcguuuauaacuuucaguguaugaguauugcacuuuuauuacauuuauuacuaaauuuuuuaugcuuuuaaauguuuuugugcauggaauuauuuucuuaauuuuguuuucagauuauucauuauauguaaucauaauuuuuuuauuuuacucuuguauccugcaguuuuaaguuuucugacgauuccuuccuuaggauuuucuacauauuuuguaauuacuucuuccuuuccagucaguuaugcuuuuuauuuuucuugccugauuacacugguuagaauguccaguacaguuuugaauaggaauaaugagaguguaaauccuucuuuguuucuggucuuaaggagaaagcaucgucuuucaccauuaauuaugguguuaaauguagguuuuuuguaggugccccuuaucaugaauaguuguuggauuuugucacgugcuuuuucuguggagauacuuaguaguucucaaauuuggcacaaggaagcuuuucauaguuuuuuuuuuuuuucugccagauagaugguaauuuuaggaucaacugugcguugcauaucauguagccuuaaaugagaaccacggcagauaauuuaauaccauuuguugaacaaauauucaugaagugccugcaggaugcauuucuaacaaguucauuugcuucugaugaauguucaagauuuggaucuaguagguuagaggucagaguuucagacccaugauaacaaaguuuuguuuccuccaugaauuuauuuuuuaaaugguuuuaaauauuuaagcauagagcuauaaaccuaauacugagcccaguuccagcuuuuucuaaaauaauaguuuucuuuuuguuaccaugagcaguaucauuagcauggcucuucuugcaccuuuuuuuuuuuuuuuuuuuaagagacaaggucucugucauccaugcuggaguacaguggcgugaucauagcucacugcagccagaacuccugugcucaguugucuuccccccucagccucccaaagugcugggauuacaggagugagccaccaugccuggucuucuuucacauuuuuaucacccauuacuaugacagaacagugccacucagaguagaguggcaauccaaauagcuguuuuuugugcucaaauuuaggugauugagauuauaccagguuuccuuuuagaacagauuuauaaauaguaauacacaaagcaaauuauuugcaugaauuuguugguguuccucugauucuuaugcucuccauugugaccauguacauugcgguuucaugguaugauuuguaucuuacagguuugccccauuauugaaauuguauguagucacaguuuaauuuguucauuucuucuaauuggcugucuucaacugugaaagcagcugaaauucugugguuaauugaaaucagucaagguagugcaguuugaucaagagugaauguuacugcauuugauuugacauuaauuuuaauuuucauucaacauuuuauuuggcagaguagcauuuuagugguuuuuguuuuuugguuuuuguuguuuuguuuuuuguuguuuuuuuuuuuuuaacagggucugguucucuuccccaggcuggaauacaguggugcaaucuugacucacugcaaccuucaccucccagacucaagccaacucccaccucagccccccgaguagcugggacuacaggcgccugccaccaugccuggcuaauuuuuguauuuuuuguagagacaggguuucgcucuguugcccaagcuggucuugaauuccugagcuuaagcgacccgcccgcucggccucccaaaguguugggauuauagguguaagaccacaccuggcuguauguuaguauucuuacaacaaaauguaaucaguuguaugguauuuuugcuaaaucaacuuuguaagccuacuuauaacagaaauguccacauuauugugggcuauucuuugccagacaaauugauggcaaauucauagguaucuaaugucacugcuuaauuccugccguuucaaaaagacagcaaauaagcaaaccacagcauuaauucuucacguaauuuaagaaaaauaguguuucucuaacuccauuaaucauuuaaaucccauaugguucucuuacagcagugugaucuagcugcauuucuucacuguuaagaacuguuaggcgcuucuguuggagauaguuucuaauguugaaauuaucagugaauguucauuaauucuucauguugaagcugucaccauggaaacuuagguguuauagcaacuaguuauaugcuauaacuuacuuagcauuaagaugauuaaauaacauacuauauguaaagcaguuggaagaaucauggaaagcaaugucauuucuuagcagauacuacuaucauuuuauucuuguuuuuuggcaagugugaaaauuaaauucaaauauucuuuaagauguauacuucuggucuugagauguaacaucacuuugugaucuuaccuaaguccucugcucuguaggaauuacaauuguuuacauaaagaugcuauuacuaucuuugguaugaaacucaaauauuuaucaauagauuuaccaugauguuuugaaaaucagugggauuggggacagugacaugucaaaaucaucuaggaauuaaaaaagaaaagcacaacacugcuuauuuaaacacugcuggucuacaaguuuagcuucuuuuggacuuaaaaaauuuguuagcuuacccuuguuuuaugauaguaacaauaacucagcauuuguuugauaaugaguuaauauauaaugaaaaaauuucaugacuaaauaguuggauguuuuuacuauauuguuugaucuccaguuaaugugacaggugaaggaguuugguuggguguugcucuuguauuuuaacccuuuuauaagauuucaguugacagugaaauuuuaaacauggaacuguaauauguaauauagguaguauuuauuaccauauauuuacuuaauaaauucauauuuacauuuguuuauuauauaaaucuaaacaggcaguuuugaguagugcaaacauuuugauaacauuaaucucagcaucuuuuuuucccucuauuuuguuauacaguacugagaaaaauccaauuuaaacagauuaguaauugaaaacuguuuuaaagcuugccugauagccuuaaauugucauucuagcagguagaaagaauaguaaggacuuuggacuugacucgccaaauaucuaaccuuggcuugcauuuauuaauuguugaaaaugagcuuuguagucagacaugauucccauuucugcuagcugugacaccauggauaaauuaugugacuccuccaagccuugaguuucucucauuuaucaaauggacguuauaauacuuuuuaccucguaagagguagaucauauuuggauuaaguaagguaauuacauguguuaaaguauauccaaauaaucauauuuggauuaaguaaggcgauuacgcuuguuaagguaugauuuucaaaaaagcaaaguucuuaggcaaauguagaaugaacaugugucacagauuguauuccacucacuuguuaaugagagaaauaguaagauguuaaacuugaccagagugcauuuguuaucuaaguauuuauaggcaauguuaauagaagauugcugaguuagauaagaaacugauuaauauccaacgaggccaggaauuuaaucuuugugguuaucugggcaaaaauuauuugcuucucuauugaauaaaaagcuacagguuaacauauauaacuucacugucuaggacuuuuuuuuuuuuuuuuuuuuuaagagacaggcugucacucugucacccaggcuggagugcaguggcucaaucauagcucaagcaguggcucaagggcucaagugaucuuuccaccucagccucccaaguauuuauuuauauuuuuuuuagagauggacucuugcuguguugacuaggcuggucucgaacuucuggccucaaguaauccucccacuuugaccuccuaaagugcugggaugggacuucuaguaaauaguguguuaaagugugcauuccccuaaauuagaauuucucaauuuaggcauccuugauuuuugggcuagaucauucuuuguuguggaaagcuguccaguguguuguuauaaaauguuuaguagcaucccuggcuucuacccacuagaugcccguagacucuuuuccucgauugggcagcagacauugccaggugucccugggggcgcaaaguuguuccauguugaaaaccauugcccuggauaaucuugaacaaccuuugucucuauacagcauugaacguacuaccaauuuuuuugccucuuuuuccaagcuuuugauaauuuuucugacacaugaaagcacuuugcagaaugccugacuaguaguaauuauuaaaugacaauugcuacuguuaauaauuauuuauuauuauuacuuaaauauuguuucuuagguaguuugauagguacuauuuggcugaauguaucugggauauugauuuguuagauaacaucauuaaaaagcagaacagccuaagacacuuuagugcaaaucuaucagauccacucagaguuucaaaauagucaaaauuagucauuuuuccugguaggucccaaaaucaaaugcauguuuuuuauacugucuucugcaguuuuagguaugguaaauuuugacccaaaauguauacguugaacucauucauucaguuuacuaaaaaaacagacaagaaacacugguuaauuccuaguaaucauuaaaaugaucauagcacaauauuaucauaguugaauauauuacauguuuauuguguaaccaacugaauaaggcagacuguauuaagagcacaggcuaaguggacaugcuugaacuuugccugacauuuuguucuauuagacaugugccaaauaaugugcuugcuuauauaguuuuaggggagcagacaugucugcacagaacugaauuuuauuaagacucagcguguacaaccuacaugaucaaugagacaaauccuccaugugcacaaaaauuggagaaguuguauuuugagauugacacaaaaugaguuuacuugguaguauggauaaauaaauuguuauagauaaacaccaguauuaaaacuuguuacacauuugugcuuccagguuuuuaaaauuaaaauuuguaaauuugaaaaugaaaguuuuaaaaugaaagaacauuggugacaccucugaggcacugcagugaaaaaggcugagaaccacagcuuaacaacuauggcucugacuuaguaaauguauuuuuaaauauaaaggcuucuaaggagcacaguuuacuuuuucuugcccuaguuacaguugacauuugacuuuucauuuaaguuccacaagucaugugauuugcaguuauuuaccugucaggguaauuagauuggagaaccagcuauuuccuuuacuguuuuagaaauguaaccuaguuuuuucucucucucaccccuuauacaauuacauaaguaggaauggaacagaauagagaauuguguaggaaauuggaauuaaaaguguucuugagcagguuuggaauuagaguuaugguuggugguaagggaauuuuugucuuuuggcacgcuguuucugguguauagcaaaauauaguauacuuuuccacaaacagcuuugcuuacuaagcauacagagaccaggcuguugaguacaaauauaugaauugauaauuuuaguuuuguaaaauuguucuuguuuuuguuuuuuguuuuuuugguuuuuuuuugagauggagucucacucugucgcccaggcuggagugcaguggcgcaaucucgguucacugcaacuuccaucucccaguuucaagcuauucuccugccccagucccccaaguagcugggacuacaggugcguaccaccacgccuggcuaauuuuuuuguguuuuuacuagagacaggguuucaccauguuggccaggcuggucucgaacuccugacccucagaugauccacccaccucggccaccugaagugcugggauuacaggcaguuuuguaaaaguugacagucuucauuagcaauuauauuucuuaacugcaauauagauguaguacuuagaacaacccaaauaauaguggaagaaagaaaagauaauuacauagaugaagcaguaaauauuccuuuguguguuauuuaguauuuuacuggcauuuguuaauucagcuuuugaguuucaauaaauacuguccauuuaaauuauagcgaagguacugcauaagauguaacaucugugugcaagauuuuaaauauaaaauacuguaagaaugacauuuucacaguauuuuauuuguugcuuugaauguaauuaguuaaugauagcuuuucugccaaaggguugauuaaaaagccaaagcacagaaaauaauauuugaaagaguggauaaaucagugauaugucggugaguuaaacugcuugacuuucugcuuuuaaacuuuccauaugguauagauauacaucaaaauugguucaguaauguuuuuccagauuuuaagugauuuugauguauuagaaaauacugaacuuuuuuuacuguccaaguuuaauuuguaauuauucuacuuaacuuugccagaugauugauuuuuguuguuguugcuugaauuguuuauagagaggaaucaaacuacaaaaugugauaauugagguacucuuuuuaccauuaaaacuauauuuuaaaucagacuacaguguuuagugguguaguaagaaagcaucacauaugacaagcucugggcucaucucuuauugaaccguguaaugaaucccuugcugcaacaucuuugccccucccccaaagcagccagcauauauuugagcauaguggcucugcucgaguuguaucuuauucucauggaggagauagcagagcuuguacugcagcaaguggagcucuguggugaauccgaugcuggauuacauuuuaaggauauuagcaaggcccugacaaaguggugcuaaaugagcacuuucauucugguaauuugacuauaauuuuagugaagcaguuuuauuaugcaggaaaaagaaacagcauuuuaauuccaaucauaguauaccgaccugaucucugcuguggggguggaaacaaugaagaaugcaacauuuuaauacaauuuuuuuuaaaaagaaugcuuuggaucuagauuaaauguucaagacagucagcaaacaacaugcacaaaggcauuuuucuggaauuucagucuuggaucgauuuaaaugcucagggucugaaaaaaugucuccuagcaucaaaaacuuggauugcuuuucuccgauguuaugccacuguaaaguagcaugcuccaacagcacaauauccuuaauguuuggauguaagguggguuugaauaauacuuccuuaaaaagcuugguuuuaaaauccaauaguauuucagcaaagaaauguaauuuagguuagaugguuugauugacuuuaauucauguaauagauuccuguccuuugugugucugacaugaguaaagaauuggucugugcacaguuaagauauaguagaaaaggaucugauuuuuaugaaagcugcauguaaaaugucauuuuccauuaaugaggauuaauuauugacuugguuuuuauguguugcuacuguggagaauuaaguguacaggaaacaccauugauacgcaggacuggagaugguuucugacaucacuuugauggaagaaacugcuuguggcaguuuuaauauuuaaacuaaugccauagacuuugauuuugauacuaaauuguguugcuauuuagauuguauagaggaaagaaagcuuuugaacaaaauaaacaccaaaagaaccaugacuuuacuacucauuuccuauaaaugaaacugguuaauuuaguaauguguucuauauaaauaaaaugaauguaguuugccuuaaagaugguuauucuuauauaaaauauuagauggaacaaagagcgggugcauuuuuaccugauuucugcaaucaaaaacaacauaugcugaggcagguagaucaugaggucaggagaucgagaccguccugguuaacacggugaaaccccgucucuacuaaaaaguacaaaaaaauuagcugggugcgguggcgggugccuguagucccagcuacuuggggggcugaggcaggagaauggcgugaacccaggaggcggagcuugcagugagccaagaucgcgccacugcacuccggccugggccacagagcgagacuccaucucaacaacagcaacaauaaaaacaacaugugguuuaaagcuauuuguaggaagagagcccucuaacguaguauuugggggaauaauuacuuauuuugagguauuguuuugaaucgaacuuuuuuuucuuuuuaguuuuuguaugacugaaacuuuucaauugcugaugugaagaggucucaaauugcuagcugauuaaauuaggcugaaagguuguuaaagaauauauugcuuuucuggucacccaagcauuuuucccucuuuacauuaaguucuuuguuuugucagagaauucuuauuuuccuacugagauuucagaaauuuucugaaauaggaaauggaaaugauugcacaagaaaaaguaugcugcugauagaaacagauuuuuaacaaauuuaacauucguauugguuguuaaacuaugagccaguaaaaaauucauaugcauuguuuaaauagcuaaggcuacauuuuuuuccccuagguguuaagccuguuuuuucaugugguauguacaacagaguguuuuaggaaaaggauuuuaaauuuuuuaaggaauauuuuuauaaagcuaaucacuguaaaaaauguuccuccuuauauguagguaaauuaaacaucuuauguauauaagauguuucaaaauacuauuauuauaaaagguuuuaagaaguaacauggcauugcucaugacuagucugauagucuugguggacuuuaaaguccuccccuauccuccacuccuuuaaaccacuuuggaugcuguuaaauucauugcacagcaccacuugagguucuugguugcccucuggugggaaaaugaagaaaauauuguauugaaaaugucacauaacuugguaauuaaagauaguuaaaagggcaucuaaguuauauguuuacaauuuaggaaaucauuagauacuuuaauuuaggaaauaaaaagaaguggguuauuuuggggcuuaaccauuuguggauagaguuuuuaaaaauuguuuuccaaaauguuugaauuuuauggcagguaguacugacaagagacguguagaaauauaguuucuaagacuacagcauccuagucacauuuuucauuaguguauuuugauagaugcaaaauuuauuaaggcuuuguggugaaacugacaaguaaauuaauuaaaaauuuuaauaugugauuaaagaagaauacacauugggaauuauaccagaauuaucccacaacuucuaguuaaaacauuucagaaauggcuugagacaauaaggguaaacacaucuuucuuuccaguguauaaacuaauaccaguauugccugugcaaaaaguuuauuuucuaacaguacuucuaaugucaauuaauaacuguuuacuuccuuaauuuguauguaaacaacaaguaaucuuacuauguaaauuccaaaucacauuuaaaacuaagcugaauauuuucauuuauggcaaugagcuuuugaaaaggaauaaaaacaccaccuuguuuguuggaaauuaaguaucuuuaaaaagucaguuuucuaugggacuagaguuuaccucuuaaccauucuguucuuuaugagacauuuauccaagaagguuacaguaauagauuaucaugaagaagcaauauguuuacuauagaaucuuggaaguccccaugugugucagagugagagugugcaugcguguguauaauuggagcaguaucagcaaaacaugaguuaauuucuggugucagucucuguggaaagaagccuguuuaaucucucaugucucgcguuagaacucagagaaaggaccuuugggaaugugaggagaaugcagaggacauucaaguucuuaauguagagacuaugaagcuguuuaggaggcaguucuuuagggguggaugugaacagaaauuagcaaaaucauagugccucugaagguaugccaacucuguaguguagaauuagcuauuucaaaauaguaggcacagugaggccggagccuaaggucccuaggaggaaaugagguaugugacgaucagaaacuuauauuuugugaagcuaguuaaaguuguuuguuuuuuuguaguaucaagcucuugaaaguucuugccuuuacuaacugcccuaagagaagccgucagaaugcuuuuuguaauaaagcauuaaaguauguuuggugacagcaguaauugaagugagagaaucccagagggaaggcagaacacccaguauaaagucaggaguguuuuuuugggugucuucucucugcagggaaauaguguaagguguuaaagccuuggcgauucuauuuuauuggaaaagguacuguucccacuuagcuguguuucuuggccagggauacaaguagcuucagggacuuguucguaucuccuugcuauguugcuucauauucuuaaugauuuguuuuuugcuguuaagagauaauuggguggaaaacgagaagaccuaucuuacaauuacaucauuuuccccacuacccaccccacuucucccugggugaaauaugcuuaagauauuugcaaauaauaaauacuaaacuaacaaugacuuuaaacaaauggaccccuauuuuuuccucauuauagucagcuuggaaauaugcagcugcuacagcuguggacaucuuuuuucuugggcuuugcuucauugaaagaugucuguugcagcucuagucauaaagacggggaaaggguggaaaggggaaaggagugugguuuaugaagcuaguagaugucugcguauauuucauugauuaaaacugugucacacggacucuccuaguaguaagggagaguuggaaaccuaacugcagucagcuguucguauccaugguucugcaucuguggauucaaccgacuguggaucagaauucgggggaaaaauuguguuuguacugaacguauacagacauuuuuucuugucauuuuucccugagcaauacauuauaacaacuauuuacauagcauuaacauuguacuaggcaauguaaguacucuagagaugauuuaaaguauaugggaggauguacauagguuaugugcaaauacuacauacaccacuuuauaucaggggacuugaguaucuucagauuuuggucucuuugggagguccuggaacgugucccccacagauaccaaaggaugacuguacaguauuuagcuuuuauagccucuauauuaaacaaaagcagggaaaacagauuguaguguugggcaaagcaaucuacagugucugaccuaaugcauacaggcaguauuuuuacugaagucggauuaauuuuagaacuugucaaguaaugugucuguuuagcugagauaaagcagaaaagugcaacugaggcucucucuucacacaucuaguugguaaaaugucuacauaaagguugaaacauagcuuuauugaguguuugcuuccuguuauguuucuuuuuuuuuuuuccuuuucuuuuugagauggagucucacucugucacccaggcuggagugcaguggugcagccucggcucgguucacugcaaccuccaccucccggauucaagugauuuucccacgucagccucccgaguagcugggauuacaggcgcccgccaccacacucggcucauuuuuuguauguuuaguagagaugggguuucaaucaaguuggccaggcuggucucgaacuccugaccucaggugauccacccgccuuguucucucaaagugcugggauuacaggcgugagccaccacgcccggucccuguuauguuucuuuauccuucucacuucuuuguuccagccuucagaagcaaaaguaaauauugcaaaagagcuaccauuacacucaaguaaaaggaguaugccccuuugcuuuuaggguaugguaugugguauguaagguuuccuugaaacaguucacugagcacuaauagguaacuuaagauauucuuauuuaagaauacuguuucaaaaagauuucaaauugaaaaauacuguguaauaaauaaugaucaauagcaguuugcuuguuagaauuggauuagaauaauuuuuaacaguaauuaagguuaaaugccuuuugauauuaaaagcacagcccuccucuaguaucuuccuucuucuaagaugaaauguacuuucucauuucugugcuaccaaaccuuuacauugagccaguaucuuuaggguacuguucuauuuuaaagucccuuuuuauugacuucaugguuucuccaaaggaaaaacaguauucuucagugacuaugggacucuagcuaguuccucagucuuucaggaugguguauuaaacuccuuucuuuuucugcuggauaggugggguacaaagaaaaaaguccaaaaacuccuuucuuaaacugaaugaauuaaauaauuuuuucauauauugggaaauaguuucuauuagcauuugcugauagcaguggccccauaauaugucugcagcuagaaauaguugauuauuguucuccuauauccauuuagaacuacacugugauauauauuauuagccuuuucuuugaaaaucuaguacauuacauuuuggaauguaauuuuucuuccuuuaagaauguacuuauuuuugaaauuuucuuuuucacacuuuauauacuuauaaaauuuucuuuuuauaaauggaaagucguacguuuuaaaagaacauuuuauuuuaaaacaaauaccacuugguuuaaauauauaacauugaagcagugaaaucauuucaggaaguuaaaauaggguaugugucuuucuaauuuuuaugaagaaaauuauugauuaauuuauucauugauucauucucucaguaauuaagcaccugugcacuagguauauagcaguaaacaaaggaaaucugcccguaaggcauuuauguacuaaucauguuaccuaguguaacuuuucucuuauuaauuuagaaauucugucaguggagacgauggaauaaaacuuuuuagaguauuaaauucuacaguguacauaguaauguuuuuuaaagcucuguauuaguuggcuagggcugccauaacaaaaacugcagauuuauugguuggcuuagacagcaaauuuaauuucucaguguucuggaggcugaaaguccaagcucaaagugccggcgagauuucccaaggccuuuccucugugcauggugagauuuccccugaggccuuuccccucagcuugcagauggccaccuucuuacugccucuucacguggccuuuccuccgugcaugcauauccccgcugugucucucaguguguccaaauuuccuucuuuuguaaggaaaccagucagauuggacuaccacacccuaauggccacaucuuaaucaccuuuuugaaguccuugucuucgaauaaagauacauucugagguacuagaaguuaggacuucaguaugugaauuuugguggggagggcgggggacauaauucagccagggcuuauuaguaaagggagagccagggcuuuaaguugacaagcaugugaaagagguuuugaaucuaggcuuugaugauauaucacauuuuuguaaaacauuuuauuuauaaaguucacugagcauucguaaauuagguuugaacaaauccuaucaucaagggagauugccaagugaauaaguaaaggugaugugguuuaagaauauucaauguuuaaauuacuugaauuuucagauuaagaaagucauuguagccucugcuucucaauuuggccacccuaugccuauuugcuacuaccaaagaagaaacaucuugagcauguguuugagaauagaggauagguaagaggacagugaacguuuugguaaucugaguuuuaauuucuuuuuuuuuucuucuuuuuuuuugaguccaagugucacucuugucgcccaggcuggagugcaguggcgcaucucggcccaccgcaaccucugccuccuggguucaagcgauucuccugccucagccuuccggaguagcugggauuacagucaugcaccaccaugccuggcuaauuuuguauuuuuacuagagacggguuucuccauguuggucaggcuggacuugaauucccgaccucaggugauccgcccgccucggcuucccaaagugcugggcuuacaggcgugagccaucgcacccggccgaguuuuaauuucaaaaugcaucuguguguguuugaugacuaccuguguuugaauuaauauaggucuaagguauguuguguuaagugggcuuuuuauggguuggcuuuaggaaccuagucauaauuuacauuguuauuuuaaauuguuccaaacaagcaaaaauuacugauuuuuugaauauagccuauccaucaauagggaacggucucuguaaaaacaucucagacagcaggagaaguuauaguuccugauugcuuauuagucuugcagaaguagaaaauaauaacuuguuugauaguacguuuuaaggaaugaagcaguugacuguguuuuccuggacuuacgguccaagaguggguuuguucugacaguauagcuguguuuuuuaagaaaaugagucuauuuuaagcugucuuuggcacuugcuggagauaaaguacauaaaaaagaaaccuucccuugaaguucauagccauuaagagaugugauaagcaaaccacugggaacuccuggcagaagccuuuuuuuaggcuuccucauugguuuuagagaaaagagcaauccauauuugacauauuucacaaauuugaaauguaaauuaugaugauuauaaauuucaucaugcucuuuucaucguuuuuguaaguguuggauauuugcuauacagacugccucgaacacuucucuuagcugacaguuacuuaacccacaguaucuagaagauuguucaucauucuuugucacuuuuuaucuuacauugcuguucuuuuuauuuuuaaauaauugaaguuguuuguaaauaacagaagaauaaaggaguaaugaaaaaucuuuguuagaaauuuuaauuagaaucuaaacauagcaaacccaauuuuuaaaaucagcauuacugggauauaauucacauauaauaaacuacacauauuaaaaaaguacagcgucuuuaaguguugacaucuguguacaccugugaaaccaucacuauaaucaagaugguaaauguauccaucacuugaaaaaauuuuccaaagcugcuuuucagucccucccuccuguccuucccuguucucuucucucccagacaacuacugguuugauuuuugucauuauagauuaguuugcauuucuagaguuuuauauaaauggagccauaaaauauguucuauuuuuaagucuggcuccuuucaaauuauuuugagauucaucuguguccuugccuguaucaguauuuccuuccuuuuaauuguugaguauuauuccauuguauguuuauaacacauuuguuugugaagauguuuguacccaaaaugugugguauucuuugaauguaaauaaccacucaucagcugcccuacaugaacaugaaauauauauccauuuuguacauacugauuccaaauuuuaauagguuuuguuuuuucacuugaaaucaaaacauaguuuacaaacuucgaugguucauaaucuugaaguagggaggacauucauuguucuugauccauaauuggaaagcauuucauuuucugauuaaucaacaccaauuagaaugaucaguccauuuaauucuuuauuuuuguaucaucuguuuccuuucauccaccuuuguguacuuaucuaccuucaacaguugucagcuuacggacaaauuaugguguaucacuauaaaaaacgagagcauacucucacauauacucuuaggauacugggaugguccaaguucuugucacaaaaaauugcaugauuaaguccuguuuaaugacuaaguggaugaaaaugcuacauuuccuuuaaaccuaaguuguucacucaucuauucuugaauuugagaaaauucauuuagaauauugucaugugaagacuugucuccgauguuacuucuacaauuaaauucgccauugucauuaaucuacaguguugcuaucuuuauuuucauucauauuuugaucagcuaguaguuguaaaauaucucucugucaguuuucuucucuuugccauuaauggugguguucacaaaaaaguuaacauaaccuaaacugcucucuuugaaaaggccagcuuguaagguuggcuguugacuagugucuggaaacuuagauuucagaaggauuccuaccacuagcugaucaagucgcuuacugugccuaaacuguuuauacaaaauacuauuucugccgaauaccuccuucugggagucugaaauuuugucaugugcuaggugccuaugugaccagcccacagugaaaacccuggguccugagucucuaacagucuuucaugguagacagcauuucacauguauugucacaacuuguuggugggugaauucaggaaaucuuaugugacuccauugggagaggauucuggaaaguagcucccaguuucccccagacugccccaugugccuuuuuucuuugcugauuuuugcuuuguagccuuucgucguaauaaaucauaucugugaauaugacucacucucauaaguccugccagcaaaucauugaaucugggaauaaucuugggaaucuuucaacgcaggccaaaaguuaaaauuuuugaauucuuaacuguguucagcaaaagcuuaaguaaaaaaaaggagagacuuaccaaguuggugucugaaggaugauggaauagugaugauuuauuuccagauagaaugaauuuuauucauauguaaaaaaguaaauuuucucuuuguuauaugaaauaucuuaagaaagaguaacaauauuggaaaagcaaucuuuaaaauauuuagaauugcuuuuaauuaccacccucugccccauaaaaacuagaauuggguucagugaacccuagugguauacaaaaguuugacagaguaugguuucuuggucauuugcauggcauuuaaaauuugccuuuauucaauauugaguagauacaaacuaauagguauaaaauauauguagguauaaagaauugcuacauaauauuaaaaauaauaaaagaguaauaccuguuuccuuagaaguccccuguuugcucuccucagauucuuugucauuccuucccaacucaguaauaauucugaauucuauauuugguauuccuugcuuuuuuaaaaaacaauuccugaacaauaaauuguugauuuuguauauuuuugaaccacuggguaauguugaauauaguuguuagagauuuuauggcuuguggcuuuuugguucagcacauuaggauauguucauuuuuuauuuuucuuuucuuuuuuucuuucguaacucuguuaacugaccguuauguuaucuucugaugaauagaaucaguugguaauuuuaaugucaaauuaccaguguuuucuguuuagguuuacacauuucuugucuuguuuugacuauccuuacauacuagaagucauaaucuccuauguaguauugucuucuaaaaguuuuauauuaaaucuuuucacauugagaucucaaaucugccugaaauuuuuguuuugguaugauacaggagucacauuucauuuuuucuaauggauacucaauuaucccagucacauuuauugacaaauucuucccauuuuccccaugauauauaauguccuucauucccacaugugagucuguuucugaacuauuacuuauguuccagucaucagccugucuaacccugugccauuacgcauuaucuuaauuacuaaagcuuuagaauaauaccaguuuuaauuguauuuguauacaaauaguaauaucauuuguaaauaacaaguuucgcugcuaucacacaaaaauaaaauuccugagucaaagguuauauguauuuaauauuuugauaguguuaaauugcuggcaaaaaguuacuuucauuuauguuuuuaccuguauuagaguuucuguuuucccacaccuucaucaaaacuagguauuauugggcauuugugguuuuguggguaugcccagauaaaagugauagaucauuguuuuaaugugcauuucuucuugagugggaggaugaacaucuuuucauuguuuauugaguauuuguaauucuuuauacaaugaacugccagucugugugucuugcucauuuuucuuuuucguuuuuuaaaaauugauuuguaagacuuuauuauaaauuucaaaacuggcccuuuuguaauguacuugagcucucccuccuccuaccccuccccccaaacuaguuggcauuuucuuuuuaaguuggugacacaaaaguuuuaaauuuuauguauucaaauuuauuagucuuuuuuguuuccgaguaucauuucuuuuuuuuugagacagagucucgcucugucgcccaggcuagagugcaguggcgcugucucggcucacuacaagcuccgccuccuggguucacgccauucuccugccucagccucccgaguagcugggacuacaggcgcccaccaccacgcccggcuacuuuuuguguuuuuaguagagacgggguuucaccguguuagcgaggcuggucucaaucuccugaccucaugauccucccaccucggccucccaaagccaccgcgccuggcccugaauaucauuucuuacuuagacuucaccauuccaacgguaggaacaaguuuauucauauuuuguuuaaguguuugggucaguucuuuauauuuaggucugugaucuaauagguauuuuuuuuuaaguuaugccauaagaauccuuauauuuuuccccaaauggccauuuaccaaauacuguuuauucaauaauccaucauuccccuacugauuuaaaauauuauucuuaucacagcuauuacauuugcauauucauuugguuguauuguagacucaguggucuguucaacacuuuguuucucuuuguuugugcugcuaucaaacuuuuaauuauugagaccuucuacugcuucucugugagagaacuggauagagccaguugccucucaugacuuuuaauucagaauuuucuucucauaugccaguuuuuucagauuauaauuacuaguacccugccacauacucugacucacccaaauaaaacuguauugauauuuugauugcaaaaacauuauuauagauuauuuucuuggaaaauucaaacuuaaaauaaugagccuuuauccaagaauaacuaaguaguguugcuuuauucacuucaguagcauuuugaaguuuucuucauagagauuggcccuuuacauuuaauucaaguucucauuuuuguuguuguugaugcuuuuggaaaugggauguuuucuaacagauuuacaaauauguacuauuuuguuuaaucauuuuuacggaaguauaauuuacauucauugagcugugucuguguaaagcguacaguuugauuaguuuugacagcugcagaccccugugaaaccauuuccauaguugagauacagaguauuuuccucacuccaaaaagauugugcuccuugguauucauucagcccuccacuccccaccagguaccacuaaucugccuuucucacgauaaauuauuuuacauuuucaaacauuuuauauaaauggauucauacaguaagacucuuuagugucuuuuuaaaaaaaagcuccuaauaaugcuuuugagauucauugagguuguuugugucagcaguuuucuucuuauugaagagguguauucuggugucuggauauaaaacacuuuguuuauuccuaucuguugauggacauuuagauuguuaacagcuuuuggcuauuuugaaugaagguguuagggaucuucauguacaaguuuuuguguggacauauauuuuuauuucucuuugauaacugucuugagguuguuuucauauccuagguauaagaaugguuauuuucacauuugggcaguugaugagagucccagucgcuccacauuuucaccaaugcuugucuuugucucuucuuucuccccaaauuuggccauuuuagcggauaugcagugauuuaguggguauuguggcuuuauuugcauuucuuugauaacuugugauguugaguaucauuucaugcuuuacaugaguaaaucuucuuuuguuaaguguuuuggguugaauucugucucucacaaaaaaagauauguuggaguccuagccccuaauaucucagaauaugaccuuauuuggagauaaggucuuuacagagauagucaaauuaaaaugagauuauugggaugggcuauuccaguauaacuggugugcuuauaaaaaggaagaauuuggucaaagagacaugacacggcaagaaugccaugugaagaugaaggcagagaucagagugaugcaucuguaagccaaggagugcggaagacugccagcaagccgcuggaagucaggaagagaggcacggaacagauucuuccucacagcccuuagaagaaacuaacucugccuguagucuuguaaauuccuuaggguuuucagugcgaacagucaugucauuugcaaauagagacaguuuuacuuaaucuuuacuggcuguuacacuuuuacuuucuuuugccugccuuccagccacaauuagggccuccagcauaauguugaaaacaagugaggcaaguaagcauccuuuccuccaucuuaauguugaacauaucaccauugugugcauuagcgguaggguuuuuuguuuguuuuuuaaaacuuuuagguucagggguacacgugaagcuuuguuacauaggugaacagauuauuacaucacccaaguauuaagcccaguacccaguaguuaccuuuucugcuccucucccuccucccacucuccacccucaaguagaucccagugucuguuguucucuuguguucaucaguucucaucguuuaguucccacuuauaagugagaacauucaguauuugguuuucuguuccuguguuaguuugcuaaggauaauagccucuagcaacauccaucuucccucaaaagacaugaucguguucuuuuucagggcugcaugguaucccaugguguauauguaccacauuuuuuuuagccagucugucauugauguccaugucuuugcuauugugaguagugcugcagugaacguuugugcacaugugucuuugugguagaaugauuuauauuccucuagguauauaaccaguaaugggauugcugggucaaaugguaguucugcuuuuagcucuucgaggaaucaccauacuacuuucuacaaugguugaacccauuuguacucccaacaacaguguauaaguauucccuuuucuccauaaccucaccagcaucuguuuuuuugacuuuuuaauaauaaccacucugacaggugggagaugguaucucauuguguguuugauuugcauuuauuuaguucuguuuaugugaugaaucacauuuauugauuggcguguauugaaccagccuugcaucccgggaugaagccuacuugauuguggcgguuuagcuuuuuaaugugcuacaggauucaguuuuuaaguauuuuguugaggauuuuugcaucaauguucaucaagauaugggccugaaguuuucuuuuuuuguugugucucugccagguuuugguaucaggaugaugcuggccucauagaaugaguuggagaggaguucagccucuuuaauuuuuuuggaauaguuucgguagaaaugguaccagcucuucuuugugcaucuguuagcuguaggguuuucauaaaugcccuuuaucagauuuagaucguuccucuggauuuuuaguuugcugagaguuuuaugaauugguauucaauuggaucacauauuuuauaugucuguugaaauaauuauauaauuuuucuccuucauucuguuaaauauagagaauuacauuaauuuauuuuuuagauguuaaacuaaccuugccuuguugaaauaaaucauauuuggucaugauguauuauccuuuacagcauccuuuucauauucaauuugcuguauuuuaaaaaggauucuugcauuuguguucaugaaggauauuugugucauuuucuuuuuucguaaugucuuugucagguuuugguauuaagguuaugcugaucucauaguugggagauguucacucuauuuauugaaagaauuauguaaaauugauauuguuucuuucuuaaaugcuugguagaauuuaguguauuugggccuggaguuuucucagugggaagaauuuugguaacagauugaauucuuuaauauauauuaaagaaaauauauuucuuauaaagacuuauauauauauauauaaauuugagaggccacucacauuuacuguuuuauauugugucagaauauggugugugguaagauguguuuuuuggggaauuucuugauuucaucuaaccuauuggauuaguuugccuaaaguuuuuuauaauuaucuuuuauuaucuuuauaagaucuauagguuuuuucagugauaaccucucuugcauuuuuuauuauugguaauuauauucucucuuuccuugaucugucuagaauaggguuuaucuguuuuuaugauuauuuggcuuuguuaauauacucaauucuuuguuuucuguuucauugauuucugccuuuuauuauuuccuuccuucucuuccccucagguuuacuuuacuuagucuuuuuuuuuuuuuauagcuucucaagguggauccuuaggucagugauuuuaaacuuucauuuuuaauguaagcaguuaaagcuacagauuuccuuuuaaguacuuguaaaguuuguuaauaguucagaacccucagguucaguaauuuacuggaaggacucacagaacucacugaaagcuauuauacucacaguuaugguuuauuacuugaaaggauacagauuaaaaucagccaugggagagauaaaaguccagaaaauuuccaaaugaggaguuuccauuugucuucucuggagucauggaugauguuaacccuucugguaacaaugugugacaauaagcacugaguauuccaaccagggaaauucaaucaggacauuccaaggguuuggagggagcuaaaagcaagguuaaauucuuuacuacauaguccuauuuagcuucauuauuacuccauucugaauuguuucugauuuccuucuugaguucuuugaaccaugagauuuuuagaaguguguuguuuaauguucaaauauuaggaauuuuacuagauaccuuguuucucaguuaauuccauugugguuagagaauggauugguugugauuucaauccuuuuaaauuugugacuuguuuuguggccuagcauauggucuguauuggcaaauguaccauauucacagaaggugauguauuuucuucaguuguuaaguguuguuuaucauaaauguuaauuaggucaagacaguugauacuuuguucaauuugucuuauauuuguauaguucuaucaguugcuaaucaaggaguuuaaaucucuuacuaaaauuguagaauugucuguuucucccuuuaguuucuguugguuuugcuuauguauuuuaaggcccuguuauuaaguacacacauuuaugguucuuauaacuuccuggugaauuaaauuuuuagcauuuugaaaucucuuuuucuuuagauaaauacucugucuugaagucuguuuuaucauauguuaauauaggcacuuuagcuuucuuaugcuuacaguuuauauaccuuuucuuuucauucauaugcuuucacucugccuuuuuuuacgaaguauaucucucgcuuugcaugaaguaagauucaugcucagauucucaacaucauuuagugguggcccaagucauauuuguuuuaauuugccuuuuaaauaugagaaaucugauuuuuacuaauuauuaauuaaaaucaguuaacauacuaaauuacuucuaguaauuuuuuuaguggauuugcuuggauuuucuagcuguguaccaguaucuccuguaaugauuguuuuaucaacucauuaaaauuuuuuucauucuaaagguaauuuugugaaugaauaauacauucacauggcuugaaauuuaaaagcuguaugaagaugaaaaggucucccucuugccucuuucccccagggguaaaucuccucucgucaagcaacuaaaguuaucuguuuccuaugcauccugguuucuccguauauaagcaaauauguguauuuucucuuccucuuacuauccccccaacuacccccaccccgccacacacacaggaguguagucuauacuauucuggacuuguuuucaccacuuaacauuauauucuggaguuuuuucuauuuccauaccugaagaccuuucucaucauuuuaugacuugugauauucucuuauuugaauaagaaugauuuauuugacaaguucauuguuacuggauauagugauggauguuuuuaauuauuuguuuuacaaacaauacuacaauaaauaacugccuacacacuucgauuguaaacauggcaauauuucuauaggauaaauuccuaaaaguagaauuaucaggucagagguucuauguauucauaauuuugauagaaguugugaaauuguccuuuuauagagguaguaccaguguacacuccacagauucguaugaaagugccuguuuuuccuauguccucaucaguauauaguauguuaucaaacuuggauauuugacaaucugauaaugugagaaguaguauaucagcguagcuuuaauuuacauuuauccucuugggaguaguagauaaacauauuuuuguauauguaagaauuacuugauuuuuuuuuuucucuaaauuguuugcuuguucuuguuccaugcauuagagagagggcuggaggguuuuguaucuuuuucuuagggacuaagaaguuuuuaaauguguuugugaaauuaguccuuuggauuuaaguuacaauuuuuuuucguauuuuuuaacguuuugacuucuagucaaauuuaucagucuuuuuuuaauggcuucucaguauuauguuacagcuauauaggucuuuguuauaguuauaaaagaauuucucuagaagaaucuuguguuauagucucauuuaaaaaaaucuucaggauauuuuuguuguagcuacccauuuucccccuugcuauuuauugaauaaucuuuuaaccaaugauauugguugaagauauaaacuuuauuaaaaauaguaccaaauuucuauuuauaugccgauuuucaucuuuguuucacuaaucuuucuguucuuguaccaguaauaccauauauuaaucaagguuuuauaauagauuuuaaaauuuguugaagauugugcacacuuacuccuuaucuauagacuuucuuuuuuucuugcugguuuuuuacaagaauuucaguuaccucuucuaauuccugcauaaauauuugaauaaaugaauaaauuuucuguuggccuuuuuauugggauuauguuaaagauaaaaguauagauaaacuuaggaaggagaugauaucuuugacuugauucuuucugccaagaacguggucugucuucuuuucauuugguaaagccggacauuuggauacuuugguuuuauuccugggcauuuuaucuuuuuuguuucuauuucagauauggccuucuauuuccuuguaccaucuaauugcuuauuauuaguuuaaaucagagauuuaacuuugcguaaaguuuguguaacuuugcguaaagagcagacuuugcgugaaggacaaacuuugcguaaagagcaaagagcaaacuuugcguaaaggaccagauagugaauauuuuagccucugugggccgucugcuucccagcuccgccaccgcaucacagaggcagcuagaaagcagccauacaucauacauggaaaugagaaugaguguggcuguguuccacuacaacuucauuacaaaaacagguggcagguccuacuugaaagcaguccaacagaauuuccagcauacuuaguuaaaugaaagcaaucgauaucuauauauucauuuucuaccuggauaccuaacugaaaucuuuuauuguuuauuguugguauaucguucuuuauuuuuauuuauuuauuuauuaauuuuuuacauuucucuuggauuuucuggauuuaccaucaggugaucuguaaauugugguaauuuuauccuuguccuucuaauuuuuuuaucucauaguuuuuuuucuuguaucuccugaaaaguguuagcaguaguuauaaugauaugcuuauuucugacuuuaaugcaaaugauguguuuccccauuaaucagauuaaugguugacuuuuuggugaauagaaagauacuauaaaucaaggcucaugccuguaauccuaacacuuugggaggcugaggcagguguaucgcuuugagcucaggaguuccagaccagccugcgcaauguggugaaacccugucuccacaaaaaauacaaaaauuagcugggcaugguggcuugugccuguggucccagcuacuugggaggcugaggcuggaggauuucuugagccugggaaggggagguugcagugagccgagaucacgccacugcacuccagccuugguaacagagugagauccugucucaaaagaaaaagaaaauaucuuacauaauuaagaguuauuuuuaaaaucaagaguauauacugauuuuuuuaaaugccaucuuagaagaauccguagaaaucauuugacccuuuacgucauggauuucuuuguuuacuuuucaggagcauacuguaauagucagaauaaugcccucccugccuacccuucugccccccucaaagaugucugugcccuauagauagccccuugaaccugugaauacauggcaaaaggaaauuaacgucacaaauggaaauaagguuuuuaauaaacugauuuuaagauagggagauuauccuaaauuauuuggguggacccaaaguuuccuuggaagaaggaauuggaaaacagaauccgagagaugacagcaugagaaggacuuggccugacauugguggcuuugaagauggaggaagugggcccccugccaagcaauguauauagacaguccccagaaacuggaaaaggcaagaaaagagauucuucuguagagccuccucagacacauuuuggacuucucaacuacagaacuacaaaaauguggguuguuuuaagccacuauguuugguaacuuacuauagcugccauagaaaaguuuuguucucaguuuuagugaguauauuucaccauuaauuguaaugucgguuuuaguuugguuuauaguaggaagcuguccaguuguacuguuuuacuccaagaggugauagugguuguuuuucaucauaauggauguguuuguugaguauuugguauucauuaauuuuuuuuccuucugacuuguuaaugaggucaguuacaugaaaugcuuuuuugauauuuaccuauucugacauuuuuggaauguauucuacuuggguuguaauauuuugauguucugagcucuuuugcuaauguuuuguuuuggaacuuuguauuuacauucauaagugagauugguuucuaguuuuuuugucauuucugaggaauuuuuuuuuagaauguuguccuuucucaugauuauuguuucagggcuuuaucucauucagucauggccaguuuuggaaauuuauaucuuccuauaaaaucauaacaacacaauuuuguucguauuguauuuugcuucccccuuccucccacgcccuuucccuaauccaggcuuuacuucugggggaaggaguaagucccaguauugguaagguauaccauuuuucacauguauagcuuuaucauaugaagguugaacacauuuuuauuuuuuauuuuuugguauguucaagaugguuugguauguggaaauccuaucuugguauaugacauuuccuuccuuaaaaagcuugaauuaguaauucuguucuucuuggcccuuaaccuuuuggcgauugcugucagugguuucggggauuuuuaaugcuuuuuuuauuccaagcaagugaaugaauagucaucuuccuguauccacaggggauuggguucaggauaccaaaaucaguggaugcugaugcccaagucauagaagacauaguauuugcauauaacccgugcacauccuccuguauuuuaaaucaucucugaauuacuuauaauaccuaauucuauguaaaugcuacguaaauaguuguuacacugcauuguucuuuauuuguauuauuuuuguuguauuuuuuuccccaaauguuuuccaucugcagguguuugaaucuguagauauggaacucacagauauggagagcugacuaguugggagaaauuguuuaaccacaggcaauaguuuaauuguaccuaaaaucuucauuccagcucccaguuaauguauauaauagcuaauuuuauuaacacacugauggaugagggaaaaucauucuguaguuccuaucacaaaguagcagguguuuuacaaagagcauaguuaaccccauuugaaaacaguuugucuggauguggcucuaaguugguccuguagcagcuuuugucguguucaggaaaacaagcaaucuaauaucaauuguuauaggauucuucuguuucuauuccugcagcuucauauuaaaccguugucaagaacaaaaagaauaguguuucguaugcauuucuguauugugguuagcucauuugaaauguacaaguagaaaaaugaagucaguguaauguggaaaucacacugauucacauaauuuuuccuauacaugggagcagacugagcagugggaauaagauuauaaucuuuagcuggagaacagaaaagcucuuggcucuugagcuaccuguugugagcaagguguucuuuguacucuauuuaaguaaguuaaagacaagcaccuacaccggggccuucugccacagagagauucauuccuaacccaguaugacucuuugcauaggauagauuucauugucuuccuuacccuaaaaguaucuguguuguuugggcccccaccagcccuauuuuaauuauaguguugucaguuugugcacuuuuacugcuugcuguggcucuugccugcccgagcaauacaauuuaaugacugcucuuuuucccugacagaggccauuuauuuuaaccuugaaaccaagaauauaguuuugcucuugaaaggauaauuuuuuagugguuaaagauugcaaaagugaaagugaggauuuuggagaagaaauguaguaaaugucuguggcuuuaaauuaauguauuuuauugaucuuaaaauguacuuuccucuacuuuuaaccugucucaaauuuggaauuauuugcaauugauguacuucacaauuuauuuggcagugguuuuuuuuucuuuuuuggggguaaauauaauuacuggggcaucuuauaauugaugauguguacuggauucaugagauacaauauuugcuauuagauaaauuuuagaauuuaaaauauccuacuuuugacuuucagaaaaccuaguuuucgaauggagauacuguaauauuuugauuuuggaacuguuuuugaaaguucaugacacagacuaugacacaguuuucuaaguauuuuacgagauggagauuuuacaaauuuuacuuacuuuauuuugagacagggucucacucuguugccuaggcuggagggcaguggugugaucauggcucacugcagccucaaccucccgggcucaagcaguucuccuacccucggccuccccaguagcugaaacuguaggcacacaucaccacauccagcuaauuuuuaaaauuuuuuguagaggcagagucucaaaaaugguccugaacuccugggcucaccugaucuucuuuccucagccuuccaaagugcuggggauuacaggcaugagcuccugucccaggccuaaaauuaacauuucuguacacaaaauacacauuuucccuuccacuucacugucacuguuaagacaaaucuaacagugguuagacugcaucguucucugacacggacagcauuccuccuuacccugcagacuuauuuaaaguaauuuucccagaucccuuugagaaaaugguuaaaguugugaacacuucuucagaaauaaugcucacaucuccuuacaauucuuuuacaguuuucugguuugcacuuuuaggcaauuacacuucuuguuuuuguuuuguuuuguuuuuagcauauugguuagaaacgcuagagaaguguugaguaagaugauacugccuugauugccacuuuaagaaugccuguuucaccauuaaauaugauugcugguagaugcuuuaaaaguuuauuuguauuucuguauugcuaagaguuuuucuucuccuaaaaucaggaauggguuuaaaauuuugagauucuuaggugguucuuagagcguucauugagaugaucaugguaaaauacaugaagacaugaaugucuuaaaauugagccauccuuauuguugggauacauuucacaucauaguguuggauucaguuugcuuuuuuuccuuccaaaacauuugaauucauauucaaaaugagcgucguuucuuguguuuucagguucuauaaucugguugagaaauuuggaaguuuuuugucuuccucaggaaugcagcaaucaguguuuccuugauagacuugaaaugcagauauaauacaguuacauuuauuguuaucacucguuuuguaauucuucucaucuuacauuuguuaugguuuucaugcauuuguuuuauuuguauauaaucgugggguacaagugcagguuugcuacauuaauaaacuguauuguggugaaaugagggcuuccagggcauccaucacuaaagcaaugcacgugguacccaccagacagccuccuaucauccaccccucccaccccuccaccccugcaagucugcauuguccaucauuccacacucugccuccauguguacacauuauuuagcuccugcuugcaagugagagcaugcaguauuugucuuucugugucugaguuauuucacugaagugcuuuggcuaagcuauuugggcucuuuuuugguuccauaugaacuuuaggauuuuuuuuucugcuucugugaaaaaugauauuaguauuuuauuguaguauuacauugaacuuccagauugcuuugggcaacguggucauuuuaacuauauucauucuucugauccaugagcauggguguuuuuccauuuguuugugucaucuacaauguauuucaucacuguuuuguaguuuuccuuguagagaucuuuuaccuccuugguugaauauauucguagguauuuuauuauuuuauuuuauuuuguaguuauuguaaaugggauugccuucuugauuggguguuuggccagaucauuauugguggauaggaacacuacugauuucuguacauugauuucguauccugaaacuuuacugaauucauuuaccaaaucugagaguuuuuuugguggagucuuuagaguuuguuuuuuguuuguuuguuuuuugagacggagucucacucugucgcccaggcuggagcgcaguggcgcgaucuuggcucacugcaagcuccgccucccggguucacaccauucuccugccucagccucccgaguagcugggacuacagacgccugccaccaugcccagcuaaauuuuuuguauuuuuaguagagacggguuuucacuguguuagccuggauggucucgaucuccugaccucgugauccucccgccucggccucccaaagugcugggauuagaggcgugagccacugcgcccggccgguggagucuuuagaguuuuuuagauaaaagaugaugucaucagcaaacaggaauaauuucacuucuuccucuuuucuaauuuggaugccuuuuguuuuuuccucuugccuaauugcugugacaagucuucugguaucgcguugaauaagaguggugaaaguggguauuccgguauuguuccaguucuuagagggaaugcuuuuaacuuuuccccauuaacuauaauguugacuguggguguguuauauauggucuuuuuuuuguugagauauguuucucaaagccuaguuugucauggacauuuuauuaugaagggaugcugaauuuuauugaauguuuuuucugagucuguugaggugagucuguugaaauaaggccuuugaccuuauuucuguuuaugugauguaucacauuuauugauuuguguauguugaacuauccuugccuccucaggauaaaucccacuggaucaugggguauuauauuuuugauggugcugucggguucgauuugcuaguauuuucuuuagguuuuuacaucuauguucauuagugguauuggccuauaguuuuauuauuuugcuguguccuuucugguuuugauaacaggguaauacuggccuccauuccucaacacauguuaauccucaucuguuucaagaauucauauuaagccucacugcuccuuuuauguuaauguguugcuguuuuucuuaaaaugaaguauauuggcuugcauggaacaauaugugguaccaaauauuucuuuuaaauuuacuacugaaauaauaaguauuugagggguagauagggagauauuugcacacuaauaauauuuguucaacugucugguauugauuuaagaaccuuguacuaaauauuuuauuaaauacuuaguuuuuggccuuaauuuuaguuauuuuggauuuucuaauagauucaggaaucugcaucauuuccauaaucagaaaauuguuucuaaagaaagauaucuggaaauuaucuaacaggaaugaaguaguaauuuagucacauuccuauauguaagucauaguagugaguaaaauaauauugcugauauuguuaaccaagauuaagggcaguguaaaguuuuaugucaaagguaguggccugaaaaacauaaaaaaggaugaggaaauguguuuagaauguucuuacuauaaucauuuaaaaauauguuuccuccuucaucccuaacccucaucacacuuuguaauucuuuuuaguauaaguguuagguaaguuagacuuggaccauccuuagggaggccuuaguuuucuacauucuacuuuauuggcaaacugguuuuauaugaaguuuucaguguuacaaaaaauuggaaauaggcugagauaaaccuuuagauaacaagaaauacagaugaauauugcuguguaauguaaugauggcccugaaagcuacuuggaaguacuuucucaaauaauaauuguaaugaacccaagguuucucuuuuuugaauaauuacagguugagcauccuuuauccaaagcacuugggaccagaagcguuucggauuuuggaauuuuucagauuuggggauauuugcauauacauaaugagauauguugggaugggaugaaauuuguuucauauacacauuauacacauagccugaaggacuuuauauacacuauuuuuaauaauuuugugcaugaaacagaguuuugacugcaacccaucacauaaggucagauguggaauuuuucacuugugauauauuggugcucaaaaaguuuugaaaauugaagcauuuuggauuuuggauuuucagauuagggaugcucaaccuauaauagagaauagacuuuaguuuugguaacuguauuuuuauaaaagguuuucuuaaagguacaaguauaagggaacucagaaacuuuaagagauucccauuggcuagagauaugucaauuucagcuucagaaaagauuuuuucaauagauuuuaucaccagcuauguauaauccaucaauuuaucaugauaauuuuuauaauaauuugaagguacucauauaguguaaaauuuacucuuuuaaaguauaugguuaugugcgcagaguugugcaccuaccaccacuaacuaauuucagaagguuuucaucaucccagaaagaaauuccauauccauuagcaucauuucucccucuugagugaaauugcugggucuuaagauacuucauguaaccuuuugaggaaccuucaaacuguuuuccagagggaauguaccauuuucauucccaucaguaauguaugagaguucccauuuuuccacauucuugaccgcaccuaucagucuuuuuuuuauuaugguccucauguuggaugugaaguaguaucucauuauggguuugauuugcauuuauguaaugauuaaugauauuaaacaucuuuccaugugcuuauuggcuguuuguauaucuucuuugggaaaauguuuaaaucuuuugcccauuuuuaaauugacucaucuucuuguugagcuauaagauguauucuggacaguagacccuuaugaaauauauuauuuguaauauuuuccuccucauuguuugguuugucuuuuuuuuuuuuuuuggagacugagucucgcugugucacccaggcuggaguacaguggccuggucucgacucacugcaaccuccacuucccggcuucaaacgauucucugccucagccucccaaguaguugggacuacaggugcccaccaccacacccggcuaauuuuuguauuuugaguagagacgggguuugacuauauuaguaaggcuagucucgaacuccugaccucgugaucugcccaccuuggccucccgaaaggcugggauuacaggcgugagccaccgcaccuggccccuuugggucaucuuuucgguuucuugauaguggcuuuugaugaacaaaaguauuuuuuuguuuguuuuguuuuguuuuguuuugaugaguccaauuuauguuuuuucuuugguugcugaugcuuuuaaugucauauccaagauacgauuuccuaauccuaaggucacaaagauuuacacuuauguuuucuaacuguaacucauauuuaaguuuugguuaauuuuguguuaauuuuugcaccuaguguaaggaaaggaucuaauuucauuguuuugcaugcaguugucccaauaucauuuguuaaaaaaaacuauucuuucucccuuggcacacacauguccaaaaucaauugacuguaaaugucaggaucuauuucuggacucuuuauucaauuccauugaucuauauaucuauauuuauuccaguaccauagucuugauuaauguagcuuuguaguaaguuucaaaaucaggaggugugagcccuguacuuuguuguucauuuucaagauuauuucuggcuauucuguguuccucgcaauuccguguggauauuaggaucagcuugucaguuucugugggggaaaagugccugauggaauuuugauagagauugcauugaaugcuguauagaaaccuaacugaucaccuuaggagauggcagggagccaauuuuucaaaucugucuugaaaacuaguaaauaagggcauuuuuccuguuucaccugugugaaccauaccaacagauaaccaaauaguaggugaaguaucucuuuauacauguauuccauugcauuaaugaaaaauaaauauagaauuaguuugucacaauuuuugcaaaucccagugaaugaauuaguuuaggcauugaauaucaagagcugcuaacuuuacaaaaagagagacagguauuauaugcuuucugauaaaauaacacaccaccaccuguagucuuaccaaaaggacugaacgugagauuaauuaaguuguugcguccagcuaccaauuuacaggaaauacggaagcaaaaggucugcauugaagggccccaugauuuugcagucauucuacuggaaccucuuuaggucaaaugccuugaguuuuuccauaauuauagggaauaaaaaaggaucaagagggaacuuauaaauuaaaagauacuuaaaagacauaguuuuaaaauuauuucuuucaagaaugaggcuuuuuuaaauuuuaauuccuuucacuucccuccaaauuacauacguacauucauaagcauggauacacacauacacauauauaaugauacauacauacaguguugcuuaaaaauguuuaaacagugcauuuauauaaaauuuuaaauauauuuauguacauacauaguuuuauguagaaaauacaugucauguguauauaaauaucuguagcuuugaaacauccuuuccucauucaauuaucuauguuuuuacuuuguccuauuagaagauguagauuuuuggucaguuuaacuucuguguagaauuuccuacgaugggugugccauauuucuuuagacauuuuguuaguugauugauaggcaguuuauugucaguuuuuuaaaauuccaaacuguagugaauauccuuauccauguaucucuucuaaaguauauccuaaguuguugaguaccuguagaguuucaaaagauggcaccacauuuccuuccuuauaucuacuccugagaguacuuagauuguguuuccacucaacugaguauguaaacuguguuagguuuucuauguuuauguuaacgucagccuugauuacaggauaaaguuagagaaccuuuuuuuauugguuuugaaacuaauugcagucaucugugaaaacauuauucuuauauccuaucgaauaagcuaauguugauguaagccagauugauguuuuccgugugauuguaccauuucacaaaaggauguuguuuaaaaagugcuacuggagguuguauaguaacuuucagcagucaagcccauaguuaccauucuuuuuuuuuuuuuuuuuuuuuuuuuggugugcauuuacaaacguacauuuuuccuccuaucuauacaagagauaacugauauuccuccuuaauacugucucucauuccuagaagugggauuacuggaucaaggagugaaaacauuuucaaggcuuuugaaacauacugccaaacugcccuccagaaaaaggccucuacugugaaugugaugauggaugcccauuucucugaaugcugaugcuguauuuuuuuuuucucucacuaaagaagcugagcguuuuuuccucuaaguuuacugacccauuuuuuucuacuuuuauuuuaaguucaggggguacauauguagguuuguuacauggguaaauuggugucacugaggcuuggcguaggaaugauccugucaccaagguaguaagcauaguaccaauagguagccauccaccccacacccccuucuaccuccccagucaagcaguccccaguguuuauuguucccaucugugugcucauguguguucaguguuuagcucccacuuacaagugggaacauaauaguauuuuguuuucuguuccuguguuaguucaguuagaauaauggccuccaguuguauccauguugccacagaggacaugauuuaauucuuuuuuauggcugcauaguauucugugguguauauguaccacauuuucuuuauccauuccaccauugguggguaucuugguugauuccauuucuuugcuauugugaaucgcucugcagugaacaugcaugugucuucuuggaauaauuacugaucaaucaauugauugacugguuuuuuucccaguagugggauugcuggguacugacccauuuguaugccuuuuuaaaaaaauaucacuuuauguucgcuuuuuuuuuuuuaaaucauugauaagagcaacuuaauaaaccuugguuucuuguugaaauucuuuuuuuauugugccuuguuuugugucuuuucuuuaugaguagguuuauucgagggugaugggaaagaauauuuuaucucagugugucuuuauuuaugccauaggccuucucagcuuggugugaggaagcuuuuuuuaaaauuaugguaauuuuuuagaaauagauugcauagaggugugugugugugagagagagagagagagauuauaguuaaaauaaaaaaugugauugucugcugaacuaauuuucagguagaaauuaaaauggcugacuuuuaaaaaauuuguguacaaguuaacggaguaagaaaaccagacuaaggugccuaacuuuggcuuuuccauugacuuuauuuaaauaauuuuaucuuagagauacaugauucaguuaacauuggguaagaaaugagcaaucaauauucagucuucucuugucaccuagcuuugaauuauuucuaauguuuaaauuaaauaauuuuauuauuggcauuauuuuuaaaguaaaauccuauuucucugagaucugauguauuaaaccauaaauauacuuuuuauauugcuaaauauugaguauuuggcuaguuaugaaaaccaugauuugaauuaaacucauguugcuuaucagggcuucuucauguuuauuuucuuuacagaaauacagguaucaggaugaagauacaccuccucaagagcauauuuccccacaaaucacaaaugaagugauagguccagaauugguucaugucucagagaagaacuuaucagagauugagaauguccauggauuuguuucucauucucauauuucaccaauaaagguaggauaguaucuauuuauuauuguuaugaauuacauauuacuuuuguuauacauauagcucaugcucggagagaaguauucuuucauguagguucgcccuaccccacccccccauuuuaguuucauaguuauggagaauuucaaggugcuuauuaguacuccagaaaacauuuuuaaauauguauuuuauaaaugaauguuagucagugaugcuaucuuuaagucuaaaaauucccacgauggaaauaacuauuaaauuucaaauaccacacacugaaauauuuucagacacuuguuuuuaaauauuaguugguauagaaacagugcauuuccagcacuuuggaaggcugagguggguggaucacuugaggucaagaguucaagacaggccuggccaacauggugaaaucccaucucuacugaaaauacaaaaaaauuaaccaggcaugaugacacaugccugcagucccagcuacucaggaggcugagacaggagaaucacuugagccugggaggcggaaguugcagugagccuagauuacgccacugcacuccagccugggcgacagcaauaacuccauuucaaaaaaaaaaaaaagagcauuaacaucaucuuuaaauuccaaauaugugacuuuucuugauccuaucaucucuccccucagaaguaacuauaauccugaguauauuuacccuuucuuauuaaaguucuaccauauauuucgauugcuaaucaauuguuuugcauauuuuggacuuuauauaaauggacucauacuguauauuuaacuugcacucuuuacucaguauuacauuccucacauugauaaauuucacugcuuuagaguuuucuauuuuaugaauauacuacaauuuauuuuacuuuugauggauauggauuuauuuucagguuauuacuaguguaaaaagugcuuguaaaaacacagguuauauauacaucuuuguggauaaagccagcuuguuucucaguagcugugucauuuccaguuucagcaggaacaucuaacaguuuuuaauugauccauguucucuucaaucgguauucuuauuuuuggcauuguuuugguuucaaaaugguaucugagugugauuuuaaugggaauuuuacuagggagguaugauauauuuauugguccuuuagguuuccuuaucuguuacgugcccauuuaagauuuuugcucauuuuuguauugggucguucuuuuuauugauuuguauuucuuuuauauucugaauauuaauccuuuguugguuguguguauuuucauuaaggaucauuucuuacuaguaaaauuuaccuggauuuuguaauucucuuugaggagugauaucauacuacugguuaaaauuuuuaaugguuauaguacgauucagauuuucuaucaguuaauuuugcuaggcuauuuuuuucuaguaauuuuuaacauuucagauauauuuucaaauuauuauuuaugauauccugcuaauaccuuuuaauaucuauagcauauguaggcauggucccuuuuuuauucauaauaucacuuauuucagacucuuuguuuuccgucaccauucuugccaaaagugucaauuucaaagauggucuuuucaaagaaccgucuuaaaaaaacaauuaucuugagucccugcccuguuugccaccacccuuaccccucuguucuuauacacacauacacauacauaaagacauguuuauguauguacauucauauguguauauguaaauauaaguuacauguaggauagcugaauaucaauuaaagauaguguucaguauaaguaaucugauccucccuuggggaacuaaaagagaguuaaggagaguaaacagccaaaaaaucugauuuuuuggcuguuuaccaguuaguggcagaaacaguucuucuaucuuuucuuccuuucucuuuuuaucauuauuauuuuuuucuuuuuugguuucuuugaguuuauucuguuuucuuguuuuucuaguuucucaagucacuugcuuauugcacuaauuaccagccuucuuuucuaguaguauucuuuuauaaauguuucuugaaacagcauuuuuaaauguaucccacaaguuugaauauguaauguuuucuuauuguauuuuuuuaaugucugaugugauuuguuuuuuguuagccucgugaguuacuuagaagcguguuuaauucuuaaacauuagagacuauuccuuccauuuugucuuuuuuguuuuuguuuuucugagacagggucuugcucuguugcccaggcuggagugcauuggcagucauagcuuacugcagccccaaacuccuaggcucaagugauccucccagcucugccucccaaguagcugggucuacaggcacaugccaucaugcuuggcuauuuuuuuuguuugguagagacagggucuugcucuguugcccaggcuuguuuugaacuccuggccucaaguaauccucuucccuugaccucccaaagugcugagauuacaggugugagccacugcaccuggcucauaucuucuuuuggauuguauuuucucaucucacuuucccuuauuacuagcuuggaaguuaaaaauuguuucucuuccuuuagugguuauuguagaaauuuuaauauauguuuaacuuuuaaaagucuaaaguaaauaaaugccauucacucuuacuccagacaacauaagaaccucagcacggguaaagcccuaacacugcuuguugaaugugcuguucuugucagccugcuuuuaucuugauugaguuaaucuaauuuauuuauuauuuuuguccaaaaacacucccaggauauguauaauuuuuuuauuucugauguuuugaauuuccggucauccuuauuguuacaaaccaaccaaagccaauuugcacauggccaacucuggucuuuugguagguauuuuaguaguuauuuugguguguuugcagauuaugacacaagcagacauuuaaacagugagccagcaugcauauuuuauguagccuauucuuuaaaucucaugaaaccucagcuuuccguuguugccuaaaaugcucauucuaagcagauaaaacaauguuccagacacaagauuuuguuuacccagagucuccagaugucuuagggauuaaaccuaagguguuaucccuaaggguuuaggccucuccagagucuuccguuucccuuaugcaaggguguauuaugucucuaaauuaauucaaaaaauucacauaacugggaugcuauggauuucaccagugaaaucccauuuugcugauuaauaagccacuaccuucaucagugaaaaccuacuucauuauaauugggaagacuuuuuguguaaaucaaagauuaauaugacaaaaccccccuuucuguuguuguuuuguuuuguuuuguuugaguugaagucucgcucugucgcccaggcuggagugcaguggcgcgaucucggcucacugcaagcuccgccucccggguucacgccauucuccugccccagccucccgaguagcugggacuacaggcgcccgccaccacgccuggcuaauauuuuguauuuuuaguagagacgggguuucaccguguuagccaggauggucucgaucuccugaccucgugauccgcccgccucggccucccacagugcugggauuacaggcgggagccaccgcgcccggccgacaaaacccuuuuagcagccaucuccguauaugauucuuguaauuaaaugcaaggugaucaaucuugggaugugaauuggaacgcagacuggccuuugggagguuuacaaguucuccagguguuucuaaugugcgggcacaguugcgaagcauugugccaccacuauuacggcuacuauaguugacccuugaacaacacgaguuggaacugcacugcuccacuuauaugcggaugaaacaaaugcagauuucaaacaaaugcaaucaaacauaaaaguauuuguaggaugcaaaacccaaguauacagagggcugacuuccuguaagugcauagcugacuucaggacuucaguaugugaggauuuggguacaguaugcgaggauucacgggggacuaguccuggaacuagucccccgugaaugcaaagcuugagguauuuuccugcacuacugugcuaucuguguugagcuauuaauauuuacaaguaaacuucugacaucauuugucgaauccuccuucuagagugagagacuuaaauugauaguauugagagagaaagcauucauacuuuaagauuuucacugcuuucuuaaucugauucauuucuuccuuaauuuucugaccauaagagaugagaagucaguuuuuugguaucugcuuuaaauugcuuuuucuuuacauauacuugcuuuuuguuuauucugacaaugauaaaggauuaugucccucacagcuuuuuaaagaaauauuuuauagaggcuuaaaggaguauguuauuaauuaaaguguccuuuaucaucaguucuaagacuuaccuuuuccacauuuaccauuucugaaauugguggaaaucuugcaguugcuggcauuuugucauggccuuaucugaguggcgaucuuuguguagucauauguaaaccuuuccugacacguuuuguuaagaucaagaaaguaccagcaugcuuuccugagucuuaggauauuaugauaaucauucagcugguucuaugagaagcgucugaaaaccuggccaucuuugugggccauucucuugcucugccuuguucaucuuguucucuuuuguuagguauuaacaggaucagucucugaaacaauuauaaaccauccucugggguucuuaagugaaaccacuaguccccuuucccucacuaguccccuuucccucacuuugguuugcuggcugucugauucauauuugcaaacugaguagauaaggauuuucaaucccagcagaaaaaaauuguguguauucucuaucauuuguuucuaaaucacacuuuaauauguuaauguuuuuuccuauuguaaacuuguuaaacauauuuucuuguauauuuccuguguaauaugauguaucaaguuuuuaaaaauuuaaacuuuaaaaacuuuaaacuugauacauaauauugccugauauauuugcaccauaauuugaugaccaugucagcucucagauaucuguuaucucuauuuuuauuagguuuuguaaagaaaccugcaaugaguaaucuuuggacaugaaaaguauuuaguuucuuuccuuuggauggauuaccagaagucagauuacugagucagaagaauaugaacguuucucaaguucuugaaacuuucugacagauuguauucugauagaauuguaauuuaagaaugauuaagacuguuucguuuggggaauuucuaccugcuuccccucuuucauuccuagguuacuguggcagaugccacguaaaauaauuauuugagggguguaauagauuuggagcaggugagcauuauagcagaguagguaggguuccuuuaacuuuuuguuagaaaaccggaauugaaggaaaacaacccuuauuuugacauaagaaggcaagcuuuaaugcuuuuucaucuuaauuuuuaaaaaaccagaauguuauaagaagcucaacaauuuauuuaaaauacagugucaaguauuagacuaguagucucuuuuuuaaaauaaaagcuaauauagagagcuuuuccucuuuuauaguauugugguuuggagugaacagcuguuacgcugcauguagaagucaguauaugaauuauuauuuuauaauuugaaaaaguaucuuagaauuaacagugguuugcugaguagauuguaaauuaggcacagcuuuagucuucacaauucuaauaaaagcuaaugguaaaaauaaaauuuaauagaugcuuuaaaaaucaacugcuaggauauuaguugugucaagcaauacaugcauuuagcaaacaguuauuaaacaucugugcuaguaacuguguuagacaucagugauuaguauuuuuuuacggaaagauaguuaacacaguaugaugugacaugaaagagggagaaauuaaauucuuggaguuuucugaaaaaagcaaguugacauuugcauaaaguguugaaggauguguaagaugccaagucagaggaggaggccguuacugggguaaauaaauacaguggaagggugacaaucacaagaaacuguagaaaugcaggaagguuuauguuauuauugcugauacuuagggugcauguuaggaaaugagggcaaaaucuaaaagaccuguaugaugaauguucuuaugaaagguuugccaccaugaaacaugccgugaauuaaucuauuagauuauuguggugguggugguggugguaguggauggugguggcucuccuuacuggaauaaugaguaaaguaagauagugauuggguuacuuuauucagggcuuggcauaaagauaauuaugauuuuauaauuuaagacucugaaagggauacuuucuugccaguguugggaagaauaucaagaaagaaauaggggauauaauaguuuuuuaaaaaucuuaaugucgaagagaaggacacaguggguaaauuuugggguuauguaagaguagugucaagguucuaaaacugaaaaugagcugagaauuaggaaaaauuguuagaacaguaaaucgaacaaauaaaaaccucagccuuuucccaaaaaguuugaaauguacaugaagcaacagggaggacaguaggaguauuauugaguguaugggaggaugcagugaucauugaagaaacaaguaauuuauauuugguuuuugucuucaauggcaaggaaaauuaugcucaaacuauuguauacaaaguaaacauuacuaagagggacuugaaaucaaacagaaaaaacagggucaaugagcagauaauugugcuaaauaaguauauuuccuagcauuuuauuucauccaguaguauugagaauauaaugaaaucacuagcagcucuuaguaguuuuuaaaaaauuguaagaaaugggaguggcagaaaaauggacacaagcaaauauaagccuuuugaaccaaaugcuagaggaauagaaguuuuccuguuucuaguauauaaugagcaguuuuugaaaucaacuuuaucuuuacaucucuggaacauauagaaacaugauugaauuuuaucauggaccugguauacuaaggugagcauauaguuugcaugcacugaccacuagauggugcucauacagaagggauuuuguaugugugacauugaggguuuucuagauaaauagcaaaucuguguucuugucacucuucucagucuugucuuaucucaauacaguuguauguuuugaaauuuaauagcccacauuagaaaagaguaauaaaaaugccuguuauauugcauuuacguuacauuagcuuuguaguuacuuuggguuuuugguggguuuuuuuuguacuuuagaguuucaguauugcuuuuccucuuguccuuuaccuuuuuacauuuuucacuaagauuauuuaguaaacugggcauggugguaaccucagcuacguggguggcugaggcaggagcauggauugagccaaggaguucaagaccagccugggcaacguagugagacuccgucucaaaaacaaacaaauaaaagauuauuuaguauuugccuuuguuucuguaccuaaagacugcuggguuugugacuuuagaaacguacacaaauaauugagagccuauccaguauaaauuuuuaacuuuuuauuaccauuuaauauuguaaauauuccucauagucauaaauuuuucauaaucauguuuugaauuacauaguaauccacugaacuaaucguauuuaguuuacuaacuuaagcuuucucuauuguuuaggcuagaauucuauagauuauauuaucacucugaaaaagaaaacacauuacggaaaaaagaauauucuuuguauaucauauuaagauguuaauagugauuccuuuuggugguuuagauugcauaccaucuuuucauccauuauuuuaaauagguuuuccagguuuuucuuuaaugaacuuaaauuugguuuuaauggaguuuuuaucuuucaucucugcuguguaaugagagaggauauucuaaagcaaagaacaguugguugccuuccgccuuccaccucccagucuaaucucaugugaaaccccucuugugauuuagguauagauuuuuugugugcauauacugacuacuggccaauggaugagguguuccuagauuuuuguaggucauguaacaggacauuuucauaaagaagucuuucccaaaacuugaaguuguuuucuugaugugaauggauuuggauaggaaauuugcaucaagaaguauuucuucccuguacauuggggaaauaugggaggcagugaucugucaacuuuagauuguacccuaaguucuuuggcucuguaggguaaauagaugcacacuaagagccuaccauugaccccuaaguucucuggcucuguaggauaaauagaugcucacuaagagccuacuauuguaugucuuuugguacuguuuacaguuugagguaggagauuugcauucaacaguuguauucaguaucuucauccauacuaauucagaauaacagaacccauaucaguuuucuccuccccuugaaguuuucaucagacauggaucaaggcacauauuuuagggccagaccaauuaccguagcauuuauauaaaccacacuaaucaggucuuuacuagguaccugguccauaacaaaacuugaauuuuuuucugggagguuucauuuuuuccuucacaagaggauucuuaguuaccuguccgcccuuaguauuuucuuacauucucuacuccgaauuagauaggaucacucuggggccauaaauugucagcuacugccggcacaguccuugggaagaagcaccaaacuuucugguauaaucucugucacaaaauaucuugcccucaagagucccacauggcucucacccuuacugagcacauguucacuucucagcagacgcaucauagagacagcauuagcauguuuucuugcggagucaagauuugcaguggaccucaacauuguaguuugacaaaaggcugcauccaguuggugcugguaagcacguagacaaggaagauucugucaguccacauccgaaaaaauauccauggcugagguugggacuuacgauaugcucuuaucagcuuaaaaauuagauuauucaaccaauaguaaauuaucaaguagcguuuuuguucacauauuguuuuaaaaugaccauuguuguaauuacuaauauagcacaguguuaagagggcuugcuugggaguuugugguucucaaacuugaagguacuuaagagucacuugggaagcauuuuaaacauaaaaauucccagguucccccugcccguaaacauuuugauggggagaggauacaccaaucugcauauauaacuagcgccccaggcaauucucaggcgaacuauuauguuaaccuaaauauuagauguuagaauauguuccuuuagcaaucaggugauaguauuuggugaaccagagugguauuuauguagaguuggauaaaacacauuucacugauuauaaaacgaaaaauuuaccagcguuaauucuuucucauuuuuagaaauuuaugaccuuguaauaugaauguuuauaaaauacuagagagaugaugcugauaauuucuugaaaguucuuuuuuaucauaaagguuccagaagcaaaauacuuguuuuaguaauuaaucuaccuugagacccaguuguuaaucauuaaaaaccaauacauuacauaaaaugauaaaggaaaauccauuuguaaugaagcgcuaucguuagauagucagaguuuaauguaggcagcaccuuugaacaacuuagagccagugccagauaauguguaagaucugccugguguagaaauuuggauaugaaugacaaagauucuuuuagugaaaucauuuuaacagucagaacuauuugcagagagaauccucuuauauguuuuaauucaguucauauuuauaauuuauauaagcagugaaggugccauuggauuuuacuacagacugugguugaaacuugguaauccaggguuuuuccacgcagugcauuaaaucaggcagccccacagggucuugguaguccaguguuuauagcauccuucuuuaccugcuaaucgaccucacuuccuggauuucaauccaucuaguuaucagcuaacaaaagaacagcuuuugguuccugcagacgcuggugaaaaaauaaucaugagaaagaaauccaccuuaugucgucuuuuuugucugcaaaaauaaacucagccaucauacagcuaacagguacagagggaagauacgagcucuuucauaggaagaaaucacugagaaaaugagcaucauuucucaagguuuuuauuuucacugaucuacaagugaugcugcuguaauuguagcugcaguuuuuaccgaucauucaccacucagcagcugguagagaaguaagccugcuuggcaaccaccugcagggcugcagagaugaauuacauuuucggaaacaacacacuucuauacucucgcggcagucgaggaggcaauacuagcucuagccauggcucagcaggcccaaagcagaaacacugggcaaaaaagggcucgucagaugaacugcaagcugagccagaaccuucacgcuggcagcagauaguugcauuuuucacucgaagacacagcuuuauugacugcaucucgguagccaccagcuccacccagguaacauaccacuuguugaaauuauuuucaaucuauuucuguuuacguuugcucuguaaaaaugucuuaauauagauuuuuuauuuaaagaauagccuugaaaccuuggauguguagaaauguauguuuucuguccauccguguaggucuuuagcacaaaagggggaacaagaaauauuuuuccuuaugcucuuauguaauaccaaacaaaauagccucagauucaauugaaugacuuuucuaaaaauauaagcccauugauacauaaaauaugaauuaauaaugcucaucuccuuuuuagacugugcuaaaugcuguagaguaugaugucugaccaaagaaaaugcugauuuguuuaguuuuuguauguuauuagauaaccuuagggagacuguuacaguaaagaaacagaagauacuuugaaauauuuucauuuuucaguguuuugaaaauagauucaauuuaauauaauuggcuaguauuauauauacugacaucuuagcuauauuauggcuuauucaagggauuuaaugaaucguuuuuuguaaauauuauuuaucuagcuuaauuugaaauuaagugaacuugugcaauuacacagucauggaauauuuuuucacauagucaaaucacaauuuaaagagaugagcaaauacuaaaagucucucaaaauuaaaaaaaaucacauaacaccacuuuuugaggaaaugagcuauugucuaugggaggaaaaauaaagaaaaauuaauaauuguuugaaauaccuauuguuugcuacaagggugguuugaggaaauauucauauuucuaaauauuuuuaagcagucaguucaacuuuaguaaaaauaaaaggacgagaaauggucuaaaaacaaguugagaaugcauuuguccucugacaucagugauauuuaaauuaggaaaauacauacauacacauuccuuaggaccuuuuaaaauaaauucccuuaaagcugucuuuuaaagaaaauaauagaagcagcucaauaaauauaaacuauaacugucaacaguucuauauuucuuuauauguuuuuuauaaauuucuuuacuguuuuugguuacuagaauugucuuuuaaugguguugauuuaaaauaacaucagcuuucuuaaguaagaaauucuacuuacuuuucucaaauauuugggagaaauggaauuaccuaggaagggggagucauuauguaggcauugagguuaaguuacaaucaaaacuuauugaaugggcaacgauugauuuaacucuuaaauugaauacugccccaagaauuuuacuaaccuuauuuugacugcaauuacauauaucacgaaaggaugcaaagacuaaagguugacaauguuauucauuguagauuaauacuagaugauauuuuccauugucaacaagacagauaucuuuagaacuuuuuauauauauauaugguuuauguaaaugcacacccuucuauauauguaugcacagauaacacuagcauugauauaucugucacucgguuuauuaaaagcaggcaaaugaaaagacaggaaaaguaguucauguauaaaguguugaaaccacagaguuacguuauagccgcuugggaguaggagcagaacguugcugugauugcgccagaagagagucaugaccccuguucgcagucagcucugcaaagccauuuuacaugacagcccccacccaguuugguucagagcauuccuguaugcuaguauaugaguuauuaauaguuuuuauuucuuucagaccucuuuccugauucucaucuugucuuuuucauuaccuuucuauuuuauuucuagaaauaggaguauuaggguagagguuuuagcuucuguuuuucuugcacuggaguaccaacauuuuguuuuucauuuuauacauuuuuguaacugauacauuggauaguuuauauaucuuaauuuuuuuauaacuuacuggaguugauuugacaaguuaaaauauaaugggacugaaaaauaacuugagauauaauuggaucuuacuugauacuagaauacuuuuuuaaauugcacuuacugacucauggcuggcagcuuucuuuugcagcacuaagggauuuauuguuagaaacaacguagauugaaauuucauacuuagagcauauaauauauaccuaugaauauaauaaggucauaguguuuuguacugcgauugguaaauaacagaggucucuuauuucacugaugucaaaaauacucuaagauuugacagaaagauuaacuuugaaucuaauuccauaugacuaagccacaugauacuuuuugcagauuggagaguuguuauaaaucaaguucuauuaguaugaaaacuaucugguuuaguaucccccccaaauacaguaugaaaaguaucugauuuaauauccccccaaauauacacaauacauaaaaagaaccuguacuuauuuuacagauucauuuaaauugcuugucugcuggagguauucauguucauaacuaagauuaugugccauuuucuacuaugauacuggaacucaggaggaagucauuaauguuuuuugaaugauaaggaaacugagugguuauaaacuuuugcaagacaccuagcuucucaguuaggguuuggcauguaguugguguuaauaaaugcuuauagaauuaauuaauuuuuauuccauucaccucaaauguuaucuccuggccuuccaaaauaugacaccuaaucuaauaccucuucaguaccuguauugauuggaucuucucucuucccucacaagugucuuugguuuuucacagcagcccaucuccuuuuccacugccuuuucuuccccuccauucuucauacuauccuccagucacacugccccgauuccccugauuuccucaccccuuucaguccccacucaguagugauaaccaaauagcuuacacacugucucucaguuuuaucauuucauuguaucucauuuuacauuguggguuuuuugagagguuguuuuauuuuuuaauguuaaauaaaaaugaguuucuuaugaauuacauuggugaaacuuuuucaguuugaggcuucauaguguuuuuguccuuaauuucaaacgauuaguauagaaaaaguucucuaugcauugcgaagcccuccuugguuccgcacccucagcgucccuccuauucuuguguugagggucacucaauaaucggccccguccuacuuagcauacacaguccuguuccaaucugggaccaguuuuuauauucagcaggguuuuauagaacuccagcacagugcugcuagacuuuacuugauuaacgccuaggugaaaaguuuuauuuacuuagugauaucgacguuuauuaaugucaguaguaaucauaugaacuuuaaauaacugugaaguguucagucauuuugaauguguguauagcagcuauucauacauuuuggacuacuugaaaaucucaacauauagagcacuauaaauacucaaaaagcccccccccccccaaaaaaaaaacacaacaugccaaauuaagcugagagcagcaaagcuguauucuuaggaauauggaacagacaugaaaacuugucagaauugaaauagaauaauaaaguuuucuuaaagaguaaauauuagcugaguugaauaaucugcuuagaggaaaaacccuguccuaagucaaaaauauaggaaaacauuguucaagugccuguguggaaaaauauuuaggcuaauuuguacacuuuaaaaaauauuguuugucugaaacagaugccuucugaguuauagaggauuuaauuuuuagagcuaugcauuggauauauuguccaauagagagaauaacaguaucagugucauugagucacuucuaccaaauaauuuaauguauauauuaauaaaguacuuaggacagcaucugacacagaguaagugcuacauuagaguuaggugccccuguuagcuuauuuuuauaucauuuaacucuaauaguauaugaacaaauucagauauagauuauuaggaauuauugcaccuaggauagcgcaguacauucaaacauucaguaaauauuguugacugauuaaguuaauuuguaaguacaagccauccacuuuuuuuaagaaccagagaucucaacaccuuuaauuacaggauuuaagggaggugccccaaagagccuuugaaauucuugaugagacuaccaguuuuuugaccuuuccuccccuccuagcacucccuucuacaaauuggugaaaaccagucacguguagaugacuaaauuuaagugauuauccacuugguaccaagcuccccuaagcaucccccaaacauaucaugaggacuauuuuuagauccuaaaucccuuuuagccugucaccacagaaaguccagaccauccggauugcagcucugccuucucuauaccaacucgcagacugcacguuaaacuuccaauaccugauuccuggucuuauucucaaauaaauaaucuugcuuuguguuccagccugcuaaaauaaaugaacugugugccuaaagcuuacccauauucacuucuguacuagaucguagucccuuugguuguucaagaacuucugaaaucccuuucucucuucacugcaucaucugucuugccucuguacugccccuagacuugccucuauaaguccuaucaggauguacaccugcuauaauaucuuucauuaaaacaaccauccaaaaaacccucguugugugaguguagauuaucaaauccaguggccaguucucaguguucauuuuacuugacccuacaacaacuguuaacacaauugauuacucccuccucuaaauucuuuuuucuccuuugacucguggauaguacugcucuuuuaauauucuaccagccucauuuuccuuuauaguauccuccuuuuuccuacugcuaaauguucaaaugucucagggcucagucuuugaacucucuuuuuauacucacauuucaggugaucgcaucuaguccuaugcccuuaaauaccaucaguauuucucuuuauuccagaguuaaucccuguacauuagacuuuuauaucuaacuuucuacucaguaucuccacuucgguuaagcaucugaaagguaacauauuaaaaagagaauuucuaguuuuauuggucucaaucuucuuuauucaguaugccauucacuaagaugcugaagacaaaaacccuuaaaauuaucuuuuauuccuuuuuucuuugcuccguauccagucugaugccaaauccuguuggcuuuuuauucaagauauauuuaugauuuggccacuuuucaacacuucugcaacuacugauucaauaauauguugccugaacuacagcaguagacaucuaacuucucucguuaauauuuuuugcuuccucuaagguagcaccccuucacuccagacauuacucugucuucuuaccugauucuuuauuauacauuuuuuacugucuuuuuacuugacugucagcuccaugugggugggauuuuucuguuauguuuauuguuguauccucaguuucugugacaguggcuggcacacuguagauaaccagaaaauauuuguugaaugagugaagagacagggacauacgaacuugugcuaaggagggcccaagcagguguguuugucugucuuuucccuuagacuuucugugaagcgcgcaucacacuuuauuuagcauuguaauaguucucuaacugaugauucuuacuugcccucugagaagaaauacacacaaggaaaugagguagggagagaagagaauucaauuuccucaaaacugggauaacuauauaacucagaccaaacuaggauacuuuaaugaaaagagggaaucauuaauaauuaaagugagacaacaggcauaaauacagacuucccaaguaaauagaggcauauggggucacucuguuauaaccauuuauuuucugacuauucccaccaggcaacaggucugaaauucacaccaagacaucuccaucuuggaccauccuagauugauugaccuaaccguguuaucgguacauaccacauucauuuugucucauguguaaugauaauuguguuuugauaaaauauuuuuucuucaucuccaaggaauggaauuguucauauucauuaguguagugcuuuuguacuaaaaaguagacuacguauaggguagguagacaaucuucuuaaacugcuuugaaaauacugacucuaauugauagguuauuuuccagagaaauugguggaaauagucuccuuugguauugacuccccaaacauucacaguuuggauggaaacgcuguuguacuggcugugagaugcugacccuuggcagacacauuuguuucuuaauuuucuacucaaaaggcuacuaacuuugcgaaauuaauaugaugacucagacuuggaaaucaauuguucccccuuugacacaaaaaauauuguaggaucuauuuuauguuucuguuuuucuggaaacuuuuacagugcaccuacauguacugacucaaaaauugguucuuaaacacuguuucaacacauuuuuaucauuuguacaauaaauaaaaauaaauaaaaaauaauauaaaaaauaaaaauaaaauuuauaucauuuguucaauaggacacucuagaaaagcauagagaugaagauuaaaccaaaaguaguugguuacaaugguuauauaagcuuuuuuaaauuacaaaauugaccauacgauccagcaguuguacuccuugguauuugcccaaaugaauugaaagcuuacauccacccaaaaaccuguacagagauguuuauaacagcuguguucauaauugccaaaaccuagaagcaaccaacauauuccucagugugugcauggauaaaguguggugcauucagacaauggaauaucacccagcacuaaaagaaaugagcuaucaagccaugaaaagacauggaggaaccuuaaaugaauauuaccaggugaaagaagccaaccugaaaaggauacacacccuuguuuccaacuagaugacguucuggaaaaggcaaaacuauggaaacaauaaaaagaucagugguugccagggguuaggugagagggauaaauaauagagcacagaggauuuuuaggacaguaaagccauucuguaugauacuauaauggcggaaacgucauuaaacacaugucaaaacccauggaauauccagcccccacagucaacucucauguaaauuauggacuuugugauguggcagugugggcucauugauuguaacaaauguacauuagaaaugcagggguguugauuauggauaguuuaugugugugagcagggggcauaugggaacuaaaacugcucuaaaaaaauauauaaagucuauuaaaaacuauaaaauuggugucuuaauguagauuagauuggcuuagcuugaagacauuugaaauuuaugauauaaggucuuuauaguuaggaaauguguuuuauucuucuuuguagcuucuguauagugucuugauuguuuagauggcguuucugucaaggauagauaggcaaaaagaaguuucacaggcuauaauuuauauauucuaaauauauucagagaaguuuuaaaguuaaccuuuaaaauaauguguuaauaacagugcugaaaagugacugaaccaugcuuaugggaucagggcaagucagccugagcaacauuuuucuccuguauuuucaaguaauguuuguuugcaugagaauuguacuucauaccucuuaucacgacucuaauucaguagucauuuggauaaugauuuuguuuaaugucagccacuaaacuguaaguuucacaagagcugaugcuacagggugugugguuuuuucccuugguauccccagagccucgcauggagaaugcacuugauaaauauuuguugaaugaauaaacagauguuauacagguguuaauuuuuauuuaaucugcuguugacgaaguggaaguuuggaacuucuaaauauuguuggaucacuguaaauuucccaagccauuuuuauguaacacuauggcuuaaaaacuagcaagucuauguuaccagauuuuguaaaguugugaauuucagaaguaauucagauccuucugugaaaaaauugugaagcauuuauacucuuacauaucugaagaacuuaaauuuuuaucaugaaaauuuuacuuaguaucagucucuuuaaauaaauuuucuuaaauuauuccuuguacuuccuggcacuauuauuuagauaacauuuccagcccuccauuuuuauagcaaaguuuagaauuuugauaaagguaaaaauaguuguucagacuauguagagaacaguagccuacaguuaccaccuuuuaaagaaaacuuuaaaccaacugaugugguaauuuuaacaggcguaugcaaauacaaaccaacuggcagugccaccugggagcaguggaauuuuauagaagccuauacacgcaacuugccccuccaggcauuuauuuaaaagauuuucccuccucacuucguaacaggagcacuuccuauucauucuuuuuccuuuaagccccaauuugguagcauuucugaacaguauuuucaguaucugugaaaucaaaacucugacuucuugacuggagcagcuuugaaaugugaagaaguuacagcugugacagaguggaaccaaaugauugcuuuacaauuuguguuguuuuguuguucugagaaaaagaauuggggauuauaaccugguguuuaauuauuuguuaauuuuuuuuuaacagccacguucaagagcaauaaacuggcauuuaaauuaaaacagaucccacccucauuuaucuguauauaaaucugacuaaucuugguaggaugaucugauguaucaaaggguuauaaauuuggaaagaaaucaguuggaaaguauuuuguaagauagaaagaaaacaaacaagaugcauaucaauauuaagaauuaauugcuuuagccaaacuaaguaccauagcaggauuuugaagggagaacaaagaaaagagaauaaaaaucauaucauuuuaaucacuuuuuuuccaaacuggaaggcuauauucaguauagaggcaaaauuuuuucaguuguaagagcacagcuuuauuauauagacuuuuuaauuaaagauauuuuaaagaacuguaggugaaacuugaaauuuccauauguauaucuuguuuccuuguuuuuuaaauugucgcuuccaugguuuuuggggagagagaauuggcuuauuuuuauuguagacuaagaauugcaacagaauuaaaccauuuauaguuaguaaaaguuaacuuaggugucuuaaagccauuuucuauuuucuucauugacuuauuuagccuuuucuuucuccuuuuuuaaaagcagcuaaagcaggagucagcaagcuacaaucuguaggccaaauguagccugccaccuguuuuuguaaauaaauguuuuguuuuguuuuugagacagagucucacugugucgcccaggcuggagugcaguggcgcgaucucagcccacugcaauuuccaccucccggguucaagugauucuuaugccccagccuccuaaguagcugggauuacagaugugcaccaccauaccugacugacuggguuucgccauguuggccaggcuggucuugaacuacugcccucaugugaucugccugccucggccucccaaaguguugggauuauuacaggcaugagccaccaugccuggcuuguaaauaaaguuuuauuggaacacagccaugccuauuuguguauuguguaugacuacuuuugaacuacaauagcaguguuggauaguugcaacaauuacugcaugguccauaacgcuucuuuuuuugucauuuccaaaaauguuugcuaaccccugaucuaaggauugaugcaguauguauuucuuuuuacagguaauauauauugucuuugcaguaaaauguagugguaacaauaaagacaaaaucucuuuuugaacuauuuuaaagagauaaguaaagaguacuggguaaguguaccaucuuuagaggaugaugaccuggauuuaaauuuauauucugccauaucgccugugccaccuugggcaaauuaccuccaugcggagucugucuccucaucuguagaaaauggggaugaaaguguuaucuuuuucaaaauuuaaugagaauuaaaugagacaauaugugcaaagcacuuauuauaauacauuaauuacaucagugaggucaucaucaucuuuaucaacuacccuuuuauccaccacuaccaccgccaccaccaucauuuucauuucaacaaaauauucugaccuuuaaaugaggaaucuagagauacggagaagcaaccauguuuuagcuagaggguugguaacuuuaauagggugcagccagggaaacagaaaccacagcaacuaacaauaaaaauacacuacaugggauugguuagaugaguauuggagaacuggaaaggcaaaaugagaaugccaagguaaaaucgagacuaacuuacagaaguagcuaccuguaggggaacaaaggacccaagcugaaauuaguggaaccucagaggaagggcaccauggauuuuaaauaugagcccucaguaagaaguuguacuuccuaaugcaguuugaauagaaaagcgaugaaaauauuuuaagcaaauaugcuugaccaagacauguuuauuuucaaaugggacauuauuaggcaauucauuauugcuagauagagaacaacaugaaacuggcaauuuuuuacauuuugaaacuucuguucuaagguuaucaaacuguaaaacaucuugaacaccuucugauuggugguggcugcccagaaacacagaaauaaccuuuuagcaaugucuacuauguauauugcaugaaaguggguaggggaaggaagacuguaccuacccaaucuauugcccaagucauuuuagagugcugauuaaguugauuucuuuugacagucgcaugguuuuauucauucaacaaauauauauuaaauacuuccugugugcacuuuucuaggcacugggcauauaggagugaacagaacagaaaucugcucuaaguagaagaagacagauaauaaauauaauuauccaaaaugcagucacaugucaguuaaugggaauacgguguauauuuauuuuuguauauaauuauacagaagauaaaaaguauaguauaauaaauauacaaaccaguaaaauaguuguuaauuaucauucugaaguauuauauaccguacauaauuauauguauuauacuucuguacaacuggcagugagguauauuuguuuacgccagcgucaccacaaauguaauacauuauacugcagcauuacaauggcuaugacaucacuaggcaguagaaauuuuucagcuccauuauaauuuuauacauguggaccaucauuaaccaaaauguugauaugugacguaugaguguauaugguauucuggaggaaaaauaaaggaaagaaacaauagaaaauguguguauuugugugggggaaauagaagaaggcaacuugagagagugauaacagggaccugaauccuuacagacuuguagagggugaauaauacaaggcaaaucugauuacugggaagcauuaagggcccauuuuagguuauuagucaugaagucugugguuuugcuuauuucucuagccacauucugauaaaaaucagguaaaaaagcacauuauugcauuugguaauuuuauccccauuugucaauuauguaaccauauauugaaguuuuagugucuguuuacuuugaaauguuucguguuuggcucauccuuuacuaggacaagauugucaucugaaugcugauagaauacugucuuuucauaauggagggaugagaaaccuuaacugaauauugugagucucacagguagagauagauucaugaacuagaugaucugucugugugaacuaacacacuuguacucauguuucuguaauggaauuaauugcuagaucuguuuuccuauuuaccuuguuuuguuuuaaauuuaaugauuuuaauacccuuagugauuuguuuaaaaauguguuuaguuuuauaauuguuugcuugugagauaguuaugacauggaagucauaugaagcugguucaaauaacauauuguugguuuuuuacuauaccggcuuaugugaaagauaccuguuugcagugacaggaccaaaggacauuugaauaaaaaaacagauuuaaaccauaaaaaucagcuuuuucugaagguacugggcccccguugaguacagugauuccuaagcagaguuuuuauaaaucuacugugcuauauuuuauccuucuauaaacauucaaaaggcuugcaguuuuuuuuaguuucucucuuacuuuuaaauagcuucuuugacauuuaaucagagaaacaugccacauuacagcauaauacaucuuuaaacaaagaaccaaagaacuuagauuaggaauauuaauuaugccauacaaaaccaaaauaagauccuuacuaacccacagugacacgacaguugauacuuuuccuugccaucuaagauauugguaccaaaagauuugcuaauucauauaucucauuuucucuaaaaauauggaagugugcauacaaaaauuaacucaagauagauuaaagacuuaaaugugaaacccaaagcuauaagacaaccuaagaagacaaccuaggcaguaccauucuggauauaggaacaggcaaaggguucaucaugaagacaccaugcaauugcaacaaaagcaaacauugacaagugggaucuaauuaaagagcuucugcacagcaaaggaagcugucaacagagugaacagauaaccuacagaauggaagaaaauuuuugcaaacugugcaucugaaaaaggucuaauauccggcgucuauaaggaacuucaagaaauuuacaagagaaaaacaguccuauuaaaagagaguaaaggacguaaacagacacuguucaaaaguggccaacagucaugaaaaagagcuuagcgucacugaucauuagagaaaugcaaaucaaagccacgagauaccaucucacaccauucagaauggcuacuuuaaaaaaaaucaaaacaagagaugcuggcaaguuuguggagaaaaaggaacacuuauacacuguugaugagaguguaaauuaguucaaccauuauggaagacaauguggugguuccucagagaccuaaaaacagaaauacaauucaacccagcaauccuauuacuggguguauacucaaaggaauauaaauuguucuguuauaaagacaugaacgcuuagguucauugcagcacuauucacaguagcaaagacaugcagucaaccuaaaugcccaucaaugguagacuggauaaagaaaauguggcacauacacaccacggaauacuaugcaacaauaaaaaugaaugagaucuuguccuuugcagaaacauggguggagcuggagggcgucaucguuagcaaacuaaugcaggaacaaaaaaucaaauaccgcauguucucgcuuauaagugggagcuaagugaugagaacagguggacgcauagagcggaacaacacacuggggccggugugagggguggagaguacgaggagggagaagauccggaaaaauaacuaaauggguacuauucuuaauaugugggugaugaaauaaucuguacaacaaaucccagugacacaaguuuaccuguguaacaagcuugcacauguaccccugaacuuaaaauaaaaguugaauuaaaaagauacaguagugaaucuuuguguauauucuuaggucaguuuacccccuucauauaacguguuaauguaaaauauaagcauuauuagcuaucagauaguauguucauuuaucgucuuuggaguugcaucuuaugcuaugaaagucauuuuaauaaauuagugagaaaauguuuuuaaauauauuuagauagccuugcaacucuuuuauaccugagucgaacucuuguauaaaagaucauuuuuaguggcuauugugaguguuaauaggccuuccucacuccagacuucucaucagucaccaagauauaccaacucuacauucaaaaugugucuugauuugacugcucauauguccauuaccaccauucaguuuaagccaccaauaaccuuucagcuggauuauuacaguaaacuccuaauugucccuucugucucuuccuguauuaaucaggguucauaugcacauaaugaaaaccacuugagugcuuuaagcagaaaaggcuuuaauaaaaguaguaggcucauucaauauacauuuauuuuucaaugaaucaaagugagggagggcgguacauggucauaaauguggaugugcagaacagaugcaaauggcuguauguagugaguguucagaccacuuuaugaaaaucuguuuuaagugcugcuuuuauaauuuuaagaucuuaaauuagauuuaaaauauaaagcuauagagaaaauuaaucucuaaaaacaaaucacuuuaaacauuuguucagauagccauccauuugauacugguuuuuaaaagguacuuuaaaauauguacaauauauccaauuuuguagaaauuuacaauuuccuugugacgguguuaauaucauagccucuguugccauggaaacaagucucugaaggcagccucagaggcuaaugauuccaugauguugcuguggauagaaacaacugagaccguugcuagucacauggucaagauuuuuuuuaaaacaacaacagaaaaacuuuagaucucaucuuauugagugauacaaauggagcaaaacaaggaugauggcauaacagucacugucuaaugaaauaguuauauaagauuuuucaaguuuaaaaugccauacugaauucuguaauaaccaaaauauaaugguuacuguauauugcugcuucauuauuuauguuagaaucuuaaguuugacauuuucuaauuuagaaucuuauacagcuccccggaguuuuacccugcucuaaaaccuuugcccaaagcauccugugaucagaucugauaucuuugcuguuccucaucagucagccuucauuugauuauuauuuguuuagagcugcauuuuuguuucaagugaacuaaaugaauuacuuuguuguucuguaauuguuuguuaccagaauugguuaucaguugugauuagggaauuguguguguugaugcgucguugacuuucucagcgguguuggccuuaaggaagaggcaggggccuauguucuucaaggaacuuggucagugcccuguagagagggggauggguuaagaugcuguaaacugggaauuuuuuuaaaugguauucacauccucgucuaaagaaggugauucuagaagaggcucagagacagaggguuacaagugggauuaaaauguaacauuaaaggauucaugguuuaucauaaaggguuuuggagagcaccugcccaguggagaaaauuuuugugcuuugcuuugaaauuugacauaagcauguacuuuugucuuauuuuggcuaucaaaguagauuauuaaucagcuauuauccuauuguuagggcuggagacuguuaauaagaaaacauauuacauuugugacauuuucaaacacuuaaaaaauaaacuuuaguguccuuaaaagaaccaaaccaaaacaaaaaacaacagaggcacaaggaagcuuuuagaggugauagauacguuuguuacuuugauuauggcaguggcuucauagauguaugccuaugugcaaacucaucaaauucuauaccuuaaauaugugcaguuuuuuauaucacuucuaccucaguaaaguuguuuuuaaacuagaauaaaauugaauuaaaaauaacguuagacuuucaugacuuugacacuuuugaugacugcagcuaguuacuuuguaauguaucacucaauuuggguuugucugauguuuaaugauuagauucaaguuauauaccuuugguagaaauauccuggaaguauuguacucucauuacauuuuaucacaugauauaugauuuugauuuuucccguuacuggugguguuaacuuugaucacuugauucagauauugucugcagauuucuccacugucauuaaugcuuugaaaggagacacuuuuguaugaguauaucccauucauccacuggaauggacguuucacuuggcaacaggaaguuuuaauauucauuaauauuucuugaaugaauuacucuauuacuaugauggcugccaaaugaugauuuuauaauuccaucauuacauuuuuaguuagcauuuuguuguaagaaaaugcucuuaucuucauuuauuuauugauguauuuauuuauaucaguaugggcucccagauuccuauuuuauucaguggauguuaugccauuguuaucauugaguuacagauuguucccagucuggccaguggcagcccuucaagccaacuucuguguccuuugucauccucuuugaguacuucccuuaucuucugguacagcaagaugucuacacacaucuugugcuugcugagcucuagcacuggagucagccauuucuucaaagacccaugguuugguuuuguuugguuuuguguugugguuuuuuuccccccgagacggaguuucgcucuuauugcccaggccggaguggaauggcgugaucuuggcucacugcaaccucugccuccuggguucaaagcgauucucuuggcucagccucccaaguagcugagauuacaggugcccgccaccauguccagcuaauuuuuuguauuuuuaguagagacagaauuucaucauguuggccaggcuggucucaaacuccugaccucagaugauccgcccaccuccgccucccaaaguguugggauuacaggcaugagccuccgugcccggccauguuguguuguuuuaaauugcagaaugaguauuuagaaaucaagauuuggaugccagguguauucgugcuguugagcuguuagcugcauccagguccucauaguuagcagaccuaugcacauauauacacacacauuuaugucuauauuuauuuuuguauuuaucuauauauauugaaaacuguuuauaccaauaccuccaauuuuaguguaacaccauaggucucaugcuaauuuucuaucuuuucauauuuauaacugccuuuucugacgcaaggaaaccugcugucaguauccuucauguauuuauuuauuggaccagaaugcccuguauauaagcaaucuccugucaucauugcugcccuaguuggacgcccuucucacgcugcucaggcuccagaagaucccauuuaguccacugacagcacaaaaccuuaugccagacugcagcuacugccucauagaugcuaucugucucacuuggguuccaaccacacacaggcugccgccacggcuuuguccauguagacacccucgucaccaugcugaggcuccagcacccuuugccaggcuauugccucccuuccacucccugccuacagaugcuuuccucacccugcgugagcuucagcaacaugcacuuuccuauucaggaggucaucugcaccaagguugugaugauacucuaccauaucauccucuagaagccuuauauuguuuacuucucucaauuaugucagcaaaccagcugaaauuaaucuuauguauaguuuaaggguaggaaucaguauuuguuugauuuuuccauguguauauccacuugauccaagcacaguucuuacaaaaccaccacgcuuuucuuaugcauucauaaaucagaagucagaaccuauggguuuucaaacauucuuagaaggccauguaaauauugcagugaguaucaguuacgauuguuauuaauuuugagcucauaauguggaauucagaauuuuuuuucuccaggaacaauauauaaauggugauuggagucccgagcuaaacccacggaggcuuuauucguaguauacuuuuuuauuguguuaaaguuuacaucaaguuuaccauuuuagccauuuguuaauguacaauucaguggcauuaaguacauucacaguguugugcaaguaucaucacucucaaucuucagaacuuuucaucaucccagacugggaacauugaaaagaaagagaaaacacaaaauccaaugcuuuaaaaaucucuuucuacaggaaauaauaaauccagguaacaggaguccagagugugaaauacauuuucaguuuguuuucuagagaaugacacuuaaagaucauaauaauuguuuuucuguuaauauucacaauggaucucccauccuuccccuugcauuuauauuaauaacgccacuguguauuccuugucaacaacuggaaaaguauaauucagaauaaagaagcagcgauagagaaaggcacucaugaucccaccccagagauuaauuuuucagacauuucuuuccauuuuuuauguguuucaucuucccuuuuuuacuuaauguuuugucauaagcaaugucccauauaauuuauaaacuguucguacugauaauuuuaaauuucuguaugauaaucucauauaauuuucuuuucuuucuuucuuucuuuuuuugagauagucuugcucuguugcccaggcuggaguacaguggcgugaucucacugcucacugcaacuuccaccugcuggguucaagcaguucuccugacucacccucccgaguagcugggacuacaggcaugcaccaccgcaccuagcuaaucuuuguauuuuuuuucuuuuuuuuuuuuuuuuaguagagacgggguuuugccauguugaccaggcuggucucgaacuccuaaacucaggugaucugccugccgcguccuccgaaagugcuaggauuacaggcaugagccaccaugcccagccucaaucucauagaguuuucauuuuuuacuuaacaauucugacaccuuuggguauuucaaauauuccacgauuuaccaaauagaagcaguguucaaaagacuaucuuaaaaccuuagaacaccuuaugggaguaccuuaaaacauaggcuuuuaaaauuauuuccuuaggguagauuucuagaauuacuaagucaaagaguuuagacuuuuuuuugaggagggggagacagagucucacucuguugcccaggcuggagugcaauggcgcaaucuaggcucaccgcaaccuccaccuuccaggcucuagcaauucuccugucucagccucccaaguagcugggauuacacgcaugggccaccacacccggcuaauuuuuguauuuuuuuuuuuuaguagagauggaguuucaccauguuggccaggcuggucuugaacucuugaccucgcgauccacccgcaucggccucccaaagugcugagauuacaggugugaaccacugugccuggccaaguuuagacauuuuuaaagcucuagauauuuacugccaaauuacuuucccuaaaguuugugugaauuuguauauccaacagcagugugagaggaccaguuuucaugcauuuuuaaaagcuuuuuuggaauauuuuuuauugguaaaauauguauaacuuacuagucuuuuaaguggaaucaugcaauauuuauccuuuugugucuggcuaauuucacuuaauguuuuaaaggcucauccaucuucuagcaugauuaagaauuuuauuccuagggcugggugcaguggcucacaccuguaaucucaacacuuuggaaggccaagguggguggaucacaaggucaggaguucaagaccagccuggccaagaugguaaaacccugucucuacuaaaaauacaaaaaaaaaaaaaaaaaaaaaaauagcugagcaugguggcaggugccugucaucccagcuacuugggaggcugaggcagagaauugcuugaacccgggaggcggacguuacagugagcugagauugcaccacugcacuccagccugggcaacagagcgagacuccaucucaaaaaaaaaaaaaaaaucauacccauuguguguauauuaucacguuuuguguauccguucaucuccugauagacacgugguuucuuuccgccuuuugacuguugugugugaugcugcauugaacauuggcauacaaguguccaaguccuugcucucacuuuugggaauaugccuacccagugcauauuuaccuacccaauugcuagaucagaugcugauucuaugguugguuuuuaagaaaccacuaaaaguuuccucagaagcuguaccauuuuacauuucccaccagcauuguaccagaguuccaguuucuccacauccuugccaccacuuguuacuuuguuuuuuguuuuguuuuaauuagacacuucccuuguaguggugaaguaaucucucauuauagcuuuuauuuguauuacccuaaggacuaaugaugucgagcaucuuuucgugugcuaauuggccacuuguauaccuucuuugcagaaauuauucaagcucuucacacauucauuaauuggguuguuucucuuuguguuguugcguuguaagagucuuuaaauguucuggauauuaaacccuuaucagguguaugauuugcaaauaccuucucccauuguguaggcugucuuuucacuugcuugguaaugcccuuuggugcacaaaagguuuuaauucuguuagagucuaauugauuuuuuucuuucaucauuuaugauuucuaagguuccauuaccaaauccacggucacaaagauuaacccuauguucucuuguaagaguuuuauguuuucaaaucucauauuuagguuguuaaucaauuuugaguuaauuuuuauauauaaugugagaugggggucuauagaccuucaucuuuugcauguggauauccaguugucucagcaccauuguugaagagacuccauacauuguuaauaaaucuuaauuugacuaauuugguaggcagaaaagaucauugccauuuuauuuugcauuuaugaaugaagauaagcccuuuuuuuagucuggcaauuuguucuuccuguuuuaaggccuguuaaggcaggcuguccucaucugcuugauuuuaguguuuuucuuacauauauaagauauuuuauuuauauagcaaaugggucuuauuacuaaacaacuuuccuguguuccaguuucauccuuuuaaaaauaacaagccagauaaaacagugaacuuuuuaguuuaauuuauaccagguucucucuacguuguuuuuucauuuuugccagauaugucuggcauguaauagacaaucaauguuaguugaauuaauuacaggcauguugaggcaaguuauuacuguucuugauaacagaaguuaguaucacggauuuguaaacucucuuugucugccugauugggcuaauaaaauuacuuuuaguuuucugaaugcauagaggaaaguagugagauguauucugagugcuagaaaaaauauuuugcagucugucuaugaagcaagugucuuaucucccagagaaggaaggaauauuguaaaugauaaucuuuuauuauuaugauuuaagcaucuaaagaguaggcauucauuuuauuacagaaucauuaaaauuauuauggggguauaacuuucuaaaacaauuucuagagaauauuuucucauuuauauuaguguaauguauuaauguuuuuccuguugcauaguuauuucugaaaacuauaauuuaucuuuauggcacagcuuuuuguuauguguuucccuuuuauuuugguguuuuuccugauuuuuugucauugaugauuuuuagccaacagaagcuguucuucccucuccucccacugucccugugaucccuguccugccagucccugcugagaauacugucauccuacccaccauaccacagguuuuuauuaguuucuuuuuucuuuauaaaaauuucauuugcuuuuaauguuucauuuguguucuuuuuuaaaacuguuugagcuguuuuuuguaauuugguaauuuacuuugggcuucaguuaguaguuuuagggacuuaaacauuugggauuuaauauaaguggagucaggauuugccauuuuauuagguugucugugaaaugggacacaaugaacuucauaauauugaaccuuagauuuguuuucaugccuuuguacuuagaaaucugcuuaaaacaguuuuuaaacauuuuuacuuuagaacacuuuauucuucuaaaguuaguaaaaaucauuguacuccugaucuuguaccaauguaucauuuuauuuaacacuuuguuuccuguuauauauuuaucuucuuuggaaauauucauucuuauguuauuugauuagauaacacacuucacauuuauuagguaaaaauaauagccaacauaucugggaguauaugggaaugcucugugcuaucuucacaacuuuucuguaaaucuguuguaaaauuuuacuuuuaaaaaauuauguguaacaguuuaaaaauaauagccaaaugugagagagucuaaucauuuuuaguuuuucaaagcuuuacuacuuccaagggguggcuugagacauuaacugcccuuccaacaguuauccaaagucaaaauaaugguagugguauuaaagauaauaauaaagaucuuuggugugaaagaucacgaucucauuuaaaguguaaauaaaugaacccauagauuuuuuuuugccauuauugaucuguagccuaaaaucuggguaaacauauguuugcuguguaaacaguuucaaaauaagcuccauuggggaaaaaaugauauaucagcugugauuauucacaucucagugcccuuccccucuccuaaaaagugaagucagugggaacauccauacaaccaaggauucuaggggaaauuacaguguuacaaugacuucagccuuacuguaauaagacugaauuguaaucauuauaauaauacugcuacuauauaauuuuugauuaugaaaauaauuaaaaauuaagucauaaaaccaacaaugaauagaugaauccaaauggauauucucucuauauugcaggaaaaaaauugaauuuauaaauaaaauauaauucugagcaaacaguuuaaggguuauuauggcaucauaauaauguaacaucuuuccaaauauauagaguuuauuaguacaguuuuuuuuuuuuuuaauagaauugaaaguuuauuuuacucuucucacuucagucaauuuuuugguguuaaaauaguuuucuggaauccuuugagaauuuguaccagucucuuuauauucauuugggagccugucuuuuccuauucagaauucucucauuuauuuacuccaagcaacccuaacuuagcaucccacugcauuugaaaauuguugagaucuugcauagucuuauaaaaauacacguuuuaaagucagaaugaccugggguuggaauuccaguccuaccacuuaaccuguguaacugcacacuucacuuaaccacagcgcacuuccauuuacucaucuguaacacugaagauagacaggaguacuaacuugaggcgcuuuacagugauggagaggaugcuuaaugcacgucagguacuggcacauaaucuuagccgcccauauuuuuaguguuaucucauauuucucugagacagcaaacuaaggaacaaguuuuguuuuguuuuuuuaaaugaggauauuuauugaggauacacacaaaaaagaccuauuuauucugcauagcuucacuuuagguuuuaaauacacuacggaaguucaugaaagauaguuuuaccauuuuuguuguguuaugugagaagccaaugagugcaccucauuuuccagaauaaguguguuccuaauuagugaaguacaauguguacauuauaaaauuaaaauaauggacuaaaauauccguccccaaguaaaauuuaaaauacauacuaacauauaacccaauuucaacauauuaagugaauauguauucuuaaaagauccacuacuuuacauuuagaugcguuaggauguauuagaaauaaaaacagaagaaaagauuuagaaucuagucugucuuugccacucaagcuaguuacccucucugaguuuuauacccccuucaucuauuaaaaugggggguaacgccaaccugacuccuuuaaaaugaguuugagagucaggcaaauuagaaagauacauagaugaaaacuuuuuaaaaaguauauagucuuucaugauuuguagaacacuuuuauacuuuucagaguacuuucacauugaucauauuguuuguacuuuaugaaagucuucuacaaaucagaauuaugcuuauuauacagaguggcacagauaaagguaauauuuaauggcugcuuaauauugcagaaagaacguggaguuuauaguccuacccgacuccaccacuuccuagcuucaccuguuucuacgugugaugguguggaaauuacucaacuucugagagccucaguuucuccacauagaaacugaguacagaguaggugacaguuacuaguucuucuuacugggaguguaaacacauaaucucugugauacuagccuauuaaauccagaggcuuauuugcacccuagaguaaauacucugcuuuaaaacuagauguuuuaaaccuuuauuucuaucaguucugaaaagcuaucauguaauuaaaguauuguugaaaaugcuuuaagagcuaauuuuuugugcauggucuuuuuugauauuugaauaugugcuuugaagaugaauagaacaucgucucuguccucuaggggccuacuagguguuugugcaagagacaaguuuaacaaauagcucccgcauaaugugagaguaauuaccuuagagguauguccagagcagagcaucauacugccucugggcuuuuuuuuuuuuuuuuuuuuuuugaaauggaguuuugcucuuguuacccaggcuggagugcaauggcacaaucucggcucaccacagccuccaccucccggguucaggugauucuccugccucagccucccgaguagcugggauuacaggcaugugccaccacgcccggcuaauuuuuuuuuuuuuuuuuuuuuuuaaguagagacgagguuucuccauguuggucagacuggccucaaacucccgacuucagguaguccgccugccucggccucccaaagugcugggauuacaggcaugagccacugcauccagccaguuguagaauuuuauauuuccaccaaagugcacaaggauuccaauuucuccacauccucaccaacacuuuuuauuuucuguuuucuucauaguagccaggcuagugggugugaggugacaucucauuguaguuuugacuugcauuugugacacaucuguucaugugcuuauuguccaugugugugucuucuuugggaaaaugucuguaugaguuccuugaccauuuuuuaauuaggguguuugguuuuaucgucgaguuuuaggaguuccucuguguauucugggucucaugucuugucagagauuacagacaagacaugucuguaccuuugugucauauccaagaaaucauugacaauuccagugucucgcuuuuagccuguguuuucuucuaacaguuuuaaguuuuagguuuuacauuuagaucaugauccauuguagguugauaauuguauauggcauuuauuucuggauucuguuuuauucccuucuguaugucugucugcaugccaguaccagacuguuucuguuacuguaacuuuguaguaaguuuuggaaucaggaaguguuagcccgccaccuuuguuuuucuuuuucauuaccauuuuggcuuucaggguaccgugaaauucuaugugacuuuuaggauggguuauucuauuucuuugaaaacccuacugggauuuugauaggaauugcauuaagucuauagauugcuuuggguaauauugacauuuuugcaauaguaagucuuccaaucuaugaccacagaucccuucccauuuauuuaugucuucuuaauuucuuucauacauguuuuauaguuuucauugcccaaguuuuuuacuuucuugaugaaguuaauucuucauuuaggaggcucaguguucugaaaauuuguucuuuucgaugcuauaauaaacagaauuguuuucuuaauuuccauuuuagauuguucaguguuagaagaaauacaacugauuuuuguguauugacuuuguauccugcuacuuugcuuaauugguuuaauaauucuaacaguuuuuguguagaaucuuuaggguguuuuacauauaagaucauaucauuugugaacaaguaauuuugcuucuuccuuucuaauuuggaugucuuuuauuucuuuuucuugccuaauugcuuugacaacaacuucaacuauucagcuaguggucauguugaguacaaguggugaaagcagacauacuugccuucuuccuuaucuuagaggaaaagcuuucagucuuucaccacugaguaugauguucacuguguguguuuuguauaugguuuuucuuagguugacauaguuuccuucuauucccaugugcacuugagaagaauguguguucuguuauuguuagaguucugugucucuuugguauauuguguuuguucaucuccucuauuuccuuacuuaucauaugucugguuguucugcccauuauggagaaugugguauugaagucuccagcuauuauuguagaaccauuucuuucuucaauucugucucauuuuugcuacuuaacauuuugauggucugcuauuaggugcguuaauuuuuguaauuguuacauuccuauauugaaccuuuuauuaauguauaauaccuuuguugucucauaaccuuuuuuuuauuuaaagucuauuuugucuguuaugaguacagccacuccugcucuccuuugguuacuguugcaugaaauaccccuuucuguccuucaguuucagcauauuugugucucuggaucuacagugagucucuuguguacagcuugugguuggaacauuuuaaaauuuuuauucugccaauuucugucuuuugauugaagaguuuauuuacauuuaaaguaauuauugguaaggaaagacuuacuuuugucauuuugcuauuuguuuucuuuauauauaugccuuguagcuuuuuuguuccucauuuccugcauuacugucuucuuuggucuuugauuaauuuuuuguagugaaacauuuaacuuucuuguuuccuuugugucuauucuuuaguuauauuuugugugguuaccauggggauuacauuuaacauccuagacacuucuaaucucaauuuguacaagcuuaacugcaauaauauacaaaaccucugccccuuuaacugcucugucccaaccccuuucaguuguugaugucacagaauuacaucuucauauauuguaugcccaaaaacagaaacuaguaauuuuuaaugcguucguuucuuaaauuauguaggagacaaaauaugaaguuacaaaucaaaguuauaauguuagcuuuuaaacuaauaauugauuuucguuauuuaccaauauugacuuuguuuauuaauauuaggcuuauuuauuuauuuauuuauaggcagggucucauucuguagcccaggcuggagugcaguggugccaucacagcucacugcagccucaaccucuugggcccaaucgauucucccgccucagucuccugaauagccaugacuacaggcaugugccuaccacaccugguuaauuuuuguuguuguugcuguuuuguuuuguuuguagagaugggguuucaccauguuccacaggcuggucuugaacuccugggcucaagccaucucugccugccucggccaccugaagugcugggauuacaggugugagccaccaugccuggcuaggcuaaguuuuuuuuuuuuuuaaauuugaaaauguaauggucucuucaaucauguggaaaaccaaaagcagauuuacauaaccauuguuacaauauuacuaacuaguguuuauuauuaccuauguauuuaccuuuacugagaucuuuauuucuucauaugacuuugaguugcugucuaguuuucuuucauuucaaccugaacugcuaccuuuagcacaucuuucagggcaguucuagugauaacaaacucccucagcuuuuguucaucagagaacaucuuaauuucccccuuaauuuugagggacugucuugcuggauauaggauucuuaguugacagguuuggguuuuuuucgucuuauuuuagcagugaguauuuccacccacugccauaugaccuccagagugucugaugugaagucugcugauaaucucauugaggauuuguuguaugugacaagucacuucucuuguugcuuucaaaaaucucccuuuguuuuuggccuuugacaguucuaguauaaugugucucagugugagucuguuggauuucauuauuguuuauugagcuucuuggauguuuauauucauguguuucaugaaaucugagaaguuuuggcuauuauucaaauauuuuuucuacucuuuuaucugucauuucucaugcaacucccacaaugcauuaguuggucugcuugaugaugucucacgggucccuuagguucuguucacuuuucuugaaucucuuuuauuucuguucuucagacucaguacuuucccuuguccuaucucauguucacuacuuuuuuuaccugcucagauaugcuuuugaaucucuccagugaauuuucuguuauuguacuucucauuuccugaauuuuauaauuuuuauuucucuucauugauauuuccguuucguucauacagcacuuucuugcuuuuguucacaucuuuuaauucuuuuuuuuuucuugagacagagucuggcucugucacccaggcuggagugcaguggugccaucucggcugacugcaagcuccgccucccggguucacgccauucuccugccucagccucccgaguagcugggacuacaggcaccugccgccacgcccggcuaauuuuuuguaguuuuaguagagacgggguuucacuguguuagccaggauggucucgaucuccugaccuagugauccacccaccucagucucccaaagugcugggauuacaggugugagccacugugcccggccaucuuuuaauucuuuaauaaagucuuugucuaguagauuugcuaucagguuuuuguggguuuuuuugguuuuuugguuuuguuuuguuuuuuuugacagagucuugcucuguugcccaggcuagaguacaguggugucaucucggcucauugcaaccuccaccuccuagguucaagugauucuucugccucagccuuccaaguagcugggauuauaggcaccugccaccacacccagcuaauuuuuuguauuuuuaguagagacaggguuucaguauguuggccaggcuggucucaaacuccugaccuugugaucugcccgccucagccucccaaagugcuaggauuacaggcguaagccaccacacccagccuuauuuuuuuuuaaggaacaguuuauauugauuuauauuuuuuuuaauaagccacuuauucuuguuuauuuaaacagcacacuugaauuuaauaauuugguaacucugaaaaucagauucuccuucuucuccaggguuuucuuuuuuuguuguuauuguuuuucugauuguuguaggcuaucaaagaucagccucagguguaaacguagggucuucuuagauauuuucugagccuaugccuuccccugggcaugcacagugacuuucuaauuuccuccauacaugugguugguuuuuaauguccuagucuucaaugucuggcucccaaaaggggaaaaagaaaauugaauugguguguaggaaggggaggccuccagcucuuucaaucuccuggaagucaguucagccugggagguuggggugggguuuccaacaaugaggaggagguggaacagcaguauccagggccuguuugcaccuuugugaugagaagcagcauucagagcacagaucuccaguauuuggagaauguaauuuucucugcccaccguggcuugugcaggcgguacacaguugacugagggauagaguguggggagcugcugcugugcuaagccugcaggucacugaaauuaacuacaguucaccuggaaguugccagccuucaguagacuccaaguuccaaaacaucuacaucagacacaugcugccacuaaaauuguguucaagguggagaaacagauuuguggugcuuccuacucuaccuucuuuccagaauccaccccauuuguuuuuacaaucauuuuaaccugcagugaucaccucagucauagcauuuaacuuugaaugcaaugugucucaaauuaggaucuaagaagaauucucuggaguuugugaguuuugcauuggaaaagcacuuguaaagcacuuguucauaauugaguagaggagaaagaaacacuagacaaauaacauaaugaaacuuugaucaaugcugagaaggagaaauacaaugcagauuguaaaaguggauuuucuaaacuauuuugaccuauuuuaaaauaauuggaucuuagaauguauuuuaacacgauuuuuaaaaauguaauauugcccucugaaacuuuguaaggcugcuucagucuguuacagcagcaaucacuacaagauccuuuguugaugaaauagaaugguaaaauuugggugagccaugugcccagccaauaaacuugacuuuuuuuuuuuuuuuuuuuuuuuugagacagagucucgcucuguugcccaggcuggagugcaguggugcugucucggcucacugcaagcuccaccuccuggguucacaccauucuccugccucagccucccaaguagcugggacuacaggcgccugccacgaagcccagcuaauuuuuuuguauuuuuaguagagacggggccaggauggucucgaucuccugaccucgugauccacccgccuuggccucccagagugcugggauuacaggcgugagccaccgcacccggccuaaacuugaguuuuaaaaaguccuacccugggugacagagcaagacuccaucucaaaaaaaaaaaaaaaaaaaaagacuuugggauccuuaaccaagacagcgaguaguagaacagguaacauggaaaaucaaacaacuacaacuaaaagacuuggaaagagucuacgugaaauuauuucagaugaagaaaaagcccucauugcaccuugguucaagugacccuguaaucucagaccugguucuaggucucucuauaccucccucuaccacucagugacauuugaguauagguaaaucacaguuauuauuaaaauucauuuucuccaucugugaaaagauagcaauaccugucuuuacccagggggacugugugaggcucuagagaaguaauauaaaagaaaauauguugcaaaucauaggaagcuauagaaaugcuuauucuguuacuaaaauuuauauaccauuguguauaguuccaacuuggacaacagugaagcucuauaauucacuuagagauuggggguagaggcaguaaaagggcaaggauauuccagaaggaggaacuaaaaagccccuaaauaauuugacccaagcaucgguaauaaggcuuaagaaacauaauuuugcucacccauguuggccagacugguuuugaacuccugguuucaagugauccaccagccuuggccucccacagugcuaggauuacaggcaugagccacugcacuuggcugaaugccaguaucuuaauagcaacccugacccagaguauuucacaacuacuuuagcuauuaaccucuuuaaaacugaguacuuggcucaaagugauuuuuugguuuacuuuuuauuaugcaaaauuucagaaauauucaaauguagaaagaauaguacaaugaacucuauguauacccaucaccagcugcagcaaucaacucguguacuucuauuugauucauaaccccuccuacucccaaccuuccauuguuuuauuuugaaguaaauauaacaccuuauaucauuucguuuauauauauuucaauauuagcgagacuuucuaaaugaauagaaucaaaagguaacuucuauaaaaugaugaugaguugguacugauaaacagcuaacauaauaauuaugguauaaauuagauuuugauaaaaaccaacuuuuuccacugcauguuugguaaaaaaucggcagagggaccaaaaggcuuucuugccauaguguuuuuaaaauguaauuucuuuuguaacuuuaaauauccuauucuuucuugcccuuuucuucuguaauugcuuaagcagaauaaagugaaguuguauuauuaauuuuuuuagcaacguaaaauaccaguuugaguaaucucaauauaccauugggaaauaaguaauuugaaauauucauaaaaucucaaaugucuguaaguuggguagcuuugcuuaaauagcaguuuuauaaguacaauuuuuauuuguugaguggacuuucaccgaauuauucaaagguagacuauuauuuaauggugggacuaaacauaaaguauuauauuuaauuuuauuuuuauauauaaugaaguauuagcuacucauuuuuaacuuacugcuugauguagcccaaaugcauacuguuuaauuuuuuaaccaugaaacuagguugucuuuaagcauuuugucauaucauuuagcugugguacugugcugaaaauaauguguuauuugaaguuugaauauuccccuuuauuaaaagccuguacauuuggaagaaaaugguuauuuuguguuacaguguuacuuuauacagcuuuuauguauaauuccucagguaauugaaguagaaccauuaauguguguaagcauaucuucuaaaguuuguuuaaaggauagucaucuuuuuuauucucugaaaguguuaugugacuugguacuuucauaacuuuaaauaugcagaagaaagaauuuugaggggaauuacaucagauuuuuauuauauuuuucauuuguuauugcauuuuauucuuuaguuucauauacauaauaauuucuaaccuaaccagaaaaccaagauuuuuuuucaauccaaacuuaacuagguguguguuauucugcuuauuuuucuugcuguaauaaaucacuguuaauucugugaguggucuagaauaacuggaaagcagucauugcagcugaaaauaaucggguuuuuacauuaagaguguguuuuuaguuucuaaaaguuuacaauugauuucuuucugugaugaacuuuuuuuuuuccuuguuuaaaaacaguucacuguggggaagaauuuucuccugggugaugaaaugauugaaaucuuuacuguaucuuugggaagagaaaacaaugauuucuaagcaaccuaggaagaguuauugguuacacuaaagaauauucauggguuuuaugagaaggcuauggugaucuguguaaaacuuaagaaaaucauggcugcuuuagcagaaauagcaauuuauuucuuaaaagcaaaucuguuuuaacugcuuauacauaauuuuuucuguuuggugcuggagaaaggauauauuauuuaacauauaaaaagcucauauaagauuauaacuuaagaaauagcaagucuuuccuaugccucuaacauugugaacaugaacauguaauguuuuauuuucuuguuaacacauuuacaauuucuucuuaaaggcaaauccucccccaguacuggucaacacagauagcuuggaaacaccaacuuacguaaguuccauuuccuccccacauugaaguaauucugccuuuccuguuccguuuuuugauacaaaugcgaagaccauggcauuguuuucucuaauacauuucucuuaagauguucuaucacuauauacuauagcuguaauugcuauaguaaauuaaguaguaugguccuccuuuggucauuuuuuuuuccuuuuguaaagcagaaauuuugaaauagaaauucguaauuuaauucagaaauuaugauggcuaacuuucacaaaagguugucucugaccauugguugcuuacacagugccauauauuuaaaucauuuuagaagucuaauugaaugacuagauuuuuaguaaccagguuuuuuuugugcauucauauauacgaaaauaauuaguuauaacuuuguaauuuuaaauugaucagggacaaaaguccacuuguugcauaauuuuauuauaugaaaguuccagaauagauaaauccauaguuacugaaaguagauuagcaguugccaggugguggguguagggcagaauggggagugacugcuaauagguacaggguuuguuuaugggguaauaaggauguucuggaauuagaaaguaaugaugauggcacaacucugugaauaaacuagaaacuacugaauugcauacuuuaaaaagguagauuuuaugauaugugaauaucucaacauaauuuguuaagguaaaaaaguagaaaaaggugaguuaauaacauaaaugcaaauuaaaacaauuaauacaucuuaaacauuauguuaucaaaagagcaaaaaguuugucaguacauucugcuggugacaguaugggguaaaaauauacugcuacauuuuuguugaaguuuaaguggauaaaacuuuagaaaaugccgcaauuucgugauaaugauugagucuaaaaaccauuauuuuuauauuuuuucuuuuguaacuuuuuguauuguauguaagaagccauugcauaauccaacaucacaaagacuuagaguuaaguuuucuucuaagaguuuuaugguuuugcuuuuagauuuuggucuuugauucauuuugaguugauuuuuguauaaugugaaguagagguccaacuucauucuuuuguauguggauagcaucacuguuuguugaaaagacuauucuuuccgcauugaauggucuuggcaaccauauagaaaaucaguuaacuguaaauauauggguauauuucuuuaauuccuuucaauaauguucuuuaguuuucuguguacaagucuuggaguucuuuuguuaaauucacuucuauguauucucucucuuuuuuuuuuuuuuuuuuuuucuugagacaguuucacucugucacccaggcuggagugcauuggcacaaucucagcucacugcaaccuccaccucccagacccaagaugauccucccaccucagccucccauguaguugggaacacggacacgugccaccaugacuggcuauuuuuuuuuuuuuuuuguauuuuugguagagaugggguuuuaccauguugccuagguugaucuugaacuccugagcucaagucauccagcccgccucagccucccaaagugcugggauuucaggggugagccaucaugcccagccaguauuuuauucuuacgaugcuguuauaaauggaauuguuuuguuuauuuuuggaguuuuuauugcuagcauaugggaauauaauugacuuuuagguguuuaucuuuuauccuacaaccuugcugaacucauuuauuaccucugguaguuauguaguuugaauuuucuauauacaagaucaugucacuggcaaauagagauaguuuaccucuggaugccuuuuauuucuuuuuuuuuuuuaauuuuaaaggaugggaaacuucaggauuuuauuuuuuguuuuuuggauuuuuuuuuuaauuucaguaaguuuuuagggagcggguguuguuugguuacaugaauaaguuaguggugauuucugagauuuuggugcacccaucaucugagcaguguauacuguacccaguauguagucuuuuaucccucaccccagucccacgcuuucccgaguccccaaaugccaauguaucauucucaugccuuugcauccucauagcuuagcucccacuuaugagugagaacauacuguguuugguuuuccauuccugaguuacuucacuuagaauaauaaucuccaguuccauucagguugcugcaaaugccauuauuucauuccuuuuuauggcugaguaguauuccauggugugugugugugugugugugugugugugugugugugugcacaccauauauuuuuuauccacucauggaaaaauggguauuugggcugguuccauauuuuugcaauugugaauugcgcugcuauaaacaugcaugugcaaguaucuuuuucauauaaugacuuauuuuccucuguguagauaccuaguaguagaauugcuggaucaaacgguagaucuccuuuuaguucuuuaaggacucucuguacuguuuuccauagugguuguacuaguuuacauucccaucaacaguguaaaaguguuccuuuucacugcauccacgccaacaucuauuuuuuuuuauuuuuuuaugaugaccauucuugcagggguaagguaauaucacauugugguuuugauuuucauuuucccgauagugauguugagcacuuuuccauaugcuugucagccauuugcguaucuuccuuugagaauuuucuauucauguccuuagcccacuuuuggaugagauuguuuuuuucuugcugauuuguuuguuugaguuccuuguagauucuggauauuaguccuuugucagaaguauagauugugaagauuuucucccacucuguagguugccuguuaacucugcugauuauuuuguugugcagaagcuucuuaguuuaauuaaaucccaucugcauaucuuuguuuuuguuggauuugcuuuuggguucuuggucaugaagucuuugccuaagccaauguuuagaaggguuuucugauguuaucuucuaaaauuuuaaugguuucaggucuuagauuuaaguuuuugauccauuuugaguugauguuuuuauaaggugagagaugaggauccaguuucauuuucuacauguggcuagccaauuaucccagcaccauuugucaaauaggguguccuuuccccacuuuauguuuuuguuugcuuugucaaagaucagguggcuguaaguauuuggcuuuauuucuggguuuucuauucugcuucauucuguguguccauuuuuauaccaguaccaugcuguuuugaugacuauggccucauaguauaguuuggagucagguaaugugaugccuccagauuuguuccuuuugcuuaguuuggcuuugucuguggaggcucuuuuuugguuccauaugaauuuuaggaauguuuucucuaguucugugaagaaugauggugguauuuuggugggaauugcauugaauuuguagauugcuuuuggcaguauagucauuuucacaguauugauucuaccuguccaugagcuugggauguguuuuuguuugugucaucugugauuucuuucagcaguguuuuguaguuuucuuuguagaggucuuucaccuccuugguuaaguauauucuuaaguauuuuauuuuccuuuagcuauuguaaaaagggucgaguucuuuuuauuuuauuuuauuuuauuuauuuauuuauuuauuuauuugagacagugucucacucuguuuguugcccagguuggaguacaguagcacaaucucagcucacugcaaccuccgccuccuggguucaagugcuucuccugucucagcccccacccuaccccaccccuuggcccccgcccugaguagcugggauuaaagacgugcaccaccacaccuggcuaauuuuuguauuuuuaguaaaguacucagugcuaccuaaaaagccccuuuuaugugcugcuuagaaaccuacaucaugaauuggcauuaaauuaagcaccaggaauauuuacugagcaccuaccuugugaggaaacuuaaaggugaaaaaucucagauuccuuaaggcagaaaucauaaggucacaguaucaaaauuuuacguuaaugccaaaagggccauauaagcacacucauuuggaaauguuuucgaaaauaaaauuuuagauuauuuagaaauaaacaaaugaacaaaaauggagcucagugcagcuagcaguugugggauuuggccuaauccauaugccaaggaaaauugguaaauuuugagguuucuaaaaauagaauagaguaagcauaaauugagcauucaacucaaaaaucuuuuuuagaaaaucaaaggacuaaagaacuguuaaaaacagaaaguaauaccaugaaauguaauagauucaucaauaaugucaaaacugcuuauucgauaaagacugauagacuuuuagcaagucuugaguaagaaacaagaugaugcaaauaaccuuuagaauaagaaaggggauauugcugcaaauaaaaauuuuacucguaacaaaggacuuccugucaaguagguaagccucccguacucuagaugcacagacaugaucaacacagcucuugaaguuacuccuccuaaacugagauaaagagauuuuacgugugugugugugugugugugugugagagagagagagagagcaagcaagcgagcuccuggucaacauagaccccaucucuaugaaaaacaaaaguaaacagccaggcaugguggcaugugccuguagucucagcuacucaagaggcuaaggcaggaggaucacuugaguccaggaguuugaggcugcaacgagcuaugauuaugccacugcauuccagccuggguaacagagugaaaucccaacucucucuauauaaaugccuuuauaacauauaaucucuaagaggaaaaugucuauagaugagaaagaagagggaacaaaauaguaauaggguuugaaucuaggagaaucacaagaguuaagaacccaaaaggguaguagagaugggcuucaaaaguucucaaggaagaaacuccuggucccuauauuagaccugaauuaagggcuacauuuuauaguaugguuaagaaagcaaaguagcuuauguagguuuuguuauuucucuugcaguuaucuaucauugcauaacaaacuacccugaagcuuaggggcuuaaaagaacaacaguucauuuuuucucauaaugaauuggauggcucugcuuuacaugguguggguuagggcacuugacaagguugggagguccaaauagccuuauucacguggcugauaguugguggugcugacugcugguuaggaguguagcuggggcuuuuggccaaggguuuugguucucuguugguuagaucucucuguaggcuguuugaguuuuacucauguuauagcugcuggguucuaaagaaaauauauuccaagcaaaggcaaauaauacuaucaggcaucagaugaccuagucucagaaaucacacagcaucauuugugccacauuuauuuuagucaaagcuagucacagggcuugccuagaucuaauugaagaggaaagagacuccuuuugaugguagggugauuuaguuauauugcaaaagaaugucuggaauggaagaugugagccaucuucagaaguagaauuuaucacaguccacauuugauuuagauagaguuuugcccagccucauaucacgagaaauuuuaaaggaaggauucaaacccauguucaucugauuccagggacuuguuucaccaguggccuuuacuguaggaguuaacuucuuucaggagagacuaggaaauaaauuggagggagauaaauugugaccaagauaucuugaauggugacugauuuugacauaaaacauguaagugaaauuugugaccgaggaggcacaaaauuccagaugucgaaguggaaaauugcaggauauguaauggaaagagcaagucguucacagaaaggguugguauguaaggccuaugaagaggugaagaaugaagggaaguaguacauuggggucaguucauucgaagacaugauuaccaacccauagaguuuggauauuucuaggaagggagaguugugaaaguuuuagaggaaguauguuaugggcuuuaaaaagauccagcuguugccaggcacgguggcucacgccuguaaucccagcacuuugggaggccgaggcggguggaucacgaggucagaagaucgagaccauccuggcuaacacggugaaaccccaucucuacuaaaaauacaaaaaauuagccgggcguggugggcaggcaccuguagucccagcuacucgggaggcugaggcaggagaauggugugaacccgggaggcggagcuuguagugaaccaagaucacgccaccacugcacuccagccugggcaacagagcgagacuccaucucaaaaaaacaaaacaaaaaagauccagcuguuuaaaacagugauuugggcaguggggaauacuaaucuaagcgauuaggcagacugcauugacaguauuccauuccagaggagguugaacaaggccugaacaaagguauuagaaaugagagugaagaggugaugauuuuccaaaaaauuaagguguucaaaucagaaacaguugguaacugauuagauguguggaucaagacagagaaggaucggagguugaaacuauuaaaagcugaauguaccuauccuggauuugaaagucaugauaccacgaauguugucaacucauuaaucacauuuguauuuuuccauuccuugaaaaucuuccccagaauuauuaaaaugaagcuauuguguuugauuacugucgcauucaacagguuuucauuaauaaaucauacaaaaauuuugccuugccauuuuggauuuuacacucugaaguuucugagcugcuuuucuuuuccccuguagguuaauggcacagaugcagauuaugaauaugaagaaaucacacuugaaaggguaaaaacuauuaucuuaaucuguuguucuagagaacuuuguaauauacugcuuuuucauacagaauccaagggagaucucucaaaaacagaacuauaugauauuuucuaaguucccaguucauaaaauuggccaagguauuuucaaaacauuugccuuuucuuuaguaaccuuauuuuuuuaauaaacuuuuuauuuuacaauaguuuuagauuuacaaagaaguuguaaagauagucccaagaguuuccauuuacucuggauucagccuccucuauuguuaacaucuucuauuacuagaguacauuuauuucaacuaagacaccuguauucauacauuauuauuaacugaagucucuauuuccuuacuuuuuauguuauucucucucagaggcccauccaggaaacuacauuacguuuaguuauccugccgccuuagaccccucuagauugugauaguuucucagauuuuucuugcuuuuuaauuuuguuuauauuguuuauaugcauaugauaaugaaguauuguucguauuaaguaaguaguauacuaguaacauggucauuauaucaauuuucuuuucuagcaaaauaaccauacuucuaacagacagagcuguauuaaaaacuaauuaugguauacuugcccaaucagaaaaugacuugaaggugcaauucagaugugcaaauuuucuuaagauauguuuuucccucaagaauaucugcacucacgccuguaaucccagcacuuugggaggccgaggcgggugaaucacuugaggccagaaguucaagaccagccuggccaacauggcaaaacuccgucucuacuaaaaauacaaaaauuagccaggugugguaacgcagaccuguaaucccagcuacucgaaucaggagaaucacuugaacccaggagucagagguugcagugagccgagaucgcacucuagccugggugacagagugagacucugucuaaaaaaaagaaaaaagaauaucugcauucaguuuuuauuguauguuauaauaguaaugccaccuuaucuggcuagcauuuuauggaaaucuaguguuucacacaagcagauuucuuaaguaacuaaauguguguauacucaagacugaaauccuagauaauuagauuuauuuauauuggaauagaaucugagaaaaauaaaucugagagagucucuuacauguauaucuuuauugccaucuacuuaaauucggaucacuugcucaaguuggguggcuacuggaguaauauucaaguaagcacaguauuaauguacuguacauacuuuaauauaguaguuugugaugucuccuaacuuuuuauauuauugauuuuuuaucuuuucccagggccuuuuaaauuccuuuuguuuaguuaggacuauacauuguauuuuucacugguugaagaacuugaguaccuaaguaauuugguaaccucccauaauccacugguacuguucuuaagauucagguaauucaugaaguuagauugaaaaacauuuuuuuauuaaaauagaauuuuaagacaaauggugguagaguggguguuuacacuguuuaauacuaacaguuaaaugauagguccacauauauuugcuuacuugaguugccugaaauucaguuagaacauucuucaagaaauaaacauuuuuuaauaccauugguuaaaucaauuauuuuuaaaggcuuuuuguagcagucgaacccuuucugugaagaacauauucagaaaucuuguuucuccaguucauaaaacaagcaaaaaguagagcugcuuuggcaaaauuuacuuugcugucaagaaaauucaccaauguuaaguucucagguuggucuuucagucagugugaaacaaugccuuuugcuaaucggguauauugguuaaacaugucagggacugauggcagcuaucacuuagcagccacaauuuggucauuuaaaaauaagcugaugucaaguuagcagaagaaaagcaccaucgccacccccuuuuuuaaaggcuaaaacaguauauggguuuugccuacucagaaauaacagcgggaagaucacuucagcauuugucucuuaggagagaugugcccuaccaaacauggcugaggugcagucuaaaagaaacagacuuacagugacaccucugcagaugggugacuaauccaacgacaaguugcacauacuuuuaaagaaagaacuguggaguauacuucaaaaguccuugguguauuuucuugaaccucaccuguucagcaguaaugccucugaaaggacuuuccuccagaacaaguccauuuaauuuagaaucuuuauauuacucacccauauaccuuuauuuguuguguuccuuauguuaguacaguuucugcguccuuuaaugacaggaaccuguccauaaagauaaaucauauucagucucaauuuuuuuucuucuauccucagggaaauucagggcuugguuucagcauugcaggagguacggacaacccacacauuggagaugacucaaguauuuucauuaccaaaauuaucacagggggagcagccgcccaagauggaagauugcgguauguuuugcgcuuuuuauugugaugcugaauccacuuuguguauuuuucuugaagcagacuggauaagggauaaauacaaauaacaaacacgaucaugauaacuagcauaggguagaugcuuuaacaacauucaagucaaugaaugagauaauuaugcucuaagcauuguguuccuguuuucauuuagacuccaguuuuaucuuagauauuauaacauuuugaauaacaaauuugguugaugguuuaaaucuuugugagcauauuuauagaaaucaugaguuucccuuuguguuuucagauacacucacagaauauuuuccauuuccucucuggcugggaaacauguguauaaacuuauuuaaguacacucacagaauauuuuccauuuccucucuggcugggaaacauguauauaaacuuauuuaagauacggaggauagaggaucacacauccauguugaaucccacaccacaaagacuauaugcaaacuuuaaauaauauauuuucuuauugacuagaugaaaauaacauuugucucuguuuaaauuuaguguuccauuuuggaagauauauuuugcaaacuuugauuuuuugagggucauaaauuaugucauuuuuccuauuuccuuguuuguuguucaaauacccugaaguuuuaggacuaaagaguuuauguagucuguuaaaaacagcaucuuauuuuaaggacguugaugccuuacgcaguuuuugaauuucuaagcuuuauaauucucacuggguaugacaggugguauauuaaugaaaucaaauagauauaaaaauuaaucauuugaccauucauguaaauguagacauuuacuuccugauucuguuagauauagaagcuugucaggaccaguuuuaauauuuuaauuauguuuuguuuacccucucuacccaauuugagaugaccaucuuuuuuuccugguggaauaccaugcaaucaaagagaccagaacuagggaaaaggcuaagacuaggaacaaaucagacuuuuaaaaaacauaacaccauggcaaauuauaaguucuuuaccuacgaaaccuuugaauuaagugaccuaaucuuuauauaaauuucaaaaaauaacuuaauuguuuuaugucuaauauauagguuggaauaggcacucagaaaauuauuuuuacuuuaucucaguuuucacacuaucucugugaccuuaaacucgugaugugagccucaguuuucuuaucuuugaaucacagcucugucacuuauuaucuggguggccuuaggaaaguuauuuacauucuuugugccucaguuucuccaucugugaaauagggauuaaaauauauauuaagcuuacaggugucaugaggguuaaaauaccaagaaagugccuggcaugugguuagugcuaaauaaauguuugcuauuuuuauaaagugugucuuaaugccuacacagaauaagcaugcaggaaguaugcaaaugguagcuguaauuauuauuuaacauuuuuauauaaucuauuauuuucacuauuucuuuuguuccuuuugcuggcccuugggaaauguuuguauuuguuuauauuaguuuuugauauacuuucuucauuuauguuuucuggaauuacuccagaauuauuuauaauucucuuuaccuuaaaaaagaaguaacaaaaaauugguaaaguggaaaauuuauauuuaaauuauauuuaauuuuuauuuuuaauauuuaauuguuuucucagggucaaugacuguauauuacgaguaaaugaaguagauguucgugauguaacacauagcaaagcaguugaagcguugaaagaagcagggucuauuguacgcuuguauguaaaaagaaggaaaccagugucagaaaaaauaauggaaauaaagcucauuaaagguccuaaagguaugugguaagucaaacuaagauaaaucuuuaagaaaucucugaguuaaauauaccuaugaacuuuaucugugacauacauuccaaguacaguauuaguaauauucuacagaacuugaguggauuuuaauuucuccguuauuucuacugauuuuugucuuacguagcauuuuagaauauuuacauuucuaccaagauugcagcauuugaaaaguuccuuuuuuugcgggguuuuuuuguuuguuuuuuugaggcaggguuuugcccugucacccuggcuggaguccaguggugcagucauggcuuacugcagccucagccuccugagcucaagcgauccucccaccucacccucccaaguagcuuggacugcaugcacacaccaccacacugggcugauuuuuuuuauuuuuuguagagacggaggccucccugcauugccuaggcuggucucaaacuccugggcucaagcaguucucccaccucagccccgcagagugcugguauuacaagugugagccacugcaccuggcccaaaauucuuacguuuauugauguaugcuuuuauacauuuuacugcagugagcauauauauaaauuuauaaguuuuuuaugauuuuuauauucaauauuugcucagcauguuuuuaagaguuuuuaaaaguagggaacaaaauaucuauuuguuuuauaaguggauaugucccuauuuguauuaaguauucuuauauugaagacuucuagcauuaaaagagugaaauauuuguguccuugaacacuuugaaguuuaguauugcuauuaacuugugauaaucuacaaaauacuuuaaaugcagguacacaggcuaaguuaaaagaagaaguguuuauaauauguauuaugagcaguuacaucugcaguaaaggacuguuaagaugugauugcugaauuuuuaaaacauugauggcuugaggauaaauggaaauaguaguuucaauauguggcuucauggaagagggaggaugucaacaaaugaaaaaggaauggagagcugagaaauuaucugauauugaagcuaugggauuuaggaauuacagaaauuccuuacuuaaaauuguuaauucauagaauauugaagaagaacaaagguauucacauuuuuaaagccuguugguucugcccaccaucaccagacaauguuguuauuucuucucaauaauuuuguucuugugaaaauauuaaaaguguagguaagcauaauuaugauggaaacaaaaguaaaacauaauuucgcaaugucacuuuggaauaacaagugcauuugcgaaaagauacuaagaaggaacaugugggauaaaaggaaucuauucguaacucuaggagcagcuguaugucuaagugucccuugauugcagaacauauacuaguagauaacuaaauagauucuuuucuauuuuaaaaaauauuagugugagggaauaauuaccuuguaguuuucaaccauuucuuucugggcuuaaguucauauuuauggaugagaaucuagaacuguuuuccaaacaggucuuggguuuagcauugcuggagguguuggaaaucagcauauuccuggggauaauagcaucuauguaaccaaaauaauugaaggaggugcagcacauaaggauggcaaacuucagauuggagauaaacuuuuagcaguaaguauaagaaaucuauugucuuuuaaaucauuuuguagucuguuuauuuuucugauagauacuggaauuucuccauaccaaaaaggucuaaaugauguuuaaauuagcaaauacuagccuugcuguaucaaauccuaaaaaaugauucuugguaauucuuuauuugucauuucucuuuucucugcuagcuccuccucccuuuuccuuuuauuccuuuguuguuguugagggcuuguaugcacagaguguuucaucauaauccuuagguuuauaaaacaaugucaucauuuguuuaugcaugacccuuuuuuauuuuacuucacuuaauaguauaaugaaaccuaguaauuacccagcccaagaauuagaacaucaaccauuuuguguuucuuauuccuuugcuucuuaaaaauuguuuaaucaggccgggugugguggcucacaccugucuguaaucuuagcacuuugggaggcugagguagguagauugcuugagcccaggaguuuaagaccagccugggcagcauggcaaaacccugucucuacaaaaaauacagaaauuaaccagaccuggugauauacaccuauagucccagcuccuugggaggcugaggugagaagaucaccugagcccaggagguugagguuacagugagcugugauugucccacugcacugcagucugggugacagagugaaagcccaucucaaaaaaaaaaaaaguuuaauuauauacauaugccuaaauaauuuuguuuaguauuauuuguuuugaagcuuuuucaaaacacuauugcacuguaugagacuuucaucuccaguauuuuuuucacucaauauugcuuuacugagacuuacccauaucauugcuuagagcuaaaguucauucauuuuaucucuacauacuauuccacuguaugucuguacugcaauuuauuuguccagucuucaucaguguauuaguuuguuuucacacugcuaugaagaauuacccgagacuggguaauuuauaaaggaaagcgguuuaauugacucaccagacucaggaaacuuacagucaugguggagggugggggaaagcaaacacgcccuucuucacaugccagcaggagagagacgugccagcaguggaaaugccagaugcuuauaaaacaaucacaucucaugagacucacucacuaucaagagaacaucauggggagccaccuccgugaucuaaucaccuccuacaaggucccucccccaacacauggggauuacaauucaggaugacauuuggguggggacacagagccauaccauaucaaucaauaacugucucaguccauguuccuuagggaaacggaaucugaagaaaagcuaaagugcuaagguauuauuuggcugugugaucucaagaaggcuagagugaguaaaaaugaggagugaagcagagaaugaacgagagccaauagaagguagaaugugucugagcuggcuguaauuuuauaagguagcuuguugcuugucauguauaacagucuucuaggcagacacuguaaaaaccauccgggcaucauaaaccuuacauccagccauccagagaaaagaaagaaagguuuaucugcuggcccuuuuauucuccugucucuugucuacccccuagggguuauuugucccaagcuuuuggauuguguuacccaacuccccugggcgcaguuucuagggaagccagcuccuauacuccauggcacaacacuucacccaagcccaaaaaugguagaguugcagugguaugacaggucaaacauagguuugugacauguuauggcccucacuguguggaacacaucagccaugcccagucccagccagaagaggcucagaaaacugggaagggcaggagacaagaugaaaguaguauaauagucaggacucuccacugagcaagcagccaaggccuagcagaaucugaaaaggcacauaaacuggaucuggcauaguaggaaguugguuuuuaaaaauauacuagcaaguacugguuuuuaaaaaucuauuuuaagucuuuuuuuuuuuuuuuuuuuuuugguauuaugaauaauuuuccugggaagagcugcuguguguucuggugaacauguacaagaauuuuacuugacugucaugggauuauugauuauccuacuaguagcauucuuuuuaaaaaccauccuguuguuuuccaggcugcuuguaaaaauuuacaucagcaauauauaaaagauuccuuuguucuacauccuguuuaguacuguuuauuguugcaaggagacuuuuuuuaguuaaugauggcgaaaaggaaagagcagaacuugaacuauguuucucuaacuuauccuuucacagcuaagaucaccacucuuuccucaaacuauaaccaguaccaucucaccaucacucaucacucacacacaaacacagucaagacagccuucuguugcacuaguuuucucaguuuuacuuuuuaauuucuuggcuaccauguuuuccuuuaugguuucucuagaacuggcuuuggugguaggagacagcaaccugugcugauaccauuguggcaagucucucucuuaaaucaacuuuuagugaggcuuuuguucucuuaauuacacuggaaucauucaauucucaguccucaucuuaauugacuuaucuggcuggaguuugacacaccuuccuccuucuaacacuuuuucauuugccuaauagucacccuuuaucuugguauuucucuucuuaguagccacucuucauucugucuuucugaugucuggugccuccucauaucuguaaccucuaaacauugaaguaauccagaacucacuccuuguccauuuucuccuuuuuacuauucacucccaaggucacuguuucuuaauguguagaagacgacucugguagauggucaaauaacuuuucucuggcguaaaacuuugggaucaucaucuuacacauuucacauuaaaucccucagcaaauugugucagcucuugugucagguaucuagugauaugugagaaaacacagagauuaauggcuaaaaaacaccacucauguauuuguuuacaauucugcagauuggauagggcuuggcaggaacaacuugucuuugcuguacuaggccacaaaauccacuguuagguuggcugacacauauggugggcaaguuggcucuuagcugggaacucagcugggacuguuagccaggugcuuaauuauccaguggucucuuugcgugguuagggugaguuucacacaggaugguggcuagguuccaaaaguaagcuuuccaaagaagacaagcacugguacauuguuuuuaucaaucuucucuuuccuucacaacuacuguaccucauuggcuaaagcuaguuacguggacaagcaaaauucaguguagaaagagauuuuuacaagggugugaauaccaggaugcauggcuuauuguaggccaccaaagaaacaguauaccacagcuauuuaauauguauuucagcaguauaccacagcuauuuaauguguauuucagaaguauaccacagcuauuuaauguguauuucagcaguauaccacagcuauuuaauguguauuucagcaguauaccacagcuauuuaauguguauuucagcaguauaccacagcuauuuaauguguauuucagcaguauaccacagcuauuuaauguguauuucagcaguaugccacagcuauuuaauguguauuucagcaguaugccacagcuauuuaauguguauuucagcaguaugccacagcuauuuaauguguauuucagcaguaugccacagcuauuuaauguguauuucagcaguaugccacagcuauuuaauguguauuucagcaguaugccacagcuauuuaauguguauuucagcaguaugccacagcuauuuaauguguauuucagcaguaugccacagcuauuuaauauguauuucaaaaugcaggcaguccuugcuuugcaugguaauguggagccauaaaaaugaccaugcugcugagacucugcaaagcaauguuaaucaucagugaagggaaauuauuauucugugaccuuuacauuuuuuugugaaaauauuaaaaacugcaauagucaacuauaaagguacaaauuaggaaaaagugaaaaauauauuaaaguuaauauuguuaauacaugguaauuuaaaacggaaacauugauaauguuuuacuuauuugcaaaaaaaaaaaauguaucaaagagaagaacaauccaaaccuaaagcaaacagaaggguggaaauaauaaagauuagagcagaaauuaaugaaauagguaauagaaaagauguaagaagacagacaaaacugaaaguugguccuuugaaaaaaaaaucaacaaaaugacaaaccuucagaccagccaagaaaaaagagagaaggcugaaauuucugaaagcaagcaugaaagagggaaaacaagagacuauuaugaguaacuaugugcuaauaccugagguaacuuagaugaaauugacagauugcuagaaagacauaaacuaccacuucuaaucaguguuauaguugagauucuauccagggcaauaagaaaagaaaaagaaaaagaaaaucagauuagaaaggaagaaauaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagcugagaucccgccacugcacuccagccugggcgacagagcgagacuccgucucaaaaaaaaaaaaaaaaaaaaaaaaaaagaaaggaagaaauaaaacuauauuugcugaugucaucauauuguauauagacuauccuaggaaccugcuaauagaacuaauaaauuaguuuaguauugguugcaggauacaucacuaccuaaaaaucaguuauauuucuauacagaagauaggugaauggccaaaaaauaauugaaaaaaaaucaacuugaguauuacgaaaguagaaauuuaaaacuaauugauguauaaauuaaaagaugcaucauuuuacagauuuuuuaaauuaguugauaauguuuaauguuggcaaaggucuaaguagaugggcacucucauauucugugguagugaguauaaauuuacuaaaaccauuuaggagaacaauuuaaauauuugugcucaauuguguucuaauaguuuuccaaucuaaauaugggaauauuaacagauaugaucuuuaauaaauuaugauauagccacacaaugggcuacugugcagcuguuuuguuacaauguaguaauucuauuaauuugugucccaacauggaacagucucuaagguaccuuacauuaaaaauccuaacauaaaaacaaaaauuuuaguauguuuucauuucuuuaaagauaaaaaugucuaaaacgcauccacacacauuccuaaaugccuaagaaugagagaaaaucaagacugggagaauaggagguauggagacuggaaucaagaugggcuauucuguuaacauucaacgacuucacaugucaugauaaacaacuuacugagaucauagacaucaaacauggguauuuucuuucggcauaccuuuauuuuccuuaaaccacucucuuauuuucccuuucuuuucgugaaauuguuuccaaaacucagagaacaagugaauaugucauaaaugucuuuugggacuuuuuuuaggugaauaacguauguuuagaagaaguuacucaugaagaagcaguaacugccuuaaagaacacaucugauuuuguuuauuugaaaguggcaaaacccacaaguauguauaugaaugauggcuaugcaccaccugauaucaccaacuguaagucuguuagcauacguuugcuuaaauuuaucuuacuucuucaguugugaugccauuagugaaauguucucaguauaauaaaguuuaaacauuaugcaaauauuuuuaaagaaacaauuaagcauguuaaucuacucauuuuuuaaaaucuacuuuaagucaaaauuuuuauaauuagaagggggggauccuuuucaccuuuauuauuuuauaguaguaguuacauuuaaaggauuuucaaacuuuuauguaaguaacagucacuaaagaacauuugcaaauauugaaauuguuuuguucuaaguuuuccacuugagcacagaaauuugcuugaacaagccguucauucuauuaacaagcaaaguacaggcauaccucauuuuauugggcuuugcuuuauugcacuucacagagacuacauuuauuacaaauugaagguuuauggcaauccugaauugagcaaauuuaucagcaccuuuuuucuucagcaacauguucucacuucaugucucuuaaugucucugugucacauuuugguaaaucucgcaauauuucaaacuuuuuucauuauuauuauaucuguuacaguaauaugugaucacuagucuuugauguuacuauuuuaauuguuuuggagugccacaaccacacucauauaagacagcaagcuuaauagauaaauguguguguucugacugcuccucugaugacuagucauuccccuaucucccucgcucuccucgggccucccuauuccccaagauacaacaauauugauauuaggccaguuaauaaaucuacaaugaccucugagugcucaagugaaaaguugcauauuucucauuauaugucaaaaagauuuaacuuagugaggaaggcauguucaauggcaauaaagggagaaagcuagaccucuugcugcaguuagccaaguugugaaugccaaggaaaaguucuugaagaaaauuaaaaguacuguuacagugaacacacuaaugauaagaaagcaagacaaucugauugcuguuguggacaaaguuugaaguggucuagauagaucaaaccaaccauaagauuccuucaaaccaaagccuaauccagaacaagacccuaacugugcuucaauucugaaaaggcugagagaggugaggaagcuguagaagagaaaugugaggcuagcagggguugguucaugagguugagggaaagaagucaucucuauaacaugaaagugcaagguaaagcagcaagugcugcuguaggagcugcagcaaguuauccagaagaucuggcuaugauacuuaauggaaguggcuacaccaaacaacaauuuuucaauguagaugaaacagccuucuacuggaaaaagacaccuuuuaggacuuucacagcuagagaggauaagucagugccugacuucaaagcuucaaaguacaagcugacuuucuuguuaguugcuaaugcagcuggugauuuucaguugaagccaaugcccauuuaccaguccagaaaauccaaggaauuaugcuaagccugucugccuguucuguauaacuguaaugaaaccugugcucuauaacugaagcaacaaagccugaaugacagcauaucuguugacagcaugguuuacugaauauuuuaagccaacuauugagaccugcugcucagaaaaaaacaaaaaaaaaacacuccuuucaaaauauuagugcucugagacaaugcaccuagcugcccaagagcuaugauggcagugugcagggagacugauguuguuuugaugcuuacuaacuugucauccacucuguaguccauggaucaaggaauaauuuugacuuucaagucuuacuauuuaagaaauacauuuuauaaagcuauagcugucauagguagugauuccgcugauggaucugggcaaaguaaauugaaaaccuucugcaaaggauucaccagucuagaugccuuuaaggacauucaugauucaugggaggaggucacaauaucagcauuaacaggaguuucaaagauguugauuccagcccucuuggaugacuuggaacaggucaaaacuuuaguggcagaaguuacugcaaauugguagaaauaauaagagaacuagaauuagaaguggagccugaagaugugacugaauugcugcaaccucaugauaaaacuuuaacaacuaaggaguugcuucuuauagauaaucaaagaaagugguuucuugagauggaaucuaauccugguaggugaagaugaugugaacauuaucgaaacggcaacaaaggauuuugggauauuacauaaacuuaguugauaaagcagcaguaggguuuaagagaauucacuucaguuuugaaagaaguucuacuguggguaaaaugcuaacaaaccagcaucacaugcuucagggaaaucuuuuguaaaagaacgagucaguggauauggccaacugcauuuuugucuuauuuuaagaaauuaacacaggcaccccacccuucagcaacuaccacccucaguaucaaggcuaucauuauuaaggcaagaugcuccaccagcaaaaacauuauaacuugcugaaggcugagaugauugcuagcgguuuuuuuuuagcaauaaaguauuuuuaaauuaaggccuguacauuguauuuuuagacauaaugcuauuccuuacuuaauauaguguaaacauaacuuguacaugcacugggaaaccaaaaaauuuauaaugacaggcuuuauugcaauauucgcuuuauugcugugguauggaacuguaauaucucugagguaugucuguaauucugagguuucuggugcugcuaguucauggccugcacuuugagaaacacugauuuacaauauaucuaaaauuaaagggauuuucuuugcucuuagguacaugaggagagauacuauuuaucuuuguacuuucagguucuagugcuuauauuuguaugcaguucaguuguguugcaguugauuaaauuguucuuaaaguacuuacguauuuuuagguuucuuacuuuauauauauauauauauauauauauauauauauauauauuuuuuuuuuuuuuuuuuuuuuuuuuuuuuuuuuuggagacagaaucucgcucuguugcccaggcuggagugcaguggugcaaucucagcucacugcaaccuccgccucccagguucaagcgauccuccugccucagccccccuaguagcagggauuacaggcuugcgacaccaugacuggcuaacuuuuguauuuuuaguagagacgggguuucgccauguuggccaggcuggucucaaacuccuggccucaggugauccaccugccucggccucucaaagugcugggauuacaggcgugagccaccgcaccuggccauuuuauauucaguuuuuuaaauauauaagcugagaagagauuuaaguauauuuuuuaauguguuuguauugguggaaaaaugaaaucuguauuuguucuuugcauugaguuaauguuugaagaacccguaaauaauaaagaucuuaaacguacuggguauaaccugcuuuugagugcuccuuuuuuaaauuguagaauuuuagaaauauuggugauuuuuaaaguaacagugcuuccaauuuuagaacugucaagauucauuauauuacuaaucauuaucaguuaaaaacaugacauuuugaaaucuacauacugcccuccaguaauguaucuucauuaucugcucauugauuuauuaauugcucaaguauaauugaauuauuuccuuaauaguauuuaaccugucugauguacagggauggugucuuauacuucuuuugugucaaagaaaagaaccuugcuacuuauuugaaauucuuacauauacuuccucuagcacauaaacuuuauauaaaggcuuuguguauuuuuuaaauaaugagccauuuuauucaucaauucaaguaucuuauuuuaaaugcugccuaucuaauaaccaugugcacauugugacaguuguuccacgaauugaguauuagugcccugauuaugauuauguuguuuuuuuuuuuuaagauggaguuucgcucuuguugcccaggcuggagugcaguggcgugaucucggaucaccacaaccucugccucccagauucaagccauucucuugccucaguagcugggauuacaggcaugcgccaccacgcccugcuaauuuuguauuuuuaguagagacgggguuucuccauguuuggucaggcuggucucgaacucccgaccucagaugauccacccacuucggccucccaaagcgcugggauuauaggcaugagccaccgagcccagcugauuauguuacuuuuucccccaucuguuauugaacuaauaaagcauuaugaaaaagcugacauucaccuugcaguuucaacuugaucauaauauuuugcuuccagucccuucccuucuuaggcaacuguagauguggguuucguuguacacuucugcauaugcaauucauaaacaaucuguuuguguuuuuugaaaagcacuuguguuuaaauuuuuuuuacauaagugaguuuuacuugucaguucuucugaagccugcacagucacccugcugucaggcuauucagcuuacucucuaucccuggcuguggugaucugguguucucuucaucagucuggcuguagucacugaagacuuuagugcgaaggcccauugucguuuugccacuguuacucaugcugucauuccuggucauguccaaaaaccacacuaaugauucauccaacacccugacuuuuugguuucuucaucucuuucugacuauccugcccuccacuucaacucaguuacuugcuucuaagauaauacuuuagauuuuguuaucuauaauuauuaacuuucaucaccucuaaaauaccaguuugaucaucccauugugugacuacaacccucaguucauucaccucuauucuagcaauuccaucucauuuugaccuucagucauuugacauuauuauuuuguugccccuugucucaauuuuucuauuuguauuagcuuagauuccaugguuucucauguucacuucauugcacaucuucaaguccuuugcccccuucuucuucgcagcagaaucccccaacacuggugcaggcaaacucugcuauuucauuuaugguuccuaaaaagcagaaccauggagaaaagcacaaaauucugcuuuuuacguauggccauaaaucauagauagugccuuacucuugccugcaguccuacuacauuucccuaauucacucucccacucuaaagaauuuuucucuccccucaaaccuucacuugccaucuacuauucaugaaugaugaucucacuucauauuucauauaagcacccagaagagaauuuccuuauuuuuccacuuucagauauaccuauguaauuauauuuuuaccccgaaacucgacuuucacuuguguuuuaaugggagucacugucauuguuccuguugaaaaccaggucuuccauuuguauacugaaugucauuguuuguugucugcagagaaucuuguucuugcagcugucccuucucucucuugcauaaucaaauccucugucuacuggaucauuaccaucagcacacgaacauguuuacauacuccuuaucugaaggaaauaggagggaucguccuacagucuuaagauaccucucuaacacugcuccuuuucucugcuuaauaucaccgagagcugauuuuccuaccauguuaagacuucuucacaucaaaaaggaaaaaagccaggcacaauggugcgugccuguggucccaauuauuuggcaggcugaggcaggaggguuguuugaacccaggaguuuggggguuauagugcacuauuauugcaccugugucuggccacugcacuccagccugggcaacauaaugagacccaucucuuaaaaaagagaccaggcacgguggcucacgccuguaaucccagcacuuugugaggccgaggcgggcggagcaugaggucagcagaucaagaccauccuggcuaacccagugaaaccccaucucuacuaaaacuacaaaaaauuacccgggcaugguggcaagugccugcaguccccacuacucgggaggcuaaggcaggagaauugcuugaacccaggaggcggaguuugcagugagcugagaucgcgccacuguaguccagccugggcgacaaagcaagacucuguaagaaaaauaaaaaaacauacccaguaaagaaauggggaaagucuauaaaaagauucuuuuaccugagacaggaucucacucagcugcucaggcugcaguggagugacacgaugauaguuccuuguagccuugaauuccugggcucaggccauccucccacaucagccuuccaagugucuaggauagcaugcccagcuaauuuuuaaaauuguuuuguagagauggggucucacuauguugccuaagcuccuaaccucaagugauccugccucagugcccccaaaguguugggauugcagauaggagccacugcaccugaccucuuuauuuaauuuuuaauugaauuaaaacauauauucaguaaggguaccaauuuuaagaauuuagcuuaaugaucagucacauggcuuuuuaaaacugcuauguauuauuccauuguauaaguguacaacaauuuuuuucauuuuacuguugagucacuuacaguucugaucuuuuaugaguguagcugcuguggauguuuuugcacauccuugucagacauaagcagucauuucucauggagugagguugcuguguuacaggguaggcauauguuuagucuccagcggauacugcugaacaauuucaacaguauaggaggcaauuaagaccccaguuuuucuacauccucaccaacccuugguauuauccaucuuuuuaauuaugaauaguauguauauguauaaaguuaucucaugauuuuaaugauuauuauuuauucauuuauugcugguuguuccugaugauuaauuauuuucagcauuuuugccugugcuuauugcuuugacucuuguucaaugcaaugucuguucaaaucuuuuuacauuuuuccauugguuuuauuauugauuuaaaggaaguuuuauguauuugagaaauaacucuaaucaguuacaucuguugcagaugucuucacugaguuuauguuuucccucaaaacaaugguacuuuuugauggauaaaauuuuuuaauuccuuaucagucuuuucuauuaagguagugcuuuuagugaccuguugaaauuuuuccuauccuuaggucauaagggacuuguaggagcuuuauuauuuugccuuucacauuuagguccgauccauuuugaucuaauuuuugcauguaaugagagauuuuuuaauaugcagauauauaauugaucuagcaucauuuauugaaagaccauuucugccacugaauugcauuggugcuuuucuuuuaagugaccacauauauaugaaccuauuucuaggcucuucuguuucauugaacuauuugucuuuguaccaccugcagucucuuaauuaucauaauuuuauaauaaauauugauguaaaguaaaucuuaauuuuguuacuguucaagauuauguugggucuuugaauuuccuuuuuaauuuuaggaucaaaaacauuacagaucgguuuaggaagaauuaaauugaguuucuuaaucaguccauuaauaugaauaucucuucuuuuauugaaguccuucuuacauucucucugcaguguuguauaguagagguuuuauauguuagauuuaguccuggcuauuugauguuuuucaugcuauuauaaauguacuacuuuguaaauguuucuaauuuuaacugauauauaggaaauaucuguuuuguauauuaauugcuuagucaacaaucuugcuaaauuuguuaauguuagguuuuauaggucuuucagaucgucuacguauauaaccaugucaucugugaacaaugaauuuuacuuccuucuuuccuaucuuuauacuguucauuuucuuuuuucuugucugaugcauugguaagaccuccaguucaguguugaacagaaauggugauaauaaauaucacugucauguucacaaacugggggacacaguauuucaccauuguauaugguguuaccagcaggucuucuguagauacccuuuuuguauuaagaaaguuaaucuuuauuccugguuuauggggaguuuuuauccuguaaguauugaauuuuauccaauuauuuauggagaugauuuuucucuuuuauuuuguuaacgugauaaauuacauugauuuucuaacgcuaaaccauucauuuguggggggaaaaaacccacauccuuauaauauauauuauauaucauugauuuugaacugcuuauauuuuguuuagguuuacaucuguguucacaagcaugaacuuaacgauaguguccugaaauuuuucugucuuguaauguuucagaauguuauuucaucucuagauguuuuguugaauuuuccaaugaagcuaucuaucugucuggcccuggaguuuucuugggaaggauuuuaguucugaaugcauuuuccuuagcagacacaagaauguucagauuuucuuucucuuguuaccuaagaggacuagauaacauuugauuuuuuuuuuuuuuuuuuuuuguggugauugucaagcauugauggaggggauguuucucacagaggcagccuugcaagugagcagaugucaaaauuggaaaacaauuuuuguacuaguuagaaaaauauuuuuagcaagaauaguaaaagaaauagggaagaucauagaaguuauacaugaacuauagaagauaaagagccacaauguuuauaaccaaaauaagguagucaaaauaugauacucaggaauaaaaguaggaaaaaaaagaagucuguugaaucuaacagagaauacaguuucucugccgacauuaaaauguuccuguuuuuuacaguauauauuuucucgcuuuuaacuuauauucucuuuagcugcauggccuugcuacuucugauuuggacaccagucuuuucccauucucacuucaagcucuucuacuugcuuuucuauaaaaucuuauaguguugaaucauucaucuuaauauauaagaaaaaugaauuaggcacucuugugcuucucugggggaccuuuuuacauaagauuugggguauaagaaauaguacuguuuuaucugauccuucuuugaggccgucauuucuuucauaggaacauuaauuuuuagucucuguugucugagaguaugugguacaugugagauuaacugccccagaaaggaugcauugacuaaagggauagucuggaugugucagggaaaauguauauuuucugguuugggcauuugacuggauuucuugucuaguuguuuuuuuuguuucaucuaaauaugaaaaugcagcaaaagaauuuaagagucaaaaaucaguaaacucuggauuuuuaacaggcuagugauuguagagguucacguggguaucuauugauugagggcuacauaccaauucacuugaaaaucccauauucuuacugaccacccaggaaagacuuuggacuuucaaaguuaagagccauugguagaaaguccuuuggcucaaauacaaacgagcaucuuauauaugaacuggauaggaaacaauugcuguuggauacugcaaaccuguaauaucaauagauacacugcaucucuaaaauacuaucguuucagucauuuccuguugucuuucauccaguucacuuuauuccuuuauguuaccuaucuggccacuauaguaauuugaacuaauaauuccugcauuuuuguacuccagugcguaguaugcugcuucccuccauagaagauaugcucuaauuuaauaaaaaagagauuaaugcuugauaauuaaauaauacagcuacuuuugaagugcuuuguaacuuuaucauaguugaagccucaagaaaguuaaauauugcuuccucuguguuuugguaaugauuggaauaauucaagugucuuaugucuuuguaagcuacagcugccauguguuaccuaccugugucuuuagaaagcauggucaggaaucacuauaauuuucuguuauuagcuuuugcuagaauggaaaaccuauaugugguauuuauuacuauugaagugaaccaacguuugguuuuugcuuuuuuuuuuuuuuuuuucuuucucgagacagggcaucucacucugucaccuacguaggcuggagugcagugaugcgaucucggcucacugcaaccuccaccucccagguucaagcaauucucccaccucagccucccgaguaagugggacuacaggccacaccaccaagucuggcuaauuuuuguauuuuuuugguagagaugggauuucaccauguuggccaggcuggucgcgaacuccugaccucaggugauccgccugccuuggccucccaaagugcuaggguuacaggcgugagccacuacgccuggacgacaguuuuugcuuguuuuucguuuuugcuuuuuaccagguuuuuauucuucuaugggugaauuuaaaagcauagauguaaauuagguugacagaucugagcuaguauaaggacauagucuuuucgcacuuauuggaaagccucugauuuuuauuauucacaaucaaauuuggacuguauauaauucuuuaaguaaucugggugugguggcuuaugccuguaaucccaacacuuugggaggcugaggugggaguaucacuucaggacaggaguuugagacuaaccugggcaacauaauguccaguuuuuuggcugaugaguaaaucuucucuaccaaauucugauauauaaaggagugcauauaaauuacacauuaaucacucauaaauggaauacugauuggcuuguuucguguuugaaguauuuuucacuuuguuuauuuugaagcuucuucucagccuguugauaaccauguuagcccaucuuccuucuugggccagacaccagcaucuccagccagauacuccccaguuucuaaagcaguacuuggagaugaugaaauuacaagguaaggaaguuaacauuuauccuucuuacauaaaaucaacuauuaaauugaauuuuaaucagccauguaagauagccacaauuuuuaggacuaaaaaauuuuauugacaguuagugagcuuaaagguuaauuuuuuuccauaggaggauucauugaagagccugaaauauacauguuuuauuuuuacaaauaaauuaccacuccuuuuuuaaaauuaauacugcuuuucuuugaggcuugguaaauuguccuuaggaauuagcuuaguaaaacuaaguuaagaaaauucuuaugcauauuuuaaaguaacauuuuauauguuccuuaucuaauauauaccauaaaaauauggcaguuauuugauuuguguucagaauucaauaaguggugguuugguuugguuuuagcaggagggucuuacucuguugcccaggcuggagugcagugcuaugaacguacaucacugcagccuccaacuccuagacucaagcuauccucccguaucugccucccuagguacuaagauuacaggcgugauccccuuugccuggcugguggguggguuuguuuguuugcuauauauccuugauauucugacacacaaaauuuacuuucaucuaaaauuacuaccugcacugaaauguauagauuaacugucuuuuuaaucccaaagaauucuaaugagguagaaaaaaauuggugaaaaagcauuguagaucuuuuucauauuauucaauauaguaauaagacacuauagaguuugcuuuguaauuuguacacgucuuuuauauuacagauucaacauuaaaauguguacuaaguaaugucuguucuuaacguuuauugauuacauuauuguuagcauuauuauuauuuuuuacuuaucagacuccugauucuaggcagugaucuuuaggacagauaggaguguuugucucuuuucuuucauaaagaauuagcaauguuggaaacuuaauagguugucaguaauuguguuugggaugaaaauuagcagaaagaauaguguucuuauuuguuugugaugggaauauccaaggcugcuagucuucaggcagugcuucuagagugaccuuucauugccauuuauuuuuauuacuuucuaauagugccuauuuaaggccguaaagagggaaacuguaauagugaauggcuuaucuagucuuuaaucucuuugcauauuuuacaaacuaaaaaauaaguuauauuugcaccuugauuacuguuccucaugcuucuucacuugagucucuugucuagaauauugcauuggacuuuuaaguaugaaccacucccuuuugauaaucacacuacuuuguaauaaugaaguauaaaaucuuuccaacauuauaaguucuucacaauuugacuuuaagcagucuuucagauguuaccaauaucaaaaaaguaaaaaaaaaaaucacaacauaccuacauuuugguucuaaaguuuauuuuuuaacagcuuuauugagauaugauucacauaucauaaauuucaccuguuuaaaguauacaauuugugguauauuacaucaguuuuuaaaaauuguagcgaaauauauauaacaaaauuugacauuuuaacuauuuuuaaguguacaauucaguaguguuaauugcauucacaauuuucggaacccuucacuauuuccaaaaccuuuucauuacuucagacaaacucugugaccauuaagcaguaauucucccuuccacugucuucccagccccugguaaccuuuaaucuacuuuuugucucuaugaauuugccuauucuggauaguuuauaaaaguggaacuguauaauauuuguccuuuugugacuggccuauuucacuuauguugucaagauacacucauuuguuagcauguaucagaauuucauuuguuuuuaugacaauacuguucaauuauacauauaugccacauuuuguuuauucaucuaaugaugggcacuugaguuauuuucaccuuuugguuauugugaguaauucuauaauaaacacuggcaugcaaguaucuguccaaaucacugcuuucaguuacuugggauauauaccuaaggguggaauugcugagucauaugguaauucuauguuagcuuucugaggaaccaccaaacugguuuucguagugccugcaccguuuuauauucucaucaguaaugugugaguugcaauuucuuuacauccucaucaacacuuguuacuuuuuguuuugugguuuuuuuaauagccauccuaguagaccugaaguaucucauuauuuuuauaucucuuucccuagugacugaugauguugagcaccuuuucaugugcuuacauuauuugaaaaucagaguguauuuuccccuggaaauacuguugaauuucagcugaguauuuuuuaaucaaguauaauuuccuaauauaaaauucuaauucauacauauuuuaaagcauaaugggaacaguaaauccggaauucaccaucuaauuuaggaaauaaaacaucacuaauaugauaaaaccuaccugugccccugcagauagguuuuaauuauuucauauaaaaagccugaagaugggcauuuccaagguugguauagcaaccuuaggccuguggugucuucgguauacucuugguuucaccuuccugauuauaauauguccaaaccaguaaagggauuguauuauucagucgugugggguuuuguuuauuuuguuucguuuuuuugaggaaaggaagguagcaaagaugcuuuguccuugauaagguuugucugucucuagaaaaugacaauaaaauuucccuucauuuaccagagguuagaaugggguuauacucucaccucagcaaaggggcaugggauugcaauaacuuguuuagguugguuaugguucaucccuuugagacuggagaaagggccugccuucucuaagacaaaaggauaccugccuuuuaaacuucuaaguaggggcagugauugcuuugaaggcaauaaagugugcaacaucagcuuuucaugaguauguguauuuccugauaagcucuuauaauacuuuuaaauuuccacguuuuuuuucuguuuugguuucauuucuguuuuauauaacacagguuuuuugcuuuuauauaaaauuagauuuuuuccuuugauuuguaggcuuagaaucucuuuaucucguaguuuuagaaaaaccauuuauauuuugucuagcuuucuuuguaguuugauaacauaaaaauuaucaguagguaguucucacugauagaaugucagguuuuauauaaaauuuccaagauacucaauuuuuuuuaauuuuuagggaaccuagaaaaguuguucuucaucguggcucaacgggccuugguuucaacauuguaggaggagaagauggagaaggaauauuuauuuccuuuaucuuagccggaggaccugcugaucuaaguggagagcucagaaaaggagaucguauuauaucgguaagacacguuagucaagaucacguuuuuguuauuuucacuggaccuauuuuuaaagcaaggucuucuguuuuuuuauauccuaaaguaauggggauaucuugguuaucuucuuaacauuuuacagcuuaauuguagaauuguagugucagagaacauauuauauaauagguguucuuuuauagaaaggggucaguuuuuauaaaugugcuugaagaaauuauguguucucuauuuauugacuggaaaguuugcuaugugucuauuaacucaaguuuguuacuuguguacuucuuuauacuuuaaucuguuaccuucuugaucuauugagguuuugaaagcuauccaaauaugauuuuuuuaaagcuacccaaacauggguucaacaguugguccucauagcauuagguuuuuuuaguaugucuuuugaaauuguauuauuggguacacauaguuuuauaguuguuauuauguaaugaacaucuugauuuauaauagugguuuuacccuagaaucuauauugucugcuauuaauguggcugauuuuuuuuuuuuggcuugauauuugugucaucuuuucuccucuucuuacuuucaauuugugugcuuauguuguuacccauacacaauuuuugucuaaaacuuaccuauaguucuacugugacacacagacuuugggaaacuuuaauucuaaucaugccauuucuaguauuuuacuucuguuucauguuuauacccauaaauuguaauuuuuauuuuuguuuauuaaaaguuaauccacaggucauacaauuuuuguuuaccgucccaucuuguaucuucccucuucuguguuucucaguggaccacuaacagcauuuggauuguacaguuauuuguuguauaggacugucuugcucuucauagaaaauuucccuuuuuuuuuuuuuuuuuuuuuuuccuugagauggagucucgcucuguugcccaggcuggauggagugcaguggcgcgaucuuggcucacugcaagcuccgccucccggguucaugccauucuccugccucagcuucccuaguagcugggacuacaggcacccgccaccacgccuggcuaauuuuuuuguauuuuuagagacgggguuucaccuuguuaaccaggauggucucgaucuccugaccucgugauccucccaccucggccucccaaagugccgggacuacaggcgugagccacugcaccuggccgaaaauuucccuuuuuuaaaagcuuucauauacaugcuacaugcuaguaaaacucccuagucauuguaaaaagcaaaaaugcccuucagauaucuaaaugcaccuuagugugcaagcccuugauuugugcuuucagcaaugguuccuuaaucguaaauauucuagacuuuaucugaaaguaucuuuauuuuauuucacuuuaaaaguuaguucaaucuagaauuacacagguugauagcuguuaccucucaguauuuugaagauacuguuuuauguugucuggcguguuguuucuauuuaacgaaagaagucuacucugucuuguucguaggugacuuguggggguuugcuggcugcuuguaagaugcuuuguguuugaugugcugcaguuucacuaaaaugugaaacuuugucgaugucuagcauauuauuuauuguguuugggauucauuaugccuacugagucagaggagucaugucuuucaucaauucuaaaaacuucucucaucaauucugaagacuuagccauugucuuuucaaauuuugccuuucccauguuguauguacucugucccuaaacuccuaugaguggaugugaaucuguuuuucaugucuguuaaccccaauuucauauuuacagcucugucuccuuguaauucaaguuuauaaauuuucuuuucuuuuuucuuucuuuuauuuuuuaagagacagggcuucagugcauugccuaggcuggaguacaguggcuauucacaggcacaaucauagagcacuauuauagccucaaacuuacgggcucaaacgauauuccugccugagccucccaagaagcugaaacuguagcagcuucaauuuucuuaucuauaucuaaucugaaacuacaucuuaucuauaccuuaccuauaacuguaucuuaacuauaucuuaucuauaucuaaucugaaacuauagcagcuuaaauuuucuuuaucuaaucuuaaaagcuacgauuuuaagauacagaaauugucggcuugguucaaaaaagcaagaccaaacuauauacuguuuaucagaaauuuacuuuaaauauaaagguucauggguuguaaguaaaagugaaaaaagguacacuaugcaaauagcauacuaaagcuacugucuuaauaugagacaaaauagaauuuaagacaaauaauguuauuauacauagauuucauaauuauaaaagcagcgagaaagauaaaagugucauuucaucaagaagacauaccuaguaauacuuucaaaauacaugaaguauaaauuaucagaacuaaggaaggaaauggacaaaucuacagucacauuuggagauuuaaaugcccucuucuuuaauugauagaacaaguagacacaaggaaaagaagaagaaucucauuucuuacuucauguuguauagaaaaauuaacuugaaauggaccauagaacuaaacuucuaaaagaaaacauacaagaaaaucuuaguaaauauggauuagacaaauuucuuaaauaguaccagagggccaccaagucaguucaauagagaagggaaaaucuuuuuaacaaauggugcuauaauaccuagauaucuguauauaaaauuauaaaccuaaaccagucuuacuccagacauaaaauuuaauucuagauggauuauagaucuaaauauaaaacucagaaccauaaucuuccuagaagaaaauaucagagacuauguucacaggccuagaguagguaacaguuccuuggacaaaaugcauaaaacacuaaccauaaagaagaugacauuaagaaaccaaauacgcugggugacgugacucuugcuuauaaucccaguaacucaggaggcugaggcagguggaucgccugaggccaggcguuugagaccagccugaucaauauagcaagaccccaucuuuaaaaaaaaaauuuuuuuuuaauuagccagacauaguagugggcacuuguagucccagcaacuugggaggcuaaggcaggaggaucacuugagcuuagguguuugaagcuacagugagugagcuuugaucccaccacugcacuccagccugggcaacagagcaacacccugucucaaaaaaaaagaaagaaaaaaaccaaauaggcaagccacacagugguaaaaaauauucucagcacauacaugacauacuacuuguauccacaauauauaaauaucuccuacaaaucaacaauaaaaagaugaauaacccaauuaaaaaugcaccaaagacuugagcagguacagcacaaaagauaugugaauggccaguaagcacaugaaaaggugcuuaacauuaggcaucagagaagugcacaaaccgcagugaaugaagagguuuguagggaguugaauaagagugauguaauuguucuauauuuugauuguggguggcugcacgaaauucacauuugccaaaacuuaacuauacacuaaagaagauugauuaugccuagauaaaaauagguauucuugaagucguaaugaaauacuauaucccacuuaguugaacaacaaaagaaaaaaauaacaacauucauugaugaggauguggagcagcuacaacccucauucacuacuaguggacguguaaaugguauaccacuacaagaacuuuugggaagguuuuuaagaaguuaaacauacaucuaaucuuaucacccagguuuuacccaggacaaaugaaagcauacaucaacaaaaacacuuugacaagaacauucuuaacaaccuuauucauaauaaucuagaccuugaaaugacccagguuuccaucagcaggacaauugcuaaauugugguauguuuacacaauauaauacuacucagcaauuaaaaggaacaacuacugaaacacaaaacaaguauguugagcaaaacagauaacaaaaauacaaucuauauaauuccaguuacaugauaaucaagagcaggugacacuaacuuguggugcuguaagucagaaagugguugccagugauugggacugacuauagaagugcacaguugaacaucgguggaaaagauacaugucuugucugggguagugguuucaugauuuuuaugguuagcaaaauccuuucagcugagcuguucaaauuucuacauuucauuguaaaauauacuguaauuuauuuaaguuacaguaugauaaggaaaacuuagugguagggaauggacuuaaaagauuaauauuguugaacauauuaccuaguuauuuagggaaauaaaauuagcuuagagccucacuucacacuuuguguccaaauaaauuuucguuuagccuagaguucaguaauagauguuuuuaaauugucccuuuggaaccacuuuagauaggucauugauacagugcuaaagugugugagaccaaccaacucaaccuaguucacccagaacauucaugguuuuagaacugaaugccccaugucuggaaacccuuuggucuugauucuaaaacuggaagucucagcuaguccagggaaguagcucacccuaaugugagugcaguuaaauacagcauuauguuuagcaauaugcaucaguaaccuuaaaauuuuaaugcuuacugaacuucucuagggaaaugcccuaaaagcacuaggaaauaguagaccgaucaauaaacuuaaaaggaaaauuggaggagugaauucuccauaaggccuuugaaaaccuccguguauccuuggaaccagaaggccacacacauguucagggcugugcgcaugcucaggaaagacuagaaaaggccuuaaacucucaccucuaccugaucaugagccucugugcaagcgauuuaaggcaguuguuaauugcuuaucugaguguuaaaggugggccccaaaaugcacauauagcccuuggaaaagaguggaagauuuguaaguuucagguauuuaaggaaauauguauucagucauuaaccacuaagcuaaccagacagagaccucaguggccacacacaacaaagaauacggacuuuauaacauuaagaaaagucacuaacagacagcaaugacaagcguagauaagaggacaguucugcuaucuggaguugccguauuauauuuauuuuaaaugccuauuuuucgucauaaaauuuugagacaagcggaaagaaaaguauggcccauauacaggagaaaaacgcaaucaauggauaucguuccuagggaaggucagacauugaacaugcuaaacaaagacauuaaaccagguauuuuaaauacguucaaggaauaaaagaaaaccauccuguagacugacaugaaaguaaaggaacaauaucucaccauguaaaaaauaucaauaaagaguuagaaauuauauguaagaaccaaauagaaauucuggaguuggaaaguacaguaacuuaaaugaaaaauucucuagacaaggucaacagcagauuugagcuggcagaagaaagaaucagcaaacuugaagaugggucaauugagauuuugaugcugaagaacugaacaauaacaaagaaagaaagaaugaagaaaaauuaacagcuucagagaccuaugggauacuaucaaauuuaccaacauaaugggaguaugugaaagaugggaaagagagaaaaaagaagaaagaauauuugaauaaauacucgcccaaaaacuucuagaacuugauuaaaaccauuaauccaagaaccucagugaacuccaaguuaaauuaauuuaaagagaucuacaacauagacacauuacaaucgaacugucuaaagccgaaggcagaauauugaaaguagcaaaaagaaaugacucaccacgugcaagggauccucaacaagguuaauagcugauuucucaucagaaaccauggaggucagaaagcagugaaauaacaaauucaaaauucugaaaagaaaaaaacuuuguugacuagaacucuauauccagcaaaacuaucuuuugaaaauaaagaagaaaucaggacauugccagauaaacaaaagcugaaggaguucaucucucaaaaaccugcccuauaggaaauaagagaauccuucagacuaaaaugaaaggaaacuagagaguaacucaaauccacaugaagaaauaaagagccuaaguaaaggcaacuacacagguaaauauaaaacaacauaaggguauuguuuuauaugcaacucuuuuuuucuccaaccugauuuuaaaaacaacugaauaaagcaauaauuacaaauuugaugugcacacaucguauaaacauaaaauuaauaugacaacaccacaaggcggguaaagaaacuagguucuuauaaaauguuuguuuguuuacuuauuuauuuuuagaggcagcaucucacucugucccccaggcuggagugcaguagcacagucauagcucacugcagccucaaacuuacucaggcaauccucgugccucagccucccgaguagcugggcugcagguaugcaccacuacaccuggcugaauuguuuucuuuauuuuuuuagagauaagggucucacugugaugccuagccagcccucaaaguguuguacucaagugaugcuccugcuucaguccuuuugccugagccaccugagucacugggauuacagucuagaaccaccacaucuggcuuuaaauuuuuacuuauaauccaagauaaccacuaagaaaaugacuaacaaauauauguaguaaaauuaaugacaugggaauuaaaaugguacacuaggaaauaucuauuuaauauaaaaauaaugcaguaauugaggaauagagaaagaaaagacauagaacaaauaaccaaauuaaguaaauucuacauuaucaguaauuauauuaaauauaaacagauuaagcacuccaguuaaaaggccaaagauguugauaaaguagauuagaaaacagaauccaacuacacagggucuacaagagagacacuuuagacucaaagacacaaaaagguugaaaguaaacggguggaaaagaugcauuacacaaaaaguaaccaaaagacaccuacuguggcuguacuaauaugacuaauaucaaaggacgcuugaagaaaaacauuauuacuaaaggcgaaagacauuuauaguauaucauuauguagucauagaugguauauauuuuauaguuauauacucuaauuaccaauacauuucuagaaagacauaaacuacugaaacuaacucaagaagaaauagagaauuuuaauagauuuaaaacaaggaaauugaauuaguaaucaaaaacuaacaaaacacaaaaaucccaggaccagauggcugcacugguacauucugccaaacauuuaaagaauuaacaccaaucauucacaaacucuuccccaaaaaggaauaagcaugaggaaugcuuuccagcucauucuguguggccaguauuauccuuauaccaaaccaaagacaucacaagaagaaaaaauuacaaaccaauaucccauaugaauauagauguaaaaaucaacaaaauaacaaccuggauccaacagcaugaacaaggaugauguaccauaaccaaauggaauuuauucaaggaaugcaugguuaguucaacauagaaaaaccaaucaaaguaagacaccaucuuaauaaaggacauaaagcacaugauaucucaguagacacagaaaaagcaauugucauaaaccaacagcuuuucaugauaagaacacuaaauagacuaggaauaaaagggaacuucaaccuguuaaaggguaucucuggaaacccuauagcugacaucauacuaaauggugagagacugaaagcuuucccucuaaaaucaggaacaagacaaggguaucugcucuuccuacuucuauucaacauuguccuggagguucuagaaauuaggcaagauuaaaaaaaaaaaaaggcuaccagaauaaaaagcaagaaaacuauuucuguuugcagaugacauaaucuuguauagaaaaaaucuuaagaaauacaacaacagacugucaagcuaauaaaugaguucaguuaaauuugcaggauagacaaagaaaacauugauuuauaauacuaucaaaaagaauaaaauacuuaaguauaaauuuaaggacauggaucaacaaaagugguauauccuuuuuuuuuuggguuugguuuuuuuguuuuuuguucuugagacagagucuugcucugucgcccaggcuggagugcaguggcgcaaucucuguucacugcaagcuccgccucccagcuucacgccauucuccugccucagccucccaaguagcugggacuacaggugccugccaccacgcccggcuaauuuuuuuguauuuuuaguagagacaggguuucaccauguuacccaggaaggucucgaucuccugaccucgugaucugccugccuuggccucccaaagugcugggauuacaggcgugagccaccacaccuggccaguauauccauuuuuaauggauuuuaguggcgcauuauuuagcgccacuaaauauaaggaaugaaguacugauacaugcuccaagggugaaccuggaaaauaagugaaagaagccaagcacagauggcuacauauuauauaucccguuuauuugaaauauaccgaauagguauauauagguauauguacaguauggucagaaaguagcuucguaguugccagggauggagaggagacacaggagugacugucaguggauacagaguuucuuuuugggguaaugaaaauauuuuggaauuaggugguaaugaugguugcacagacuugcaaauauaccaaaaaccacuaaacuauaugcuuuaaaaaugugaauucuaugguaugcgaauuauuucuccauuuuuaaaaaugucgguguaaaagaaaaaaagugacucuaaggcuauuuauacaaguaucucucucaguacuggaauuucuucuaaaauauccuuaauaauguaucuucaauugaaauguucagugauagucuggaaagucuuuaauauguaguuuuguucaacaaauuaugcucuuaaaagaguuuggugcacagaaauaauucauuaacauucuuaaucuuuucuacaauaaucugugaaaaaccugucuuucuuuauauuucuugccugauauguucucccaggaauugggaggauuuucuuuaugcacuaaguagaacuguuuauacauuguauugaguuuuauauggccaucaucagcuggagauacuaauaaccacauuguuuacauuuguuuauguuauggauuuuagaucuugguuuucauugagggggguggggggggcuggcuggagacagagcgucccucucucugucacccaggcuggaguacagugaugugaucucagcucacuguaacuuccgccucccagguucaagugauucucaugccucagccuccugaguagcugggacuacaggcacacaccaccaugcccggcuaauuuuuguauuuuuaguagagacagguguuugccauguuggccaggcuggucugagacuccuggccucaagugaaccacccaccucagcuucccaaagugcugggauaacaggugugagccaccaugcccagccucaagggguauguauuuaaauuuaguugcauaaugguuucuuuuuagauaauauaaaacaucagaucuuuauaugguuaaaauguucuuuauguaaauuuaugaucccaagaauuucugggcucauagucaaauuuuuuaaaagugauaugugaucuuuaacagauuuuagauuaguucucaacaaaacaaguuuuuguguaaaaauugcaugaugaucguuccuuuccaaaaauuuucagugaagguccugaacauugccauauucuauucauuguugcuucuuaauuuuuuuuaauucgguauuuaaaguuuauuacauucaaguauaaugcuuccaugaauguccucuuaaguuugucuuauuguggaaaaggaacaaucucuuaagauaauguaccuugcacuauauauguauauaugcgcgcaaaguauugguaaccuuugagaaauaagaauuaaguugccucuucuucuggaguaggauuguaccuacugguagaauuggauaauuauuucaccuaaggaagggcucuuaauucaaaaaauaacuccugguucauuuaauuaacauuuauucuaauuaaaucaguccuugaaaucugagcuguuuuaauauuucuaaauaauagcuuuccuauuauaccaaaagaauggaaguuuuaguuuguacaggaagaaaaauaauuggaacugaauugagcaguaggcgugagaauguggcaggagguaaauggaugcuacaagcaaaaugacuuucccucccauugcuugaguuccuagcaaaauaaagugugcaaaaugaugccacuugauuuuucagguucucaaauuaagguacauuucucaauggauugauacccagccuucuaggggaaaauguuuugguuuuacuaacuugacauuaagcaaggugguuuuaguaaauaaaauagcuuugaaugauaauauuuuguuuuacuacacaauauauuuuuagucaaucagaacaagaaacauuuuagugguaaaguuauugcaacuaauuuuuuaauacaugcuuacucaaagaauagacuauugugauuucuaaucacagugauucuuuucucccaaauuaagauuugguuugauuuacagguaaacaguguugaccucagagcugcuagucaugagcaggcagcagcugcauugaaaaaugcuggccaggcugucacaauuguugcacaauaucgaccugaagguaauaacauucuuauugucuauaguuauugcuuauuuuaguuuuuaaaauucuuccucuuuaauauuuaauaauguuuaacuuccaagcuaaacuuccuuuuuugugcuuuuuuucugauuugcuaauccaguauuuguuuagucugaaccuaguucuuuuuccagaucaaaaguuguuuguuuuuuugguuuuuuuugguuuuuguuuuuuguuuguugagacgggguuccacucuuacugcccaggcuggagugcaguggugcgaacucagcucaccgcaaccucugccucccagguucaagugauucuccugccucagccucccaaguaacugggauuacaggcaugcaccaccauaccggcuaauuuuuuguauuuuuaguagagauagaguuucuccauguuggucaggcuggucucaaacuccugaccucaggcgauccgcccaccucagccucccaaagugcugugauuaccggugugagccacugcacccugccaaaaguauuuuuuaaugaugugggaacuggcauccacaagcuuaacccacaaaacccccauuauguggguuaauuuaacuguuuacuuuuuuaaaucuguucuguaacugaagacauagcuuuuaaugucccuuuuacuacuuuauugaucugaaaaaauaauaaaaaccauaagcagauauaguaauaaugcccaaaaaaauuaggucacccagauuuuuucuagcuuuugaauuagguuauaauuauuaauaucaagauuuaagacauguuucuaauagcuguuacugccgcuauuuaaaauaaagagaagaaugccaaguuuggaguauacugugugucuagauggugaaguaugguggaugugacuuuacuaaguuccugggggaagaagguggugauggagaauuugaggucaugccauaguaaacauauguaagacucuaguguacaucagcauaaccacaucuccaauaaaaccucaguggaauuuagaaagcuuaaauacccaaaagaauacauagcauauuuguugaugcucauaaacaacaugaugaauaaggaaaagaugaugugaguaaaggagcuaaaugaguaauucuguaauuuaucaacuaauuacauuuauucuuuuuugaagcagaauuucuuuuuuaaucuaguauguuuuuuagcugaucaaagcagcauguugagcauugcuuggucuuucuuaaguaugggagguucuaucaaucuaguaaaaccuuggccuuuuaggcuuaguaacuaaacaggggaaaauuuguuuaauugggaguaaauucugaauauuaauucacauuaaccaaacaauagagacuaacguaugaagucagaaugucaauucguuaauuuuugugagaaacaaaucugccaaugggacccuauguuguacuuuuaucuucuggccaacauauuccaccccguagguacacuauauggaagccgaguuacagucacugguuccuuaguauuauagacagccucucauuuauauguuuauaaggaauauaaacuuuuuagguaugguuacggguaacuuaauaucugcucccuaaccucaaaacacacagaacacacaaaagcaguaagaaaaacaaaacauacacgcaugcuccuacccacacaacuucacuuaauauuaacuaaaacuaagaaggcagguaugauaccuggacaaccaaguagagguaaagacuccuuaagcagcugaggucuugcagaagccacacggaaagaggggaagaguuaaaauauggaauguugagaauguuugugauggcacaaauuuaggauaugguauaaaauuucacucauaaugugguuugguuuagaaaagcagaggacccguauuuggauaaagcagccugccucuguaggaucagauaaugugacaguauuuggguuuuaaaaccuguaaaaauguccugugccucuaucuuuccugcaccccucgacuuucuggaauagcuacucuagcaaaaucuagcaaaguaauaaguaauuuuuuuuguuuguuuuaagauggaguuucacucucuugcccaggcuggagugcaguggcacaaucucggcucacuguaaccuccgccucccagguucaagccucccaaguaggugggauuacaggcaccugccaccacgcccggcuuauuuuuguauuuuuaauagcgacgggguuucaccauguuggccagacuggucuccugaccucaggugaucugccugccucggccucccaaagugcugggauuacaggcgugagccacagcccccagccccaguaauaaguaauuuaaaaguagccucacauucauacaaagauaauaagagguggggaaaagcaucaaagcuuaguaacagguuagcuacacgcacacacaacacaaaaacauuaacacaaaucggauuuuaagaaguacaaaaggagucauccgacacucugauaaucagcaucuugcaguuaguaucuuuccuaaaggcuugggauucucugccuuguugauaaucuuauauauauacauacaagacagacagauagagacaaagguaagcuuuugguagaauuaaguuuuuuaucuuucaggaucuaugguuugccuuauuagucuuccaaaaaaguacuuuuauggguuuuucagcuuguguacuuugaacuuucuugacuuggauucugauuaugagaaaaaauaaucucuacaagacauaugaaggaacauuaucuucuaacuccuuucaguuuuauuaauuccaaaggcaaggaauaauucacuuuggggggccuuuacuguuaaucuuuuuggagaaucauuaucagaaauuagcuggacgugguggcucaggccucuaaucccagcacuuuggaaggccuaggugggaggauuacuugagcccaggaguucgagaccagccugggcaacauagcaagaucuugucucugcuaaaacuuuuuuuaaaguuuuuuaauuagccaugcgugguagugcgcacccguagucccagccaaggcaggauugcuaugaucucaccacugcacuugagccugggcgacagagugagaccccgucucaaaauaaaaauaaaaauaaucgaacaugggaacuggaaauauaauacuauacucguuuuggacuccauaucccaaaguuauaaaguuuuaucacauacuuccuauaguuuaagaaucucuuggccaggcgcgguggcucacgccuguaaucccagcauuuugggaggccuaggcgggcagaucacgaggucaggagauagagaccauucuggcuaacacggugaaaccccgucucuacuaaaaauacaaaaccaaaauuagccaggcgugguggcgggcaccuguagucccagcugcucgcgaggcugaggcaggagaauggcgugaacccgggaggccgagcuugcagugagccgagaucacgccacugcacuccagccugggcgacagagcgagacucugucucaaaaaaaaaaaaagaaucuccugugauaguauauaauaguaaaacuguacgccaugcaugauacgaaccauguuauguuuauucacucuuuuaacucccaagauaauccuguaaguaagcaccguuauccccguuuuacguuguaguugaauaagcucuuccauaaagagaccaaguaauuugcuaguuacacaacuguuaaacgguuaagauuucuucuagccccuuuuaagcgaagaaaaaccuuuuccuccacccuuguauguucaguaacgggccugugaaguaaacugacaaaaaaaacagauuaacauggaaaaaaaguuucuuguauauggaugcaagaggcaacagaagaaauacugaagcuagcuuguggaugaaguuaaaagcuuguacaccuaaucuaguagggaaaggaaggagggagaaacagcuuuuauuagaaaaacguacauuucuucaggaaagacaaguuuuuaggagaagagaugggggauaaaguuugugaugacauuugucuaaacugguaugacuggucuuuccauucuucggggccaucagacuccucagaggguauuuaugguaacuucauuucucggaagcugcaccuuuuagucagauuagagaaacuccgagaaggcuuuuuuccugcaucuguugaaucucagauaucuucagcuuaaaaucuuuguggcaacucugggguucugggugggucuccauacccuguucuuacucuuucaacuacucauuaaacucuuggaaucucucaccucaaauauuuaaucuuauuguuccucaagaguauuaggccaacuuucagagcuuauaucucaaucuuuuguucagaaagcauuaauuauauuguaauaauaccauaaaagaaauaaauuggaaagaaacucaauauauaaguuaaauuuauuuucucuuucccauugguuaggucuuauauuugugacauauuuuauuuucgcaagaaaaaaacuguuugguggcauaaucccuauuuugcaagugaccagagucuagagagguuaggccauagucacuuaacuuuucugcgcuucaaagcuuugauugaaaucuugaguuacaaagguagauuucuaacacccaguguccugacuuuauuuucauuauuacuucuuauaccaaccaaagggagaagagguggagauaaucugggaagauugcaguggacuaguggcauuuauuugcagacauuugucauuucuuaucauuuucaguaguagauagguaauuaaaauuuuuuucagucuccugcuuucccacuucccuugcuguauuuuucuacgcgccugugcugcaguugacccuugaacaacacagguuugaacugcgaguguccacuuacgcacgugcuguucaaccaaacugggauagaaaaugccauaugccugucagauuccacaaggccuccuguuagacuugaacaugcacggguuuugguauacgugggguucuggaacuaauccuccgaguaugccagagagcuauuguacuuaaaacaacuaacuggccuucuuaaaaauaguuucccuuuuucuuuaggccaauuaauaguauccauccucugagaauuguuucucuuggguuuaauaucuguguuuaauguauuuuauuacaguuauaaaugaauguuuuucuuuauagggauugcauguuaagaagagauugaggaaguccaauuucccccauaccccuuccucacuuuuuacuucuaguguggcggugaaaacaaagguuaaaauuugaaaggggauaucaaaugaaaaaaucagcuuuuaaauaucucuccuuguauaagcguauacauacuaacuuguagccagcaguucagauacguccuaauacguuucaugacaagaaauaugguuugauacaggaauuuuugagauguugaauggagaaaaucucuuauguaaaauuauagcuuugcugaguuuugauguaauucuaggagaggaguguaaaugacuuaacugaaaaaagggaugaaacucuuccgucaaaauaaaaauuuaagaaaauagguguagugguuagcacuucgggaggcugagacaagaggaucacuugagccuaagaguugaagauccccuggguaacauaggacacccugucgcugcaaguaauuuuaaaaaugagcugggcauagugaugcaugccuguaggcucagcuacuugagaggcuaagguaggaagauugcuugagcccaggaggucagagcuacuaugagccaugaucgugccacugcacuccagccuggaugacagagcaagagccugucuccaaaaaaaccuuaaaaacaaaacaaaaauauguuggugggaguauuuacgaaaauauacacaggauagguaaaauguggagacugauaggacuaaaaguaucaauugauugaaacaaaaggaaaagguaggaaucuuaaguagguaaaugaaauagaagguuuaaaggaaaaguaacuuuaaaaugccgaaguauguuuugaacauauagaaagguagcugugaggaauuguuaagaguaaggcaaagacuuggccaggcgcaauggcucacgccuguaaucccagcacuuugggaggccaaagcaggcaaaucccuugaaagcaggaguucaagaccagccuggccaacuugaugaaacucugucucuacuaacauaaaaauuaaacaggcauggugguacauaccuguaauuucagcuacugaggaggcugaggcacaagaaucacuugaacccaggaggcagaagcugcgaugagccggaauugcaccacugcacuccggccugagcaacagagcgaggugggggcgggugggaagacucuaagcaaagacuauaaauaugaagaucugaauacagugaaagaaauagaucacaaauuuaagaaauuaucaggaauugacuuagcucuucaguaucuuaaauuuuuaauaucugagacuauguuaacugcuuuguaguaacuuaguuacucauuaagaaagaauauuuuucugcaucacuaaaaaguaauguguucuuuuuacacagaaagcuuuuaaauuucuaaaauguagacuaucuuaaaucacuaggacuucuauuaaucagaucagcaaaauugcuaaaaacuaauaaugcuacaugaaauguaauacacaucuuauuuaaaaagcauugcagaacuuuuaaggaauuagcaaacaaaacaugaagggaaacuaggaacucggaacucagggcuaaggaagcagagaagucucuuuuguuucaagagcaacagcguacgggcuugggagagccaguuaaauuuucagauauuuuucaaacuaaaacauagccuuuauuaaaaauaaaauuauacagaaauacaaauaaauuauauuuaaaauaguaaaauuaaaaacaaagguaauauugaaaagucaucacuuccuaguuguuuucuaggaaguaaaauaauagaaacauaaaccagugagacuaacagaaaauacaaaaagaggguugggcgcgguggcucacgccuauaauuccagcacuuugggaggcugaggugggcgacucacaaggucaggaguuugagaccagccuggucaacacggugaaaccccugucucuacuaaaaauacaaaaauuagcugggcgugguggugcacgccuguaaucccagcuacucaggaggcugaggcaggagaaucacuugaacccaggaggcagagguugcagugagccgagaucgcgccacugcacuccagccuggaugacagagcgagacucucucucaaaaaaaaaaaaaaaaaagaaaguacaaaaaaagauaguagauuuaaaacugaaucgcccaaaacuccuccucucccucaaaaaaauuaggaaagccaaaccaaaauuuguuaaaaaucuacaauaaaacuagacaaaaagaugaaagauauccuaugaaccccaaauauaagcugauguaaacaagguauuaacagcuacaagaccaucugauaucagcaucugugcaaggggaugcaacaggagaagcccaauguuaaccaguccucacaagaaaaugcaguagguaaauuugagaacaccaagugaacuauaagaguuuuuguacaaucugcauguugagugcaaggaaucuacacuaagauaugaaggggccacgagcagucugggcccuaugacacaguuaaccagcuguaguucccuuuccauuuaaagccccacacuaaggaagaacugcugggaauaaaauccaaauugaguaggauagggauaauagagccaaaggaaauagaagguucagauuaauggggguaaguaaaguuucaggaaaucucacagugucugaggucaugucuuuaaacacuugagagaaacaacaaaauagagaguucuagagcugugaaguuagaaaaccuaucuugacucguaacuccuauguaaaaguuggggaaaacuaauuucauauuaaaaugagcaguaggaaaagaucacagucaaauccauggaaaccuauuugaaaagugaaaauaaggauuagcguaaugucuccacagucaagcuguaccagaaagacauauaguuuaugaagcuaguguaaaauaaaauuaauauuuugaaacaaagaaaaaugauagaguaugucgaagaacaacaucaauaaguugauagaacucagaaaauuaguagaaauaaaaacauuguuuuaaaaacuaaauuugacuaaaagagacauacuuccuuaaaccaagaaggugaaaaagaagaaaaauuuguaaagcaaaaauagaccuucucuuucuacaacuugaucaauuuaguccuaaagccauuauguagaggagagaaaaauaguuuaaucuacaccucacaucuggagagguuuaggagauuuucgguggcccauuggacuuacccaugagguuggcuuccaugcaggguaaugccuugguuucaggagucagagccugagggcuggugaggaaagcacauaugggaaugcucagagcccagucagggaaguggauggcuguucaaauucagauugaccaaauuaauauauauguuagguuauuguuauucauaauuuucacuguugagaagagaguuacaaauauggaagggaagaaaacuuaaacaugaauccuguaauacuggauuagaacugaagaaguugguuugaagggaugguuuuccauugauacagauguaaacauaaauaucuacgucaguguguauguaucuguguguauguuauuuucccuggcucugcccacugagagggccugagccuagugccaccccaagagcagugagcaccuagcauccagaucuugccuugcaaauauuauuucccacugaaauuacuaaggcuuuuuugacaaacggcagguuccccaggagucaggcaaagaaaaugcuagauuguucuauaauauccuuugccagaaaacaagcaaguacucaaggaauguuggagacaugucaaauggacccagaaucuaacuucaagggacucucacuggccaaaucaggagcaaucucagcauucaguuggugauaauaauggcagauuauaacccacugaauaaaguaggaaauaaugaguuuuuacucauauaaauaaaugaauuaauugaaaguuugaugagaauggagaauuguacacaguuucaguaauuuauuugcaaaagggaaaaguaacuuuacaguagagaaaccuggcagacacaacuuuuaucaagcgauuaaaguuaauaacauuggugaugggacaaaucaaaauuguguaccaccugauacagauguauuggguagaacauaacauuugugauauuccugccaaaguuggauaacuucaaucuaauugugugggaacuucaggcaaacccaaauugagagagauucuacaaaacaauugacuuguaaucuccaacaguauuaaggucacaaagucaaggaaacaccgagaaacugcugugacucaaagaucuaaaaagacgugacaacuaaaugcaacaaaugacuuugaaauggauccuuuugcuguaaagaacauuacuggugacucuucauagggauccgagcauuagaugguaguaauguauuaauguuacuuuugaugguuuuguaguuauauaggaaaauaucuguaggaaauacacacugaaguauucagggaugaugagacaucaagaaggcaaauugcugucaaaugguucaggaaaaacaguuugugauugcucuagucuuuaaaaaaaauuaguaagaagaaacaaaagauuugaaagugacagguauagaagguagguaaagaauauucaacaugcauguaauaggagucuccuaggaagaaauccaaaacaaugcuagaaaaugcauagacaagaaaucuuuucuaaaauuaaaaaaguuauuucaaacuacacuucaaaaugccauaauaaaaugauuaggauuuaaaggaaaaaaauaucuggaauuccacuucccucccccagcagaaaaagaaagaaaauuccguuguucucaguuuauagaagacaauggagugaacauacucaauaaaggaagaagcugaaucaaacagacuuucacauauaaaaacuggaaucaaauauaucaacaaauagagugauaguguucguauaaacacuuccuggggugagagaacaaccugcagacauccaaaaugauaggaggagagauacugacauaaggacugguguuagcauuaaugaagaagauuauaaggaagagaguauauaacaugaaaaagcuauaugcucugacaauuuugauaagguacaauuauuagaaaauggggacagaauuugaggauaauaugaaaacagaauaagccuccuaauugcuuuaaaguuuuuaacuggauauaaaaggauaguauuuccaauccaaucugggaagauugcuuguaggaggagaccaaaagacaaaagccaaacaaaaguuugccauuagaacaaaaggacaagcgugucugaauuguuacacacacacuuaaaagaacaaaccauauagugagacugugcuccaguuacuguugcuucaugagauacuaccccaagcuuaauagguuaaaacagccuuuuaauagguuuuguagguuaggaauucaggcaggauucuggccagaugguucuuguuuuccuucuggcaucaacugaggucacuuagugggacuuagguggcaaaugagcugcuuuggagggcccaguuuggcuuugcucuccuugucuuauguguuggugguacuggcuagaaguuugggcucagagcaccaucaugugaccucugcaguauggugguuuuagaacagucuuguuacaugguaucuggcuuccacugaacaagcauuacagaagaaccaggcaaaagcuucauggccucuucuaaucugaccuugaaagucauacgggauuacuuucacauuuuuuggcauacaaaugacccaaagcacuagcccagauuccaggagaggggaauuagauuccaccugucgauggggaaauugcaaggucacaguguacaagagcaugugggaugcaggcaucuuuggaaaauauaaucugccacugguuuauuuauguuaaaagcuugaauaaauaagacaggaugguaagaacagaacugagaacaauuucaguuauaucaaaaguuaauucauaaaagcagacaauuuucaggcuugcuaaugaagcagaauuuaacccugugcaguacauaagagucauaccuaccacaaagaaguaaagguuaaaaauaaaggacugcauauugcuguaaaaaaaaaaaaaagcguggaugacaucuuucuauauugugcagugaucuucuggauauacuuacuauuaagugaaaaaagcaaagcagggaaauguguauucuacuguuuaagaaagaagagaaauguuggcugggcacaguggguaaucccagcacuuugggaggccgaggcaggcggauuacgaggucaagagauugagaccauccuggccaacauggugaaaccccgucucuauuaaaaaugcaaaaauuagcugggcauguuagcgcaugucuauagucccagcuccuugggaggcugaagcaggagaaucgcuugaagccagaaggcggagguugcagugagccaagaucgcgccacugcacuccagccuggugacagagugaaacuccgucugaaaaaacaaaaagaaaagaaauguauuaugcuugugauguuuguguguauauauacacacauauauacagauauaaaaauauggaauaaauguaaauguauuugcguguuuguggguaucuuuauauuguuuaaauguugacauauaaggaucaggacagaauaggaugagaaaaagggauagaagcuggacuuuuaaauaccuguguuuuauagauuugacuguggaguuauuuuaccuacuuauaaaaucaaugaaaaauuuuaaaggcaaauugaaguugaaaauaaaguacaaaugaaucuaaauguguauccacuuggcaacaguaauacucaggaaggaacuauuccaagugauuuuaaaaugguaauuggccagguacaguggcucacacuugugaucccagagcugugagaggccaaagcgagaggacugcuugaggccaggaguucaagaacagccugggcaacacagcaagaugccaucucuaccaaaaauaauuuuuuaaaaauuagccaagcauguuggugcacacgauggucucaccuacucggaaggcugaggcaggauugcuugagcccaggagcucaagccugcagugaacuaugcuugugccacuguaguccagccugggcaacagggcaggacccugucucuaaaaauaaaaaaagaaaacaauaauucaaccauacaucucuagcuauagccuaaggauuaaaagcuacaggaaauaguuaacuguuuacaguaaucauaucaugguaguaguguugguggucuaauucacuguuguaauauuggauaaaacaaguaagucauuaugccgguacuuuuauucugcuaucuccacuaucuugagaaccagaauuacucauauccaagaaagcagauacaacgcuaaaauaggagagcuuaaguaaaaacccagugguccuaauuuuucauuagaaaaaccaguauaaacucaugauauauuuuuaugaucuccauucaucagucuauaguuuagcuguuucuacacauaccaaagacaacuugccauggauugauauuuauuuaauuaugauggauacauucuacuauuaaggcuauuuauguuuuuauuuuaaguguuuuguuguaauuuugaaaggauaguaaaauauuuuauuauuaauguggaauuuuaaauguuucuaagcuuuuugaugaauuguugcuucaguugagcuuauuauccguaaaacaaaguugaugauuauggugaaagaaagaguaacucaacaauaaucaugcuuacucuuacucugucaucuuaaccuacacaaaaucccagagaaguuauuugcuguaagacaggcuuuauaagaaacucagauuugaaaugaccuaguugucugcaauuuguuauaaauagaggggaaaaaagauauguguuuauaaccauguaacugcaauauuuuugaaaaggugcuuaaacuuuugucauuaauagauuuaguaguuuuuaauauguagcuuuaaauuguccauuuucaaaaucauauuuuuguauaaaaaauauuuuaaauaaaaauauucacaaauauuacuucagauugcuuuugugucuugaauuuugauaauuuauaaauuauaaaaucaguuaaaauaaauuuuguuuaucacuuguuuaaggcauauuuuucccuuuaauguugacccugcacaaguuccauauugaaguauguaaaaugaacugauugucucaaggggaaaaagucaauaaucaaagcaucuaguguauuaauuauuauuauagguuucuuccuuaauauaaaaauuagaauaaauccugauuuuuaaaauuuacacuuaaauucaacaguaauauaagauuacugcugucugaugcauggaaauugucauuuaauugacuaaaugugguauaaacuuuaaaagagcauguagaaaaauucuaacucagccaauucuaauuuaugguacauuuagguuauuaauaauuuuuuuuugaaauuuauguguugggcaaaaucuuucgcauauuacuauuuuaagguucuaaccacauuuaaucaauuauaggacaguuuacauauuuaauacguuaucuucaaauaacuuauuuuuugaaaauauaucaauuuauuucucuuuuucuuccaucagaauacagucguuuugaagcuaaaauacaugauuuacgggagcagaugaugaauaguaguauuaguucagggucagguucucuucgaacuagccagaagcgaucccucuaugucagguaaauuuuuuuacuucuaauuauggcaaaucuuaauuaguuaugcauguaaauuauuuuguauuuuucacuauaacuuacuuaguuuuaccguaagaaaauauauugccaaucaguguuguuuuuuauuauugauucucucugacagugugccuuucaagaauuggaauauuauuguauuaauaauuuuauuaaugaaaguuauguaauccuugaauaaugaugauauaauaaaggaagaaauuucuguggaccagaaauuguuuucagauugauguguuaguagugacuacaagcuugaugauaucaugucuaacacuuagauuuaaccucuguccuuuucuaauauauuuuccauucaaguaacauuuaauuaccuggcaauuuccauaguagcaaaggaggcauauguaaauaauaauuuaaaaugugaauagccucgguaaauaaugcauauuuggaaaauuucuacaugcauuuuuuaaacacuugggagaaggcaaauauguuauuuuccuauaauauauaaagguuaaguggcaacauaggucuaauaaauaggugauauuaguauauaaacugggguguuucuuuuuuuuuuuuucauuucguuggcuuauaagacuuaaaacagaaauccgaauguauuuguauucuguauacuuuuaguagaacuuuaacugauaacuuuauuauacuguuacuguaacauuagcacuguaaguaaucugaaccauucuuuauaaauuaucaucucagucguccugauucuguugggggaccuguuccuaauacguuucauuuauccuucugaugagagagauauguuacauauauaaacauguauccuauacacguguaucuauacacacaaacagguacucuguacuuguuuacauaugauaugacuuacugucuucacauaaucuuacucugauacaucaugaaagcaaaccuuucucacuuucuucuuucuguuccuuuugucuuuugcuguacuugguacuuauaacccuaccagugaugugggaaucuuaaaugcaucagauuuuuuuuucccuucgccaauucuagcaguacucauuaaacucuuguguuccaaagucauuaaaaguauuuuauauauacaaauauaucgaagaaggaagaacauggauuuuucuacucucuuuuuuacacuuucuuuuuuuuugcuuaucuacauuuccuaauuuuaguauaauuaauagguguugccuuuuauuuguacuugauuaaauauuuacaaaggcauaaaaaucagaacauaauagguuauauuuauuuucgguacauuuagugaaucuucacuuguuauuuuuagagaaguaaugcucuauuuucuuucuguuuuuuuuuuuuuuuuaaagacagggucucacuuugucacccaggcugaagugcaguggcgcgaucucagcucacuguagccucaaccucccggguucaagggauccuuccgccucagccccccaaguagcugggacuguaggcacaugccaccaugccuggcuaauuuuuguguuuuuaguagagaugggguuucaccauguuugccaggcuggucucgaucuccugacuucaugggccucacccaccuuggccucccaagugcuggcauuacaggcaugagccacugugcccagcuucuauuuuuuaaaaccauauauuaucuaaagacuuauaaugaaaaacaacugucaccggcaccagccccuaguuucauucuccagaaacaagcauccuccauuuuccuagcaaacuuccuucaccuccuuauuucuaaauaugaagccuucgccucuauauuucuaaauaacaugcauauacugcuaucuucuacuuuaccaguuuugcgcauuagucuuacaaccaugguagaugagaacguuucuguguagaaccaaaccacucauucagucucaucaccaucacccaaacauagccuaucucuguuaauaaaacuaauagcauuuacagucaugugacuaugcaauagcugucaugacucagucgagugguacccuaugagcugccuccuuucuucugcagcccuucauuuuuccuggacuuaauaauugucuugcauuuuauuugauuuuucauauucuuacuacuaaauaucuuucuguaucuuccaguaaccacuguagaguuuuucacaugaugaaaacauauggucacacauacggucugauaguucagguuuuuucuaucuuuaugcuccagucuagacuaguuccucuguaaacgugcuguauagcucucagcugggacuucccuuuugccauuauucuauuuccuuuggcugucuacuaugucacauguuuccuagaugccacauuuucuucuuucucaauuaaucuuccuagagcacauccuccaguaaauuccugcgaaaaggugugugggaggcacccuuugaggcuuagcaugucugaaaugacuuuguuuugccuucuccccaguagagaauuuggaaugugggggagggaaugauacccuguuuuauuuugcaggagcucccucaucuuccauuucuuuuguggacaugaucuggugugucucugagauuuucuucugcuuuuuuguauucuuugcuuucucuguauuccuuuuuucuagcuauccuauuuucuuggagguuuuuucuuuaguguuuuauauaaggcauucuuuaaauauccaguguuccuuucauuguuuuccacucuuaggaauagagaaaugaagauaauggauuuaacuagaagacagugggguaaagggggggauaaauuggcucuuaaauuuucucuccugucccacgucauucuguucuuuucuauaauuaaauauccuuagagaagaaucccugucuccugccaauaguauaaaccaaguugcuagaauuuuauuuucauccauuucaguccaaccaccuuccccuucuccaccaaguuucagaguauacagcuccucaaauucaauuucucuggagacuaaaccacuggucuucuguggguuuggggacugggaaaaggaacuuuggugggguuggucuaagugcuacauacaguguuucuaccuucuguuuuuaguacaguaacuuaucccugccuaccuugguacuacuguacacuucuaauuuaugaccaucuccaggauucuuauggaauaaaacuuguuucuauaacccucucugcugccacuccauuuauagcuucuuucauucugcuaaauuuaauuagcaucauccagaaauguguuaaaaucucucuuccccuguugucuucucucuuuuguauuuuucguauuuuauugucauuuuaaugagucaggguggagaagaaauagacacagugugcuauaguuaaucagaagccucaugguucuuuuugagauggggucuugcccuguuggcuaagcuugucuuggacuccugggcucaagggauccucacaccuuaacaucccaaguagcugggacuacaggcacacaccaccaccaccaccacaccugagucuugugggguuuuuuuuagucaauguauuucuaauuucaaaagccaaaaaaaaaaaaggcugcaaaaaacuaccuacagaauaccucuuuauaaagcucugaaacaagcaaaaacauacauuauaucuuuuagucacucacauauuauaugauaaaaccaaaccaaccaaaaaagaaugagucaaagaaauaaacauuaagaaugauaguuacauucuaauagugguuaacucuugauccaagggaaucaggaucagagggaauauacgcaggugaaugugaauuacugaugaagguuuuguguguagucuuggguuggguaguaggugaacagauguucauugcacucuuacgauuaauaacucacauguauuccauggguuucuuuuuuuaugaaucaaauauauuaaaagagaauguuaaaaugcuaacguaaguagagauugugggugauuuccuuuguuguucaauaauacuguuacauuuugugauucaaaagaugaauuuuuauaauaauguaagaaguuaguauuuuccuuuucugaaugucuugacauuuguacuaccucuuaagguacuuuauuuucuauuuuauauuaugcuuauuugugcccucaucuucucuauguuugaauguauguuuaagugagcccuccugcuuaacgauccccccugcuucccuagcaccuuuagccccacgaaaagacuugaaagaacucauuugaaaaaccauuaacuacuaguuuauuuauuuagccaucaaguaauuccaccccucuugaguuuuacuugaagagcuagguucuuaaauguuggguagugugaaaaagauuacgauuuucauccuaauuuccaguugccaaauuagaacaaaagaaugaauaaauuauauuauaaauguaauugcugugauccuuucuuacacucuugagagagcuuauuuggacuuaagaauuugauuuauuuuaauguuguacauuaauuaaucaagugguagcacacaauauuuucuuuuuaucaaauuuuaaaauauucuuaacacuuugcaauuaccguauuaaauuauuacuuucuccaaaauauuuggcagcuguuaaagucaucuguaauuaguguccaucauuguuacugacucugaaaacucuaucaacucuaguauugugaacaaauggaaggaauaauuaauggacagaauagucacuauguugaucuagucguacaguccacaacuaauaaaucaaauauaucagggaauuuguuuuccuacauguaucuaaucaaaguaaagagaagaauguaucuuaauacuuuuuguuuauuaauuucaaacucucuggauuugucuauuuuagaauucaauauaacuuaccauuggauuacaauccaagagcguuuuuaaaauuugucuugugauauugaaagaaacaaauaauacaauacaguauuuucauagcaaguugauuuugcuauuucuuuuuugucuuaucuuguaugcagugcagaauugaacugggcauuauuuggccuacuaugauauauuuaauuacccaaauuacauauacuuucagaacccuaugauauguugauuaauauuauaacaagugauuauggacuuuuuuucuucugacucuagagcccuuuuugauuaugacaagacuaaagacagugggcuucccagucagggacugaacuucaaauuuggagauauccuccauguuauuaaugcuucugaugaugaaugguggcaagccaggcagguuacaccagauggugagagcgaugaggucggagugauucccaguaaacgcagguaugccuguuucuuaccacuugaaugugaggcaacauaaauaauugauguucuuuuaaauuuuuuuuaauuugugacaacauggauggaccuggagugcauuauucuaauugaaaaaagccagacacagaaagacaaaaaucguaugaucacauuuuuaugugaaaucuaaaguagucgaagucauacagagaagaauggugguuaccagggguuaggaggauggggaaaugagauacaaaguuuccgugacacaagaugagugaguucugcaccuccaacauguaagcauggcaacuacagguaauaguacuguacuugaaauuuguuaagagggucgguccuaaguguucuuaccccccaaaaaaaggcaaccaggugagguaauggauauguuaauuagguugacuguaguaauuauuucacaguauguauauauauaauauauauauauaaaaucauuaaguuguacaacuuaaauauauacaauuaggcugggcacgguggcucauuccuguaaucccagcacuuuugggaggcugaggcggguggaucacuugaggucaggaguucaagacgagccuggccaacguggugaaagccugucucuacuaaaaauacaaaaauuaccugggcauggaggcacacgccuguagucccagcugcucgggaggcuuaggcaggagaauugcuugaacucaggaggccgaaauugcagugaccugaguuugcaccacugcacuccagccugggagacagagcaaaacucugucuaaauaucuauaucuauaucuauaucuaucuauauauauaaaauauacacauaaaaaaauuaaaaauaaucaccagaacugaaaaaauaaauuuauuuuacuaaaaugauuuuaugcucaguuuuuuauauuguguuucacagccauuugauuuuauucaaauggaauuguaaccagugacauaacuagaaaauaugggccaggugcaguggcucacaccuguaaucccagcacuuuaggaggccgaggugggcggaucacgaggucaggaguuugagaccagccuggccaguauggugaaaccccgucucuacuaaaaauacaaacauuagcugggugugguggcgggcgccuguaaucgcagcuacuugggaggcugaggcaggagaauugcuugaacccaggagguggagguugcagugagcugaaauugcaccacugcacuccagccucggcgacagagcaagacucugacucaaaaaaaaaaaaacaacaaaaagugaugccuccaagcagaaauugaucuaaagcuacuaguuacugaaaacaaaguaaguauauauuaaaucagugugccauuuagcuauaccagugaagagaaaacugaaagugucugugguugguguagguaaguaagaggacuuaaauuuuguauuuuugguggcaugaauuucuuccuucaugccaaaauguuuggaaauaucugguaauacgcuucacuucucuuuuuccuugcuuaaauuacauguauuggugcaguucacuggucuuuucucuuugcuuuuaaugauuauauauagguagauagguagguagguagauugauuuuuuuaagagacaaggucuugcucugucgcccacgcuggagugcagugacaugaucauagcccacugaaccucagacuccugggcucaagcuauccccccaccucagcuaguagcugggacuccaggcgcgugucacugcacccggcuaaguuuuuuguuuuuguuuuuguuuuuguuuuuguuuguggagauggguucuagcuauguugcccaggcaagucuuaaacucuuggcuucaagcgauuuucucaccccagccucccacagcucugggaugacagcugugagccacugcagccagcccuaaugauucauuuuagugauucauggguguauacuuagcacauagcaaaaguaguuaaggacaggcccucuuugcaaaggauggucccagcuuagaggaccucuucuaaggccugugaagugcuguugagugucucugcuuuuguggggaagguguuaaaaugucauuucagaauuccccugagauagcuuauuuaugagaucugcuucauccaaaucauugucuggaaguucuucuuuaagagcuuuuuaaaguaguaguaguaagauagccagcaaaaauaguuaaugagaucauaaagaaauguuuauuauaacuaguuaauucauuuuaagucgauuaugcuguaauaaacaucuuuuucuuauuaguugaauuuauaccuauuucguaacuauuucuagaccuuuauuuauuuaccuguuuguagaaguugaaaaguaauauuauuaaauuauaaucaagauuuauaauuaugauuuucgggcuuauaacugcuguuggcuguauccauauauuuagcaugauccaacuauuuggcuagaucuuucaguugaugacaaauccucuuuuagcaaugcagcaaucagcauaacuuuuuuccagaaauagaacauagucugcuuuaaauucggaaaugcuuccucuaugccuuguugagucaguagaaaccuuacaucuuaaauaucaaggucagagcuccuaaaaauugucuugguucuuggagucucauaccuuacaaaggcuuucugugccuacacccaauaauaaacacuguuggcuucacuggagagauuuuuuuuucauuuuguacaaaaauucuauaagauuguguuuuaaagcaagcaauaauguaagaaagauaucuugagaccucugccaauuuccacauucaugaguagcauugcagaauauaaucuuacucccguaaaauacaguaagaaaccacaacuaauuaugccauuucguucuugaauguauucaaaacuuaccuuuucuuaaauagaacuaucucuuucuuagaccucuucuaaaauaacauaggaauuguaauuccuacaauucuuggcuuucaggaauaauauuuacaaauauagacaauuuaaguugcugaauuauguacuaaacaaaauaaugauuagaaaacaaaguugaguuguaaaugcucacccacuaaaugcuaguuuuguggugcuguugauaaguaccuaggcaagauuauaaauuauucaggucauggagccucagaauuguucuugaaucguaaaaaucaugaguuuuaauuuuuuuuuuuguuuggggugggggacggagucuugcucuuucacccaggauagagugcaguggcaugaucuugguucacugcaaccuccacuuccuggauucaagcgauucuccugccucagccucccaaguagcugggauuacaggcacccgccacugcgcccagcuaauuuuuauauuuuuaguagagacaggguuucaccauguuggccagacuggucuugaacuccugaccuugugauccacccgccucggccucccaaagugcugggauuacaggcgugagccacugcgccaagacuuaaauuuaaaauuuaaauucaugaaugcuaagguccugcuguacccauaguaaaacuaaauagauaauaaggaaaaaauaaaauucauuuauucauagucuuguuuugguaggcuuuucuguuauaugcuaacauaauugcuaugucgaaauuggagaauuuaugaaagcuuaauuuacaugacauuuugcaagauuuacauuaguguuacaaucuacauaaaaacuuguuucauuguaguuuuauuugcuugcuuauuuugaguagguaaaguucagaauuuaaaagaugugaaggcuuuacaggcugucucucacaacacccauuucaccuccauagggguaaagauuaacaguucuuauguauccuuccaaaaauacuuuaaaacucuuacuucaauaacuguaacugguuauuuauauauuuacacacacacacacauauaucauuaaaauuaggcuuaauuuuuaaauauuccaccuuuuuguuaaaaguuucagagcuauagaaaaguaaguacaaaaacggcaauauacagugaacguccacauauccuucucccacuuucaccaguuuuuaacauuuugccacauuugcuuucucuagcuuaauuuuuagcauaugugcuucaugcuaagcuaauacuuaaaaacaaacaaaacuuggaaaacuguuaaacucagaaauggugccucauacuuucauauaauuuuguaacuaaauauacauauaaaaauauacacauauauacuguguguugauaacuucauagcaucagguuuuguuucauaauaaaaugagcccuuuauuucauuuuucagcaauucuaauuuggggaugcaaaccuagaugacucuuaaagguuuuagaguauaaaaaugcccauuauaaagauaacaauucugguuauuucuaguaagaccccagauauguuugguuuacuuaaaaaauaacauucuauacuuugacagaguugagaagaaagaacgagcccgauuaaaaacagugaaauucaauucuaaaacgagagauaaaggggugaguauuugaaaucucuacauuuuuguaauuccuguuugagcuacauuguuaaaaugaaaaggauuuugcuaucagaauuauucaugaucaguucuugccauggugcuuuacaaugguagauacuuaagcauuuguuaaauucaagcacccauuucacagacccuuccaaauuaucaaaacuaucauuugauauauuauuagcaacauacuuuugggucaagcuuauuuuuauaaaugaaauguauuugaccuucauucgauuuccaauuagaaauuuguguuacuaggccgggcaugguggcucacgccuguaaucccagcacuuugggaggccaagucaggcagaucaccugagguuaggaguuagagaccggccuggccaacauggcgaaaccccgucucuaccaaaaauauaaaaguuagccaggcaugguggcgggcauuuguaaucccagcuacucgggaggcugaggcacaagaaucacuugaaccugguaggcggagguugcauugagcccagaucgcaccucugugcuccagacugggcaacagagcgagacccaaucucuuaaaaaaaaaaaaaaaaaaaaaaagguaaaaaauuagccaggcgugauggcuugcaccuguagucccagcugcuccaguggcuaaagugaaaggauugcuuaagcccaggagguccaggcaguagugagccaugaucaugccacugcucuccagccugggugacagagugagacccugucucaaaaaaaaaaaaaaaaaaaaaaaaaaaaaggaaauauaucaauucuuucaucauauauuuuagaaguguauuuauuuuuccuucacuuuaaguccuucugcuugcaucuaaauacuugggcugucgauagaugagaaagaugguacaggcuucaucccguauugguggauguaauucuuaauaauccugaacucacugcaguggaauauucuagcaguaagccuggagaacaaacugaauacauguuauguuaaauaccauuuauagcaauguuuuauguuugggguuuuuuuuaauacuaaacaaaauuuuuauaagucuucugauaauauuugaaaugaauguggaauguuaacucagcaaauaaauuuacucuguacaucucugguaucacuaagcacucagacuuaaagcuuuaaaauuuaaaagaugagaaauaucuuugguucaagaaguuaaaucugagaaaauuauguguuacauuccauuuuuuagaaaugauaaauuccuuuaaaauuguagcuuucagaaaaauuccaaauuauauagugugaucugaagcaauauuaaaauagaaauuuguauuagaggaaaaaucccagguaaaugcucaggauuugaaaaaugugaauuuuuuaaugcuuguuuuauguauaucuuuaaaaaugauuuaguacaauauaccaucaauaaauugaaaaagagguugcauguuguaacuuuccuuucauacuguaagaaguuaacugaauuaacgacguguuuaaaucuuagucuuguuuguugacuguaaccaacuuuauacagagucacuguguucuaacacagcaccaaaacuaugcaugauacugaguggggugaaaauacgcuugccauugaucagaacugcauuucuuucuauaguaccauuuccuacuucuccuccuuuccuuacauagugauuauggacuuuauuuuuacuacagacuuacaacauuuuaguuucucauuaacaugucuaacauucauuuggcuauuuugaaauacauguggaaauuauguauuuagauauuuaauauauguaucaugaauuuaugauauuuuaucaauucuuacacugucucucuugcgauauagcauuaaugacaguaaguauuaaauguaguacuucugauugaaaauacagagaaacuggagguagcaagucuucaguuuuguguuuucccuacacauuuuugucuugguugcuugugcuauuuuuuucacuuuuaauaaguucuucaccuggaggauauuaaaugugauacaacuaauacuuucuuaacuaacaagcauuucucucuguccuauauuaugauaucuuuaugauaucucauuuuggcuaacugcaaagauaauaagaaucagacauuuuaaacuucauguuucuuuugguuguuugcugugaaacugacucugaccacuauagaugcaguaagagggaugaauaaacuuuuauaaaaaacacaucaguuguaucagauauaaaaauuauugcuaaauucaaaaccauugauucuuaugaacgaaaagauuuaguuuuucccuaaauuagauuaccauaauuuuuuucacuaaaacacuuucucgucuaucuccuuucuaaaauuuggauuugaacaaagauuuuuauucaaauaaugcuacuugacaguuuauaaaauaguuauaagcccagauuucuccauaauacuuuuucuguccauugaauuuuuaacuucuacuuagaguucucuuuuaucuaguuccucagagccuucaaacuuuaagauugaaaucaagacagucugcuuggcuaaugaacugugaacuuauuaauccugaauuaauuauaugaaaagguaaaaaugaaaguuuaaccuuguuuuuauaaagaucuuuaucaaaauaagucuucucaagucauagaauuugagcuaaaagucacuuuaaucuacuucacuuuuuuuuuuuuuuaauuuaaagaaaaggucucacucuaucacccagguuggaaugcaaugguaugaucauagcuaaucauugcagccucaaacuccuggguucaagugauucuccugccucagccucccaaguagcugagacuacagucgcacaccacugcucccagcuaauuuuuuuuuuuuuuuuuuugagaugggguuucgccauguugccuaggcugauuuugaacuccuggccucaagcgauccuccugccucagccuaccaaagggcugggguuacagaugugagccaccacaccuggcugcuucaccuuaauuaccuggcaucacaugcuuaaaauaagggcaugccaaaaacacacuguucuugucaauauacuucaaaauaaugaauaauacagcaucuuaagauguguauaaacucauaaaaaucagaacaaaaaaaucuauucuuuauauuuuucccuucccccuccaaaaaauaauaauucuuagugucacugguagguaagcccguuuccuucaaaacaugaaugccuaugacagagaaaugacaaaagaagcuauuucuguuuaauagccucaucguucuugugcuacaugcucuuaaaucuaugaaugcacaaaugagacauucaaggaaaaacuuguuuccaacaugugcaauaagagacaucaaaucaacugcucaacuccacguuacaauuauguauaaacuguuagaaucuuaauugccuuguggcuuugguggacaccaaacuuuuuauucccuaugaaggacguggugccaaugauuggaugugguucuacauuauuuauguguacuuuuuuuuaauaaguagaguagaacuuaagaauaaauaagucaguacugauagcauucacguuggucaggagacuucaguacugaagcauucacguuggucaggagacuucugacucuucuugcuuggcuaagagauggcauugauaagucucuugcuggacucugugugcuugauggaccuuuuaguuuucuucccauuuucuggcucauaagcauuuaguuaccuuuuauccucuuccaagaauauguauauguguauauauaaauauauauauauuuguuuuuuaaauauucagcauuagcaacuuucucauaaucauuuugguuuacuuuuuaaauaaugacuuuucuguuagcucaucguagccacaaaaaaagagauaaaggaauaacuguggucaggccaaaauaaaaugaagauaaugaauaaaauguaauugagcagcaaaguaacauuaaauaacuuuugcuguagagcacuuaauacuugaaaauuuuucuggaaaaacauggauuaguauaaacaaauguuagcuugguuuguacuguaguaguaacugauuugccuuuuuuugucaaguagcauuuuuauuuuuagguauaaaugaacuaugcugucugaaauucuuaaguauuuucaguugcaaaauguuagaauuuauacaaaaguagaaauucacuuuauaugagauuaaaguaaaaaucauauacaaacugcacacuguggucauaggagucagcuuccacagagcugcuaggcugggccuuuguacacacagacaguagacaucccuuuguuuugccccuccuucucuucuucagcagucauucaaugacaagcguaaaaagaaccucuuuucccgaaaauuccccuucuacaagaacaaggaccagagugagcaggaaacaagugaugcugaccguaaguauguggauccaguggucaacugaaaauaaaauggagagggaccuacugcccugcaguugguuguuaccauggagacaguuucaagagcugcagcagguugcuaauugucuucaagggcaacuuaacaguuauaaauuaauuuguaugccgaucuuaacuuuuucuggcaccuuaggaauucuuaauuuaaagcaaacauuauuuuucaguuauauguuuauaacuugaacauauaaauauguauaaaugcaguuauuugaaggaaagauuuuuaugaaaaacacauucauacauucaaagaauauuuuagaggaagaacaugaauacaugagaagcuaccuguugauuucuagguauaacauggcgagucugauaacuggauucucuggaaucauuacauuuuacccuauuucuucauuauauguagacaaucuggauuuuacuuuuaaaauagcaagaaauggucuaaaauuuugcuucuguaccugaaucagccuucaugcuagaacuuucauucuuuugguagauuacaguuagcagcuagcucauuucaaaguucuagaaauauguaaaaaugcucuguaagauauauguaccuguaauggucuuggaacugucucuuacuguagcaccaauuuuaugcauuacugacaacuauuuucuuugauuaucuuuuuauugcuugcucucuggggacuacccucuacaggagaucccugacgacaugggaucaaaaggccugaguaagugaucaaaauacucccaaguuauuuuuuaaccuccaucugcagaccuaccuuauucagauacauuuugagauucaugguagugccuuucuggcauaaggagguguaugauuuagauugcuuuuagaauuuucauguuuaucacaugcuugggacuuuauuucuguaauacauaacuuuuuguuuuuauuuuucacaugucauuugaaaaauucucuugcucguaacuauauuuuccuuuuuguaauuuuuacgacaguuacuuuugcuaggaacuuuuaaaauauaaaaacuuuuaagauuuuuuuaaauguacccucauuauuagaauguagaaauaugcuuccuuggaguuuuauguuccccuuuuuuuuguuaaaauaauuuaaaauaauuuugauuauguguuagaaaagcauuacuauaaaaguauaaagcacaauagaauacuacgcaaguagcaguuuauugaggggauagguuguguaucucuuuuuuuuuuuuuuuuuuuuuuuugagaaaguuauaaguuaccacaagaguauaagaacuauuuuguuuuuccuuuagcuaagauguugccuuuguuuuugguuuuuguugcugcuguucuuguuuaauuuucuagcuaguuacuuaaucuucauguaaagcuucacacagggucuaguauguagaagacauucaauaaauguuggcaugaaugaaugaagcaagaagccauuuuagcaaauaaaauuuuuaauuugcauguuuucaaauugcuuaacugaaaauuuaccaaacauuacugaguaacuuuaggugacagugagugauagaaguaaucuuuuaaucuaauauuuucuaaaugguucuuucuauuuagauuauuaaauauuuugaaaacuucuuugucauucauugaucauuaagccuauagccaguaucuuuuaacuuucuaagaccuacauuaauaaacauuaaauuuuacauaagacauuuuucugauuuaugcuuuuaugcugaaauuuuaaucuaaacugcagguacuuuuauuucaaccauagugauuuaaguuuguauuagauugaagacaguauguuuauuuacaacucuuucuguuagacacacuuuguuauuuuugcaugugccuuuauaggauuuaguaagggccacagauuuccuaucacuagugacacccuuacauuuggggaaaauuaucaaugaaaaccucuaaaauuggaccauacuaccacaguuuauguaugcuauagaauuuauuuugagauugauaacauacuuuagaggugguauggaucaacaaauggacccacagauuuuucuuauauguuaagugaacagagacauaggaaacucauagaaaaagaaacuaaaugaagaauuugguucccauauugauguuauaauagaugaucauuauaccuugacccucuuucucugguucugauugaagauugagacuuuggaagagaaauaauaugaaaaaugguaacugauuaucagacgacguuauucagaaaaagauuuuauuuucuggagagugaccuaagaucucuugaauaauagauuucugugcuucaucucacaggaauuaaaagaauuuauucaccugguaacuugaucaucagaucaagauuuuauucacaaaauguuggagaagacagaaaaauaucaguaaaauucuaaaacuggauaugauggagguuaucacauaaaauagaugauauaaggcaguugacaaggugcccaugauuauguaguaguaaauacugggaagaaggauguguucaaggacguuacuuguggccucaguuacuuacauucugaaguuaagaauguagggaauaaacuaagcaaaaucuugagagacuuuaauauaagaaaauaagugcaacuuaauguagguagucaucaggccuuauuggaacaaaacucaaaaagaacccaaaaaagaagguuaaguuauuccagagaaccgaaccuauugaagagaaauggaauaacacugaauaucaagaaaaaaaaaauguauaucugcuguaaauucacacaaccuaugaaaaaugggguauuuaauugaagagcagacagagaaacagaagugauaccauagaacgcuuuguguagaccugaauucauuuguucuuuauucugagaagaagagagucaaauaaauuauugauuucccuguuaacaguagagaaaacagugagagaaaucgucuuaucaaaccuaauuuugcuaaacagaacuaaugagaguacaauggaaguuugggagaaugcagcuaagucaucauuugcgaaaagcuagaaauaaaaacccgugccgcuuucaugcuuuaagggagguaauuuugaaaaagcucaagggacuaaaacuagguaagauuccuuuaacagagacugaaaggaaacauaacucaauaaaagauacauaaggugcucagaaguaaaauuaugacauaagauuugagacaagguuuguucuuauuacauguaggcuuuccauuuuuacaacuuuccauguuguacaacaccucaaaaauuuccucaggcacguagguuuccuguuacauaugucuuuucuuucuucucacuuuaaagacguacgcauaguugugcagagcuucuaaaugccaaaaacagacuuauuuucauuugcauuacgaauaagauguaagaguaguuucauugcuucagauugaugauguaguauuagaggagagcagaagagaaacaugauguacuguaucaggaagaagcauuugaguacaaugauaaaacuugguuagagagauuugagauagaucuguucaucaaacaucauaaacaggcugggcgcggugacucacgccuguaaucccagcacuuugggaggcugaggccagcagaucaccucaggucaggaauucgagaccagccuggccaacauggcaaaaccccgucucuacuaaaaguacaaaaauuagcaaggcaugguggugcacaccuguaauccaagcuacucgggagggaggcugaggcaggagaaucacuugaacccgggaggugaagguugcaguaagccgagaucacgccacugcucuccagccugggugacagagcaagacucagguuuuuuuuuuguuuuuuuguuuuuuuuuuuuuuaagacaaucauaaacaaaaauaaaaacuugaagaauuuauuuguaccauguaugucacaaggauaauaucuuuauaaguuuuuaacagguaauaagaaauaagcuaacucuccauuagaaaacugggcaagagugcucagaagauaagcaaaugaaauaagcauauaaaaaauguuuaauuucccuaguagugauaagcaaaauguuuuaccugucacuuuggcagacuuuuguuuaaaaagaaaacccaugacggagagagugcugcuaaaugccugcuuuuaauguauuacaaguaaauaauguauuacaaguaaauguaugggaguguaaauuggcacagccuuccugaaaaagcacaucuuuugacccacuaaauccucuucaaagaauuuauccuaaggauguaauuagagauggagacaaagccuuauauaucagaaugcuuauuauaauauuauugaguaauaacagcaaaaauaaaaaaaaccgugguaaaaugucuuacaguugggaagugccuaaugaaguaugauuuauccauacuauguaauauuacauaaccaucaaaaaucauauuuaaagauaaugacauggggaaaugcuuacuaucuaugaaaaaaguaaaauaugaaacugcauauauugucucagucuuauauguuuggagcuauuuuaaauaguguugcuuugaacauucuuauacaugucuugugguaagcauauauaugccuuucuguuggggaaauaucuaggaaaggaauugcugggucguauagauacacauuuguccagccuuaguagcuauugccaauuaguuuucuaguuuuaccaguuugcccauuccuagcgcaugaacucccauugcugcauaucauuaucgaugcuugacaugucuguuuuguguuuucauuuuagccauucugguggauggcagagacacucuuugugguuauaauuugcauuucccugacaaguaauuaacuugaacacuuuucuauauguuuauugguuauuugacugucuucuuugguaaaaugcuuugaagaggaacauuuucaauuaucagaagaaaaacauuuuauuuuucuaauaacauuccaaacaauuaugaugacgcuauucuaaggaccauacuuugaguagugaggcuuuauuguagaagagcuaagugaaaugauauuugaaagaaccugcagaauuugauuguggcguagcuuuuggcagucuuagaggguuugaggugaguaggagaaaucucaaaaaaaaaaaaaaaagacagugaagagauuuugguaacuuaaacuuuuuauuauauaaauaucagauauauucaauaguagaaaaguaguaaaaauaaacccugcagguauuuguuuauccagcuuucauaauugucaacugaacauuugccaauucuguuucuucuguacucccacuuacacuccccucccuucaccccauugcaauaacuaauuuuucuuuaguuuacaaacuagagauugcagaggguaauaccaauacuaauguaaacagaauaacucuuuuuuuaauguggcguguuucuggguaugaaauuuaaggaaauaggacagaaaguuaaaagguauauauaaaugaagacauucauaauuguugauacuugugaaaaacaguuuaaagcaaauaaaaauaucuaauaaauagcgagguaaauaauguaucaaucuaauagaauauuauacaccaauuuuaaauuauugcugucaagcccauguggugacauggaaagaaauauuuuaauaugagcuuuuaaaaaaccuaccauuuggccaggugcgguggcucacaccuguaaucccagcacuuugggaggccaaggcagacagaucacgugagcucagagguucaauaucagccuggccaacauggugaaaccagucucuacuaaaaauagaaaaauuaguugggcauggugcuauauaccugcagugccagguagucaggugucugagacacaagaauagaaucgcuuaaaccuaggaggcagagguugcagugagcugagaucgugccacugcacuccagccugggcaacaaagggagacuaucucaaaaaaaaaaaaaaaaaaaaaaugaaauuuccagcuggguguggugauucacaccuguaaucccagcacuuugggaagcugagaugggaggaucccuugaggccaggaguuugagaccagugugggcaacauaguugagacuugucucuuuuauuaaaaaaaaaaaacaaaauuuuagcagggcauggugguacauaccuguagucccagccacucugggcuaagaugggaggaucacagaagcccaggagaggagggcgaggcugcagugagcuauagucauaccaccucacucccaccugagcaacagagugaggcccugucccuuuaauuaaaaaaaaaaaaaaaaguuaaaauaaaaauucagauuucccugucucauugaaaguuuuauuuuuauuuuuuaaaaauaaaaguauuagucuuuguuuaauugaagggagauauuuauugagagaaaacuugagaugacauuuacauggaugagaagagugccuaugguuuuaccaaacaauaaagucgugaaauggagucacuuuuaaggagggccaggcaguuucuggcuggguguguuuguucucauugucuuuuuuauguuuugcaaaagccagccagugccagucuuaucaaagcagaguuucuaagaaauauuaguugguuuuaaaaugcaauugccaccaucggugccuucccuuccagcugagacaucugaauuuaugacuucuaauauuaguugguuuuaaaaugcaauugccaccaucagugccuucccuuccagcugagacaucugaauuuaugaccuuuacaauccuuuaucuauaugaucucagaaacauggauuuucaucuucagaaacaggagcaaagcuggauugaaaauaagaucaucuauuuauuuuuaauuacaaagacaucccgucauuaaaaugggcaucuauuuguuuaaauauaguuuguccccuuugccaguuaacgcuguuucaaaaacugaaauagugccaacaguauuuucuccuuugaguuuuaugucuacauuuggacuaauucagggucacuuagcccuuuuugucauauucuacuugcuauuuauaauagauuuguucauaaacuguguuguacaaaaauaaggcauuguccuuaauuacaggaguuuuccuuugcuaauauauauuuauuauuugaaaaacuuaaacguuucaaagaaaaagaaaaugcuuuuaaaaaauuauuuuguuauauauggcuuauaucucaacauuucauuuugauuauuugcuuuuuaaacucaugacacuguuuuauuuuuuuucauuguccugcaauuucagagcauguaacuucuaaugccagcgauagugaaaguaguuaccguaaguguuuuaaguuacuuguucuuuuguaaucucgaguaauacauccucugcagggguggagggauucugagugauauguuauaaaaaccugaaguuauaugaucguuauuuuaaaaucagggagagacaaguaaaauucuguacuugaaaaauaaaaucauacuauauauguagagguuaauuuauaaaauuuuaauaaaauaaaaauauuauuuguguacaugauacauauguauauguauauguauuuuuuguaagaaguaaauaucuaguuaaaugggggaaaacuuguauuuugaccuucuguuuaguaauugguuuuaacaugagcacuaaaauaauauuuuucaguaaugcuaaauuaucauuagcuuuauuuccauuuuuauucuuugucaccaauacugaucugggucaugucauuguuuaucaccagcacuuggugaacggaagaaauaaggaaacauuuucaaugaucaccugaaaaauaauacuaauuuuucuuuugcuguuuuauauuacauucuugguuuuauuaagugaacugcacaagcaugugauguuuuaaaacagacuugggcaugggagaaggggaggguacauaauaucaguuguagcaccuuaaaaauuaaaauuacuuuucuaacuuucuuuuuuuacugcugucuaauaugaaaguaaucuugauuacagaugaguauggcugcucaaaagguccauccuguuaauaucagucccuaauacuuuuucauguugacaguauauacuuuuaaccgucauucauuugguugauuauuuuucuacacaauaguuacuuaaugauuuuuuuuuugguguggaaaugauuuccuguauuucagcauuuuauuaauuauaaccagaacccacuauaggguaguugaguggcuuucuaggcuaaaaagagguaaugaaaguauauacugucucucaccauuugcaugaauuauuaaggugugaaauauucaaauugcauguguuugcuaguauguaagccauguuucacauccaguacuuuaaaaaacagcuuauaaaauauuggucuuauguacuuugauaauaaaauugaaaacaaagaaauacuucuaaaacagaaaagaauguuuaugccaauguauggauuuaaaagaccuacagcuacauacauauaauauaaaccaauugcaaaauucaugguaaaauuguuauaggaucuugauaauuaaagagaaagucuucaaauacauuauccaauauugauugcuuucauugaaccacuuggguuaacacagucuuuucuaauuuuaggcgugggggugaggggggauguguguguguuaguuuaaaacuccuagaguuuuuggccgggcgcggcggcucacgccuguaaucccagcacuuugggaggccgaggcgggcagaucaccugaggucaggaguucgagaccagccugaccaacguggagaaacccuaucuuuacuaaaaauacaaaauuagcugggcaugauggcacaugccuguaaucccagcuacuugggaggcugaggcaggagaaccgcuugaacccgggaguuggaggcugcagugagcugagaucaugccauugcacuccagacuaggcaacaagagcgaaacuccgucucaaaaaaaaaaaaaaaaaaaaaaacucucagaguuuuuaacuauuuauuucuuuucacuggauucagauauucagauauaauuuguagacucuuuuauuuagaguauuuccuaagcuccgaaccuuuaauuuaaccuuuagaagcuuuaacuucuuguguuuuuaaggucaaagcaaauauauuuaucuccuuuacuaucacuguuguuuauuuucuuggaaggauuuaguuuuaucuaaagcucuuuuugacucacauuaaauuuauuauuuuuuuacaaaguugaguuagugaauuuuucaucagugaaauaguaacaguaguuuuaccuuugcauuuauaauuuuuaauuuuaagauguaauuauuuuaaaaauaaaauauacuguauucaguauuguaguugguggaacaaaaaaaguagcauguuuuuaauaguaacaaauuaccuaauacguagauagaugauagacagaucugcucauuaaagcauuaaucuuuaacagauuuaauaauucuuagauucuaaauaaaggaguagcacauagcaucacaaaugaagauuuuuagauuugauuaucuauaaaauauaauauugauuauauagcccauuuguauuuuguuuuacauuuagcaaacucacuuuuaagacuuuauaauuugacacuuuuuuuuaacuaaaucuugccauaaaguaccucuuuccauaucuuugccauuuucucaggaaaguucuaguaauguauauguuguuuaugaagaauuagauuagcaucaauuaucuuuacacauuuuucaucugugccuucacuuucuaauagguggucaagaagaauacgucuuaucuuaugaaccagugaaucaacaagaagguuugugaagccuauugauguuuuauaaccuucuagaagaauauacuuuuuaauuugggggaaaaaaauucucauaccccaaaaaauguuguauuaaaauuuuuuuuuacuacauauacauguagaaauuuacuacauguguuuuaugaaacauaguuuacuccacagaauauuagaaucuagucauuucauacugacuuuuauauuuguguuuuauuucccaagcaacuuuguuccaguguucuuguuagcaucacuaucuuccaaauaacccuuuuuugaaaaucuuggaaguaucuuugagccuucucuguuccuccuccuccuccucauccaguuagguuccaggcacuguuuaucccacuucuuucuuauuuaugaccuucuuuucaucccuucuaucacaauguuaguucucagucucacuaccaaucuccauuauuccagcaugaucccagaccacccagaguuuacacuucuguuagaucaucuuucuagaaugcuacuacugggauuauaucacuuccuacauccaguuucuguucugcccuucuuugcucugcuuccuuacaauuucuacuucaaagccaucuguaaaacacuagacuuuauucugucauuugcaauguaaagaaacauuaucugcgaaaacaccaaauuuaacuugauugaauuaucaauaugacuucuagcagaagacuaaguaaaguuuaagaucugagucaagauuauaaaagagcaaguuacgcaucuuugguugaugguagagugagauggagagggaagaaaaaaauuagucauaacaguuaaggauauuuuuguucgcuggugaaauaaaauacauugauauuuguugaauguuuauuccuuuuaacaugcaguuuaucuuuauaguuaauuauacucgaccagugaucauauugggaccuaugaaagacaggauaaaugaugacuugaucucagaauuuccugacaaauuuggauccuguguuccucguaaguaaaccaaacaaaaacauuuaauuguuacucuuaacauuuccugucacugugugugggaaaaauagauauaaccauuuuuuaaugguuuguacuuauuuuaucaguuacucuuccauccuccauauuauuguccuuucucagauuuaaauuaaucuguucuguugaacuuuacaaaacgauguaaguagaaaauggauuuauugugguuuuuuuuuuaauauuaaacacuuucccaaguuuuuuucuguuaaagauacaacuagaccaaaacgagauuaugagguagauggaagagauuaucauuuugugacuucaagagagcagauggaaaaagauauccaggaacauaaauucauugaagcuggccaguauaacaaucaucuauauggaacaaguguucagucuguacgagaaguagcagaaaagguaagcaucagacuaaucccagaauauagcuucuaaucagauaugccuuugacaguaugcaagacugguaggauagauacagcacuaauuaguuuuguuaaugugaugaauuugcuuaccuaaauaauuaauuuuccauggcuuaggaaagugcauacaagauaaaacagguaaauaagguaaacaaagaaagugaaaauagaaaugauaacaugaauguaagagaaguuauuuucaggucauuugcuagagauagaccuuuuguuuaggccuagcucuccagcauauauuaaaaggagauaagggccggguguggcagugcacccuuacaguccuagcuacugagaaggcugaguugagagaaucacugaagccugggaguuugaggcugcagugagcuaugagcaugccacugaacuccagccugggcaacagaacaagacccuggcucuuaaaaaaagaaaaaaaaagaaagaucaauaaaucuaaccacuuaaaauuuuuaaaaaacuuuuuuuauggccaaagacuuuuuccaaaaacuauuggaaaacaccauuaacaaugucaaaagacaacugacagaaaaaauuugcaagaaaagggcuaauauucccaauauauaaagaacucauaaaaacagggaacagagaccagaaacccaauagaaaaaaacaguggacaaaagaucagaauauauaguucacacaaaaauaagauauaaaauggccuuuguacauaggaaaugacguucaacuguagucauuauuaaagaaauguaaaggccgggugcgguggcucacgccuguaaucccagcgcuuugggaggccaaggcaggcggaucaccugagguuaggaguucaagaccagccuggccaacauggugaaaccccgucucuacuaaacauacaaaaauuagccaggcuuggcagugcaugccuuaaucccagcuucucaggaggcugaggcaggagaauugcuuguaccugggagguggagguugcagugagccgaggucgugccguugcacuccaaccugggugacaagagugaaacucugccucaaaaaaaaaaaaaaauaaggccaggcacaguggaaggcugagguggguagaucaccugaggucaggaguucaagaccagccuggccaacauggcaaaaccccaucucuaccaaaaauacaaaaauuaacuuggcgugguggugcaugccuguaauccuggcuaaggaggcugaggcaggagaaucgcuugaacccaggagauugcagugagccaaaaccaugccacugcacuccagccugagcaacagagcaagacuccaucucaaaaaaaaaaaaaaaaaauguaaauuaagaagacuacucuaaauucaauuucuccccuaucagauucagggagaaauaugaagacauuuucuuggugagacugagagaaaacaguugugcauugcugguggaaaugcaaacugguacugccuuuuggaaggguauuuggcaauaucuagcagcuuuccuucaacccagcaucccacuucuaggaauuuauuccaaagauauaccccaacaguaugaaaauacaugggcaaaaggguauuuauucauuguagcauuguuuauaauugugaaauacugaaaaucaucuaaaugcccagauaaaagugauugaauuaauuuuacauucacaaaaugaaguucucuaaaacuguuaauaagguauuugaacugauacacaacaugcaaaagaauaucuacgguauaaaauaagagaaaaugggaaaauacaaaucucugcucaguugugugaaaauaagcacaggaaagguaaaucagaacuuaaugagguugguuaccuacagagggagugauguagagagggaauuuggaaugggauggaaaggaugagggguaugacauuucucugaguauacauuuuuguauuauuuuaacuuuuagaaaguauguuaguauuuuacauauuuaaaaaaaucaaaaauaaaagcaacaaagaaagaugggggaaaagcaaaaugauacauaaguagaaacuaaauaaaccugacuguauuucuuuuuuuuuuuuuauacuuuaaguuuuaggguacaauaaaccugccuguauuucaaaugaauaacuuaacuacauugaagaggggagaagucuuaaucccagagauucuuuaacacaagcugaagacagaucuguaaacaaaauaaaacucuaauuaguagguuuguuggguggaguguaugggcuuacaguucugaaacuaauauauauucuaggguugagcaaauaaacuaauacaauggcaguagugggagugagguuugacugucagaaaaagggagaggguaaaaugaacucugugauaauuggauuggagauauuagauaauuagagcgaugaauaugaacccauggauuguuaagaguagauauagaaauagauguguauuuauguauacacacacguauguuuauuugcuuuauccacuaagaagaccuaaaaauaacacugaauaagccaugagaauaucuggggcccggaucugggcuucuaaauauaauucguuaauuaaaagauccaggacuccuuagagaaauggcugauucuggggccaggacuggaaaagugugagauaagccuguaacauuuugcugccagaaaaauaaggaagcacucaaagaaugaugaagauguguaaaaaggcaaaggaaccaagcuguagggucccccacuggccaagucugagauaauuugaauaucaagauaaaugauaauaacauauuauaauacauagaguaaaauaaaaaucguagaguccauaaugauauaaacaaacacagauggcccucaacuuagaaugguucaacuuuucagaggcgcaaaagugaugcauauucagucgcagccauacuucaaguacccauacagcuauucuguuuuucacuuguagaacaguauucaaugaauuacaugaaaaauucaacacuuaauuauaaaacaggcauguuggaugauuuuguccgacuguagaguaaguguucugagcacauuuaagguaaucugggcuaagguaugauguucaguaggguagguauauuaaaugcauuuucaauuuacaguauuuucaacuugugauggguuuauugggacguaacucccaucauaaggagcaucuguaugugaguaaguaaguggauagaagggaacgcuuuggacugucuacuaaucaagguagaagaaaugauuaaauuagaaaaucuuuugaaaaccgcauggugguaauuguuuccggcagaaaccaucaguguauucuaaaauuagugaacauuugaugaaaaaagggauauuuauauagucucaaaguguccucccccaaaauacuuaucaguuacaaagguaaaaaugauaauuuuacaguggagaaaccuagcagauaaaaccuuaaacaagugaucaaaauuaggaucacuaauaaugggacaaauagauauaauaucgccucccagauaugauggacuaagaaggacacacauuaugucuguaguauuccugccaaaaauguguaaccugccauccgagagugaguaaacacacaaacccauaaacccauagaaugaggcauauucuaugauauaaauauuuuauacucuucaaaaacaucaagaaagacaaaagacugaggaacugugucagauugacggagacuaaggagacuuuacaacuaaauacaaugugugauccuaugauccugaauucgauccuugaccaggacauuuuuuuacucuuuuccaauaaggaacauuagauggccacuuggaaucauauugugauuauguaagagaugccauuguuuuuaagaaauacgaggugaaggagcauuaugcaguuuauucucaaacuauuauguacauauauagaaagaguuaaagcaaaccuagaauauuaauauuucaguaucaaguuauuaaaauguuuaagcgaucauguaaaauauuuaugucugaugaaaguagauaauggguacauggugucuauuauuuacuuuucuauauguuuggaguauuuuacaguauuaaauuuuuuauuuuaaaugugcccaccaaauugaaauuaucauguauugacuuggacucaaguccuuggguuagaaguugcauuauggggcugagcaugguggcucacgccuauaaucccagcacuuugggaggccaagguggguggaucacuugaggucaggaauuugagaccagccucaccaacauggugaaaccccaucuguacaaaaaacacaaaaaucagcugggugugguggcgcacaccuguuguccuagcuacuggggaggcugaagcaggcggaaguugcaguaagccgagaucaugccacugcacucaagucugggugacagagcaagucuucgucucaaaaacaaacaaacaaaaaacugaaguugcauuaucggggagggccugauuucaaauguauuagaagaaaaucugucauaaauaauaaauacuaugcuuaacauggaaaugcucaucuguauuaaaaaccuaaguauccuuugucagugaguuuaagcuugucagaaaaguugucauuuaaauccagaacuggggucccauaugcuaguuuaugaguuuuugucagucccuaauaaaaugagaaauagaaggauugaguaguggcaaugagguuucacaaauuuguuuauuuaaaagguuugcccuuacucuaggguuuuuuaucuuuuaugaaaugauagcuauggggagaugguaguuuggagucuuaaugaauaacuuuucuuggcagaaugaaaaauaggaaccugggccuggcacaguggcucaugccuaucaucccagcacuucgggaggcuaaggugggaggaucacuugagccccaggaguucaagaccagccuggucaacagaacaagaccccgucccuuaaauuuuaaaaaaagggaacggcgggggagcucuauuuuucaccauuuugagaaauaacugauccgugaaaacuaggaacuguauuuucauuccuuuuuaaauauaacauuuguuugaaaauggcaaauuaauuaugcauauucagccauuucauuuccuaucuaaaguuugcugagagaaaugacaaguuuacuaaaagugaacaaggaucgaaacagaucaugauuuagacuguggaccuguaggaaaaguaccuuugauauuauugagaauauuuggcucacuuguuuuuuuucuuuguucccuuuauuuuagggcaaacacuguauccuugaugugucuggaaaugccauaaagagauuacagauugcacagcuuuacccuaucuccauuuuuauuaaacccaaauccauggaaaauaucauguaaguguaaaugccuaaggcauagccucuguguacaaauucagucacuguaggguaauuuauuuacucucccugcaucucaguuuaucuauaaaauugagauaauaguaguauguuuauucaccucagauuauguggugaggauuaaauaagcacuauggguuauaaauugucauuguaaucaucaucauuaauauuacuaaaguauaagguaacauguguuagaacuuuaaauagccccacgugugacuaguggcuacugaaguacgcagcacagcucucagguaaccauuaagagaauaaaagaauguauaaccauuaccuaauacuuucaggggacaaaaaaauagaaucuaaguaaaaauuaagaaagaacaaauagaaacacagaaugugaggcagaaccauauaaauagugagaugguauaaacuaaagcaaauaauagacuacuagacuaaauguuccaauuaaaagacaaggggugaagaaaaaaguaaauuauauguggcuuucaucagacacaccuuaaaaauuaggcuaugggaagguugaaaguaagagaauaggaaaagauauaccaugcuaaacuaggcugauuuuuauauggcugacgaauauacuuuaaggcaagaaguauuacuuagcuucagagugacauuucauggcugggcacaguggcucacgucuguaaucccaccacuuugggaggcugaggcgggcagaucacgaggucaggagaucgagaccauccuggccaacacggugaaaccccgucucuacuaaaaauacagaaaauuagccgggcguggucgcgggcaccuguagucccagcuacucgggaugcugaggcaggagaauggcgugaacccaggaggcggagcuugcagugagccgagaucucgccacugcacuccagccugggcggcagagcgagauccaucucaaaaaacuaaaaagagugacauuucauaaaaguaaaauauucacuccaacaggaagaucuguucguacauuuguuugcacuucauagcauucucaaaacaaaaaauaaaaauugacagcugcauaggggcgaaaaguaauuccaacaucaucgagagggacagaagcaauuaaauaagaaaacaaauauaaaaaucagugaagguauggaauaacacaaauuuaaaacuuuaccuauuugacaucuguuaaacacugcacucaucaucugcaagagacacauggauuuccaguguacaugaaacaguuacuaaaacugaucauuugcuagauuacaaauuucaaaggauagaaaacaaauacucuccgaccauaaugcaauuuaaauggaaaccaauaauuaaaagauaacuagaaaauccucauguauuuggaaauuaagcauuaugcuucugagugagucaaagaagaaaucacagaauaaauugauguuuugaacuaaauaguagugaauugccaaguagaguuuggaggcuuucauagcuuuguugaaggaauacacacagcuuugaaggaauacacacagcuuuaaauguuaggaaagaauguugaaaaucaaauauuaggaaaguugaaaaucuaagauuuugagaaacugaaaaagaaggcggggcacaacggccggccccuauaaucccaacacuucaggaggccuaggugggcggauuguuugaguucaggaguucaagaccagccugggcaacauggugagacucugucucuacuaaaaauacaaagaaauagccaggcaugguggugugcgccuguggucucagcuacuugggaugcugagauggggggauugcuugagcacagggagcagagguugcagugagccaagaucuugccacugcacuccagccuggugacagagcgagacccugucccaaggaaaaaaaaaagaaaacaauauuuaaaaauuuaaaaauaaaaaauauggcagagcagaaauuaaugaaauagaaaaaacaaacauaugauaaagaggaucaacaaagccaaaaguguucucuuugaaaauaaaauacaauaaaccauuaggagugaucaagaaaagaaagaaggcauaucaaugugaauaucaggcaagacaaagaggauaugacuacacaugcagcagacaccaaagagaucaacagaggcagccugacaggaaaagggacaaagggcuuggacacaucacaaaagagaaucuccaaagaauaagccugugagauagugcccaacuaaucauggaaauacagguuaaaaaaaugaaaaagacaaaauauuuaaugcuggcaaagauguggaacaacugaaacucguaacaguguuaggggugcagauuggugcaucuucauugguaaacuguugauaguaucauagugucuccuaaagcugaacaugcacgaguuaugacccagaagucauauucuuagacgcacacuccacagaaacgcuuaccuguguuuacaaagacagguacaagcgugaugacaguacuguucaaauagucaacgacugucaggugcggcggcucacaccuguaguccugacacuuugggagcccaagacagaaggauugcuugaggucaggaguugggagaccagccugagcaacauggcacaauccugucucuacagaaaacuuuaaaagguagcuggaugugguggugcauuccuguaaucccagcuacuuaggaggccgaagcaggaggaucccuugagcccaggaguucuguccaagcuguagugagcuaugcuugcaccacugcacuccagccuuggugacagagugaggccgugucucuaaaaaaaaacaaagagucaguaacuaaaaacuagaaacuacccaaauacuaucaggaguagaauauguaaauaaauuaugacauguucacaaugaaacauucugugauaaugugagcaaucuccagccacauacagaaguauagaagaaucucacaaguacaauuugaguuaaaaacaaaaacccagaccuaaagauauacauacucugugacuccaaauuuaauaauugcucauagaagucaaauagagguuacccuguaagaauggguuggugacuagagugagcacacccagauucugggguccuagucaugcucugugucuugaccuaaguauacagguacauguaaguuugugaaaauguaacaagcuguaugauacgauuuuucuaauauugcucaucuguguuugaaacauauacuucagaaaauguuaaggaaaaaauagaaaaggaaaagaaaaauagaaaaccuaaauaaucuaguacuuauuaaagacuugaacccgucauaaaaagccuuuccacaaauuaaauacuaagccaagcagacuuacuaaauucuaccaaaagcuaagaagcuaugucaauuuuauacaaacuuuucaacuaauuuaugagcauuaauuugauacccaaaccuggaagggacuauauaggaaaggaaaaugauaaagucagucuuaauuaugacuauagauugcaagaacccuuaccaaaauaggagcaaauugaaucaaacaauuuuuuuaauaaggcaaaauguaacaaccaaguuggguauauuccugguaugcaacacugcugcagcauuuaaaaacuaaucaguuauggagcuagagggaagauggcagaguaggaagcucugggaaucugucuccccacccagacgacaacugcacuggcagaaucugucugauguuacuauuucggaucucuguucaccauuuuuaucagguugggaacucugaagucuauugaaggcuuaugacuuccaggggaagguuugaaagguuaauuucagcucuuaacaugguagcaacuaccuguucgucuacccucagucccauagcauguagccauguacacauuuucaagcagcuuugcauaggguuugugggagccaguguggacaauaaggauucuguccuccaaauagcaggaaucuuugcucugauagcuaauuacugcuucugaucauggaggugcagccauacagugagccauuguugcaaaccccacugccacuguuacaagccccuccacuugaggcugaagugacuuaaagauuuaaagggccauugccuucaguggugauuagugaggagaaagaaaaaauauuaaguaaaaacaaagggcuagugcuucccucuuccccccacaccacagacacacacacacaccuuuuuucccccuccccuuuugggggccagaccaggacauucaaaaguauaugaggggagguuuucauauccauggaaaaucacaggcuuagaaaauaccugaaaagacccuaaguuuacaccucaggcugauuccugguacagaaacaccuugcaacaguaaacaauaaaauuaaauuuuaaauaaaacagcaaacccugggaaaggaagagaauucguucuccagaguuacuuacauuguaagauuuaaauguguaguuucccacaaaaaaaucacaagacauacgaagaaacaggaaaauauagcccauucaaaggaaaaauaaacaaacuaucccugagaaagacuauacuugagaaagaguuagacuuaauaaagacuguaaaacaagauacuaaaugagcuaaaagacauggacaaagucucaagaaagugauaggcccagcgcaguggcucaugccuauaauccuggcacuuagaaggcugagacgagaggaucacuugaacuccgugguucaagacuagccugggcaacauagugagaccuugccucuauaaaagguaagcaaaaauuggccagacgcaguggcucacgccuguaaccccagcacuuugggaggccgaggcaggcagaacaccugaguucgguaguucgagaccagccugggcaacauagcaaaaccccaucucuacuaaaaauacaaaauuagcugggcgugguggcgggcaucuguaaucccagcuacuugggaggcugaggcacgagaaucgcuugaacccaggaggcggagguugcagugaguagagaccauaccauugcaccccagccuaggcaacaagagcaaaacuccgucucaaaaaaaaaaauaaacaaaaauuagcuggccaugguggcacgagccuguggucccagcuacaugcaaagcugaggugggaggaucucuugagccugggaggucaaggcugcagugagccgagaucacaccacugcacuccagccugagcaacagagggagaccuugucuccaaaaagauaaaggaaaaaaaagaugaaaaagauacaugaacaaaauggaaauaucaacaaagaaauaaaaaaccuaaaaauaaaccaaaaggaaauucuggagguaaaaauaacugaaauggaaaauucacuacagggauucagggagauuugagcagacagaagaaagaaucaacaaguuuuaacuuaaagauacaacaauggaaauuauuuagucugcgaaacagagaaaugacugaagaaaagugaacagagccuaagggaccuauaagacaccaucaagcagucaacguacacauuguggagguccuugaaggagaauagagagaaggcagagagauuguuugaagaaauaauggccaaaaacaucccaaaugugaugaaagacgugaauauaauccaagaaagucaaugaacucaaagcaggauaaacuuagauacccacacugcggcacauuauaaucaaagugucagaauacagagagaaucuugaaagcagcaacuuaccacacacaagggauuucccaauaagauuaucagucacuguuuuuguuuguuuguuuuuugagacaaggucucgcuuugucacccaggcuggagugcaguggcucgcugcuuacccagguuacugcugucuuaacuuccugggcucaagcagccucucaccucggccucccaagcagcuagggcuacagacaugcaccgccacgccuggcuaauuuuuguauuuuuuagagagacaggauuuugccauguuucccaggcuggucucgaacucugagcucaagugauccacccaccucagccuuccaaagugcugggauuccagguguaaauaaauacccaccuugcccagcaaucagcagauuuuuuuuuuuuuuuuuuuuaugagacagggucuacucugucucccaggcuggagugcaguggcucauucucagcucacugcaaccucucugccucccggguucaagugauucucuugccucagccucccuaguagcugggauuacagggacucaccacugugcccugcuaauuuuuguauucuuaguggagacgggauuucaccauguuggccaggcuggucccgaaguccugaccucaggugauccgccugccucggccucccaaagugcugggauuacaggcuugagccaccaugcccugccagcagauauuuuaucagaaacucuggaggccagaaaacaguggguucaaaacacugaaggaaaaaaaaaaaauuuaacugucaacaaagaauccuauaucuggcaaaucuauucuucaaaaaugagggagaaauuaacacaugcccagauaaauuaaaacugaaagaguuuauuaccuguaguccucccuuacgagaaaugcugcagagaauuuuguagggugggaugaaagaguacuagacaguaacucuacaaaauaucaaagcaaacgucauaauuaauggcaaaauauugaaggcuuuccuuuaaguugggaacgaacucuauacucaucauccagcugcagcaauaauuauccacuuaugaccaaucuuguuucucuccacucacacccaccuccuuacaccuucauuccagauuauuuugaaacaagucucagacauuccuaucauuuugucuguguacaucacuguguauuugaaagauaauuucuuacaaaaagucacugauuaucauacuuaaaauaauaauuauuugauaaaguucaaauguugcugguuauuucauaaguuuuguuuguguuucuucaguuuguuggaauaaaauuuuuaguaagaucuauucauggcaguugguuaaguuguuuaaccuauagauucucucuccacaucucucuuuuaugcccccaccccgccacaccucccauuuauuugugauagaaaccaggucauuucuucugcagauguuuccccagacuguauuuucugauuaccuucucaugguguuauuuauaugguuguuuguccccuuauuuucuguaaacugauagguagaucucuaagucacuuuaauaugaaauuuucaucaaagucaaaaguaucauaaauuaaugaauagguuuuuuggcuacacugagcugaugcagaauuuguuaaaacccucugucauuccaaguauacagcaacauauucagugacuaaaucuaguuuuuauuuuuuuauuuuuguuuauuuauuuauuuauuuuguuguuguggagacagagucucgcucugucacccagacuggagugcaguggcacgaucucggcucacugcaaccucugccuccuggguucaagcgauucuccugccuuagccucccagguagcuaggauuacaggcaugcgccaccacacccagcuaauuuuuauauuuuuaguagagucgggguuucgucuuguuggccaggcuggcccugaacuccuuaccucaagugauccaccugccuuggccucccaaaaugcugggauuacagguauuagccaccauguccagccuauuauuuuuauuuuuaaaaaucccagaaacaggcugggcucgguggcucacaucuguaaucccagcacuuugggaggccaaggcgagcagauuaccuggggucaggaguucgggaccagccugcccaacuuggugaaaccccaucucuacuaaaaauauaaaaauuagccaggcgugguggcgcaugccuguaauccagcuacuugagagaugggggcaggagaaucacuugaacccaggaggcggagguugcagugagcugagaucgugccacugcacuccagccugggugacagugucagacacugucucaaaaaaaaaaaaaaaaaaaaaaaaaauucccagaaaugaccagaaugacucaaguuuuuaaugacauucauauuuucagcagaguucaacuuuucaugauuuucuauuuuaugugucaucucuccuuugccaucuuuuuuuuaaaaguauuauaauuugguaauuaucaauuucuacauuuauuuucguagggaaaugaauaagcgucuaacagaagaacaagccagaaaaacauuugagagagccaugaaacuggaacaggaguuuacugaacauuucacagguuggaaccguguuguaacaguccucuuuaagauagaauuuugcuuugaagccaugugaaccgacccguucagguggauuuugaacuaugccuacaucuacccguaguaacuaguaucauccagccuaggcaguggugcuggggaaccuuuuuuuugagacggaguuucgcucugucacccaagcggagugcaaugguaugacucggcucaccgcaaccuccgccucccuggcucaagcgauucuccugccucagccucccgaguagcuggggccucccuggcucaagcgauucuccugccucagccucccgaguggcugggauuacaggcaccugccaccacgcccagcuaauuuuguauuuuuaguagagaugggguuucgccguguuggucaggcuggucucgaacuccugaccucaggugauccaccugccucagccugucaaaaugcuaggauuacagcggugagccacccugcccagccaggaaucuugaaauuuaauguuucuuagguuauugauuagaacaacaaaaacaggaauaauucauacuugaccagagaaaaauagauuuagauuucauuucuucuaugaaacucugauuuuucucuuauccuuuauaaauuuugauccauuuucucuagccauguugagguauaauugacaaaauucguauauauucaaggcauauaaugugauuugauaaauguguacauuguaaguugauuaacacaaucaaauuaacaugucuuuaaccacacaguuaccauuuuguguguguagggaagacucuuaagaucuacucuuuauuaacaauagucacuacugcuguauauuagauccccagaauuuacucauguuaaaacugaaaguuugugcccuuucacuaacaucuccccaucucuucuacucugcagucccuggaaaccaccucucuguuucuaugaguucuacuuuuuuagauuccacguauaaaugaaauacaguauuugcuuuucugugucuggcuuauuucauauagcauaagguccuccacauucacucauguugguuguugcagaugauaggauuuucauuuuuauggccuaauaaaauauuccauuguuguauauauaccauaugcaugcauacauacauacauauauauauauauuuguuguuguuuguuguuggguuuuuuuggggguuuuuuuuguuguuguuuuuuuuugaaauggagucuggcucugucgcccaggcuggagugcaguggcgcaaucucggcucacugcaaccuccgccuuccguguucacgccauucuccugccucagccucccgaguagcugggacuacaggcagcugccaccacgcccagcuaauuuuuuguauuuuuaguagagaugggguuucaccauguuagccaggacggucuugaucuccugaccucgugauccacccgacucggccucccaaauugcugggauuacaggcgugagccaccgugcccggccuguuuuugguuuuguuuguuuguuuuugaggcaggguuuuguucuugcccaggcuggaguacagugucaugaucauggcucacugcagccucaaccuccugggcucaagcaauucucucucuucagcuuccuuaguagcugggacuacaggcgugcaacaccacaccuggcuaauuuuuuauuuuuguagagacagggucucgcuauguugccuaggcuggucucaaacuccuaggcucaagcaaucguucuuccucggccucccagagugcuuggauuauaggugcacugcaccuggccuacaauauucucuuuauucauucaucuuuuuuguuuuuggagauggaguuuugcucuugcugcccaggcuggagugcaauggcaugaucucagcucaccacaaccucccggguucaagcgauucuccugccucagccuccugaguagcugggauuacaggcaugugccaccaugcccagcuaauuuuguauuuuuaguagagaugggguuuccccauguuggucaggcuagucgaacucuugaccucaggugauccgcccgccuuggccucccaaagugccgggacuacaggcgugagccaucgggcccggcucauucaucuuuugacagacucuuaggugauuuucauaucugggcuauuguugauuauguugcagugaacauaggagugcagauuucaacauacugauuuauuuuccuuugguuuucuuuuuguuguuguuggcuuuuuguuuuuuauuguuuuguuuugagacagagucucacucuguuguccaggcuggaaugcgggugugaucucagcuugcugcaaccaucgccuccuggguucuguugauucuccugccuuagccucccaaguagcagggacuagaggcacaugccaccacacccagcuaauuuuuguauuuuuaguagagacaggguuacaggguuggccgugcuggucucaaacuccugaccucaagugauccgccugcuucagccucccagagugcuggaauuacaggugugagccaccacgccuggcccaauuuccuuuccuuuguauauauaucgaguagugggauugcuagaucauauaauaacucaguuuuuaauuuuuugagguggcugggcacagugguucaugccuguaaucccagcauuuuuggaggcccaggugggcagguccccugaggucaggaguccgagaccagccugaccaacauggcgaaaccccuuuucucuacuaaaaauacaaaauuagccgggcgugguggugcaugccuguaaucccaacuacuuggaagguugaggcaggagaauugcuugaaccugggaagcggagguugcagugagccaagaucgcacaauugcacuccagccugggcaacaagagugaaacucugucucaaaaauaauaauaguaauaauaauuucuugaggaauguccacacuauuuucugugauggcuuuacucauuuacauucccaccaacaguguacaggguucccuuuucuucauaccauugccuacuuguuaucucuuaucuuuuugauaacagccauccacacaggucuaaggugauauuucauuaugguuugcguguguguuugugacagagucuugcucugucacccaggcuggaguacaguggcaugaucucagcucacugcaaccucugccuccuggguucaagcgauucucaugccucagccuccugaauagcugggauuacaggcacaugccaccacacccggcuaauuuuuguauuuuuaguagagacaggguuuugccauguuggucagacuggucucaaacuccuggccucaagugaucugcccgucucagccucccaaaguguuaggauggcaggcgugagccacugcacccagccucauuaugguuuugguuucuguugcucugauuaaugagguugagcacuuuuacugauaccugcuggccaucuguaugucuucuuuggaaaaaugucgauuccaguccuuugcccauuuuuuaaauggauuauuugguauuuugcuaaugauuuucuuauauauuuuggauauuaaccccuuaccaauugcauguuuggaaauauuuucuccucuuccauagguugccuuuucauuuuguugauuguuccuuugcuguguagauuuuuuauuuaauaucccacuugaugauuuuuuauuuugcugccugugcuuuccaaaaaaucauccaagaccagugugaaggcgcuuuuuucccuguguuuucuucuaggaguuuuaugguucugguuuuacauuuaagucuuuagucuauuucaaguuaauuuuguauaagauaaggguuuaguuucguucucuugcauguggauauccagauuuuccagcaccauuuauuuaagacacuagccuuucccuauuguguagucuuggccccuuuuuaaugauuaguugcccuuugauccguuuugaaauacuauuuguuuaaaaaaaaaaaaaguagguagcaacuccccaauauucuuauuuuacucgccuuguccuuuaacuuccuccucaagucuuuggacauuuuuguuguuguuacuuguuuguuugaaauaauaucagccuaaauuugacauucacacugaguaucaguaagggucaugguuuuuaaaccuugugcuuucuuauuuuuuucaaacuaauuucagacuuaaauagaaguuacaagaauaguacagggaguuucauguacccuucacccaaauuccucaaguguuaacauuuuaccacauuuauagguuuuuuucugauacacuugagaguaaguuucagguagaugucccuuuacuucuaaauauuucaguguguauuuucuaaaaaacagggauauucccuuauagaaucauaguuuuauuaucaaaaucaggaaauuuaauaauuauaugucucaucuaacuauagaucuuauuaguauuucacuauucuucuaaucucuuuagagcaaaauggaaaaaaaugguuuuucuguucuggugcaggauccagcggaggcucacgugcuguauuggauuaucacauccuuaauguucuuuaaucugaaaucguucccaagucuuguuauucaugacccugacugacauuuuuuaagaguaaaaacacuaggggggauuuuuuguuguuuuuuguuucguuuuguuuuuuguuucguuuuguuuuuugucuuuuguuuuuuuuugagccagggucucacucugucacccaggcuggagugcaauggugcgaucucaguucacuggaaccuccaccucccaggcucaagugauccucccaccucagccucccaaggagcugggacuacaggcuacagccaacaugcccagcuaauuuuuguauuuuuuguagagacaggauuucgccauguugcccaggcuggucucaaacucauccaauccgcccaccuucaccuugaccucccaaaguggugggacuacaggcgugagccacugcacccggccaaagacccauucuuuuauaaaaugucccucccucaauuuggauuuaucugauguuuucucauaauucgauuuagguucugcauuuggggcaggaauagcaaugaaguaaugauguguccucuguguaucaugcaaggagguuuacaaagucuacuugugccguuacuuaugaugcuaauuuuaaucacaugguuaaggugucugcagccuuaugcuuucccaguuucccugguuuacuaaccauuccauuaaugaauuuacaaaguaagcaaaauguauauuucccaagucaguuccugacuguuuucuccuaaaauaaauccuugcgugcuguugucaaccuaaacuaugaaaugcucuaaaauaaauccuugcgugcuguugucaaccuaaacuaugaaaugcucugggauucuguccugugcuguuggggugcaucaagaugccaaacccacgaaccaaguauuuugucaaaugaacugagucuucagggacauugaggcaugucugcauuuagcucaaaagguagaagucucacaaaacugauacuagcgaauaucauguuacugaaaauucuugguuauucaggcguuccuagcuauguauaagugcuuccuaccuacauacaacgucuuucuucuaugcacaucaucucagguaccaaauagacaguauuauuuaaaaucccccuuugacauuuuaugcucaguuuuucagaccauggaaaucuacaccuaugaugcucuuccaagaucacugggcauuuuuuuguaguuuaguaagugacuuauuuaauuugcaauucucaauuauuucauuuauauguaaacuuuuuuacgagacacaagguuccacucugucacccaggcaaaugguacaauccaaugguacgaucauagcucacugcaguugugaacuccugggcucaagagaucauccuccugucucagccucccaaguagccaggauuacagacacacaccaccaugcccagcuauuuuuuuuuuuuuuuaaauacacagggucucacuauguuccccaggcugaucucaaacuccuagccucaagcaacccucccacuucagccucccaaagugcuaggauugcaggcaugagccaccaugcccaaccauaaacauuuucuuucuuucuuaaaaaguuaguuacucaugcuuagugcugucuagcgauacuuuguuuuuguuuguuuguuugcuuuauuaacuaaucccucacagaccucaggggcuucagcuauucccaaagaauuaguuguuaguaauuguuacucuuuuuuucacacauuauuucagacagcaaauaaacauugauuguuaagucucuaaccacuaacaagcuagcuuagguaucucucaauucaccuacacuacaguaccugacaugcuagcuuaacugaaaaaaguaguaucaaucuguaaucagcucuuuucccccaagauccuaccccaaaaaaaaaaaaaauuauccuuacaucauccugucuaugggauuguacccaguuuccuuuuuucuacauauguuuauggagaaaucaggaaaguuaagaaaauaauuuguuuuaaaauaauaaagcuaauauaugcucagaugguaaaagaacaaaagaaaagaucuccaagucuuacuuuuugauccauuuuuaagauaaaaauuuuauacuauauaaauaggaaaauuaaugaagugagccuuuuuuccuaagugaacaguguguaaauggugauucuuccuggaugaguaacuuuuucaaagauacuagcuucuacuauuucaucaauaauuguaauggcaaaaauagacaauuaauggagauuucugauuuuguuucuaucauuacagcuauuguacagggggauacgcuggaagacauuuacaaccaagugaaacagaucauagaagaacaaucugguucuuacaucuggguuccggcaaaagaaaagcuaugaaaacucauguuucucuguuucucuuuuccacaauuccauuuucuuuggcaucucuuugcccuuuccucuggagucuuucuugaguacugauuucauguugaauuguaucccacacaucauggucugcagcuucuuuuucacauguagugucuccuucaaguuacaucguguguauuauuuaaugucacuauugguuaguggccauuuuucagaacugaagauggaauggccugaccagcuauuaagaacguggggagacgcagaaauugugguaaaauuccuuaauguuuaagggaaaguaacuuuaagagauuuuuggaaaagcuuuauauacauucuuuucaaauuucaguacaaaugaaaaagugguuuuaaucagugauuuaguagacuuugagcaacugugcacgcuucaguuuaauagcaugguuuggccaguguauuacucucaaguccuuuucucaaucaacuucuaucaucaaagcaauuguuucauuauagauaaauaaggacauuuuuuaauuuaaaaauucaugucugaguugacuuucauaagggauuucauuuuuuccucaacauucuuaaagccuuuuaguauuugacgguucuuuuuucccaggacauuugcuaggaauaacaacguuucaauguuuuuaaucuacuugagcaacacuaucgugucuuacaaaaguuguucauauguaaaugaucaucacauuucgugaauugaggccauguucaggugcuaaggaaguucgccuuuuacacagaagauugagaaaauuuccuagauauaaauacagauaaaucagacguuacaguggugacguaguaaccaucauggcaauggaaaggaguccaauucauagccuaaaacuucaaauguauucuuaggagucagauuuuacugaauauuuuacccacaauagcugccuauuuuguuauaauaaaauauauauaaauauauauauaaaacuuucuuuaaacuguaacuaugggaauuauuuucuuuacauaguugcgcacacacacaaacauauauauauauuuaaaauauauuuuguuucuuuugccaccuacuccuaacuuuuuguuugguuuuuaaauuaaauauuaauugaauagacuuaucuuccuuaaucaugugaacugaaaaugggggcaugguggucaugaggaggaaacauuuagggaaauuagauuauaaguaaaagugugggcauauucuccucuuuucuacaaagguuuucaaaugguuccugagguuuuuuguuguuguccguguuguuacuguuguucuugucaucagguuugauuuugguccuugcccuuuccuucuaguucuccuuuuauuaauaggaaggcaggcaaaagccccauuuauguguguguuuuccccucagacagcuuucauccacugcucugcacuagaauugcacaaaucuucauggugagcaauuuuaagaaauguuagugaaagguagaaauuauuucacaaaucaguuucucugguccuucauauuaauaauaauauuuggcuucccauugcucuuuggaguuguuuauuaaauauguguuuuugacaaccuccucauuaguuucuuaaaugaguacugguuuguaaagaauuaucaacauuauccauuccauuuaugaagaagaggagaacagcuaauaaacuguauuguaaaauccauauguuaagugugucuugaauuuugaaagaaaaaauauauuuugcaagcuaacauuuucuugaaacaauuugaggcaucauguaacuuauaaccgaauccaagagccguuaggcagcagaguguguuaccacauugaaauacacagugcugcuguuagacuaaaugucguagguuguuaaccacauagaaacacacuaguaugaagaaaacuguuguaaaaucucaagagcuucagaaacugccuuacaagaccgcagcauaagcuauuuugaaguauuuaccaaauagucacauguuguaaaauaucaagugguuauaaaaggaugccauuuauauauuaaaauuuacauaacauuguuuucugga

SEQ ID NO: 192622 - RNA, 5976 nt, Homo sapiens
gccugucgcuguggaaaccgcuaggccagcgcucgccgggaccuggaaucccuguacgccgaggugggagccgguggaccggucccccagccggcccccaccuccgcuucccgguguuugaggguucgggccucccgccggggaguucaccccucgggcucgucaguagggcuguggcugucgccucuuccugcagcgccaggcuccgcccggucucacagucggcuuaggggcuuugcgugcacugcgguuggguggaaaaacccacuccugguuguuuagacguuggccugcagacgaugucauuucuguauuccucuaaggguaagaaagccagccuugcacuaguggagacgugaguagggagagaaucgucuacucuuuggggacauucguacccuuaggugcuguggggcuuccuaacaagauugugggcaguuacugaucucuggggagaggaguauucguguccaggaagaauaauuggauaaacgugccguccuucuuccuaaacagaguggaaucuguaagcaggccaagagagcauccaggcggcuuggaguggaauagagggcucuagagcgggugucucaaagaggaaacagaguguaugucaaaacauacuauccaaaacugaaaauagccgggcagguggcucacgccuauagccccagcacuuugggcgaaucaccugaggucaggaguucgagaccagccuggccaagauggcgaaaccccgucucuacugaaaauacaaagauuagcugggcauggugguaggcaccuguaauuccagcuacucgggaggcugaggcacgagaaucgcuugaacccaggaggcggagguugcagcgaggggagaucacgccacugcacugcagccuaggcgacagagggagacucuguuucaaaagaaaaaaaaaaacugaaaaugguaguauaagcauguuucuuaagaaauggagagagaaauuuuggaagauaugccuuuuaaaauucagucuggcucccuaugaagaggaguagggccaaggacgauaguuuguuguuauaagccucauagaauuauuuuauauuccaaauacaaacauuacuuuagcaaaaauuaaaguuaaauuuuaaaaagagucuaguaaaaaaaaaacuacauuauuugaguaccaacugcauacaucuuugacgaguacagccauugcuucaguguguggaguuuauaugugccccguagguuguaguuuacuaacaucaaauuuuaguuaggugaauugggaauaguauucguuaaaaaaaaaaaaaaagcaagaaaagagaaggaaaagaaggagaaauggugugagcucauugcaucagauuagagguagagcacaguaauuuuuuaaaguaguuuuuuuuuuuuuuuuuuuuuuuuuuaagaauaggcguaucaugcuuuggagaggcuguugugcaguggcaccaucucaacucacugcagccccaaacuccuggguucaggcgauucucccaccuuggccuuugguguggcugggacuacaggugcaugcugccaugccuggccaauuuuuaaauuuuuuguagagacaugcauggucucgcuguguugcccaggcuggucucaaacuccuggccucaagguaucuccucuccuuggccucccaaaguguugggauuacaggccugagccaccacaccugccuccaucuuuuugagauggagucuugcucuugucacccaugcuggagugcagugguaccaucucagcucacugcaaccuccgccucccagguucaagugauucuccugccuuggccucucgaguagcugggauuacaggcaccugccacuauguccagcuaauuuuuguauuuuuaguacagacgugguuuucaccauguuggccaggcuggucucgaacuccugaccucaaaugaucugcccaccuugaccucccaaagugcuggcuggggugagccacugugccugggcuuauaugugauuaauuuucuaagaguaaaaauucucaugcccaacaauaaguggugaauaauaugauuauaguacauccauaaaauaaaacauuuagcagucauauaaaauguuacauuguaguaaaacauuugaugacaaaauaauaauauauguuguuaaauuugaacgucaggaaauagcuuguaugauaagguauguaugaaacauacuauaaacuauaugccuagaaaaaagacuggacacaaucaagggugauuauuuucuauagguuuccccucuccuuugcccccaguauucuacaaugacguguauaaucacugcuaaguauuuaauaaaaaguauguuccuaauagugauucuccagcagaacugaguucacgaagauaucaucacccuaugccacuuuaccucaauguuucuugacauuuacaaaucuuucugggaaugucacagucacaucaaaagcagugcuuaggguuaaguguauucuuugggcacugaggguggggaaaggaagagagaauaguaaguauucaucuacaaauagcuguuucuuguagcuagaaaauuaucauauagugagacacacaggccaaaauaaaagcccugcagacauuacugacuauuguauaugaagaagcugagauaugugauguauaugauguagcugcagacguuacugacguguauaugaagaagcugauucugcagcaggucugcuuuuugaucaggcuucuagacuguaaaugcuuucaaaaauguacagggaccaucauguuaauucauagcauuaaacaauguauggaaugcccacuacguuccagguauuaugcugagauauugugguggaaaaugaauaugccccccacccucauggagcauauugacuagaagggaagauagaugauuaaauaaauaaugacaaaaaacucuaguaaaauaauugggaaaguacaaaggagacaguucuggauuggugaaccucucaggacaaaaugauuaagguuaaaaaacuuaccuuaucauaguaccuugauaccgaggaugcucgauaugcccuuucuuaauugauaaauaguaaagacccuauaggucagcuauugggcugacuuagggguucauauucgaucuucaguaagagugcaguacacuaagagguucaaacuggauugcauccccagauucacauaugaacaagucuauauccuugaaaaaaccagaucuuagggauccaacagguugaaacuaacccagggccaagcugaacuuucagggcaguucucaaaauaacugagcuuuguggucguucccgcgcacauaccccacaauuggaaugauacagagaggaucagcauggccccugcgcaaggaugacacacaaauucaugaagcaguccguauuuuaauuuuaaaaaaaaugaguuucacaggcugagcguguguggccagagccggacuagaaccagaucuucuggggcaaaggggcgaggggaaugaaugacauuuauccaacaccuaguuguuuuuucccuuuagcaggaagucauuaugcaacuuacacauauucaucagauuuccucugacuuacccggacauguacaugggaaugaugugcacugccaagaaaugugggauuagguuucagccuccagcuauuaucuuaaucuaugagagugaaaucaaggggaaaauucgccagcgcauuaugccaguucgaaacuuuucaaaguuuucagguaccucaugucuuaucuugccuccugucuuaaauauucucuaaauacagguucacaucaugacucugucagggacuggaugugugacacuggaugaauuacuuacucucagugagcuucaguuuccuaaucuauaaaagggaauuguaguguuuuuuuccaaucugauaauuaauaauccuuuugggauugcugccuagguuaaaugauauagcauuauucaauaauauuaauucccuucucucauuccaaauguuuuuuauuuguagucuuaauauuuuauuaauaccacuacugcuaucuaaaagcuauaauaucacuuuucuucucagacauauucuccaguugaaaguguuuaauaucucuacaaagugauuuuuaaguuaaagaagucaaaacuguaucuguccuucucccaccacacugaaagcucaauauaaaggaaugguucuacaaaguaauucauuccaaucaagccauuuagcuacuugacuauaauggagauaauauuuucaggguucagaguuuuuguucuguuuuggcuguugcaguaguuuauggcguauaugauguacgugguacguaugugguauauaguuuucuucucucucccagauugcaccagagcugcugaacaauuaaagaauaauccgcgacacaagaguuaccuagaacaaguaucccugaggcagcuagagaagcuauucaguuuuuuacgagguuacuugucggggcagagucuggcagaaacaauggaacaaauucaacgggaaacaaccauugauccugaggaagaccugaacaaacuagaugacaaggagcuugccaaaagaaagagcaucauggaugaacuuuuugagaaaaaucagaagaagaaggaugauccaaauuuuguuuaugacauugagguugaauuuccacaggacgaucaacugcaguccuguggcugggacacagagucagcugaugaguucugauaccaaacacucaaaacaugcauugggcuagcagaauauccauguuuauuaccagacugguucuggaagaagcuguaaagaauacuaaauauguuggguuauaggggauugaccauguuacuuuucaaaaccaggacauuuaaagcaucuacuauguaggugcaugaggaguaugggaaaaacagaauaaaggaaucugccuuuaaggagcuuacaaucaugccgggugcgguggcucacgccuguaaucccagcacuuugggaggcugaggcggguggaucaccuaaggucaggaguucgagaccagccuagccaacauggugaaaccucgccucuacuaaaaauacaaaaauuagccaggcgugguggcgggugccuguaaucccggcuacucaggaggcugaggcaggagauucgcuugaaccugggaggcugagguugcagugagccgagaucgcgccauuguacuccagccugggcgaugagcaaaacuccaucucaaaaaaaaaaaaaaaaaaaagcuuacaaucugacuggaagaugucaaaaccugugaaaagcuaauuagcaguauuaagcaacacaaacauuagugccaaaugcaugauaaaggcuaaagaaggccagagcauauauuacuguagaguagaauaguaagggaagacuuuguccuuuaguaaagagauaggagguggccuggcccuugaaauaguaguguuuagguagaugcuuguguaggauuccugauaagagcaacugaaaagaaggagaggggaaguaguaaagggacaagaaacaauuuuuuuuuugaggaaccauaagcaaauuauaguuugacaagacaagauugggggacauauaugguuaccagggaauuaccucuuauguguuauaucuuuauauuauuuaucucuggaaaagaguacccugcaaaauucccuacagcugcaagcagaugucacuugauggacagagggggaauucugccccuccgguaucgggaaauacauacuaaagacauugcgaaacgcugaaccucuucccauaaauaaaagguuuguuuguaaaaugggaaauccacccauaauaaaugaacaauaggcacugccaguuuaggccuguucaugaauggaucugcaagacagcaucuucguuuaacaacauuaucugugauuugauacauuuauccuuauuacaauauuguuuaguugguagaaauucuauguuuucuacaaggaaauugauguuuauuaaauaaaacugaaaauaauua

SEQ ID NO: 192623 - RNA, 49332 nt, Homo sapiens
cccgggcgucuccccgcaaccuccucaacuucccuagucagugacgcggcgccggccagaaauccgaccggaccgggcucgggggagcgugaguugcaggugugugccuaucuuugcgucucuguuugagaggacaaacuguggggcugggaccgcgaggugacugugacugaggaagagugguaagugacagcgagggcagugggagccaggggcugggaggcuacugugaccgagggccagugacagcgaggggacugugacccaggagcagugaaugcgaaacacggugaccucggagagcgcgaggccggggcugcgacggcacuuggaccgaggaaguaugaggcagugacugcaagggacuaugaucaaggggcaaggacuccaaggagacucugaucgauugguagugacugugggggauccggaccuaagggaacacgagcagcggccgcgaggggacuccgacccagagcagugacuucgaggggcugacuuggagaagaggauggcauccgugaugggcgauggcgcuguaggguuguguuugggcacggggugugauuggccgugacugggcagagaaggucuuuaguggaaagaacacuggucuggaacuuaacaggccugaguuuaauuuuuacggacaaacuucaccacugaguuacaguuucuucaucagugaaugggaaguuuggacuaguuuaaugccucccacacuauggguuucuuccuaguauugagcugugaaaccaauuuaguggauggaaccuguacuuuuuuucuuuuucuuuuuuugagacaguuucgcucuuguugcccaggcuggagcgcaguggcgcgaucucagcucaccgcaaccuccgccucccugguucaagcgauucucuugucucagccucccuaguagcugggauuacaggcaugcgccaccacgcccggcuaauuuuuguauuuuuaguagagauggggauucuccauguuggccaggcuggucuugaacugcugaccucaggugauccacccgccuaggccucccaaaaugcugggauuacagugugagccaccgcgccuggccugaaccuguacuuuucuuuuaaaaaguggaauagaauagaaacuuucaguguguuuacauaguaaggguaaguauuguuucaugugauuuguuugaguuauguguguaugagauuaugauguaaaauagauuuuguacaucucaaaguguaagaagcaaaauguacuuuaaaaguuugaaaaacauuggaccggaugauuucugaguuuucuuuugguucuaaaauguaaugauucuaugaauagggaacucuuuggaaguacaaagaugcaauugggaacaggcuguauuagccuggccuaacuggaggaggcuuccugaauguaauugaggugacuagcugugagagcugaaacucggcaucucaguugggagaaccagaaauuauauugaaauagggacacugggcgggugugguggcgcaugccuggaaucccagcuacuggggaggcugaggugggaggauugcuugaacccaggaggcggugguugcagugaguugagauugugagacugcacuccagcccgggugacagagggagacucugucucaaaaaaaaaaaaaaaaaaagggacagugguauuugugauauuuauagaggcagugaggauuuagggguuugugguaugagaaacugcucaugaggaacgggaagcuuugagcguaggaacaaggguugggaaggaaacucaagauaggggcagaaaauaaucugccaacaauaaaauggaaguaggaaggcagauaugaccuccagagccuauuuaucuugauauuuagugauuuggcaaguacagagaauugcuaguaaaaagacauugagaaugggauuuagugcaguaauagcaguaaacuaugaccaugaugagaaagaaagggggacaaaaugaugacacucgcagugucaauaauggugauugggaugccacaugggagagacuucaauguacuuagcucucuaauucaaugauuuguacacugaggccaagccuggcaugcuaggaaugauaccacacuauggguaauguaaaugaagcuuuagcugcugacuuuauuuccuacacauucccuuucuuuagggcugugagugauguagaugaaauuaaagugaauguuacuacuuccuucucucuuacagcccuuuuuauuuuauuuauuuauuuauuuauuuuugagacagagucucacucuguugcccaggcuggagugugcuggcacgaucccagcucgcugcaaccuccgccuccugguucaaagcgauucuccuaccucagccuccugaauagcugggacuacaggcaugugccaccaugccuggcuaauuuuuguauuuuuaguagagacaggguuucaccacguuggccaggcuggucucaaacuuccgagcuuaggugaucuacuaaccucagccucccaaagugcugggauuacaggugugaccaccacgccuggccuuacagcucuuuuuagaaggugcuauugauugugccaccagugcuuuuuauaauaggagaaguaugaggucauuuaauuuaucguacaguguauuaaucugauaaccacuccugcccccuacacucuguaauaggggaauagaguucagauagguucuugaaugggaaugaguugagaauggugggggauagccuuuucuuggcuaaauaaauugguuaguuacaccuuuuucuagcacauuagauguuuacuugacuuacauucuacauagcuaaaaggaacuacccagggguuucuucuagaacagcaucuaugcuucaagguaacagacuguggaagaggcuugggauucagcaguacucccucuagggucuuuuuucuuugcugaaugaaaugaaucuuuuuguaggacaaaagauuugcuuugcaaauucccuuugaaaacuagcaugauggccugguugauaaagaaugagcuucauucccccucagucuaugacucuccucccauaagcagugggguuuuauuuucccuggggaccugcuuuuuggauaugugaucccuuaagaagaaugaccucgucagauagagccuggacuuagcagucccuggugacuuucuccgauguuaacauuuacucgcccugugacuauguauggaaagcauuauugcuuucucuuguuguagauuuucuaaccauggccagagguaacucuucuuaugauuaaacagcccuuuaauaaucugaaauauaugugaacuuaccaaauuuuguauguaauuucauagaguuuguaaaccaucugacuccauuuauaauucagagcugucuggccuuuaaguuagacaguauuucccuagggagcugaauaaccucuccuagagauguuauaagugcugaugagaauuaguuuuugaaaugcucaaauaaaaagcauaauuuuccauuguuauuaaugauggauaauagcaaaauaucugcuaauaauaguagaguucuuacuuaagcaucaugcuuuucuaaguauuuacauaacugaucugaagcagaccuucugauuuuucuacuaauagaaauuucccuuucugaaucaagcagaaauaggucucccuuacaucaaaguuuguguuaccuugaaauagauuggaaagaauacauuuuuguaaaagucauuuuuuucuuggauuuguuuccaguuggagaaacccuaaagucagggcacuugccaauuaucacaggacugugagagucccuuuuuugcucaagauuguggcuggcugcuuguacaucuuugacauuaucacacaucaagcauauuagaaaaaggggugacuugggagagugaggggaucagcacuuuaggccuugucaacccuccugcuuaucugcuuggcagcuucuggcaucuccuuuucccuaaguccuugaaccucuuuccuaagcguaaaccuuucuguuuuuaguccuaaaccucucuuuucacaguauuccugucaaaugaguacuuaaacacauguuucaucugugauuuguuuuguuaauugcuuuguggauuauuuguggcagaauuuaaauccuaauuccuuucuacaauuuagccaguaaauucaaggaauguaccuuuuuacguuugcagcaugugccgaagcgccaccucagaagauaaaaagaaaugagucucauauuuggcauucuuuuagguuuguuaccuaccuuauucauuaauguaaauaauugaauuaccuguauuuuaccauucguaaaccagguuaauagauauauauuaauagcaggcuuucugugugugucuuuucccuccuuucuuucuauuuauuuauuuauuuauuuuuugagaccaagucuugccuuguugcccaggcuagaaugcaguggugcaaucuuagcucacugcaaacucugccuccuggguucaagcgaucuccugccucagcugggauuacaggugcccgccaccacgcccagcuaauuuuuguauuuuaguagagacgggguuucaucaugugggccaggcuggucuuaaacuccagaccucaagugauccauccgccucggccucccaaaguguugggauuacaggcgugagccacugugccuugccccuugcuuucuuuugggaauucucuuguaccacaaguugaaaguuauauuaguuugaggcuuucuauguuuggacuaggaugacugccagugagccaggggaacccaugaaucugcuaggcuguuauaucacauucacaacuacuugcaaaccaguuuugaagugaaggcugccaaaaauaaugacauauggucccugcucuauagaaaaugagcauaugacccuuaauaaaaaacagguaguuuuuuuauauacagaaaauuacccuaaaugugauuauguuucuuuauuuuuugaccguagaacaggaaucuuaaucuuuuuuguguuauggacuccuuuggcaguguggugaaagcuuuuagaguuccuuuuuggaauauguuuuuauaugcaaaaauaaaauacauagaacuauaaagaaaaccaguuauauugaauuauauugauauauaguuaucaaaauuuaagaaguaugauaugguaugaaaauauccaugauuucuacugguaacaaauccauuugucuaauaagucugcuauuacugcuguagcuuauguucaucacugaagugaaaauaaagauacagucuuuuucauccaaauucacagacuuccugaauucuaucauagacccugccucagagauaugaguuccauaacccacucuaggaagaucacauucuaaacacaagaguuuacucaccaaauauucugguagaauaguggcagaguaaaauuguucaacuguaagaacuauuacaugugucccucaugguuuuuucuuuccugaaauauucuacuacauguccaggccgaagaaguauaagcuuuauuaugugugccaguggcuaacccagggucuggcacagaguaagugccgcucaguguuuguugaauaaggguuucucugacgaaauuagagggaagagauccaguucaaagcuaaggucuuaaaugugacaguuuauagggcucaugacaaguaacguugaacuuuaguuuagaacuaaucugucagagaagcucauguuuugaaauucacuuuuacauuuauaaguucucagccuggugugauaguucauaccuauaaucccagcacuuugggaggcugaggugggaggauugcuugaggccaggaguuugagaccaaccugggcagcaaagugagacccccaucucuacaaaaaauuagcuggguguaguggcaugugccuguaguccuagcuacuugggagggugaggcaggaggaucacuuaagcccagcaguucgaggcugcagugagccaugauugcaccacuguacucgaaauaauucuauuucuaacacuguuuuucacuuuagauuggguaaauuuagguagaauuugccaccaaauuauuaauaaagcugguccugauuucaucuaggaugagagguagcaaacuuuuucaguaacgggccagauuguaaauaguuuaggguuugcaggucacacaguaucugugacuacucagcucugcuguuguagcacaaaagcagccauggacaauaaacacaucagugagugaacauggcuguguucugaucgaauuuuaauuacaaaaacagguagugggccaucuuuggccagcuagcuguaguuugcugaccccugaucuagauuuucugguucuugaguccagcucuuuucccuacuuucgcuuagccauauacuccuucaagcuucaaaggccuuuacauagggggcaauguccuuacacuguuaucuccagaaagaccugaguguacagcaagaugauaggauuaaugaaugccaggaauauuagaugcacuuuaacccuugaguuuccagagcuugccucuuagagcaccagcucauuaagcaccaccacgguagaagcagagaaacaucccaaauguaaagucugcuugcgcacucggcuuuggaacugggcauugauaugcugauagaaaaauacugggcauuggguuuuaguggggaagauaauguaggccuagagauggggaaggcaggaauagagugcaaaggaaaaauuaugccucaucuuuuugcaaauaguuccuuguaguaauuggucaaguuugaguuagauuuuugaaauguggaauagcauauguaauugcaacuugcuacuacaagagcucacccuuagucgcaguuuuacuuuccgugguuucaguuacccacagucagccacggucagaaaauaggugaguaugauguaguaagauauuuugagagugagagagaacagccacauucagauaacauuuauuacaguauauuguuauaauuguuuuauuauuaguuauuccuguuaaucucuuacugugcuuaauuuauaaauaaaacuuuaucauagcucuguguauauagggagaaaacaaaguagagucagcccuucguggccaugggcuccacauccgcagauucagccaaacuuggaucgaaaauauucagaaaaaaaaaaaaaaaaaaacaauaaaaauaccaauacaacaauaaaaaacaguacaaauaaaaaaccaauauuguauaauaacugguuacauaguauuuacauuguauuagguguuguaaguaauguagagaagauugaaaguauauaggggguauagauuauaugcaaauucgacaccguuuuauauauauaagggacuuuugagcaucuguggauuuuggcaucugcaggagauccuggaaccagugcccugcagauucugagggacaacuguccauauaggguccauacucucuagggguucaggcaucugcuggcgucuugaaacauuuccccuguggauaagagaggacucugcuauauuuagauuguuacauaguucaggaagcaaaguccaacuccucuuucccuugguaggucuguuugcaauaaggaaguugaauagaaaggauuggauaggccgggugcgguggcucacgccuguaaucccagcacuuugggagacugaggcgggcagaucaccugaggucaggaguucaagaccagccucaacauggagaaaccccaucucuacuaaaaauacaaaauuagccaggcgugguggugcaugccuguaaucccagcuacucgggaggcugaggcaggagaauugcuugaacccgggagguggagguuguggugagcugagaucgugccauuguacuccagccugggcaacaggagugaaacucugucucaaaaaaaaaaaaaaaaaaaaaaaaagaaaggacuggauaggagucccuaaaacuacuuguaggagccuaucaucuuucagacucaagcauagacaugccagcaccuagauucugucuccuucaggacauucacauuggaaaaauaugacuagcuguauccuuagugucuccucagugccaccccucccuccacaaacacaucuuccacuugucuagcaaagcugaugugccucagcaggcauguguuggaacguggaggaacaaggcaagcaguguguacugguaggugagucagcagaaaccaaaccaggucuuugugagucggaguaaaaaucacaggcacagauacugcauucuguauuucgagggcacuuuggagacacuaauguacuuagcaggcaggguguugggggauggguuuuuauguccauauuuagagucugugcucaaauuucagugauuaagauaaggugacuuaucuagggagugaauaggcagcaguuggaaagaucaggucuuaacaauugcuguauucuggcugucagcccuuuuuuuuuuuuuuuuugauagaguuucacucuugucacccagguuggagugcagugguaugaucauggcucacugcagccuccgucucuuggguucaaaugauucuccugccucagucuccuggguagcugggauuacaggcaccugccaccacgcccagcuuauuuuuguaguuuuaguagagaccgggcuucaccauguuggccaggcuggucucgaacuccugaccucaggugauccucccgccuuggccucucaaaguguugggauuacaagugugagccaccacaccuggccuagcuuuuuuuuuuuuuuuuuuuuugagaugaggucuugcucugucacccaggcgggaguacaguggaacgaucuuggcucacugcaaccucugcauccuggguucaagcgauucugccaccacagacucccaaguagcugggacuacaagcaugugccaccacuccuggcuaauuauuugucuuuuuaguagagaugggguuucgccauguuggccaggcuggucuugaacuccugggcucaagcaauccauccgccuuggucucccaaagugcugggauuauaggcaugagccacuguacugggcuguuauagccuuuuugacaaagaaaguguucuggaggaugaaccacuaaacaaacaggaaguguuggcccauccuaguagggcucuugagggagguucucuauucuaucuccaaauacuuuucuuccugucucauuccuaagggucagucugcagggcauugaguaaugcacugccccauguucgccuccuacuguauuggcucugaggaggcgcgaucauuucccagucccauugcccgcuggacaaacagggauauuaaggcagccugugugugugcguguauuuuuuuuccccuuugaauguagauauuuaaagccaccuccuuuuccagagccaucacuguaccuuacuugaaugguauugguugaugacagaggcgcacuuaucauaaacugagaguccaagaaauauuguuccucauuguuggagguauuccaaaugguuacugggcaguuaucgauguuguaauggugguguggcuuuagguacaccuaaguuucaguguaacaaauuaagaagccaacacgauguuaggauguauuuacugucuucaguacgcccucauccucccacacaccuuuucucuacacuuucucaguagcaaaggugauguguccgggcaagcaucuauuggaacaugagggagacuggggguaccuuuuuccaugauuuuaaacaucaguuauuauucuguaugcuuuggugcugcgguuauaaguuaguagaugugagagaacauugggauggcauaagaaggccgggaaaaaaugaaaaaaacuugugagaccuacagaguaaaaguuuauuauuguuauuauuauuuugagacaaagucucgcucugucgcccaggcuggagcgcaguggcgugcgauuuaggcucacugcaaccuccaccuccagggaucaagugauccuccugccuuagccucccaaguagcugggauuacaggugcaugccaccacgcucagcuaauuuuuguauuuuuaguagagaugggguuucaccauguuggccaggcugguugcgaacuccugaccucaugugauccacccaccuuggucucccaaagugcugggauuacaggcaugagccaccgcgcccagcccagaguaaaaguuuaaacagcaguaguucuagaggaaagucaugaggaguaaucuuugcauaauuucuaaauucuuuuaggguuaucauuauggaauaucugugacccagauguuuuccaucuccugagaaguggaugagauaaagaagugucuuacacuaaaacccaaaaagcaguggguguguuuuauuuuaaauccgaaggaucuaaagacuucaguuuaaagaacaguguagaauauaauguaaaacccaaaagucaucuuuagaaaauagaagaacuguauguaagcagauaaggaauaguauaaacacauaauaguguaagcagguaaagaaaaaaauauauauauuuuuuugaaauggagucucacucuugucacccaggcuggagugcaauggcaugaucuuggcucacugcaaccucugccuccuggguuuaagcaauucuccugccucagccucccaaguagcugggauuacaggugcccgccaccacaccuggcuaauuuuuauauuuuuaguagaaacgggguuucaccauguuggccaggcuggucuugaacuccagaccucaggugauucgccugccuuggccucucaaagugccaggauuacaggcaugaaccacugcauguggccuuuuuuuuuuuugagaaagggucucacuuugcuguccaggcuggaguguaguggcaugaucauggcucagugcagccuugacuugcuguucucaaguaguccucccaccucggccucccgaguagcugggacuacaggcaugugccacuacaccuggucaauuuuucguaacugcaaauauccuauuccucagcaaacuuucaccccaugguuuuagaauccuguagagcauuuuuauaucauaagcauuuuugagguggagcucuguguguguuuuccaugccuuaauugaagcuuccuugagaaaauaguuuguacuuaauuuuuuuuuuuuuuucauuuuuugagacggagucucacucuguugcccaggcuggagugcaguggugcgaucucggcugacugcaaccuuugccucccagauucaagugauccucccgccucagucuccugaguagcugggauuacaggaaugcaccaccaagucuggcuaauuuuuguauuuuuguagagauggaguuucaccauguugcacaggcuggucucaaacuccugaccugaggugagcugcccaccucagccucccaaagugcugggauugcaggcgugagccauugugccuggccuuuaauuuuuuaaauugauaaauaauaguuguuuauauuuaugggauacaaugugauacuucgauauauguuuacauguggaaugauuaaaucaagcuaauuaacaaauuccuugccuuauauacuuauuuuuuuguggugaaaacauuuaaaaucuacucuuuuagcaauuuugaaauauaaaaugcauuauuauuuauuuuguuuugguuuuuuuuuuuuuuggagacggagucucacucuggcgcccagacuggagugcaguggcacgaucucggcucacugcaagcucugccucccggguucacaccauucuccugccucagccuccccagcagcugggacuacaggugcccgccaccacgccuggcuaauuuuuuguauuuuuaguagagacaggguuucacuguguuagccaggauguucucaaucuccugaccuugugauccgccugccuuggcgucccaaagugcugggauuacaggugugagccaccgugccuggcugcauuauuauuuauuauagucaccauucugugcaauagaucacuaaagcuuauuucuccauucuuuuuuuuuuucuuuuuuguugagacagagucuuacucuguugccaggcuggagugcaguggugcgaucucagcucacugcaaccucugucuccuggguucaagggauucuucugccucagccucccgaguagcugggauuacagauaugcgccaccacacccagcuauuuuuuguacuuuuaguagagaugggguuucaccauguuggccaggauggucucgaucucuugaccucgugauccacccgccucagccucccaaaggcugagauuacaggcgugagccacugugcccagccuguuucuccuuucaaaacugaauuuuuguacucgacaucucccuuuuugcucuccacccucuucuguccaucucuuguaaccaccauuccauucuguacuucugugaguuccacucuuuuagauuccacaaauaagugaggucauuugugguauuugucuuucucgucuggcuuauuucacuuagcauaauguccuccagguucaguuuguacuuaaaaauuaugauacaguacuuuguaagcaguaaguacucauauuuuugacugccugauauuauugacuugccagaugccaaauugcugauuauauuucucauaguggauuuugucucucuacacuuagaagaauugagcagauacuuacagaagaguacugugcaaauuagaaaacaaucauuaauuggauggauuaggcauuuugaguaguucacucagaccacugagaugagaguauugaccucugaauauuaugaaggaaucauuaagaacaauagugaagacaagcucugaucaucaucacugaaagaacucggagugaaauguauagaacccuucuuccauuuuaauuugcauuugugaugaaaggaaguuucuagguggugcucaucuuucacuuucgacucugacauuuuuucauguuggccaugacucauggggugucaccuucagcuucuaagaauuaggccaguuucuuguagaucuugucauauugccacucggaguugagccggaggaaagaaaguaaggcacaguugcaguuguuuagacgaacaucucagucaggcuuaugagaggcaguagggcagagcagacuguccucauucugucuggcauugguuuuccaccuguucugaagauuuuucucugaaccguaucuugugcagagaugacaguuuaucauagaguuuccccuacccccaauuucuggcugauuccuaaaauuucaucaguaucaagaaaguaauuuauuuguacaaauuguguuacuuaagaaaaacgcaacuaucccugcagggggcugaaaagccaacaucuaaaugauggcagcgguggccugucuggaugggcugcugccaugaugccggcugcagucggggaggcauggucugugcugcacgcuccauggagccacugggagcugggaguagguggaagcccugcccguuuccaaguuggcagggcgggagcagccguggcuacauacccgggcuucccugugcuuuugggggcccaggaaccuccccugccccugcaggcuugaagugccugcucccacugccuggccucuccuugcuccuggugccugcucugauuuuggagcaaaguugaggccaagccugggcacugucaugaccuggcuggguuugcgugugcuaggggcagugcugacaugccagcccccuucugccuuggcccccucuggauuuuggguguccagcagcacaggaggggacgccaaggcggagcugagagcagcuccauucaggccugcaggcgccccuucgugaauagccugggcgcuguggacagcagguugaugacagcaggaggcagacaggcuccuaggcggaaaugggcgggucccuggugaagccccaccuucaagccagggauggccugaagccuggggcccaggcugccaguucuguggacuggaaugagaacuuacgaugcuuuuuccgggcugccuguggcugcccauggaccaaucagcaugcacuuccugcccgcugaagcccguagaaacccuggacucagccauacuugaugggaugaccugccugcggauaggagcuucccacuccaggucuccucuccacugagggcugcagagacgucaggaugaccugccugcagauaggagcuauccacucugggucuccucuccgcugagggcugcacagaugcugggacgaccugcugcggaaaggagcuacccgcuuggggucuccugagggcuguuguguugcucaauaaagcaccucuucaccuugcucguccuccaguuguccauauaccucauucuuccuggacgugggacaagaacucgggaucugccaaauggugggacugaaagagcugaaacacaaacagagccgaaacacguccuccccucccccacugcuugccacgcugugggcaacagaaagagagaagagaggagagagaaagagaagagcuguagcccuuugggaagcccagaccuaggagcuccuugagccagggcugugacacccucuuuggagcucugugguuccuggccucuccaagcuucugggcagcaccauguuccccagugccugcaguggaagcugcuuguaguacgccugguucagcugcagccucucagggagcuggcgccucgagcugcucacccccuggcagcuggcgugccuggcugugcgcaguggccggacccugugcuggcucgccugugcaccucuugccgcuccgugccuggcuuguccuuggcaugcauggaaucugugcugguaacacaagcugagcauagccuaccaggcugaguggacggaacgagcccggcgggccugagcaaaacucaggcaaaggugccacuggccacagagguuucuggcuagcgaagugacaccccaaguauucugugacuuaaacaugaaauacagaauauucagaacuuugcuguaauagcuaguugcuagaaacucucugcuaaaugagacaauaauaaauaaguuccuuugggggaaggagaaucccugaggggguuuuaauagcuggaaacugugaacaagcuugagguguuaagacccugaaagaggaaagggaaaugaguacugagaaaagaaggggaagggccaggugcagugguucacaccuguaauuccagcacuuugggaggucgagguggguggaucaccugaggucaggaguucaagaccagccuggccaacaugacaaaacccugucucuacuaaaaauacaaaaauuggcuaggcgccauggcucacgccuguaauuucagcacuuuuggaggacgaggcagguggaucacgaggucagguguucgagaccagccuggccaacauagggaaacccugucucuacuaaaaauacaaaaaauuagccaggcgugguggugggugccuguaaucccaccuacucaggaggcugaggcaggagaaucgcuugaaccugggaggcggagguuguagugagccgagauggugccacugcacucuagccagggugacggagugagacucuuucucaaaaaaaaaaaaaaggaaagaaggagaaggacauuuaaaaaauacauuaugcugguccuagcuauucuggaggcucagaugggaggauugcuuaagcucaggaguuugaggcuacagugugcuaugauuauggcugugagagccgagaucgugccacugcacucuagccagggugacagagugagacucuuucucaaaaaaaaaaaaaaggaaagaaggagaaggacauuuaaaaaauacauuaugcugguccuagcuauucuggaggcucagaugggaggauugcuuaagcucaggaguuugaggcuacagugugcuaugauuauggcugugagagccgagaucgugccacugcacucuagccagggugacagagugagacucuuucucaaaaaaaaaaaaaaggaaagaaggagaaggacauuuaaaaaauacauuaugcugguccuagcuauucuggaggcucagaugggaggauugcuuaagcucaggaguuugaggcuacagugugcuaugauuauggcugugagagccgagaucgugccacugcacucuagccagggugacacagugagacucuuucucaaaaaaaaaaaaaggaaagaaggagaaggacauuuaaaaaauacauuaugcugguccuagcuauucuggaggcucagaugggaggauugcuuaagcucaggaguuugaggcuacagugugcuaugauuauggcugugaguagccacugcgcuccagccuggacaaccuagcaagaccccuaaaaaaauaaaaacaauaaaaaaguaaauaaaaaccauuaugcuacuccacaauuuucaugcaaguaacucuggugaaguggucacugaaaucuauagaacuuuuagaguuaagaaauucacucagugaugugguucaugccugucaucccaagucuuugggaguuugaguugggaggaucacuugaggccaggaauucaagaccagccugggcaacauagcgaggccugucucuuaaaaaaaaaaauaacuaggugugguggcaugugccuguagucccaacuacuugggaggcuggggcaagaggaucgcuugagcuaacgagguugaagcugcagugaggcaagaucauaccacugcaccccagccugggcaacagagugagaccccgucuuaaaaaaaauuagaguuaagaaauccguguuuuguuaauccaggacuuggugagagccauccguuuacaaaaggcucuuuucucuaccugcaccagucauaccuucacauugccuuauaccugucauaucgaugaugcggaggauagugggagagucuguguaacuaucuuucucagccaaauuauuccaaucuuuugcaugcaaucaggauuuaaaaugagcaguuaguauguaggcugcacugugagggggaaugacuuccgacuucaggcaauucacuguggccauuguugcacagagaggcguuucaguauuucuacuagagccuguguuuugugaagcuucgcugguuuugccagaugccauuggcucaucuuggugaagugcagcuguagaauugguauuuugcugaguguauccacgucaacgucucugaaauacuggugacaaacuuuuucccaccccaaugagaaaauuuuuguuuucacuuucuaugaccaguuaaaagaagauggaugcacaguguucagccaaggucaaugcaaggaagaggagaaaagaggcgcccggacccaacggggcaacagaagaagaugggguuccuuccaaagugcagcgcugugcagugguaaguggagauuaaccuggcagggggaggguagaaaccgauaugacauugaugauaucaguguuacaugucuucugaaauaaugaaaagaaggaauaguaaguguauuuucacagucacuggaaaucugcugccuuuuuacuggauuaugacucacagcucaguuguagaagcuuuacauuggguuuagaaaaagaaguguuaggaaaauauggaaguugcauguguauuaggcugaaacuauugaaauauggccaggugcggugacucauaccuguaaucccacacuuugggaggcugaggugggaggaucaccugaggucaggaguuugagaccagccuggugaaacccugucuuuacuaaaaauacaaaauuagccgggcgugguggcgcaugccuguaaucucagcugcuugggaggcugaggcaugagaauugcuugaacucgggaggcggaggaugcggugagccgagauugcaccauugcauuccagccugggcaacagagacagacccuaucucaaaaauaaaaauaaaaaguaaauaaacaaauaaauaaaacuaaugaaauagaaaaauuggggcucuaggcagugauuugaucuucguaucaucucauggugucuagugcgucuuuucugcuguuuuuucucccucuaucauuccuccauccuguuacuaguuguaucuuagaugagaaccuuuuuccguuuaugccuaccuuaugcuccuuuaucucuggaaaauuaucuuuguauuuccuaauuauugccaaaccuuagaugaaagaccccauuccacacugccuaucccaucucagcuugcuacccuuccuaaagcuuuccuccacacugccuauccugucucagcuugcuacccuuccuaaaacuuuccauaauaaaaacaugucagagaacacuuacacacaauugaagcuacuguuguuaauauuauuaugaaaucuguguuucaaaaucccagugacagaauuguauguuucuuuaccuauauugacuauuagccauugaucaaacucaguuuccacugcuuaguucuagagcuucccagcccaaagggaaaaaucuauucugaaacaguuaauacuuauuccaaaugaaugcucugucuugagcaauaaaagcaaauaauacccuacaaauagacaagugccugcagggcugauauugaucauaagggcaaguauauauauuuguuuccuguugcauuuguaacaaauuaccauaauacaaauauacaaaugaauuaucuuacaguucuggauaucagaaaucugaaaugggucucagagggcuaaaaucaggguguuggcagagcuggaggguccaggggaaaguccaucuucuugccuuuuccagcuucuagaggguucccacauugcuuagugcuuggcaccagccagugcucacaucacucugacgauugcuucugccaugucuccugcucugauucugaaccuccuacuuccccuuuucacuuacaaggacucuugugauuacguucgguauacccagauaaaccagaauaaucuuccuuuauuuaaucauaucugcaaagccucuuuacuauuuuuauuuuuauuuauuuuuauuuguauuuuugagacagagucucgcuuugucacccaggcuggagugcaguggugcggucccgguucacugcaacgucugccucuuggguucaagugauuucccugccucagccucccaaguggcugggauugcaggugcccaccaccaugccuggcuuacuauuuuuauuuuuauuuuuauuuuuagaguaagggucuugcuauguugcccaggcuggucuugaacuccugagcucaaguagucuuccuaucucggccucccagagugcuaggauuaccaggcgugagccacugugccuggccugcagagucucuuuugccauguaugguaaaacagucacaggcuccagggaauggguguggccaucugcaggggggcauuauucugcauacuacagcaaauaagcucagaaagugacucagcaaucaacaaaacagggcauuguuaguuucugaauauuucuuagauaauucagauuaaagaaauggugguguguaccaauucagcaacaucacuuggaguaggaacaaguuauaaccaaauaggugauacugucagcuaaucagccaaucacuguagcuaggaauaaagcaaaggaagccagucuuuucaguggaaugagcucugagaaaacuuaaauuucuuggucuuuagacucugggaaucuuuuuuuuuuuuaaauucuucuggggagucuuaaugcuuuaaauuacuuugcuucauauauucaugugaaaucaguucagugacuugcugcuaccuauuccacauuccucccugaaacacacagacuauuuggcauaggugaauggucagagauccacccaacagccuggcccaccuuagugaggaggaaugucugcuaguaaacuuucugccaucucacuguacaccuguacuuucuagcucugaaucuccuuugaacucuauaacaaaagcaagcaagacuuuuuucuuuuuuuaacagcuuuauugaguuauaauugacauaucauuuacaguauacaauucagugguuuucaguuuauucacagaguugugcaaccaucaccaugaccaauuuuagaauuuuuuucuuuuuuuuuuugagacagggucuuggucuguuacccaggcugcagugcaguggugugaucauaguucacugcagccucaacuuucugggcucaaacaguccucucaccucagccucccaaguagcugggaauauaggugcacaucaccaugcuuggcuaauuuuuaaauuuguuuuuguagggauggggucucacuauguuacccagacuggucucagucuccuggaucaagcgauucuccugccucagccugccacagugugggauuacaggugugagccaccaugccuggccugggauauuuuuaucaccccagaaagaaggccuguacucauuagcagucacuccccauuuccccccagucucuccagccucuggaagccacuaaucugcuuucugauucuguggauuugccuguucuggacauucauacaaaugacaucauacgguauguggucuuuggggcuggcuucuuucacugagcuuguuuugaagauucauucguacugcaacauguacaaguacuuaauuuuuuuuuuuuuuuuuuuugagacugagucucgcucugucgcccaagcuggagugcaguggcgcaaucucggcucacugcaaccuccgccuccuggguucaagugauucuccugucucacccucccggguagcugggauuacaggcgccagccaccacauccggcugauuuuuuuuaauuuuuauuuuugguagagacgggguuucaccauguuagccaggauggucucgaucuccugaccucagguaauccgcccgccucggccucccaaaguacugggauuauaggcgugagccaccgugcccggcaauuuuuuuuuuugagacagagucucacucuguugcccaggcuggaaugcagcggugugaucucggccucccagguucaagugauucuccugccuuagccuccugaguaacugggacuacaggcaugcgccgccaccacgccuggcuaauuuuuguauuuuuaguagagaugggguuuuaccauguugcucaggcugguuucaaacuucugaccucaagugauccgcccaccucaaccucccgaagugcugggauuacaggugugggccaccacguccggccaguacuucauuuuuuuuuuauugacaaauaacauuccaucauauaucacauacuacuuuuuaguuauucauucuccaguugacauuuggguugaguaagcaagauuuucuugcauuuuuauuuauuuauuuuuuugagauggagucuugcucugucgcccaggcuggagugcaguggccugaucucggcucacugcaagcuccgccuccuggguucacgccauuuuccugccucagccucccgaguggcugggacuacaggcgcccgccaccaagccuggcuaauuuuuuguauuuuuuaguagagacgggguuucaccguguuagccaggauggucucgaucucuugaccucgugauccgcccgccucgaccucccaaagugcugggauuacaggcgugagcuacugcaccuggccuuuauugcauauuuacaaugcgcuaguauggcaguaggugguagacguguaaagauaaacaagaccuuccuuuuaugagaugugagcauagaguagaauucuauagccuagagcucauuaguuuauuuauuuuuuuuuaaugggcacuugcaggccaggcacaguggcucacgccugucaucccagcacuucgggaggcugaggugggcggaucaccugaggucaggaguucgagaccagucuggccaacaugacgaaaccucgucucuacuaaaaauacaaaaauuagcugggcgcaguggugggcgccuguagucccagcuacucaggaggcugaagcaggagaauggcgugaacccaggaggcggaguuugcaagugagcugagaucgcgccacugcacuccagcuugggcgacagagcgagacuccgucucaaaaaagaaaaaaaaaggguagggggacuugcucuguugcccugggcucaagcuauccgcccaccucugccucccuaagugcugagaugacaggcgugagccaccacacccgguggagcucauuagcuuuagaaaaaguacuuuccuugcauguaaagaaaggaauaggaaggaucaccaaguaguagauaccuggguuggugggucaggaugaaauggauagaaaagagacaaaggaguuaagaaggaaaaacuaggaaaaacuuuauggcuauuuugucgauaaguauaaaucauuuauugauacagauguuucuaaagguucaaucaaaaggaucacaaaaguauuuacaaaacauaagacguuuagcuuaucuuaauauauaucaggcugggcgcaaguggcucacgccuguaaucuuagcacuuugggaggccgagaagggcagaucacgaggucaggaguuugagaccagccuggccaacauggcgaaaccccguuucuacuaaaaauacaaaaaaaaauuagcugggcauggugaugugcgccuguaaucccagcuacucaggagacugaggcaggagaauggcuugaacccaggaggcagagguugcagugagcugagaucacaccacugcacuccagccugggcaacaaagcgagacucugucucaaaaaaaauaaauaaauaaauaaaauaaaaauaauaauaaauaaaauaaaauaacuuacaaagaauaucauauguaugaaugagucaugaaguaucuaaacugugggggaaauuggccauaguucugcuuauggcaaaguaggccucacaaucucauuucaaccaaaauguuucgagaaccucuacuugccaguugcauuggagaugcaaggaugaaaagaugaccuugcccuuggaaaacucacagacaaaaaagagaaagaaacagcagcaaauaauuaugauacaguaugaaauuaugauacguaugaaaagugccaaauagacggaaguuacaaagucaaucucuugagaaaaaaggaguaggaaggauaccagguauuagaugccuggguuggugggucaggauggccauaguucugcuuauggcuaaguauaggccucccaaucucauuucaaccaaaauaaucuugagaagcaagagacugacuuugaccaagagguaggggcagugguuugggaaaagcgucaucaaaaggguuauuucugagcugaacuuugaaggauacaaggaauucaagaaaugaacaagagaugggguacaaguucagaaucaugaaguagggcuuaaacuaugacauuagguacagagagugcgagauaaacuuugcacauuucuagaagguaaaaucggcugggcaugguggcuucacgccuguaaucgcagcccuucaggaggccaaggugggaggaucccuugagcccaggaguuugagagcagccugggcaauauagggagacccugucucuauuuuaaauuaaaauuguaauuuuuaaaaaagauguaaaauggacaguucuuggagauuacugagauaugaaggacaaaagguguuaagagugacuccuagguuucagucuuagguacguuguguagaugggguacuucccauugagauaagaaauaccaggaggaaaagcagguuuaggaggaagacaaagaguuuaacuuaguacagguucaauuuagagggccuauaagacauccaaauaguaauuggacagaugagcucauuguuuacauucacugaaauggcaauaggagucagggagaaugauugcuuuucuuucauuuuuaaaaccagauccuggcugggcgcaguggcucaugcccguaaucccaacacuuugggaggccgaggaggguggaucacgaggucaagugaucgagaccauccuggccaacauggugaaaccccgucucuacuaaaagucacaaaaauuagccgggcgugguggugggugccuguagucccagcuacuccggaggcugaggcaggagaauugcuugaacccuggagguggagcuugcagugagccgagaucgcgccacuguacuccagccuggcgacagagcaagacucugucucaaaacaaaacaaaacaaaaaaacagauccccgggggguggaaucuuucagcucuguucuuugucccuucuuucucauaccacaugguauuccucuugacucuguagcguuucccguggcauuauugaaagaauugggccaagcacaguggcucaugccuaaaauccaagcgccuugggagguggaaggaucccuugaggccaggaauuugagaccagccugggcaaugcauuauagagagacacugucccuacaaaaaaaauggaaaaauuaacuggauauggugaugugccccugugguccuagcugcucaggaagaugaggcaggaggaucucuugagcuuaggaagucaagguuauagugagguauggaucgcacugcugcauuccaaccugggcaacagugagacccugucucuuaaaaaauaaaaaaaauagaaacaauugggaucucgggaggacccuuuaucauuaauacagaauguuugggugaaagggaaauaaauguuuuucuguggcauucagaaacuuuuugcugaaaaauauuuaagaauccuuagaguuggaugcgguggcucacgccuguaaucccagcacuuugggaggccgaggcggguggaucaugaggucgggaguucaaaaccagccuggccaacaucgcgaaacccugucucuacuaaaacuaaaaaaauuaagcaggcgcaguggugggugccuguaaucccagcuacucgggaggcugaggcaggagaaucgcuugauccugggcggcagagguugcagugagcugagaucgcgccacugcacucuagccugggcgacagggugagacugucucacaaaaaaaagccaaaaaaaaaaaaaaagaauccuuagaaaguaaaaaguguacugggaagacaauaucaaguucuagucuauauuauuugaauuauguccauuuuccuguuaguguggaugccagaaucucuuguuuucacugaaauuuuaaggaauagugaaauaaugugugugaauauagucuggaaaaaguuguuauggaagcaauauugcauucagagacaauucauaauuuggggacuguugauuuccauuauaacuuuuagaugcaugcauuuggaaaguuuauauagcauuuuagaagcuaaccucuuagauuaauaggaguuaauuuuguuagcaugcugaaaucuguguucuauagaauacaagaggaaaugagcuaacgacaaauucgucgagugccuacuuuugugaaacauuaugcuaauuacuuugcggaugcuacuuuguuuaauccucauaguaaacuuguagggcagguauuguuguuuucuauuuuguagaagaugaaaugaaagcuuuagaaacuugcugugauuucacagguauuaaaugauagaguugggauuuagaucuaaauuuuccaaguccuaaccccauguucuuucauuuauaccucacuaccagauagucuuaagacuugaaagcgauacuguggcauucccuugagguuaaaaugaaggagauguguuuuaggagaacacagaaauauuuaguccuacuuuuauaaaccucagcuucuagagacacuguucuuugagaauaacacaguguuuuaaaaaaauacuaccuuuucuagcuggaaacaacucuagaaaaaaagauuuugcugcuuuguuauagcugcacaacguuagguuucacucccuauacuuaggagaaacggauucagccuaaaccccagccaggaaggacagcuguauuugucuucuaccuggaaauauacacaguaugugagaaagacugaagaaacaguugugaaagauaagauacuuaaaauaucucuuuuuuuuuuuuuuugagauggaguuuugcuccacugcccaggcuggagugcaguggcgugaucucggcucacugcaaccuccgcaucccgaguucaagcaauucuccugccucagccucccgaguagcugggauugcaggcaugcaccaccccaccuggcuaaguuuuguauuuuuaguagagaugggauuuuaccaugcuggccaggcuggucucgaacucccgaccuaagguggucuacccgccucggccucccaaagugcugguauuacaggcgcccaccacugcgccuggcuaauuuuuguauuuuuaguagugacgggguuucaccguguuagucaggauggucucgaacuccugaccucaugaucugccugccucggccucccagugcugggauuacaggugugagccaccacaccuggccaauguaucuuuuaaaauuuggguaaaauucacauaacauaaaauucacuauuuuaaccauuuuaaaguauauaagucaguaguuuauagucuagucauacuguuguacaaccaucacaaccaucuaauuccagaacauuucaucaccacaaaaagaaacccccuguauucauuagcagucacucccuauuaccccuccagcuaccuccuggcaaccacuaaucugcuuucugucucuacagcuuugccuagucugaacaucuaauguaaaugaaaucauacaacuuguggacuuuuguguccgacuuccuuuuuuggcauaauguuuucaagauccauccaagugguagcauguaucaguacuuuauuccuuuuuauggguaaauaauauuccauuguguggacauaccauuuguuuauccauucauugauggacauuuggguuguuucuacuuuuuggcuauuacgaguaaugcaagugugaacauuuuucauguauaaguuuuuuguuuuuguuuuuguuuuguuuuguuuuuuugaggcagagucuuucucuaucucccagacgaguacgguagcacaaucucagcucacugcaaccuccaccuccuggguucaagugauucuucugccucagccucccaaguagcugggauugcaggcaugcaccacgccaccuggcuaaguuuuguauuuuuaguagagaugggauuuuaccaugcuggccaggcuggucucgaacucccgaccuagguggucuacccgccucggccucccaaagugcugggauuacaggcgugaguuaccgugccugacauaguuguuuuuuucuuaauauauguuuucaguuaucuuggguauauaccuagcaguauaauuucugggucauaugguaauucuauguuuaacauuuugaagaacuguuuuccaaagcugcacauuauuuuauauucacaguagcaauguaugaugguucuaacuucuucacauccuuaccaagacuguuuguuauugccugucuuuuugcucauagccauccugguugauaugaaguaguauuuccuuguguuuuugauuaauaucuagguccuugguucuauuuuuaaaaguauuucaaagaagaauaacacauacacaucuaaaaaugaaugucuuggcugggcaugguggcucaagccuguaauuccagcacuuuaggaggccgaagcggguggaucacuugaggccaggaguucaagaccagccuggccgacauggugaaacccugucucuacuaaaaauccaaaaaucagccaggugugguggugcaugccugcaaucccagcuaguugggaggcugaggcaugagaaucgcuugaaccugagagguggagguugcagugagcugaguucacaccacugcacuccagccugggcgacagagcaagacuuugccucaaaaaaaaaaaaaaaaaaaaaaaaaaaaagaauguuuccauuuauaucauuaaguauaucuuaaacuaaacuuauauaagugauuuuuuuuuuuuugagacagggucuugcucuguugcccaggcuggagugcaguggggcaaucucagcucacuguaaccccugccucccuggcucaagcaguccucccaccucagcuucccaaguaacugggacuacaggcaugugucaccacgcccagcuaauguuuguauuuuuuuguagagacaggguuucgucauguugcccaggcuggucuugaacuccugggcucaagcaauccaccagccugggccucccaaagugcugggauuacaggcaugagcuacugcaccuggccaaaacaaaacaaaacaaacaaacaaacaaaaaaaacguguuuuaauguuaaaacaauuuugaaaaucuacacuuaccugaaaacaaaacaguaucuucccagucucuggauucagcccaaucaugauacgaucuuuuuagaacggaacaucacugcagccauacagaaauuagaaggauuauaagggagcaauuucaugccaaaaauuugacaauuuaaauguaauagacaauuuccuagaaagagacaaguugcaaaaacuaaccaagacaaaggagaaaaucuuaauagacuuauaucaaguuaaaaaagaaaaaaaaggaauuagucauuaaaaaucuucucacaaagacagguccaggcccaaaguuaaaaaauuagcugggugugguggugcaugccuguagucccagcuauuagggaagcugaggugagagaauugcuugagccccagaguuggaggcugcagagagcuaugaucgugccgcugcacucuagccucggugacagagugucuuuacaaaaaccacaaaaacauuuaaggaauaaauaauacgaaucuuacacaaaaauaagguaaagagaacacuucacaacuuauuuugugaggccagauaucaaagccagacauaaacaucacaagaaacaaacuauaguuaaaaaucccaggccagaggcugggcacgguggcucacgccuguaaucccagcacuuugggaggccaagguggaaugauugcuugaggccaggaguuugagaccagccuaggcacguagugagaccuugucucuacaagaauaaaaaaucagcugggugucggguaguguaugccuguagucccagcuacucgggaggcugaggugggaggaucacuugagucggggaguuggagguugcagugagcugaaauggcgccagugcacuccagccugggcaacagagcuggacccucucaaaaaaaaaaaaaaauccagauuggaaaagaauaagcaaaacuauauucacagaugacaugauauuauauguagaaaaugcuaaggaauccaugaaacaacaacggauacuagaacugauaauuaacuuuagcaaaguuauaggacauaagaucaauauacagaaaauuucaguuacacaaacacaaauacaaaucaauugcacuguuacauaauaucaaggaacaauccaaaaauaaaauucagaaaacaauuccauucacaacagcaucaaguagaauaaaauacauaggaauaacaaaaacucuuuuuuuuuuuuuuuugagguggagucuugcccugugggcuaggcuggagugcaauggucugaucuuggcucacugcaaccucugccucccggguucaagcgauucuccugccucagccuccugaguagcugggauuacaggugccugccaccacaccaggcuaauuuucuguaucuuuaguagagaccugguuucaccauguuagccaggauugucucaaucuccugaccucaugauccacccaccucggccucccaaagugcugggauuacaggcgggaauaacgaaaucucuuaaacgaagccaucuauaauagagagaucaaucuccuuucucucaucuuuuuuuuuuuuaguauuacaguguaugccauugaguugaacuuucuuuuccuucacuuuccauuucuuaagggcuuacggcaaccagcuccuuuuucugaugaaauugaaguugacuuuaguaagcccuaugucaggguaacuauggaagaagccagcagaggaacuccuuguaaguaaauaccuucuuaauuuguuguuugacuauuguuuuuagcauuccauugucuuuaucaaauacacaccugcucucuauauacugcccucuguuuacuugcaaaggccagcagcgaagggguucuucucaccugucuugauguucuauuuagaaggguaacuccacuccauaaacuuucauuuuuuuucuuauuauuaugcaccuguuuccugggcugcuguuguagcugugagauacaguaaaacagaaacaauaugauauuauauuagcuugagcugaguuaugaucuuaucuauuucuauaaaguccaaaucaugugucagggugucacauucuucauagccuucagaauuccccaccaccucucuacguucugucagcuggcuaugaugcugccgauugauagaggacaaaaauaucccaaguugggagaugcucgucacuuaauuuuauuuuuacugauauuauaauuuuccagguuuuaaaaaauacuuuauuuucaaagcccuugcucuuuauuugcaugcuuaauuuacauaauuaauuagcaguuuuugacacauaaauuacuaauauauauucgagaugcuuuucuuauguggggcaauugguuuuagagaucauuauaaaaagaaacuuccaagagcauuuguuaugaauacaaaguccuauaggcaaauauucuuucuucucuguaaauuccccaauucucccuuuuuuuccaauccuuuuucacuucuucugauuacuaaguguucucucuacccuguaaauauaggacugaacuaagacucagacagacaccagggaauaagagggauuuauagccacaaaucugugcauuugcagcauauacaguauauuugugguuacuucuuaauuguguugguauguuugcucucuguaguaacugaagaacagugaaauacaaauagaagugggccaggagugguggcucacaccuguaaucccagcacuuuggacaccaaggcgggcagaucaucacuugaugucaggaguucgagaccagccugguuaacauggugaaaccccuucucuacuaaaaauacaaaaguuagcugggcgugguggugggcaccuguagucccagcuacucgggaggcuaaggcacgagaauuaugugaaccugggaggcagagauugcagugagcugagaucaugccacuguacuccagccugggugacagagcgagacccugucucaaaacaaacaaacaaaaaacaaauagaagugauguacagugucauacugggaaauuuuuuuuucuuuugaggcagagucucacucuguugcccaggcuggcaugcaguggcacaaucuuggcucagugcaaccuccuccucccggguucaagcaauucuucugccccagccucccgaguagcugggauuacaggugugcaccaccacgccuggcuaauuuuuguauuuuuaguagagacgggguuucaccauguuggccaggcuggccucgaacuccugaccucgugauccacccaccucagccucccaaagugcugggauugcaggcgugagccaccgcgccggccaaugccgggaauuuuaacaccuauccuuuggccuuaucuuggguauauguauuguggguuugggguccucaacaaaaaagaggcuaauuccagagaauccuuuccuuuugaaaaaauguguagauauaguucauauugaucacaaccuucugauucaugauaagauuuuugaguuuggcuucccuuauuuggguaauagguaggcuccuggaggcaggguaaaaugacaaagaaaaccagagacuauggauuguguaaugguagccaggucuaacuucaaaacgccagaagauaguucaggguucacauucagaugugauaguagaggcuauugaaagcaagaacuuuuuacauacucucuaaugacacacauuuacaaucagcuauucauuuagauuugaucugauggguugcauuauccaguuuguugcuaauuugucuauauaucauuugugguacauaaaauuugaaaauauguguacuguuuccaaguugaucuuuuguuuuguuuuguuuuugagacagagucucgcuugucaaccaggcuggagugcgguggugugaucucagcucacugcaacauuucccuucuggguucaagcaguucucaaaucucagccucccaaguagcugggauuacaggagugagccaccgugccgggccuguuuccaaguuuuaaagcuuauaauuaacaaguccugacugguauaauuguuuuuaauuuuagaauuauaggauuuuacaaauaagucauuuucaagauuaucuacuuuauaguuucuucauuaaguacauaaagcaauuaagguccauaguaaccaagaagcgaaggcuuccccuacaguaaaacggaugauuaguggaauagaauugcagcucaaaccucacccgggaauggugcuacucauuguaagcauuagaauagaaggccuucagcaaaauaauuguauuuuugguggaacaaacagccacaaauuagccuauaaauuugccagcuuaauuugaacucugguuuuucucuuagaucucauuuugucugacuguuuuauguuaaaucaccaaguagguaacugcauucaugccagugcaggacaaggaauaaagcaauaaagaaugcaccugcucuagugaaguuucaacaccucccuccugcuccccagguuuuuacgagggagguuguauaaucuaggagaagauucucuacuuagagaaaaacaaauaugauuugagagacaagaaggucagcucuaggaaucuuuugggagaugaaaaaaaucagcaauauguuuaacucagagaaaggaaggaaaagggagagugugaagggcaauggaaauguuaggaacagaauguuucggugguagguauuugggagaguaaaucuaucaaaagagaucauuaacugaaacccagguuucuucugccuaaaggaggacauaugguuacuuagucaccaguggugcagcguauaauucauaacccacauaaaccauauaauuuaucauccaaaucaggacgguuuugagcaugaaagggaguugcuguuaauaauauacagagguugagugugguggcucaugccuauaaucccagcacuuugggaggccaaggcagaaggauugcuugaggcuaggaauucaaggccagccugggcaauacagugagaucccaucucuacaaaaauuuuaauaauuagccaggugugguggugugcaucuauagucccagccacucaggaggcugaggugagaggauuguuugagcccaggaggucuagaccacggcaagucaugauugcaccacugcacuucagccugggugacagagacccuaucuuaaaaaauaaauaaauacauaaauaaaaauuaaaaaaauauauauauaggccagguacagugacucacaccuguaaucccagcacuuuggaaagcugagguggguggaucauaaggucaggagaucgagaccauccuggcuaacauggugaaaccccgucucuacuaaaaauauaaaaaauuagccaggcgugguggcacacaccuguaaucccagcuauucaggaggcugagacaggagaaucacuugagccugggaggcagagguugcagugagccuaggucacgucacugcacucuagccugggcgacagagugagacuccgucucaaaaaaaaaaaaucuaucuaucuaucuauauaacauauauacauauguaauauaugcauaauauauaaaugauauuaaauauguauuauauaguacauuauauaauagaaacaggaaaaauuauauuaaaaguauauaauuuauauaaauaugauuauauauacuauaacauacauuaaaucagggguguguuuauccuggccaauagccacuugguaaaagaauggcuaacgcuagcuuucuucccagacuaguucaacagugaccccuucuggccguuugguuaauauaucagccuggguuugccaaagacuugggauggaaugguggccaguugagauguugguaggcuggggaagcacuggagagagcaagaggcgcaucugggauuggucugagaaaagguucagugaucuacuuggccuaacauaggaugauuagcugugcugcaagcagccacuugaucaacagcauucugugcuauugccaccauccaggcaauguguuucuugagcaaaauuucccugcuguaugcugucuaguagcaaagaaacaacaaaguagucuucauuuguauauucuaucccuuguguuucaggaucgaauagugugagaucauagccccucuggacuuguuuagggaaaauggaacuauguuaguuacuucauggacgugacuucugggauacuucaauuuuuuuuuuuuuugagacagagucuugcucugucucgcaggcuggagugcaguggcgcgaucucagcucacugcaaccucugccuccuggguucaagagauucuccugccucagccucccgaguagcugggauuacaggcgcccaccaccauacccagcuaauuuuuguauuuuuaguagacacaggguuucaccauguuggccaggcuggccucaacugcugaccucaggugauccaccugccuuggccucccaaagugcugggauuacaggcgugagccacugugcccggcccaaaaaucuuuuuaauguauuauuuuuuaauaggcauagagccaaugcagugauuucugggacauagaagggggauuauaugcucaaauuuuguuuuauuuugcuuugucuuauuaaaaauuaucuuuuuaaaaauauuuuuuucuucuuuuuuuuuaguugacacaugcuggcaguaaaaaauaauuuuaauagagauaggguuucacuguguugcccaggcuggucucagacuccugggcucaagcaguccuccuaccuuggucucccaaggugcuggaauuacaggugugagcuacuguacccagccugcuuucucucauagaugagaaaacugaggcauaaggaaguuaagguuacagaggaagaaagcugguuggaaagcuuggucaaagcuugagcuaugaccuuucugacucuuaaauccauuaauuaauucuuaguuuuucauuggauugguauauuuaauuuaaaauuuuuauuuccuguauuauaaaaucaauacaaccagccugggcugggcaugguggcucacgcccguaaucccagaacuucgggaggccaaggcgggcagaucacuugaggucaggaaauugagaccagccuggccaacaugggauacgaauauaaaaauacaaaaauuaucccggcuugguggcuuucgccuguaaucccagugacuugggaggcugaggcaggauagucacuugaacccaggaggcagagguugcagugagccuagaucaugucaccacacuccagccugggcaacagagcaagacuccaucucaaauaaauaaauaaauaaaaauacaacuagcuugggcaacaugugaaaccccaucuguacaaaaaauacaaaaaucagcugagcguaguggugugcgcuguagccaguggggcguggcggugugcacuguagccaguggggcguggcggggugcgcuguagucugcggggcguggcggggugcgcuguagucagcggggcgugguggugugcgcuguagucccagcuucucgggaggcugaggcgggaggaucauuugagccugggagguggagguuucagugaucugagaccaugccacugcacuccagccagggugacagagccagacccugucucaaaaaaucaaaucaagugaaaucaauacauucccacaguuuaauauccauaaaauacaaaaagggcauaaaguaaaaugucucccucucaagaccugucucacagccaccugguaucccuauaacaggccaccaauauuacccauuucugugaauaucuaaguaaauuguuuauauauccucccaccuuuuaguggguguauuaugcuauauucaaucuuccguugaaauguaggucguuuccugacuguugcuauuauaaacaguacugcaaugaauaacaucuauauuuacugugagauaauucccagaauuagaaaagcugggccacagcuauaagcauuugucguuugucuuuugauagauacgaccuaauugcccuucuugaaaguugcugauacuccuuucagcaguguaugauuucuugguuuaaaaucuacuuauuuaugaguaaagcuuuuugaaaacaaaaauucauaaaccuccugagaacuacuuuccuucuccuucauucauugcccugaagacaggaaggagauguaucugauccucaaccucagcaugguguaucugauccucagccucagcauaguguaucugguccucagccucagcauaguguaucugauccucaaccucagcaugguguaucugguccucaaccucagcaugguguaucugguccucagccucagcaugguguaucugguccucagccucagcaugguguaucugguccucagccucagcaugguguaugugauccucagccucagcaugguguaucugguccucagccucagcaugguguaucugauccucagccucagcaugguguaucugguccucagccucagcaugguguaucugguccucagccucagcaugguguaucugguccucagccucagcaugguguaucugguccucagccucagcauaggguaucugguccucaaccucagcauaguguaucugauccucagcauaguguaucugguccucagccucagcaugguguaucugguccucagccucagcauaguguaucugauccucaaccucagcaugguguaucugauccucagcauaguguaucugguccucaaccucagcauaguguaucugauccucagcauaguguaucugguccucaaccucggcauaauauaucugauccucagccucagcauaguguaucugauccucagccucagcauaguguaucugauccucaaccucagcaugguguaucugauccucaaccucaacauaguguaucugauccucagccucagcauaguguaucugguccucagcauaguguaucugauccucagccucagcauaguguaucugguccucaaccucagcauaguguaucugauccucagccucagcauaguguaucugguccucagcauaguguaucugguccucagccucagcauaguguaucugauccucagccucagcauaguguaucugauccucagcauaguguaucugauccucagccucagcauaguguaucugguccucagccucagcauaguguaucugauccucagccucagcauaguguaucugauccucagcauaguguaucugauccucagccucagcauaguguaucugguccucgccucggcaugguguaucugguccucagccucggcaugguguaccugguccucagccucggcaugguguaccugguccucugccucggcaugguguaccugguccucagccucggcaugguguaccugguccucagccucggcaugguguaccugguccucagccucggcaugguguaccugguccucagccucggcaugguguaucugguccucagccucggcaugguguaucugguccucagccucggcaugguguaucugguccucagccucggcaugguguaccugauccucagcauaguguaugugguacucaaccucagcaugguguaucugguccucagccucaguauaguguaucugguccucagccucagcauaguguaucugguccucagccucagcauaguguaucugguccucagccucagcauaguguaucugguccucagccucagcauaguguaucugguccucagccucggcaugguguaucugauccucaaccucagcauaguguaucugaugacacuuugaccuaucuuucccaaaugauguaaaugcuccugucaguuucugcugcaguaaaauagcucuuccuuuauucacagaaagggaauaaguuacauggacuccuuagauuuauuauuuaaagcaugauggaccauuaugcugauucuguuuuuaauguuuauuucacuuuggaauuagucuuguuccccgggaaaucauuuccuggcuucuaaguugacaguucucuguuauuuguugugccugaaaaguuugguacaaccaggcuaacagaggcaguuagugcagaugaugaugucaaaaaucucuuuauaggcugagcaugguggcucacaccuggaaucccagcauuuugggaggccaaggugggauugcuugaguccaggaguucgagaccagccugggcaacauggucucuacaaaaaaaaaaaaaaaaaauuagcugggcauggugguguccaucuguggucccaucuacuugggaggcugagaugggaggaucacuugagcccaggaggucaaggcugccgugagcugugaccacaucagugcacuccaggcuggaugacagagugagacccugucucaaaaaaaaaaugaaaaggucuuuauagucauuuuucauaacccaaccuaccccuaaaaucagggugaauacccagagaacaccuaaagaaaggaguaugcaguugggccgggcgcgguugcucacaccuguaaucccagcacuuugggaggcuuaggcggguggaucacgaggucaggagaucgagaccauccugucuaacacugugaaaccccaucucuacuaaaaaauaauacaaaaaauuagcugggcuugguggugggcgccuguaguuccagcuacucaggaggcggaggcaggagagucgcuugaauccgggaguugcagguuguagugagccgagaucgugccacugcacuccagucugggugauggagcgagauuccgucucaagaaaaaaauaaaaaaaaagaaaggaguauacagucauggaacugucacacagagccaguuccauuugccaaguacaagauaucgaaucaauguauuuuuguggcuuggcauggugguucacaccuguaaucccagcacuuugggaggcugaggcuggcgggucauuugagaccaggaauucgagaccagccuggccaacaaggaaaaaccccaucucuacuaaaaacacaaaaauuaggcaggcgugaugacaugcaccuguaaucccagcugcuugggaggcugaggcaggagaaucacuugaacccaggaggcggaaguugcagugagccgagaucacgccacugcacuccagccugggugacagagugagacucggccucaaaaauaaaaauaaaaaugacaaaaaaaaagguauuuuugugaucaauucuuucauuuggauuuaggugagcgaccugugagaguuuaugccgauggaauauuugacuuauuucacucuggucacgcccgagcucugaugcaagcgaagaaccuuuucccuaauacguaccucauugugggagguaagaaaacauuuggugacuucaggugcugugcagaaaaagaugauaguacagucugucuuucucagcugaguacacuggcucuuguuuccauuuuuaaaugaaggauguaguacagccucucuaacacacaugaaguauauggguaccagcaaacuaaaccuggagagaggagcuucaagcuccucgacugugccaucuggcauuuauucacugcuuguagcugaguuucuguggucacaggagcagccgugacuuccguuguccacuuuaaaacauuugcuuuagauuucaguuuaucauuuugaauuaacuggaguacaaaagucugccaaggaaauguuaggugguccaguccagugugaauaaaacaggaaaacauguuuaaggacuuaauugaugcagacacgcacagcagguuuauuucagagucaaagaucuuggucaccuguuguacugucccuucuccaaaguaugaacauacuguuuagugaguguugcuccugaagguauacgcugcauuaggaaaagcguuaucacccagguucaaccaccuuuagaagacuuuuuuccaguuggggaagaugguugcaguccuaagcagugggagaagaugggagaggucgguggcugaggaggugcuaagcaaagaggacuccaacacacaauuuaugauguggugaaccaguuugcagugaugagcucacacacaacuucaaaggcuucacggugaugaacgagaaugagcgcuaugacgcaguccagcacugccgcuacguggaugagguggugaggaaugcgcccuggacgcugacacccgaguuccuggccgaacaccggguaagaaacuggacacauauucccauuccuuguuucagaauccccucaacucucaaagcugcuggcacguaggcugguuuuccacuagccguguuuuacuucuaccucuuauguaaguuucguaggagaugacagugauauuacuagugauaacagucaccccugacguuuauauggggcuggaugguuugcaagcacuuuuacauccauucuauuccauuuucugcccacagcaauccugugguguguuugucauuuccgcuuuacauaugaguaacaagggcuagagaaaccaaauaaccugcuccaaguuacaccauuggcagggcugggaacugaacucgccacaaguuacaccacuggcagggcugggaacugaacucgccacaaguuacaccacuggcagggcugggaacugaacucgccacaaguuacaccacuggcagggcugggaacugaacucgccacaaauuacaccacuggcagggcugggaacugaacucgccacaaguuacaccacuggcagggcugggaacugaacucaccaguuacgagaccuuccccccacaccauaggcacaucuacccuuagaacaugccagucuccugagaauauccauagccccaggugaacucugaagacggucacauuaccaggaaauaagacggauuaacauagacuuuucuuggcuuaaguuucauuucagggcuuugaucuuaugcuagaaauuggguggaaucagaaaucaaggauauuucucacuguuucucaguaaguuauuaucaaccccuuaccuccuuuuaauucucccacauuaaaguaacagauuucagccaggugcaguggcucacgccuguaauccaagcacuuugggaggccaaggugggaggaucgcuugagcccaggagcucaagaccagccugggcaacauaccgagacccugucucuacuuuaaaaaaaaaaaagccacagguuuccugcaaaagguggguacaaaagaugagaaggauugauuaggccagguuagaggcccccaagccugaggaaauagcaagcauguugucaguucucuacaggggcgcguggaauguuguagguaaauuguucagugaggcagaaagaaugaaggcagccaaagugcuucuaaagcaauacguggguaggccugaagaggggauauuuauuaaaacuauugaggauuaggacagaccuuuuauaauucucuggcuuuucuacaucaacaccuagcagccaguggcaccaaaggugguaagcaaguuuauucucagcaccacagcccacaggcccagacagaaguaugaaguuagaggaauuucuaacuccccuuuucucuuuguuaacaauauauacucaaccuugaguuuugcuugucccauucuuuuuuuuuuuuuuuuugagacagaguuuugcucuguugcccaggcuggagugcaauggcgugaucucggaucaccgcaaccuccgccucccggguucaagugauucgccugccucagccucccgaguagcugggauuacaggugcgcgccaccaugcccggcuaauuucuuguauuuuuaguagaggcaguguuucgccguuuuggccaggcuggucuugaacuccugaccucaggugauccacccggccuccuauucuuuacuuugcugccuauggaucccugacaaguuguucaugaguaauugagaugcuggcugagagucucugacauagucccaaugaacaugcuucacacuacaguggucucucggggaugguauagugaucuuaguaauuaucagcaaaaggcugguggcccauacaggaaggaguaagugaaguuuagcacgccuccgaacaacauuauugauccccaguaucauucaucucuucuugcccuugcaaaggauauucauagcaguaaaauggccaggcgcuguggcucacgccuguaaucccagcacuuugggaggccaagucagguggaucacuugaggucaggaguucgugaccagccuggccaacacggugaaacccugucuacuaaaaaugcaaagauuaaccaggcggggugacaugcgccuguagucccagcuacucgggaggcugaggcaggagaaucgcuugaauccaggaggcagagguuucagugagccgagacugugccacuacacuccagccugggcgacagagcgagacucggucucaaaaaaaaaaaaaaaaguagugaaaugauagauccugaggauaaaacuucuuuuauuuauuuauguauuuuuauugaucauucuuggguguuucucgcagagggggauuuggcagggucauaggacaauaguggacggaaggucagcagauaaacaagugaacaaaggucucugguuuuccuaggcagagggcccugcggccuucugcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaauugagucucccaugucuacuucuuucuacacagacacagcaacaaucugauuuuucuaucuuuuccccacauuucccccuuuucuauucgacaaaaccgccaucgucaucauggcccguucucaaugagcuguuggguacaccucccagacggggugguggccgggcagaggggcuccucaccucccaguaggggcggccgggcagaggcgccccucaccucccggacgggguggcugccgggcggagacgcuccucacuucccagaccgggucgcggccgggcagaggagcuccucacaucccaaacggggcggcggggcaguggcgcuccccacaucucagacgaugggcggccgggcagagacgcuccucacuuccuagacgggauggcggcggggaggaggcgcuccucacuucccagacugggcagccgggcagaggggcuccucacaucccagacgaugggcggccaggcagagacgcuccucacaucccagacggggucguggccgggcagaggcgcuccucaccuccaagacuggguggcggucgggcagagacacuccucaguucccagacggggucguggccuggcagaggcgcuccucacaucccagauggggcggcggggcagaggcgcuccccacaucucagacgaugggcggccgggaagaggcgcuccucacuucccagacugggcggccgggcagaggggcuccucacaucccagacgaugggcggccaggcagagacgcuccucacuucccagacgggguggcggccgggcagaggcugcagucucagcacuuugggaggccaaggcaggcggcugggagguggagguuguagcgagccgagaucacgccacugcacuccagccugggcagcauugagcacugagugaacgagacuccgucugcaaucccggcaccucgggaggccgaggcuggcggaucacucgcgguuaggagcuggagaccagcccggccaacacagcaaaacccugucuccaccaaaaaaauacgaaaaccagucaggcguggcggcgugcgccugcaauggcaggcacugggcaggcugaggcaggagaaucaggcagggagguugcagugagcagagauggcggcaguacaguccagcuuccgcucggcaucagagggagaccauagaaagagagggagagggagaccguggggagagggagaggggagaggggagaagggagaggggagagggagaaaacuucucuuauggccuucgguuuguauuucucaggccaauagauguaucuauuccagucagagggcucgugguugcuauuuuuauauucccucuuuucucacggacugagagaaacuaguuaagaaagaaguaaccucuuucucauacuuuuuuuuuuuuugagacagagucuugcuuugucacccaggcuggagugcaguggugcgauuuuggcucacuguagccucugccuccuggguucaagcaauucuccugccucagccucccaaguagcugggacuacaagcgcccgccaccaugccuggcuaauuuuuuuguauuuuuaguagagacgggguuucaccauguuagccacguuagucuugaacuccugaccucgugaucugcccgccuuggccucccaaagugcugggauuacaggcaugagccaccgugccuggccuuucucauacuuuuagaaacccuuauuugaccaaauccuuccagacccaggacagggagauuuccuucuuuccuaggcuccacccacuaaccgguucaccagcaaacccucuggcccuauugaccacagcaagaugacugguauacagagugaggguaacaguucuagcagacuaggagaaauagcuacaaaagcagcuggcuaacuucauauguauacuccauaaaucauuagguugggugguuugugaauagauuguagaauuuaugagcaaagcaaagagagauaugaaguccacugaggccuggccucugccuauuguccuuuuucugggccugagaacauugacugggucuuucugaauggcaguuaucauggguuuuaaugauguuuccuuauuuucagauugauuuuguagcccaugaugauauuccuuauucaucugcuggcagugaugauguuuauaagcacaucaaggaggcaggugagugagcugugcuuccucacuguaggggaucucagggcagcugcagauguucagccauguugcugcuuuacagaggaaaauguguacauuagaaauucaacauccucuuucaggccacauuuuggauaaaagguaaagaugagcauagcacccaucaauucuuugucgucaguucaugacauccaucaauucuuggucuaaacaucuacuuuggauaucucucuuaauuucaggaaacccuuucucauauuuuucuuaauauuagggcuauguaacucuucuuugccuuaccucuggccuuugauucggucuaccuucuguauaucaguaucuuucaguuucauuuaguaauaacagauucugcuuuuugaggaaaggaaaggaauguugcccccaauuuccauuuagucuuaauaccugagcuaaccagaaccucacaguguuugucuguauguguuucugaguuaggcauguuugcuccaacacagaggacagaagguaucuccacaucagacaucaucacccgaauugugcgggauuaugauguguaugcgaggcggaaccugcagaggggcuacacagcaaaggagcucaaugucagcuuuaucaacgugaguuccagccuuaccccagaguucccugacucuguaggagacauaucaccucccacuccaucucagcugaacuggcuuugcaguuggcuuugaugaucacucccaaaaguucagugaaugaauuaccacuauguuaacuguucacaaaaagaaugaaacagacaguuucugccguuacggucugguaccaacacauucguauaaagccauacagccaacuaaauaaaugaguaauuuauauagugcaguauuucugucaauaaauggaaaacggugucucuuaaacuuccucucucuucuucgguuggaugaugucuugggaaccugcgaaaggcuaugagcccuccucguguggauagugacacccgacacaccacuucccacacagaccugaguuuuaaauuuggauugacgaaaguuaaguuuaucuuagcuuaauauugccuuuuagaaacucuauauauuuuucugggcaugguaguucaugccuguacuuugggaggcugaggcgggaggacugcuugaggccaggaguuugagaccagucugggggcaacauagcgagaccccaucucuaaacaaacagacaaacaaaaaaacuaaaaaaauucaugcaaauauauauauauguaguguuucuuucuuuuugagacagggucucgcucugucaccgaggcuggagugcaguggcgugaucucggcucacugcagccucugucuccuggugccuuagccuccugaauagcugugauuacaggcaugugccaccaggccuggcuaauuuuuuuuuuuuuuuuuuuuuuuuuuuuuuuuagcagagaugggguuuugccauguuugccaggcuggucucaaacuccuggccucaagcgaucggacccccuuggccucgcaaagugcugggauuacaggcaugagccaccguauccagccaacacuauacauuuuguauguaaauuagaccucaauaaaaucgauuuaaaaagaagaaagcugcuaacuuuaaugucuucuacauaaccaguuuaccaugcucccugaccuacucccaucucuguaaauugugcuauaagaauggauaaaaugauuacaucuaaauaugauuuaucuaggcagauaaacccuagcucuuguuaauuuacuuacuauagcuuuauuuuucccauaaaaaucagguguuuaaaaauucuaaacauaaucccuuuucucuuuaugaucuggaaauuuugagaguacuuuucuuuuucuuuuuuugagauagagucacacucagucauccaggccagaguacaguggcgcaaucuuggcuuacugcagccuugaccuccgggcucaagugcuccucccaucucagccuccugaguagcugggacuacaggcacaggccaccauacccagcuuauuuuuuauauuuuuauuuuuaguagagaugaggucuugcuauguuguccaggcugcucucgaguuccuggccucaagcaguccucccacuucggcuucccaaagugcugguauuacaggcaugagccacugugccuggccaaggauacuucucauuugacuaaauacucccuucccuuccaccggaggguuuauaccauuuuccuuaucuuuagcaaaguugguaagaccaacgaguaucaucauuuugcaaaugaguaaauggaccuuaaaauacuaaaggaacaaaaagcaaaaaacacaauucauuuaaaauaauagaauaagccagugauagaggggaaaaauccaguacaauaagcagauuaauuaaguaaaagaucuaguauuuucucuuucaaucuauuguaauuaguuuauucuuggcaguauugugcagugaucuuuuagcugccucuguaucuccgucuggaaugagguucgggccaugcugcgcauguuuauguuccaaguuuauguuuuaucuuuaaaacucugacuuuauuuggcuacgugccuguuacuggguauagccuauauuuuuaguuuauucccaaaugcccacaauauuagaauuaccacuucuugugugugcauccacagcauaucuuaucuguuauuaugcugagagugggguagauuaaagcaaagcaaaauucuagacugaaaacagugucaauugagugcuugagccauguuuuuucguucucuuaugguagagaaguuuaggaugagcauuauuucucagaagaguuauuucuuuaucuaggagaagaaauaccacuugcaggagaggguugacaaaguaaagaagaaagugaaagauguggaggaaaagucaaaagaauuuguucagaagguggaggaaaaaagcauugaccucauucagaagugggaggagaagucccgagaauucauuggaaguuuucuggaaauguuugguccggaaggagcacugguauguucuuucccacuggacaauguagggaguuccauguuguggaaagaaugacagaaucauugagcaggaaggggcaucgacacugagaaguuaucuagucuauccccuuaucugggcagaacuaucuuucaacuguccccagcaagguuuuugaaaccuuuacagaaagacguuacacauucuccuagauaauuuugccagcucucucucaaccuuaaagucuggugacaagauaagcaagucgccuugcccagcuuuuaucugugguaugauuuuagauagaaggaaaggaaagaauaaagaacaauaaaaagaaagcagccuccacuacaaguagcugcagcaggaaccccagguaaggugggaauucugucuuugaggaguagcagucuuuucaaccaaauaaaagauugagcaagugaguccuagguuagauaucaggaaggaucugucugugaagguguuuggauaaauuagaauaauccuagacuagauuauugaggaagaauggggaauuucccgggugaugacagcaggggagaacccuuaaauaaauaguacagcauagacuaucccaguccuagaugcuucagugaugauuaaguaggauccacgguguuuuucugacucuuccuuucgguuucugcagaaacauaugcugaaagaggggaagggccggaugcugcaggccaucagcccgaagcagagccccagcagcagcccuacucgcgagcgcucccccucccccucuuuccgauggcccuucuccggcaagacuuccccaccuugcuccccagcaaaucucuccaggcacaaggcugcagccuaugauaucagugaggaugaagaagacuaauguuuccucccuccuuuccuguccucccuuucugucccauuaccuucagaagcucucuguugaauuccaaauugugaccccaacacuaaaccuaaggacagcuacaaaggaaagacaacuggggaaagaagaccuaggacugggggaacccaaacagccuguccugcaagugacaucacucacccacacgaaggagggggacugcaccuuagaagccugcucugcauccauuuacccccccccaagggcuuuguuucacuguuuauguucacgugaucucaacagggaaauugucauuuucauuaa

SEQ ID NO: 192624 - RNA, 128764 nt, Homo sapiens
uuaggcaauucauguuaauucuuuaauuaaaaagacccucacuaaacaauaauaguuuacaaaugcauguaccuuuugauccugcaauuccacuuuugggaauuuauccuagagauacacuuuaugcuugcacauuuguacaagauuauucacugcagagcugauugucauugcaaaagauuggaaagaauccaaaugcucaucauuguggaacuggcgaaauaaauuauaacacauuuauacaaugaaaaaaaugaacaaauggcauaugaauugauaugaaaugucuccaagauagauuguuaagggaaaaaagcaaggugcagaacauguguauaacgugcuaacuuuuguguauaaagagagaaugugagacucuacauucccauuugcuuguauauccauaaagaaaugcuggauguacggaugagaauagugguuaccucuaggccaggguagacaggaacugagcagguggagaauaaggauuggagggagacuuuucacucuauauaucuuuuggguguggaaacaugugaguguauuauuuauuuuugaauaaauaauacaauaaaauauaaaacauacacuuauuguggcccucugcacaagcaaucugguugugcagagucuugguguccccugcuagucuuaguaccuguauagagcucuucagacugggugucguguugcagaggcuagcaccauuccugaugucacccugggugagacgugguccucagaauccagauuuccuuuuuugucuuuuuccuucuuccacauguucuaagaaaacauagauuucuggccaggcaugguggcucacgccuguaaucccaguacuuugggaggcugagacggguggaucacgaggucaggaguucgagaccagccuggccaacauggugaaacccugucuccaguaaaaauacaaaaaauagcugggugugguggugcaugccuauaaucccagcuacucaggaggcugaggcaggagaauugcuugaacucgggaagcagagguugcagugagccaagauugugccacuggacuccagccugggugacagggcgagacucugucucaaaaaaaaaaaaaaagggaaaagaaaauguagauuuccauuguccaaagugacagcgggaggaugggucuugaguuucucagguuggagaagcagcuccacgaagguccugagcuuggguccacuguacaugggacagcuccaaaagaggaaggucccagcacugcaucuaguagugaggcaucagcugcucccgguucacgagggaggaguggugguagcgaucccgaguggcgaagucugcauucuccugggugagcugagucaucuccaugucaaccuuagccagggacggcgccaagaugaucugcuccugaggggaccgcaagcuccugcagugagagagacacagaggauggugagaaggacagaacagagacugaacaguagaggugagucuacugggcauaaagaaauuaucuguaaacacacauguauuuaaauguuuaaaacauaauucuugaaagguauauguacagguauauaugaacucaaagcaugagaaauacaaaguaucaaauaaaauaaaaagagacagagagagugauauuuacccucccuaaguagaaaaguauaaagcuguaccuaccugauaggaaauaaccaacaaagagagguuuugcccuccaaaugguaucauguuggggcucuguagcuuuucuuugccuuuuuuuuugucaaaaauaauggaauggagaggcuggaaaauugagaagagcagaaagagaaaauucucguaggucuauugaaaagaaaguugaauaaggagugauuucaagagcuaaggcucacacagcaagcagcuaagagggacugcaaaggcuuuugacaccaagguggccucaggugaagagcaagucccauauggaucccacugucacuggagucucugcauacaguuucgguuggaauaaacugggaaagaaaaauguuagggaugcauagggaaagugcuaagaggaagaaaggagugaggaaagcucaggcuggcuguccaggcagcugcuacggaaggcagacccagucacagcuccaucccuaaucagcuagguggccuccagaagccucuuuaccuucuugugucucuauuuucucaucuucccgggucucuuccaguuccuauagucuguguuaggucuguaagucauaccuuagacauggauuuccucuuaaaauuuuuacucuaaaagaaucaucuacuuuaugaguaauaaguuucaauuguuugaauauggaauacauuugagaguugcgaaaagguagaaaucuaauguuauugaucuguggaacuuaaacagaaaguuucaacggacucuggccaaauguccugcuauagaaguucagaucacaugacuauggcauuacagccaguuguugagaacauguauaaaucauauaggucucugaggguucuugagaacugaauuaacuucuauaaaggcugaaucuccaaaaaguuuaggaggugacaaaaaugucacaccagucaacauguaaguguuuuugcuaaugcuuuuguuuugauuuuuuaggugaaaccauuacauucuucugagucuggagaaguaaaauacuucacucucuagucuagaaugacuuucaaauccucauuuggacaguugcuagugcuucaagaaagaaagccuucucaaugacaggcucaacuucacauaguucaugggaauuguaggcauaacagaggaaguaaccuagccaaauucuucugccaaaacacacccuacauucuucuucuucuuagguuuugaagagcauuuuggggguuauaguuggggacugggaggggaacucaaaacuacaaagcagaaacacagcuaccaaucucuauuuuuauuuuuuaucuuauuuuaauuauuugagacagagucucauucuauugcccaggcuggagugcagugguugaucucagcuuacugcaaccucugccucccagguucaagcaauucucaugccucagccucccaaguagcugggauuacaggugugcaccaccacacccggcuaacuuuuguauuuuuaguagagaugguguuuugccauguugccgaggcuggucucaaacuccuggccuaagugaucggccugccucagccucccaaagugcugggauuacagguaugagccagugcaucugaccaaucucuauuuuaaaauaaaucaccauuuuuuuuucuuuuuuuuuuugagacaaggucucacucuauugcucagacuggagcgcaauggugcgaucucagcuuacugaaaccuccgccucccggguucaagugauucuccugccucagccuccucaguaccugggacuauaggcaccugccacaugccuggugacaggguuuugccauguugaccaggcuggucuugaaauccugaccucaggugaucuacccgccucagccucucaaaguccugggguuacaugugugagccacugcgcccagccuuucuugguucuuucaaccuccugaauaaccaucccaaaauaucgcccagcagccaugguaaggccaauaaguuugauguugacuuagcugaggccucugcuccccaccucacagcccacagagccugguguuuguguuaugaaugguguggacugauucuacuccaaccaaaguacuguccuuuucuaagaauaaucucccccuaguacauucuucuuucuacauagcacugcugugaccuccaaggugaaauccuaggaauucagaguacaacauaaggacuggugaccuccuauggcauuuuuaggcuuuaaaaccagaaaugacuaaaaauauuccuguaaaucaggcaaggcaaaaaaauagucucacccacacaccacuugcagcuccagaaucuguaggcagcuuuuacacagaaucuauuuccauuuaaacucuacucuuucucaggacuggguuguaggggagaagagaucagugaagaaauguugugaccuggcucacccaaccuugugcaucggacaggacaagaggcagaaagaucacucacccucucugcagcuccacaugagacauugagaccagcuggcccaaguaagcagaugacagggugcuccccaugcaccccagccuccaucccugggcccugucccugcuggugucuguagcccuugcugcugcuucuugucaucccaagcuccagcacgaaggcuuuauuucuugugccaucuugaauagauuggcaauuauuugugaagaguugucuuaaauaggauucuugggaaugcagaguguuuaaugggcauggugaugauagcacagcaacgugaauguccuuaaugccacugaacugcacacugcacguaaacauggcuaagaugguacaucucacguuacauguauuucacuuuuuuuuuuuuuuuuuuugagauggagucucacuuugucaacuagacuggaguucaguggcacgaucccggcucacaguaaccucugccucucggguucaagcgauucuccugccucagccucccuagaaguuggaauuacaggcacgccaccaugcccaacuaauuuuuguaguuuuaguagagaugggguuucacuauguuagccaggcuggucuugaacuccugaccucaggugaucugcccaccuuggccucccaaagugcugagauuacaggcguaagccaccacgcccagcccuauuuuaccauaauuuuuaaaaugaggagaaaaaaggauuaugaaguuacaucugggaucaaugggaaaggaucccaugauccacuagcaaugucugaacaugcaggguggaaauauuagcaaguacaacccggacaucuagagucucaaaaacaaaccaacaaaaugcaaccaaaugaacacucgguuggguucugccuggauuuuccuagccugcagcucuagcuccucacugauauugaaaggggacagaggguggguguaauuccccagaaucccagggccuuaaaagguaagaagcagugauacugcaagaguggaggagaaggagugagauuagggcacaugugaaauauacccucucuaugaggcuucuauuucucaggaaaguuuuuuuucuccuuuccuguauaucugaccauagaggucccacagaaauccuccaggaucuccacuuuauuucuauacuuggccucugcacuguccccaacccagucaugucaacuaccucugacucagauggaagaaugugcuuccuggcguuacauuucccuugggcuuuaaucuugugugugauuaugcauugaugugaaugugucuuagacuguaaacucacugagaguagugacuuaucaccccagcaaccagauucuaaauaaagccucuguucuugaugacugaggauaagaagggaagaggacaugagccuagaggaagcuucugaugagccgaaucugggggccgagugugguggagugcacgcaggagcaacaucugagucucccggaggugcccaguuguuagguucccaugccacaauccaggcccaagcccagccaggaaugggacacccuuggcaccucccaggacucuggacacucauccauucugguacuggcuccaaauuggcacagaccugcaggaggggagcaagagagaccucauccaccggaaaaagcugaaguuggaggcugauccugcagggaagacauauacauaaccauuuuugaagguucuacauaaggcaucuagaagcucaguuuuaauagggugaaugcaaaccccaauacacacacacgcacagaauuaacacaaauguuuuccuuuuucagucuaaacaaauaauuuucauuguaaucuuccaugacagcagccuacuaaggacuuuuacucaugugaauccuucaaaaguuuauuuccaaacuccaaaaucacucccaaaaaacuggauaaagugcuauaaagacaaaugcagagacuugcuaacuuuagucuuaagaauuaaaaaacuuugauaaauuuuuuaagauucauacugacaaguguugaauacacgccauaaaauuuucuacuagaccauacacugagaauugggaacaugucuuuuucauccuuauaaucaucacaguaccucacaggaucuggcacuuaagaauuuuuuuaacagguguuaagugaaucaaauaguuccacauguagaaauguuagagcugaaguuugaagugacauuguuguugauucuagccaaauaauccugacaucaaacacacagauuugaauaggguuuaucaauugaaaaaaauccauuccuccuuugguguagguuuaaaaaaauucacauaguaaauuauauauaacuuuagagaaacaaaucaaaugugauuuuagaaaaugcuuuccuaaauuauacauacauaugauugaaaauugauugauuagauaauguucaauauaugaucaggaaaauagcauuauuuuaagaggcuuauguuaaaaucuccacaaauaucaacaguaugcagcugauaaccuguuuccucaauaucauuuaggcccuuauggcuaaagggaagauaaauuuuagaucugcauuugcaauugcaaagagaagauuucuaauacauuuugagauugucagaaggaagaaaauaaacauauuuuauuaacucacccuacuuaagugugauaauuuagauucuaaauuauuugaauuuuagauggacauuggccugaaauuugauuucauguuuuccuaugaauagauuucuaggaaauaauugaaauuucuuaagaucaaacuacuuuuuaagaaauaaagaagcaaucacugaaguaaucacuguuaauuaaaauauauucuauccaugaagucagcuaacauaaggaccucuucuuaacauuacuguuuucuaaaucauuauuuuuaauacacacgacuuaaaauguuugaagugcauuucuuucaaaguguuugaagugcaucagacuauucuaauucugaagaaccuuuuucucuuuuuuuuuuuuuuuugugagucggagucucacucuguugcccaggcuggagugcaauggcuugaucucggcucacugcaaccucugccuacugggcucuuacuuuggguuuaauuugcucuucuuuuucuaguuucuuaaguuggauguugggaucacugauuugcaaaugaucuucuuuucuaacguaagcauuugaugcuauaaauuuuccuuagcuacaucccacaauuuugcuguuccauuuucaccuuuauucaguucaaaauacuuuguaauuucacucugcuuucuucuuugaaucauggauuauuuauuuucuguauuuuaauuaggguuauguaauauucuuuaguuucuaaauauuuggggauuuucuuuucuuuuuuuaauuuuuaauuuaggagacagagucuuguuauuuugcccaggcuggccucaaacuccuggccucaagcaauucuccugccuuagcccuccaaguagcuaagacaacaggugugugcgaacugugccuggcuuauucaaggauuuucugauaucuuucuguuauuuauuucuaauuauucccccucuggucagagagcauacucuguucuugaauugacuugaauacuuuuaaauuuauugaaauauuuuuuauguacuagaauauagucucuccugguaaauguuucauguauaauugaaaagaacauauauucugcuguuuugggguagaauguucucuaacugucaauuaagccagguuuguugauaguguuauucaagucuucuguagacuuacugauuguauacuuauuuaucaauuauuaggaaggagguauugaaaucucugacuaugguugugaacuuuucuauuucuuccuguaguucuaucagguuuugguuuguguauuucaaagcuguguuuuuaagugcauaaauguuaagcuuuguuaugucuuccugauguauuuuucccuucagcuucaugaaaucacccucuuuaucacuguaauauucuuuucuccaaacucuacuuugccuaauguuaauauagcuacccugcuuuguuuuucauuaguguuagccugauguaucuuuuuccuuccuuuuacuuuuaacauguuugugucuuuacauauaaagaaggauucuuguaggcagcauauaguugggucaugcuuuuucauucaaucugacaaucuuuggcauucaauuagggugcuuagaccacccauaucuagugugauuauugauauggcugggauuacauauacauaaaccaucuuguuauuuguuuuuuguuugucucauuuguccuuuauuaucuuuuucugccuuauuuugauugaguacuuuuuaucuccuuuacuggcuuaacuauaacuguuguguuaucuuagguugcuuuaggguuuauaguauacauuuuaaacuuaccacaauccgccaucaagugauguuauaguauuuaacaaaguauaagaaacuuacaacaguauacuuucacuucacugcuagcucuuggacuauuguuauucauuuuuacuucuacauaucuuauaaaccucauuuuuaaguuauuauuuuuauugguaaucauucaugugcuugucacaguucuccuccuagacuauaaauuauuugaaaaugggauucacaucugaaucaguguuggcauucaauugauauucaaaaucuuuuuuuucccaaugaaugguagagagaaugagggaaccaguggcaaaauggcucugcugcuuaccaaggugaagcccuggacuggcccggccaauguagaaauacacgauggcagcaacacccauguuaaccaggguauacacccacuguaucacaaacaugaugagaagggacccaacagccugugaaaacagaguaggaagagcaaaucaccuaauggcuuucuacaugguaagcaagccacaaggcuaaugucuucagcaacaacauucccucucaucaacuucugaucacuguaaaagucugaauaauugaaguuuaugaagaauucaaaaaaccucacuuaagcagauauuugggcagacaccuucugaaaauaacucuuuaauuaaaacuaucaacuagauauucuaucuuaucuccuugucccauuccucccuauaagaaacaaauuaggaugaaaguaugauaacuuagcguaccuuaaaauuuaguaacccagaaguuaucauagacaauuauuuaaaaaggaaauuauugauuaaaauaagcagucauuaaauguaaucuugccauauguagucucaucuaaauucuaauacaacaggcaaaucacauugcuucuaauuaggcccuccaucuuuccucccccacagcccaagaucacacauguguccaccugaacucugucccaagaacaacugagaucaagaugaaguuacucacccccaacagggagacccagggguugcacauguggguauagaaagaaguggaucuucuccagacaucuuguucuuggagccuggacuucaggaagaaaucuaaaaaauagccaaagauuuggcugccaaauugcuaucaacucucuacuguuuuuuaggaaaauauaccuaugagcuccucuuccccaauuuuguaacuuagccuaaaagacaucucccagggcuugcucuugcagaaggaagaaagaaguguuuauggccucccaccagccaaggaucugagaaagaaagagaagagagagacagaguggagaggaagguccucugaugcucaaggcacaacuguccagauaugucaucuggggcaacuggaagcucagcucuccccucuuuuucagauguaagguguuagagugggagaacuagacaucugguauucuuggcuuccaggugugaccaccgggacugcuagggcagguuggcuuuugucuaaugagagauggucuuugcuaccuucugacucugaaaguuagcucguguuagaccugucucagguaucaaccagaaacugaugaaggagaaagauggagggagaauagcuccucugauuccuuccucuggcaauugaaauggcugaggggaaaggggccuggcaauaaacaaaugcaugauccugccucauccuuucaggcacaacagggcuuucagagcuaugucauguucuauucagcucugcauucucaguuuacagcuggcuccagaagcgcucaauuuaaaaauaauaauaauuuuuuaaugucagaguagugaaguuugggcuuuuaguguaagccucacccaaauaguguacacuguagccauuaggcaauuucucaucucucaaucccacccuccuaccuuuccgagucuccaaagucuauuacuccacaaucuaugucaauguguacacauuauuuagcucccacuuauaagugaagacaugaggcauuugacuuucuauuucugcagaaaugcucaauuuaacuaugaaaaugcaucuagauuguuuaacaauauggucuaaucaccaugaacaccacaauaauguuucaaauaaaugauauguugaauuaacuucgcaguauguuuauacuucauuucaacacuaaaacuucagguguucucaaccuucauaguuuguugcucaggaaauauaguagaaagcucccuacauagcccuucucuguucuccaauaucaaauuuccacuucagccaaacucucuugacugugucaucuccucugcccagcccuuccuucuucacuacgguccaaauccugucucauauaccaguguucuuccccaugucaaccacuccugauguguugguuccuggaaucuaucugggauccacgucucauggauccccuagcccucugcuuaucuaacuccuaugcaucccucagcucaguuaucacuuccucagggaaaucagcccccacaggaaaaucuaaauauauucccacauaccauuaauauuuccuuauggcccauuuccuucacagcacuuaccaucauuuguaguuguauacuuauuuacauguuucuaugcccauuggauuauaugcuucaugggggcaggguccacauccaucuugagccuagggcuuggcauguagcagaacucacuaaguauuccuagcccaagucucccauccucucuggucacuguugcuuuaugaccuagccccuuugaagcacaugccaucagacuauuucacacccuacccuucaucauuacagucuuuuaccaacuugucauucuucucuugcuuguuaaauauuucagccccugguucaccaucuuuuucucuaucagcauccauugucaucauuggugacuucuacaaaaacaacucauccaaagcccuacuuucucgauuccuugaaauccucauacuaauaaucuuuucuuucacucaucccaacugucaacucccuuagcugcacuugcggugugucauuaccaguaaccuuacacuuccuaaaucaugacuuucagcaaucuacucucagcccauaaccuccuuuaaaagcaacguuaagcucauuugcucugcuguuccucauuccaaccauucauagucuacagagggaccuuuagauaguuugccuuaguauguuuuugauuuccaucaccuaccucccgcuuucccuaaccucuuaccuacauacacaucugcucccaugcuucagaauuacucagcagccucauaccuaggcaacucauccuccuacucucugauagaacaaauuuacaagcucucuucuccaaagagaacuuuucauguucucucaucacccaauuagccaauucacuugcaucuauacccucuauucugccuuccuuccuuucacgguggaugaacagccucugauccuaacuaaggcccaucccuccacuugugccaggaucccaucccuuuuggccuguucaaggacuuuguucucacaucaucaauuuuucuguccccuacugaaucauucccaacaaauacaaauauacugucuucucucccaccuaaacaaaugucuacagcucaccccuaguuauuguccuauugcugucucucccuuauagcaaaccuccucaaaagaauugccuaugcagucucuauaucccauuauuuccucaacccacucuuaugauuguaucuacuuuuccacuaaaacuacucuuaccaaaguugccaaugauuugaaucuuuucaaauucuguggucaacuccuagcccucaucccauuugaucuuucaggcagcaucugauacaugugaucacuuucuccuucuuggaaaaauuauccucuaagaugccucacucucuugauuuuucuaugucacugcccacucucucagucuucuuugcuggcucgccuccuccuuccaaccugaaaauauuggaguauuccaacauucagucuucagcacuccuuuuuuccauguauacccacuccuaagagauuucuucuagucucauggcuuuaaaugcuacugauauauugaugacuccaaguuuacaucauccucgaccucucccuugaacuuaaguuuugaauagcucauugucuucucaguaucacccauuaguuggcuaauaagcaccuuaaacuuaacaugacuaacacagaaaucuauucaccucaaaucuucauuugaauaaauaacaccaccauuuacacaaacauguaagauucauccugacucccuucuuucucucacaccuauacuuauuccauccauaaaccuuguuuauucuacuaucagaauauauucuggauacaaugacuccucacugccuccauugcucccauccuaguccaacccacuuucaucuuucauccauuuacugcagcgggcuccugugguacagaccccagcuagaguacaguccacaggauuucucacuguuagguguaaccaugugacuaaguucucagcaacagaaugugaacagaagcagugagugccacuccuggcccaaggucuuuaagagaaugugugccucuucucugugcacuuuccccuuccucugccugaaaucugaaugugguaacucagucuugauucuucacaugacuagguccgagggcauagugaagucauacaaauggcaggagccuggaucccugaguggaugcauggaagagagccucccacggaguuggaacacccuucuugcacuguaaagcaaguaaauaacauuuuuugguuauuuguuuagccuacccuaauuaauauaccuccaaauuggccuuggcucucucucuuaccucuaaaagccagugaucuucuuaaagacugacucuggucacauuguagcuguagcuagaacuuucagcgccuuccaucacacucacaauggcccacauggcccuauacagcacugcccccgcuuuccucacuggaccccucucaucucucuucccuggcucacugcucuccagucacuacugggccucugccauucuugaugaguugccaguccaguucccaccuggacuuuuuuacaugccagguccucuaccuggaacucuucuucuacuucucugcauggcucacugcuucaugcaauucaguucuccauuaaaauaucaucuucccagugagaucuuuucuaauaaaccuaccugaaacagugcaucuuccuccccacccuggucucucuuuaucccauuacucuauuauuauucauuauacuuaucacuuacugacaucacaguaugguauuugcuuguuuaucauaugucuuccccuacuagaauguaagcucuacaacagcaaaaaccuucuaugucuauucagcauguucccccagcacuugggacagugucuggaauguacgagguauuccauacaugugggugaaugaauaaaucauucuacaccuugagaagacuucauccucucaacaucuauuugcauucaucaugugccuccaaguauuaugcuuaucuuuuuuuacaucuguaccuucagggauaaggacccucuuuuauauucuaaaugccaacucuaggcauuuagaaguuuguguauaggaagcgcucaguaaaagucuccuuaauaauuauggauuaaaauaaagucugcaagauugaucugaauggauggcucuauuacuuuucaaaaaauaaauaauucuguuaugauugccauuaauuaaauuguauaguuuuaacaauuuaauuaaauugguuauuuguuuaguuuuguacuuaucacuuauugacaucacaguguguauuugcuuauuuaucauaugucuuccccuacuagaauguaagcucuacaacagcaaaaaccuucuaugucuauucagcauguuaaauuguauaguuuuaacaauuuaauuaauggcaaucauaauuauuuaaaaaauuguuuaauuuuaacaauuuaauuaauggcaaacauaggcuuaguaaaauacaguugcccucuugguuauuaagaaggaacacuaggccgggcacaguggcucacaccuguaaucccagcacuuugcgaggccaaggggcaggugcaucacaaggucaagagaucaagaccauccuggccaacauggugaaaccccgucucuacuaaaaaaaauacaaaaaauuagcugggcaugguggaacgcaccuguaaucccagcuacuugggaggcugaggcaagagaauugcuuaaacccaggaggcugagguugcagugagccaagaucacaccacugcauuguagcaugggcaacagagcaagacucugucucaaaaaaaaaaaagaagaagaaacacuauugguuaagaacuuauauuuuugcaucucuuugagaucugucaccuguuaaagcucacccuuuuacaacacuugaucuuacacaaccucaauuuuacugaaccuaaagggaauuguguguguguguguguguguguguguguguguguguguguguguguguguucugaggaacuugggcagaaguaguaggaaagguuuguccucuaggcagccacaaugcuguuuuauauaucagcaauguaagggaaaauuuaugcaaagaugcucaaugacucuuugaauagguacuguaaaauagacaauuauucauaauucugaauagcuaggguuucaaaacucuuccaaagugacuagaggaauuuuuuuucuugucucagauuuugcuggagaaagcaaguuguacaaacuugucagaggggcaggggacagcuucucaugcuagaaauacuaggaaguuacaacuaggcagguaacuuuacuuuaucaagccucuacucauaaaacaaacaagcaugcaucgugcauguuaaaaaugcuacacauaacaaauauaaggcaaaauauuaaauugaccuuuaaaaucuagugauaugucuaaguucuauguucacagcagauauaaacacuuuaagcauaaaggaggaaaccccaauuauguuaauuuuuaaauaauaaauuuaaguaauuuuauagaaauuacuuaaauauuaaacccucugugaaaauucacuucauaucuuuaucagaauaaauaaacacauaguucuaauuagcauguauaaacugauaacguauauugccuuaguccacacagaaucauguuuaaaguccacgugguauuuuaucauguugauguuauaauuugcuuaaccacuuuccaaaugcugagcacuuauuucuaauuugucauuagcacaaacaaugcagcuaugacaaucuuguacacauuuuuugguuugcuguuuggcugauuugggguuguuuccuugauaaacaguucccucaaauagacuuacuaagucagggcaauuaaacaguuuuguguuucuuguuacaucuugaaagaucauucuccacaaacaaugaaccagagggacuucuagccauggcaguaugaagaggucagugaaucuucuccacacacacacacacacacacacacacacacacacacacacguauaaaacuagacaaaauaguccaaaacacuuacuucagagcuccagaaauuuaccagaugaagaaaacaaauugagaaguauuuauuuuucaaaaauuucuaaagcugaggguaagaaacaugaaagccuguagccuucuugccuaagcugcucccauuaagcaugaagcuggucagaaaccagcaguuugcugucagaggggcaaaguugauuugaagccagggcaaaaggcuguggcuuuauaugcuaaauaugauaagcacaguagaaaaaugaauggggaaaauccuugcuagccugaaagugcagacccagcuagggugagcagaagaccagcagaaauuuaauggggagauccuggaaaugagagcaccauagaaagacuagauaaccuccccacauuucccuggaugacuagaaaacuacgcccacgccuggggaggccugaaagaaccuggcaaaacauaaaacccagaggagaauggggaacuaauuggauccaguuuugacuaugcuucccaagugacacacagauccacuggcagagagcagagccuuaagggcuaugcagagccuuaagggcuaugcagacacagggggcaacuccuaggaagcaaggcuaaacacauaagaauaaaaagcugacuaacgauaucagcagccacacaccacgggggaggcagaugccacaguugaaauccaggcaauuuacuaaaauaaacaaaaaaccaaaaacucagaaauauauaucagaauaaagaguugcuacaauacauuauuuaaauugucuaguuuucaacgaaaaauuacaagacaugcaaaaaacccagaaaacugugauccaugcucaggaaagaaaaacaucaaguaaaagaaacuaacugaguagguucauguguuguauuuagcagacaaagacuucaaacuucaaagcagcuguuaaaaauauauuuaaagaauuaaagaaaacgauaauguuaaugagaaaaaaauucggaugacaaugacuuuaaaaauaaagaauaccaacagagaaauauaaacuaaaggccagguacaguggcucaugccuguaaucccagcacuuugggaggcugaggcaugcagaaccccuaaggucaggaguuugagaccagccuggccaacauggugaaaccccaucucuacuaaaaauaaaaaauuagcugagcaugguggugggcaucuguaaucccagcuacucaggaggcugaggcaggagaauugccugaacccaggagguggagguugcagugagccgagaucacaccauugcacuccagccugggcaacaagagcgaaacucuguuucaaaaaagagagagagagaaauauaaacuauaaaaaagaaccaaaugaaaacucuacaguuagaaagcacaguaacagaaaugaaaaauguacuagaugcuaucaacagaagauuucagaugacagaggaaagaaucagugaacuucaagacaaaaaugauccaaagugaagaacagagggggaaagguggaagcaaaggaaagagagucucagaggccuaaugggauaaugucaaguauaucaauaaauauguaauggaagucccacagggacaggagaaaaagaaagggcagaaaaaauauuugaagaaauauuagccaaaaacuucccaaauuugaugaaaaacuuuaaucaacaggaaagaaagaaugaaucaauugauguugccucuagcaauguguacauacaccuaauuaucacaaaucugcuauuuuuauuuaaauuuuuauagcuuaauagauaugcaauuauauauauuuauuauuauuauuuuuuaaaaauggagucucacucuuauugcccaggcuggagugcaauggcaugaucucgacucaccgcaaccuccaccucccagguucaagugauucuccugccucagccuccuaaguagcugggauuacaggcaugugccaccaugcccggcuaauuuuuguauuuuuaguagagaugagguuucuccauguuggucaggcuggucucgaacuccugaccucaggugauccaccugccuuggccucccaaagugcugggauuacaggcacgagccaccaugcccagcuuaaugcuaucuuaaagaugauuuaggccgggcgcgguggcucacgccuguaaucccagcacuuugggaggccgagguggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaagaugauuuaauuuguguucauuuaaucaauaucauggccuaguucaaaacaaauacccauugcaaguguuggcauacacacuguguagugguuaagagcacagguuugacagucagauugaccuggguucaaauucugacugucuccuaucaugagcaaguguuuaacuucucugagccucaguuuuaucaucuguagaaagacagaacaaugccuaaaucugggcuucagcgaaauagcucauauuaaaugcuaaucucagugccaggcacauaggaugugcucaguaagugcuggcuauuuuuagcuacuaauaauacuuaacaauaagaauucauuuguugaauggacaugaaugagugagcauuaauuuuucaaauguaaaacuuuguauuuaucucaccugacaucuuuucaguaaaaucuggauuuugaccuuccuguuuuuaaaaauaauacgcuuuggaagguaugcuuucaucaguuguguuuugucagaauaauuguuuccuucugugacacuguguuguacaaauguuuuuuauuucuauuuaaucagauaucuugucuuugaugaugucuacguaguuaaaaaaucucucuugcacagcuguuguaaauaaauaauucuuguguauauaagguauaaaauacagccucaaguuaauuuuuaaaauccaugcuuucaggaauauuuauuccauugugauuugauuauuauuauuuuauagcaucugguuugucaacgauuagguucuuauaauaguuuaacucuuucuauuugaucaaugcuucaauguuuuagccaaaauuugcucaauugcucaucaauucaaguaggcuuuacugaguguuugcuacauuauguguacuguaugggaauauugugacgaguacagagguaaaaagacauaguuugaaaacaaaggaaucugacaaucuaguggcaaagaaaugaguuuaauauuuauuuccuuaagauagacaaauaaaccuaaagacaaaugugugaacaaaugugauauaaauaugaugugauauaaauaugagauaauaguuuauauuacuaauaugaaucaaauguuaugguugcacaguggaagacaucagagaauccuucuccaaaaggggugaaagugggucuuaaaagucagauggauuuuaaaugaugucagaguuuuccagauggagaagggggaggugaagcaaucggaggaggcagaacaggguguaugaaggcaggaaggaauaaagaacaugguguguuuaggacaucaguuugggugaaagcggaacguacagugcauggguugucaugagaaguguggccaggaacguagguuagggcugcauugcgaagaaccuugcaucguacacccuaucugggacuuuacacggaagggguuaaauuccagcaagcauuuuuaaguaagagagacaugaugagaguuuuauuuuagaaagaucauucagugggcagcaugaaggagaaaugggaugcgggagagucuuggagacuuagcaagaguccagguacaagaugaugagcgucugcaccaaaguaaaggcagcagggagugggagagagggaauggucagcaacaccuaugacauuucuaagacuaggcagcuggacagcgaccacuuccuugauuaaacauugcagacuguccacgucucuccugaaaauccaaugagaagacagaaaaggaaugaaacagacauaaacccacaaacacgaagagaaugagagaggaaaaauaaaaacaaguccuggaagauggaaaggugaccguagugacagacugagcagagcagaggagagugaacccuagggcccccagagagggugcuggcagggagcagcccaguucauucuggcagaccagcuucaggaccaggaagcaccacaucccaugcagugguaagguauagggggcugugggaggucuauauuuguuguauaccaagauccuuuucucugccuaugaagccaaguaacaacccuucuguugcccaauucccuccucaagggggcuuuccuuugaaacaaucaagccagagagugccuaaacuuggcacagcaggcacagcaaagaguguggaaauggaauuugaaggcagggaauuaaaugaacaucuauacccuaaacagugggaccccucuccaacucacucaccucauccuguucccagaaugcccguaccuaucugugugucccucgggcaagggauuaaagaacucuccuccagaggaaaacgugaagagcccaagagaaaaaccucuagauauucacauuuggggguccuccaguaaaaagucuagcccacuccuccuuauucuacaguaaggugccccaauuaacaagcccugcuaauguacaaagcucuucuaaacaguuuuuuaguacuucacuuaaaaaaaaaaaaaaaaaaaaagagagacagaggcucacccugucaccaaggcuggaguacaguggcgugaugauggcucauuguagccucaaccucccaggcucaagcaauccucccaccucagccuccugaguagcuggaacuacaggcaugugucaucacacuuggcucauugaaaaaaaauuuuuguagacacagggucucaauauguuaccuaggcuggagugcagugaugugaucaccacucacugcagcuucaacuucccaggcucaaguugucuucccaccucagccucccaaguagcugagacuacaggcaugugccacuauacccccacuaauuuuuuaguuuuuuguagcagccggaucucgcuaugauguccaggcuggucuugaacuccugggcucaaacauuccuccugucucagccucccaaagugcuggauuacaggugugagccaccgugcccagcgagugcuucacuuuuaaguacaaaaagaagucaaaagaucaauggacauuuuaguaaaagccuccaagauuuaaaaaaaaaaaaaaagagagagaaagagagagcccaaaccaaagagaaaauaauuaaagaaaacaggaacagugaaaggaacagaaaaacuuuuuaaaauuauuuuuacuuuuauuuuuagagacagggucuugcucugucgcccaggcuggagugcgguggagugaucauagcucauuguaacuuugaauuucugggcuuaagagauccccccaccucagccucuggaguagccggggcuacaggcauaugccacuaugcccagcuaacuuccuuuuuaauuuuuguagauauggggucucacuguguugcccaggcugaucuugaacuccuggccucaggugauccuccugccccagccucccaaagugcugggauuacagguaugagccaccauguccagccucagaaaaaaauuuuaaaggaggaagaucaauaauaguaucagagagagaagauaagccauuguacucauagaacaaaaauagaugauguucaaauuagaaaaaaaaaaaaaaaaagacaaggacaaauuagaucacaaccaagaggucuuggaaauuaaaaacuggauaauuguggcauagacugauaguugcuaccuuaucucuccuucuuucuuaggaaaaaaagaaaaaacacauaauuuuauguaaaguaguaauaugaccaguuaaaaaacaauuuuaucagccuucuuugcaguuuguuguaaucacaugacuaaauuccaaccaaugaaauaugagaaguuggaaugggacuuuugaggaagccuccuccaaaugacucaguuuagaggcucacccuuuugcccuuuuucccuccccuuuuucuagugccuggaauauaaauguaauggcgugaccccagcaaccacauguuggaucacagaacaauauacuaagugauaaaggagcaugggucacucaggaccauggagcugccauggcagccauggacugcccaccucuggauccuuguguaugagcuagaugaagucacuauuauuuugcaauuuuguuauccucagucaaaacuaaucgugacugauacaacaaccaacacuuuaaaaaaaaaaucauuagaagccuugggagagaaaauccaugaaauaucccagaaaaaaacaacaaauaaaugaacaauaggaaagagaaaagaaagaagauuagagaaccauuuaagaagauacaaaaucgagauaauagaggggggauggagggauggggguggggaauuaucaaagaaaaacuauguaaaagcaugacuuugguaagaaaucucuuguuuccuggaucugacacagaagugugguaacaagaggaauucuaagacaacagcuuuguagcagaccuagcaaacaaacaaucuagaguggaacagaaggauggagccauaggacagaggggaaaaaagaaaagaauacauuucugaagaauuggagcauuuugaaaauaacacaaaaaggcauuugacagaucugccagagcauuuaaagaaaaaugaugacagaaaaccaagcaaagaaaaaaccaaggcaauuauuaauuccaggaaacagcaaaaguugagcaaaaaaggaaauguaaucauaguguaacauauggcucagaacugagcaauauuuacuuagucaugauaacaagaauacuagcuuuuaauuuaauaaaaaacugugagauaacuacucugggggcauuaaauaaggagaagucagaguggcauauaagaguuaaauccaggcagggugugguggcucacgccuguaauuucagcacuuugggaggcugagguggguagaucacuugaggucaggaguucaagaccagccuggccaacauggugaaaccccaucucuacuaaaaauacaaaaauuagcugggugugguggugggucccuguaaucucagcuacuugggaggcugaggcaggagaaccgcuugaacccgggagguggagguugcagugagcugagaucgcaccaaauccucauuuaccauaacagcaacucaaaagaugaugucagaaacugacauaucaagaaguagcaaugcaaauacauuauuuagugacagauuaacagaagaagcauauuuuugguucaaagugggauuuucugggaaugggacuggaaauagagaaggguaaaaggggugguauaaaagaguaggaacuacuguuucugguuaugugacuuuuaauauuauuuggcuuauuaaauuguacacuuauuacauugauuaaaauaaaauaauuuuuauuuuuaauuaaaaguuucccagaaauuuagaggcaaagaaggaaaaacagguuucugggagaacuuaaaacacuagguuuuugggguuuuuuguuguuguuguuguuuuguuuugagauggagucucacucugucacccaggcuggagugcagugucaugaucuuggcucacugcaaccucugccucccaggcucaagcaacucuccugccacugcaaccuccgccuccuggguucaagcaauucuccugccucagccucaugaguagcugggauuacaggcagcagccaccaugccuggcuaauuauuuguauuuuuaguagagacaagguuucaccauguuggucaggcugggauuauagacgugagccaccgcgcccggccaaaacacuauuuuucagacaccuccuucuaugucccucaucuccuccucuuugcccacaccugucuguauauagcuccagggagagcauaauguagaggaaaguacaugggccucaaauacagacaauacaaugcagggugauguccagcugugcaaagaaucaggucagagucuucucugugaccucauguggacacaaggucuuacuuguaaaagggaaaaugcuaauauauguuauauuacacgaaguaauagauguaaagcaccuagaauaugguagguccuugaaaauacgaguucucauuuucagaauuucucaugcucuauaagccucucugugagugucucuguguaucucuguguuuauagauuugagaaaacaaagcuugagccaccuucuguccauccccucuugccugguuugggagguucaucuuccacaaagaaaacauauugcauccuuaacagguaguuuaucacaacacauuuccacuucucuuguaaggagagauugauuuuacucacauugaggcuuuauacuucuguucauuuuugagugaaaagagauugauacccaauuacuagcuguggcucucaggucuaacauacaggaguagauagaaauuucuguuuaaaauuaacuaucuauaacagaguauaauuacaaauaauucagcugauaccugaauauaauguuuuaaaacaaauauugcacaaaauuaacaaggauuuuaaacccaguuauaacugguucacaauaacuggguagguaggauaaucaguggucauccccaaauaagaggccccagugugauaccagagcacucaccuucuccacuggacucugauugguugcacagcucaggaacaaguugcucuccauauguucccucaggcugagucccuucgcucuuggaagucugcuuguuccagcaggacuccugccccucccaggaggcagcgggcaaccugucagagaucucgacagggaaagaaggaggggauuugagguccaagaggaagcuaucuuguagggucugcuugguggccuucuugcuuuuccucuucugacuuucugggguccuguuacccucuccuugccugggcuggcuacucucaagcuuccugguuagcuggaggagcugauccauguccuuggugaauuccaguagcgugcccuccaagacucuuugggcaggucccucagagccguaacugggagcuuucucuaagagcaggugcucagagcaguggaggccuucugcgcccucccugagcaccggcucaggcaccggggucaggcugcaggaacacauggacagggagaaguaagaguaguccacugcaacguaugucagcaugaaguugauggugacgaugggggccagaacguucacuugacccacaaaaacaaaggccauggucaccaagcuggucaggcagauggcagccacggguguuuuguuuggccccuucugcaggaacaaaaauaacaugcaggaccauaaaauuucagauagaacgcuucagagauuucagaaguuacaggcuagaaacacaacucauaaugacucagccacuucuccccaugugauuauucaucuauaaacuugagauaauaauauccuacucaugggauuaguucaugcaugcgaaaugcuucacacagacugacaugcaguaagcuccacagauauuaguugcauuagcaacuuuuuuuuuuuuuucuuuuuuugagaccgggucuggcucuguugcccaggcuggacugcagugaugugaucucagcucauugcaaccuccgccucuugggcuuaagccauccucccaccucagcauccugaauagcugggacuacaggugcacaccaccaugcauggcuaauuuuuguauuucuuguagagacgugguuuugcuauguugcccaggccagucacaaacuccuggccucaagcaaucugcccaccuuggccuaccagaguguuaggauuacaggcaugagccacugugcccagccauaggaauaacuaugaacauggggcauuauuauagaacuuugacuucccaaauauuuccuccuuuugucuuucauuggguuuuaauaccagcauagaaaaucaaagaaaugcaaaguugauucuucccagggagaggcagauugcggaagacacagcagaaucacugguggcuggaggaggggaauucugacacuaauucugacacugaguauccgcaaauacucacacacacacauuacacacaccuguuauuaauggagguggguauggugaccuucagguggacaggaguggaaaaaaggugcuagcugccucuccugggagcucuucaucacagucacugacauaguucuugggccaaaagcaacagucacuucucagucccugucuucuuuaacccagcuggcuacucaguccucuucgaaacacuuucuucaccuuacuucuccugauuggccucccucuucacuggcugcuccuucuugguuucuguggcuggcuuuucacgucucugaacuccacauuuaaagcagccccaggcuccauccucagaucucuaucuguacucccucccuuggugagcucaacuaggcucacggcuuugaauaccggcauuauacugacaacuuccaaauuugaaucuccagccuaaaacauuccccugaaacccagguuuacauauccaacugccuacucaacauuuccagugaacgucuaauaggaucucaaacggacuauguccaaaaccaaacugcauuuuuggaggaagauaaaggaagaaaucaaggauaaguugcaacgauguguucccuaaaccagagagaggcugaaaauuggaagcggcuggggaggcccucugggguaccccaacaagacaaaaaugaacucuagcuugcaaaccauauuagugggaaaugggauucucuguuuaugucucuuugguccuccccuggacuuuaggaaugucuauuuuaaucauuccagccaugucucaacugagcugcccuuuauguaucaguuaagguuugguucaugaugguuaacaggaaguguagacgccagagguguaggaaaucaucaaacagcaacccccaaggggcgguugaaacucaagggcagaguuagagcugcaaggaccagcucgccuccugaccaaaacacgcuuucuucuaugcuaaaccuggaggauccugaauucauuuucauuaaaggauggggcacugcauuuucaugcugcucaggguccaagaugguacuaggacugguuagcuaacccaguccuaaaagugcuaaggggcuggguggcugggacauuuaagaugcuucaucuacuuagcccuaaccuaagccagccagaggacagggcugaaagaaaugaccucugcauuauuuucugugucaccccaaagaaauugaccagaggcucugaucagaaaagcuuaaccaauugaugggccaacagugagguuagcagcaaaacauguuucaaaaaacaaaccaaaaaaagaggauuacucaccccuugucccagacaggcaagugcagggaucacuuucuccugggcaaugcacugcaggaugcggggagcuccauaaaguccucccaugcaggaagccagggacgagauguauaagcccaaaaggaacaggaagcccaugagggauaccugugugagaagcgguuucauucgccagugccagaaccugcuccugugccuuucuacccccccagcacccacccaccugcaccccaugcaaucauccacugagucgucuagaucugaucccugggauacaguuuccacauccccagccucgcccccauucauuccaugguuucagcugaauccaccaccacauuucauauggauugcacagugguccucaaaugaagcgucugccagacucagcugcagggcuugcuaaacacaaacuucugggccccuccucagaguuccugguucaguaggcuugggguggggccuagaaaucuggauuccgcaugcguucccagagaccacacuuugagaacaaacuggccaaccacaaugcucauuggccucuugccuuuaagcucacccuuaaagaugaguuuaaaucuucagaugauucacucugaaucauccccuaagccucuguucucuaaacucaaaucugaccacaaugucuccguugcagauauaucaaaaucucccccuguccugacauauaaggcucuucauggucugugaccucuuuagcuccacacccugcacacugaaagucugaucagcaugauuuuucugucuguaggaagccucuguucacacgcccuaaucuacucauugucuguuaaacuccuaauugugcuacaaaacucagcaccaaccucaccuccacugugaggccauccccucuucccugacuacaguaguugcuucucagugcuccauagcauccccaacaugauguuaggauagcaccuaucguggugcccccuccacuaaucuggaggcuucauuuaagcaggccuucugucuuguuuacccuagaauucuuggugcccaacacagaaauauaaaugacgaaugaaugaaugagauccaugacccacaaggcaccaacagauagaauaagagggcacagcuguucuucuuggugucaacuugcaaaagaucaggguccaagauguuacuagcuaacucagggcuaaaagugcuaaggggcuggguggcugcaugacugcuugccaugcacagccagaucccaagcugucacucaugaauucacccuccugggccagaucucaucuguacccacaggaaagcaucuuuguuuucuuauuugaggugcccuuuccauucuacuuuccuuuaggcacaauggccagaacuguacauuccaaguacucaugcguccaaugcuuacagauagguuagaguuaauauucagcuuugucacuuacacccuucuugaugaaggcucuccucaccccauuuuuuacuuccuugcaucagcaaagcaccggauucgugucaccaagcuacauugaacacaagccacuggcuagacuucuuuccuggcucauaaauuaucacuggaauaauuugacugauggaugaaucagucaggacaguugauuggaaaaaaaaaauuucuuuaaaaaagaauauauuuguaggacacuggugguuuguagaaucaucaggaggcuaaaggaugaggcucagaaaagggcaggaccaagccuggaggcacacccagccucuuccccaggaacagcuuggccaggaugcugccaacaccccugcugcccuguggauggauucucaccagcucuuuaucuuuacuucauugguuacaaugggagcacgcaauggccuaguguaggucaugugcccuaccagggcugcaaagggacaggcaaaagaggucugguccauuggguuucuauuacacacaauggggguacucucucccuucaagaccauugguggaauaacccccaaauggucaggaaggucagaugcuugaugaacaagacuaagguccacuacggagcccaccuugucuuuaauucacuguugauuccuuucuuuaucaucucaugcuuauccccaaagaaucucaccugucucuuuuuucaauaucgcagauuucuuggguuuguccugcccaccccacucaccauuuuauuacuacaggaaaucaaugucaucuaguguuuccaucacuuuaugugaucugauggcauuuuguuacuuuccauccugugggauaguuaguuaugcucauggcuuauccugccagcacccugagcaccucacagguagaauuguaucaugcuuccuggcccccuucccccagcaccucaugcagaaucuggcaagcagagcucaacagcugaauucaugcagcuucaugacuuugcuguaaucgugcccuaggugccuuacaaaacuguuagauaagcuggauccauuaucaauccucaauccauucugagaugugaucauucaucgauaaccuuuauuuccgucuucucuaccaaaugcagccuauguugacugguuuuuaaaaaccagauucuaugaugaaauuuuaucaagaaagagccuuuugaaaauuuaagucaauaguucuccacucugccuaaacauaagaaucacccagagauucugauuuaauuaguguagagugagacacagacgugguugaguuuaagaaagcccuccaggugauucuaaugugcagccgauguggagaaccccugggcacaacacauuguagccacugcauucuccccucaaaaaauucuuugggagagucaggcauggcaucuccuugcagaaauuucacugcuucuuaccuaaaagguuauguauauuugaauuuuuacaacucuuuuucauuuaaagccuauuuacucacagcaggaaugagugggaaugccccagccuggcauccuccuaguguuggacugaccucaggaacuggguugagccucuggcaccaugaguacacgauaugguggcuuccaucuuuggccagccuucccacagacacacccugggauuccuccagagcccuaggagcuggggucagacagggccaaguauagcaaccuauguccaguuugucaauuguguagaaugaucuguucacuuaccacuuuaaaaaaauauaaaacuauuauucagucuauuuucugaguaauauaugaaauguuggucuccacaucuagauaaauuauaaaaacuucauuccaucucucuccugccuaaauccuaucucuuucugucauuugucauccauccauccauccauccauucaggaagcauuuccugacgacagauuauguuccuggcauggugcuaggcagagcaaggcuuauagacacguagcucugcucccagcccucacagaacuuaauuguuuucucuauucauaucagacugaaaauuugcuaaaugugccaguggagguggaagugagaauuuauuugagcagaggugugucaacagcucuuuuuaaauaaacagugauucuuuucuggcauacaccuguuugagccauccccccacccccagagcucuuuccaaaauauuacauggggugugagcuacccugauuucuuucuucaguaacuacugaugaaaauaauuacuuccaucucucugcucuuaguauuuucucccagcucccacuugagcuucggucauugagggacucugcucauucauuggcugcucucuucucucaaaggacuggauuuaaagucauuugcaaggcgcucauucugucucaucuaauugcggugaccccugacauaacuggggagugcacccuaaaaaccuuuacaaucccaaguguauuaauaaggccgagucucaacaacgcuuuuuuuccucccacaucucauuucuagagucaugaguuuccuaacaucuccacgcuccaugaauugaucaacaucucaacuuucagucaaguuuuaccucucacuugagagccauuuuccauaaugagaccuagucugcuucccuuccugagaggcaggacuguguccacgauggagggcagaggacacucaggcuggcccacucccaggugcugaguggcccacuaggcucacuccccaguuaccagcgcugucccauccccaucuucccuguacagcuugugucaugagcuuccaaggucccucuugaauaugugaaaccaugacuauuaaauccaggaaucagaguuugcucugugggauuacccaguuuuagggggguuuuguauuuuugagacagaguuucgcacuguugcccaggcuggagugcaguggcacgaucuuggcucacugcaaccuccgccuccuggguucuagcgauucucuugccucagccucucgaguagcuggaacuacaggcaugcaccaccacgccuggcauauuuuuguauuuuuugguggagauggggguuucacuguguuggccaggcuggucuugaacuccugaccucaagugaucugcccgccacgcccucccaaagugcugggauuacaggcaugaaccacccagauucccuagucuuaacaauaauacuuuugggauauuuuuccuucuuagauugcucuuauuuugcuaguuagcaagccccagggcuccuaagguauuuggccuuuuuuauuuguaauaaacaucuguuuccuggacuguauacgaguuuauucugaaacauuuaaucuauuuaauuucaccccaacuaacacuguuuauacaauuccuuuucuaacuaaauaauacugagauugacuguucuggcuuuucuauuaaauaugguggauuuguggggagaaaauguguuccuaaaauaaaugucuugaucuguaaggguaugcccauaaggaguguggaagggaguuaaaauuuaguuagcaucugcuaugugccagguaaaauguauuauaauuagcaccuacuacaugcuuucauggguuaucucagagccaccacuguauacaagauguuuaagaacacacauacaccugagagcugggagaaaguuccucugcaguggggauaaaaaguaaaaagacgucgccgggcgcaguagcucaucccuguaaucccagcacuuugggagacugaggcggguggaucaccugaggucaggaguucgagaccagccuggcuaacauggugaaaccccguuucuacuaaaaauacaaaaaauuagccaggcaugguggcaugugccuguaaucccagcuacuuggggggcugaagcaggagaaucacuugaaccugggagguggagguugcagugagcugagaucaugccauugcacuccagcuugggcaacaagagcaaaacuccaucucaagaaaaacaaacaaaaaaaaaaaguaaaaagacgcuucuuagagaaacugugaguugagaagccaaauaauuagaaauagaucagagaagcugcaggaaacccagaaagaaacagauuaacugaccagcugcagaucaguagaaaggaauccagggcagccugcagccauugaagauaauuguucuggcagaaagcccccgagagagaggagugcauuugggagcugcuugugaacgagcgccaaggagaguaugucagagacccacccugucucaguguccagaggugaugcgcggggcacacauacagaagaggccuuuuuucaggcccaggaaagcucagagaugcgccggcucagaacugaagccacaaguaagacaggaagcugaggugaacagguuaucaggguggccgguugugucaagugaccaaaguaaagaaacuccgcccuugcaccucccaaccaguguagguugcacccucccauucuccagguacugccaguaaaaacaucuguggcccaaucuacugccugagcacgguaccugcuacugcagcggagucagucccaaggagcgacaccagugagcaggaaagcagaaaaggugugggaggaaacuccugugugguccccuuuaggggguggguagugggaaccagaagacccaggugcugcuauuuugaagucaucagggucgguuccaucacugcuuacugacuugcugcaccugcccauuucuacugagaaccaagagcaguagcuuuguuccuuuauaggcuuuacaauggucucuuccagggaauggucucuuguccucuccgaaaacuaaaucuccacauuucaucccagugugugcauaauuacauucccaagugucauugcugggccugaugaagcaggugcccccagcuggcuaagugcuugccuaccugcucauugucgggacagguggcauuccacaggaggcucccccgguuugugugccuaucauuaggugugggauuuccacccacaaaggcucucaugugcugucucugggcuguuuuuacccuacugcuguuuguggccuuccuuagauacaaagcugccugcccucccauauaccuacucugaucauucccuugaaaaacaggggaaggagaggagggaggagagcugcggcccaggggauaaucagaucagagucccuaaaggguggaaggaccucugugaaggaaagcaugagaaaggaacuuuagaagcaggcagagcuggucagccacuggcaagcugcagaugagcaggaagcauuucccucggucaaaccagccucacccagucugcucccugaggccuucaauuccuguaaugcagccaagcuuuucauuccacaacuagagaacaggcccuugggagugaaacuucagacggaagcaugcauguagauacaaaugagggcuauagauuccugcccugagagcaaaccuugccaccugggggucugugaccuuggguacuggaaaguggguaucaguucucucacuaacugaacuguacugccuuccaaaaaaucugcuuuuauacuaagggcaagacccuugaaaacaaauaaucaccuuugcaugggugccuacaagccuuaaaaagaaaccugugcuaaugugaaaaccaagcucaaacauaucucucaaaagaaaauucagaguuuccugccccagguugccccaggcacuggcccuccauuaagaccagcagggcugcuuugcaaagccucacaccaagagaaaaugguagucuauccuaaaauauaggggcucaugccuguaaucccagcacuuuggaaggcugaggugggaggaucacucaaagccaggaguuugagaccagccugagcaacauggcgaaaccccgucucuacaaaaaauugaaaaaaaaaaaaaaauagcugggugugguggugcaugucuguaguccuggcuacuugggaggcugaggugggagaaucaccugagcccuggaaguugaggcuguaaugagccauguucacgucacuguacucuagccugggugacagagugagacccugucuuuaaaaaguuaaaauuaaaauauuaaaauuuaaaauacauaaaauauaagcagugauacucaggaguucacagaaaaacucccuaaccaacuacauuucucugaaaaaugaugggaaucucagggucuacuuuuucuccaagaacuuaaaggagggugggaguuuuuggggauuuccagaaaaauaucuggaaaucuuauucauguggcuucuaggaugccaaauaaauguccuugaugucagaugaccuccagccaaugccaggaauucauuaaucuucuccuggcagggugcagacucuagaaacaaagauguugcagccaaaucaacccagaaugucugagacucucaggaaagccaaaggggucaaggaccugagggacaaggagggccucggcccucacccuggcacugggcuuccgcccgcucccuccacgucugccuguccagccuccuucuccacuugccacuucugagcagcacauuugauucauuguggaaggugaagcuauuagcaaaagugaggcacuugcuuaacugggaauuuggggugagcagauucuucuguuucuguccugauuuuugacaggaagagauguccccauuaucuagccccucauauuugugaaucccucugggcaucauuaucuguuucuagaaaucccuaagcagggccuguaccuuuuccaucaugucucuuccccaccacaacccaacacuucaguccugggcuagagacuauaugaaggcugggcgugguggcucacgccuguaaucucagcacuuugggaggucaaggugggaggaucacuugaggccaggaguuuaagaccagccugggcaacauggugagaccucaucucuaccaaaaaauuaaaaaaaaaauuagcccagcaugagggcaugccccuguagucccagcuaccuggcggucugagacaggagaauugcuugagccuggaagguugaggcuacagugggcugagauugcaacacugcacuccagccuaggcaacagagugagacccugucucaaaaaauaaauuaauuaaauuuuaaaaagacuauauggauucccagacaguacugcaaggggaagguggccauuuguuggugagaacaaauaaaugacuccggcagacugagcccuuggaguagcgcaggccucacucaccuuuuccgcuaucaggaagucauagcgaagggccucucgagugcagauggcgcccaggaggaagacgaagaugauguacagaaaccaccugcaaaacccaagagcagaacagagcugcccccgacucaccucacccagccccauccaauucccucacucaaccuucuguuuccaaagggaacuuguaucagaaugagagaaaggccagucaugaagcuuccccagcuggcuugggaggacacuuuuuguacuauuucucuucuggcauauuucuuaccaaaaaagggguaccauuguuuuguuucuuuuuuuacuuuuaaauauauauaaaaauauggaacacuucacgaauuugcaugucauccuugcacaugggccaugcuaaucucuguauuguuuuaauuuuaguguauguacugcugaagugagcaguuuuuuuucucuuucuuauauuaaaaaagaaaaacauacaaagggcauuccgaguagggaagugggaggcccaguugccucuagguugccaggauucaggccaggguugccccgcagccucacaccccagccuccuccagcaaaagaacaagcugaugauccuucgggccucuaaguccugcuggucuguuaucuuuggaucagauaauaaagagggaaacuaaagucaaaaggcagagagcagaggccuggcucuguccccaagaugcccuguaaccuugaacaagacccagguuccuguggucuccucauucccaucuggguaaucagaggaugggccaaggguuccuccuggaaccucccagcuggggccagaaacaagacaggguccucauucagaagccucuuucuuuuauuuccuucccaacacucaacucuaucucuguugucuucauuuucuucccaauguuauugcacaaaauacccugaugcuguacgccaggcugauagcaaugguuucacugcaguaagcuaagaacaaauucaguguuugugaaacagauacauuaauauuuucuaaauacugugguuagaauaacacaggcccuuuuaacuucucaagucauuguuucuggucucugaucucuuugccucuucacaccuacccaaugaagggcagagaagcuucuuccugugguacagagagaaacaauauucuaaaaggucagaaauagacccaagguuacccagccugcuuguguggguggcacagugugaacuaaaaccccagaggccugacggccugggggagcuggaggggaggcucacugggggaagaagaagagcugggugcugagcuuccacugugugccuucucuccccgccgcaaucuaggaagcacauacagugucauuauccccauuucacaagaaaggaaauggaggcucagagaacucaguaaauuguccagagucaugcagccaaucagcggcagagcugagaugcagccccaauucgucugauugcaaaacucuucaucuuuaugcucccuccagugauccuggaaacucggugguuaaaaaaauccccaaguucaaaaugggggugggggagggacgggggcgggaggccgaggaaaggaaagaaaggauucgaucugugaucugggucccgacacuccuccucggcagcauucccaggcagggcgcaugaaagggcagugucugaacccaccagacgugaauuuuccagcccaccgaguguuaaaagaaggaucggaauaugaaauagauuggucacagucggggcacucucagaacaaaaggggcaaucccucuucugccugggguuuucucucccacucucuagcucagacugauugccaugaggggaacuuacgagaugccaacagcugccagggagcccgggggaaugcuggcggcaggcucccugaggucgccccccauguugaagccggccaugacuccugaaagacacccagauggggaauggggugagcagccuccuccacgcaucgccuuccccagggcugccccuuccucuccugcgggacccucuccuggaagcugucccaccgcaagcccuccagcugcagcucugcgcauaggcugcuuuucaaucuccccuggcaacuagggaggcaucccuguggcgugaaaggcaccuuuguggguuggaggaggcucaggaggaaagcccucccagcuccaaaagcauccuaccgcucagcgcaaagcaaccaggggggaggaaagcggcuugcaaggcacacagagguccugcgcugccugcugagcugggacaaugcccuggagaggcucagcauuacaaaggucuggcagccuccugcucagcagcuuucccugccucugcugccugcugauuccaugggagcuuccuguguccucggggucagguaccauccuccaagccccugagcuaccaaagggcuugaaauaaacuccaaaaaaaccaauccugaugccacugacauggagucacaagcuccuuuucaucaucaccucucuucugcaagaacacuaaugaaaaugaauuaauccaugagggacccacagcacagugcugcauggugaaguggggauguugccucuucccauacaaacaaauauaugaaagcaacaagacaggguguucugaacaucggaugaggauccagcccacaagugccauaacaacucagugugaugggcugcccuggucaggaaagacccguggaggggguuguaucuugaauguggccuugaaagagggauuugaaugggcuuagggaugggaaugaaucuaacuccaugauuugugaacacuuucaaacugccugggccugugucaagugcuuuacaugcauuuuuuuauccuguuuaauucucauaacaaccucaucagaaagguagaauuauuuccucaucuuauggaaaaguguucaaagagguuaauuaaaacagccuaaggucacacauuuaauaagcagcaaagcuaagauucaacccuggucugucugacucugaaaauuaugcucuuaaugccucugcuacaaugcuucacagaauccaagcgaagugcagugaagugacaguuuggaaccagaaagugaaaguagggggguguauuucagagagaacccugaaugcuggcccgcggauggggugcauauacugucacccagcaacuccacuaugaggacuuuacccaucguagguagucaaggcuaugagggaagauuuagcccagcguguuuauaaacgcuuguuuagaauaguggaaauuagaaacaaccuaaugucuaaaaauagaggguugguuaaauaagugaugauauagcuuucaauaaauacuaggucucagaauauuguaagggauauguugugacauggaaagauguuuagaagcuuuugcuuaguuuuaagacgcauauuagaaaacagaacacaugguaugaucccauuauuauaaaaauauauagaaaaaggaacuggaacauguuuuaaaacauuaacaauguuauuucugggugauaaaagaacaggucauuuuuauuugacuguuuauauuuucucaauuuucuacaaugaucauuuugaaacgugaaaacuuuuaagguuuuguuguuguuguuuuuguuuuuguuuuuaacggccuguuaggcacauuuucuuuccucucauucccuccucuccaagauccuauuaagagcauaguaaaggggaaaaguagauaaauucccauaagcaaagagaaguugggaggaggacccuaaguagaugaaagguucccaugaaugucuggaacauagaacauagaaaauggagaauauaauaccgaggaaaagagaaggaaagaaagccucggaaugcuucucuacaagaucucaauacacugaggaaaaccagggcuggacguuugcaccccaaauaaagcccugcucaagaaucaacagcacucacaaacuucucaucaagguagggccccagcagggagacagaccuaaccaugcgacagcuggggaaauccaugcccacaaccaagaucacccaaugugugaugaaaaccagcaacaaauaaacaaauacacgcauaaauagaaacagaacaacccaggcuggaagaaacauaaaucaggauacagagagaauuuggaagaaaacacuaauuaguagcuccagguacauccaagaagaauauucuaucuauaaaacaaggugcuaugaaaaaaaauccaagaacaacaaagaacuuuuggaaauuaaaaauaugaucauuaaaauuaaaaaugcaacagauuuaagggccagguguggugguucaugccuguaaucccagcgcuuugggaggccaaggcagaaggaucacuugaggcuggguguaauggcucacaccuuuaaucccagcauuuugggaggccgaggcaggcagaucaucugaggucaggaguucgagaccagccugacuaacauggugaaacuccaucucuacuaaaaaugcaaaaaguagccaggugugguggugcacaccuauaaucccagcuacuugggaggcuguggugggaggaucacuugagcccaggagguagaaguugcagugagcggauaucaugccacucacuccagccugggugacagagauccaucucaggaaaaaaaaaaaaaaaaaaaagaaggaucccuucaggccacaaguuugagaccagcuuggaccacacagcaucucuucauaaaauaaaaaaguuauccgggcauggugguacacacaucccagcuacucaggaggcuaaggcagcuuuaauugacucacaguuccacauggcugaggaggcaucacaaaucauggcagaaggggaaggagaagcaaagucacgucuugcauggcagcaggcgagagagagcuuguguaggggaacuccuauuuauaaaaccaucagaucucgugagacuuauucacugccaugggaacagcacgggaaagagacucacccucaugauucaauucccucccaccagguuccucccacgacacauaggaauuguuacaauucaaggugagauuugaguggggacacagagccaaaccauaucaugacauagugcucuuuauuccucgccauuguuguaccuccuacaguuugucaggucauuuuguacaccuuccuucagaucuuuuauacagaaguuaacccaugaagaccccugagaacaccacagcaauauaugcuucuguggaggaaaaugacugauucauccuaauugcuuccugcuuccaaacacuuacugucuccauaacaaacccccuuuacuccucccccagguucuguguaggcugccuguugugcaguacauuaggaugcugcucagugggaggagaaaggacugaccgugacacaggaaugagccaggcccagauauggccagaaacuuggcuuuugagacaaaacagagaagccagaaaguagauuauaucacagacacaaagagccagaaacaaggagaugcaggcaacucggacugcagacaagaagucucacgggugauuccugcuggggcaaugugggugguucccacagcaaaguguacauuuguuuguguuuguuuguuuguuuggauuuuuuuuuugagauggaguuucccucugucgcccaagcuggagugcaauagugugaucuuggcucacugcaaccuccgccuccuggguucaagugauucuccugccucagccucccaaguaguugggauuauaggcaccuuccaccaugucuggcuaauuuuuguauuuuuaguagagaugggguuucaccauguuggccaggcuggucucgaacuccuaacaucaggugaucugacugccucggccuccaaagugcugggauuacaggcaugagccaccgugccuggccugcacauuuguuauaggggcucacacacuguggcugucauuuccaaaauucuaccucuguguuaccacacaauucuugggcaauguucccuagcuucggugaauuauaaaugucucauucacuaguuagagcuagaaaaauuauuuugacuuaguauuuuuuuccugucuguguuaagugucacagaaauucucuaguuugcuuucuuuuugcauccagugcaauuuuaaaacacuaucauuaagguuagaguuacauuuaggguuggcguaauagaacaaauacuauuucccagagcauuagugcccagguguuuuacaaauauuacauuuuuuaaaaaguuccacaauugaaaauaagguugggaaaaccuuaauuagagagguuuucggugcugggcuauuguagugccuauaauaugcuaauauucauuguccaucucuaagaagagaaauacagcacacaguuucgcaaaacuuauuuggcauugaacccuuuuuuuuuuuuuuaaagaaaugaaaacuuucuucauuauuaaaguuccacagagcacaguuugggaaacacucagugcccauuuuauaauuacuauuuggucucgacacuuuucuuggcgggcuuccaaaaauuguuuaaauuuggcuauuuaggacuggauggaguggcucaugccuguaaucccagcacuuugggaggcuaagguggguggaucaccugaggucaggaguuggagaccagccugaccaacauugugaaaccccgcgucuacuaaaaauacaaaaaauuagccaggcaugguggcacgcaccuguagucccagcuacuugggaggcugaggcaggaaaaucgcuugaaucugggaggcguagguugcaaugagccaagaucacgccacugcacuucagccugggugacagagcaagacuccgucucaaaaacaauaaaaauaaaaaauaaaacaguuauuuagaaucaugauucuuaaaucuaggugauacccuagcgaucaucuacuccaaccuuuuauuucacagaugaggcaacggaggcccaaagaagggaagccauuugauucaaguguuccaagcuaauugcuaacagaaccagcacuaacccucaaguuuccugauuccaagucaguguuguuuccacuacaucacauagccucuccauuucuuccuaacaccccugcucuuuguagauuuccccuucugaaauaguaauugcaugauuaaugugggguuacauacccacaagaaggcugagcuuaucaguuauaaucggcgcgaugcauugguuucgccacaggcacuugcaucaccagcuccuaaucucuagacagugcuggauugauggcauuucuggguuuuaaacgccaauuccaggaagcaguuaauugcuuuacccaaaaacauuuuuucucccugcaucacaacgaugaucugucuggucugcacacuguuaccaugugacuuagguaaacagcuuccuuaauauggggaaagccuucuggcuuggucuuccaccccaguccuggggccuucaggcacauauuuauggucucaguuuugauaugcaagucugaaggugucagccaucacuugaccagcuuagguuuaugaggcuacaccucgaguggcauccguagccaccuagacauugacaucacaccuacaguuucgauggauggcaccaggugaacaggggacuuggggucagcgccuacuuccagugucuggucucacagaagacauagagggccagaaaaugaaucaaccccuuauagcucucaaaaauauauccuuggguaaaauaaccaguguaaaugucaaugaccacuuaccaacauuugcaaguggguaggucaucucuuuucuucccugcccccugaaucacccaguggcacacauugaucaaaguccuuacuuaucaccaauuaccacaagcccguuucccaccccaauucccuuuucuguuccugaaaaugaagauuaguaggaaaagaaaaucccaacaguuuuucuaggcuuuucagguuccuguuaguucauaaaggacuacuuacucuuucucaaggaacuuccaagauuccuccuggggacuuuucaauccaaaucuguguccucagaaacucuucaacuuuuucuuuccauuuauagcuuaaucguuucucugcugccuguuuucuaaguucauaacuuuauuuuucuuucuuaugaagguagacuacacaugcacuaacgugcccaagucucaucugcugccuuuuuuuuuuuaacugaaaaaagggaucuauuacuguuugguggcaauguggcucugagcccugcuuuccucaccuguaaauggggauuauacuguuugcuuugcaggacuguggugaaguuggaacagauauucauaagcaccuagcacaguggcuggcaccuuguaggugcuaaauaaaugcucacccaggagagaugggcucugcuccuuacucagaaaucccucagauuccuaaagacuggucugccucucuuuaccuuccuucugauuuccaaaccccauuccuuucccauaccuggcuuguugguugguuuguucagcuguuccugcagaaaucucuaaaccugucuugcucuguucuuggagcaaaacuugugaguuucccucccucucaauguuuuagagaugcugcugggacagacagugucaaauaaugcaacuuuccaacuccaggacccaggcaagauuuauuggcuucuggaugaggggcggcaccaacauuauguguucucucuuuaugggaagcaacgggguuuaccgcuuacuggcugggagauguuggggaaauaaccucucuaaaucuuuguuuccucaucuguaaaauggguaaauaauagaaccugugggaggaucuagguuccaugcggccugaaauuuuuuugaaaguacaaaauuaugaauauaaaauuaggaacaaggcuuuggaaggagcucacgcaagugagggaccuugaagcccaggcuucaaccacuucauggcagcccugugucugauggaaccagucaggcuguggagaaguuuaaacagaaaacuauacauaaagugcuuaguggcugacauaauagguuauuguaaugauaauaaguauugucgauauuuauaauuguuuugauaaaaacuguugauauguauaauuauuuugauaaaacaauuauaaauuaauuccauaaauaaaauuacaaaaaauagacauguauaauaauuauaaaacuuuuuuuuuugagacggaauaucacuuugucgccagauuggagugcaguggugugaucuuggcucacugcaaccuccaccucccgggcucaagugauucuccugccucagccuccagaguagcugggacuacaggcauguaccaugcuuggcuaauuuuuguauuuuuaguagagacaggguuucaccauguuggccaggauggucuugaucucuugaccucgugaucugcccgccaaccucccaaagugcugggauuacaggcaugagccaccgugcccggccuaagcuuauuuuuauuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuuuuuuuuuuuuuuuuuuaagacagggucucacucugacacccaggcuggagugcagugaugcaaucuuggcucaccgcaaccucugccucccagguucaagcaauuuuccugccucagccucccgaguagcugggacuacaggcuugagccacugcacccagccaaagcuuccuucuugucuccuguuucugcccauaaguccaucagaaugaagggaguggagugagcccccaucuucagacugucccuacuuggggcucucuaguccuuaaacaugggaaccccauucugauccagcagguucuuguccucucacucacaagacacauaacuugugaggagacccaggggacgccuaggaggggggaaugggggaaguaggccagaggaggggugagcacuaacagccgggcugaggggccuggagacagccagccaauuggagggcccagcaaauucccagagcuucccaggguguguacaugagcaggagagaggagucaggcccagggaggucaaagggcaucacagaaauagcuggguucuugaaaaggaaggugacuguggacauuucaguaaaggcuguagguuuccuaccacauuuuuucgugcuggguguggucaaccacaggcccauguguuggcuguggccaaagaggcccuuaucccuuccaguaagaguuuagaaucugggaacaaggguuacaggacuucacaugacugauauucuuuucagugaauuuccauuuccuaguuccucugugaaucguguuccuggaucccuggaguggcugcauccacaugguaugugugaaacccuggagaggagaugucugcuucucagggaaaguuugguaguggagcuuggagaaggaaugcacuuugagaaggaaugcacuuuaagaagcaaagcaaguacagcauccacuccaagcuccccccacuccaccccugcagccaccagcacaggguguaauggagaagagugcagugagggggcagggggacagcuuccuaaauccagaggagcaccagaccgaaucuccagccgcucuucccaggaagcugccugcccuugggauaaaauaucugaaguaacuuaaccaucauaucucugucaggaggauggggggcuggggacagaaggguuuguucaucaaaacucucuccucgccacagucuggagguucucuuguuccagaagaggaugguguuggagggaaccccagccaugacucacucggagcuaauccuuagcaaaucuaucaccauggaaacugccaaucauccaugcuuuucauagcuuaaccgaacaucugccaggagacagcaagucauacaaaccauucguccugccuauuguguuuacaauuggggcccugaaaaacagagacagagacacggagggcagcucuccacagcagggugacggcccaacucuggccacuaaucagcuucgugaccucugucggguccuucauaagcuccucugcaccccuccuccccagcugguaaaauaaaggaucagaucaaugauucuucaccucaguugggccaaugagagugagagggacaggaaagcagguccccuaagagggguggggcagagaggccuguguaguuacaaucuaugcgcuauuaucauuuuacauuugaaagcuuucaaaauaauacucauaauuuaaaucacagaaaauaaaucuugacucaucgucuuagguagcuauagcuuuuucagcggaaggacaacgacacuccaucucugagccagaauguccagugucugugaggcuuuuaguaucauuaucaaaagugaauauaggccaggcaugguggcucaugccucuaaucccagcacuuuuggaggugggaggucgaggcggguggaucacuugaggucaagaguucgagaccacccuggacaacauggcaaaacuccaucucuacuaaaaauacaaaaauuagccaggcauaguggcaugcuguuguaaucccagcuacucaggaagcugaagcacgagaaucucuucaaccagagaggcagagguuguagugagcugagaucacaccacugcacuccagccugggugacagagcgagacccugucuuaaaaaaaagaaaaagaaaaagaaaaagaaaaagaaauacggauuaaaaagacaaaagcuugggaguuggacuagcugaucucacaugugaguccagcucauacucugggcuacuggguggcaccuucaagccucaggcugcugcuaacuccugccuggagggagaagcuggaggggaggcucaccgcccccuucccccacucacaccaggcauccucucucuuaggaaagccagccgugggagcagaguggaggggcacaucagggccacauugccaagacaaaccccuggugcaccugaggacgcccgagacauucccugcacagugugaccaggcaaagaggccuucugcccugccucuaggguaaaugcuaaccugguaucuuggcccaggggucuucacucaguggggacacugccaggcuccagagaacacucagaugguuuucaauuuguguguggaaggaaagaggaagagaggcugggaaacaucaucagauguuaacuuuguuuaauucccucuguuuuucccuuuuccuuuucuguccauucaggaggaagcugaccuauauucucuugucuugugggagacaagaggcagagaggaagcagaauuugccugugcacuguuuuggcuucuguuucucaaaagccuagguccuuagaagauuuuggagggaaacagaaaagaaacagcagaaucgcuggggaaaacaugaggcgacaaggagaaaaacuaucacacaguuuguggggccacauaaaaauacaaaugcagaaucaaaaauuauuaagauuuuuuuuuuauuuuuugagacagagucuugcucugucacccaggcuggagugcaguggcacgauuucagcgcacugcaaucucugccucccagguucaagugauuuuucugccucagccucccugaguagcugggauuacaggcaugcccuaccacaccuggcuaauuuuuguauuuuuaguagagaugggguuucaccauguuggccaggcuggucucaaacucccgggcucaagugaucugcccacgucauccucccaaagugcugggauuacaggcgugagccaccaggccgggcccaagaauuuuaguaacagcaaagccuuaaaacaagcaugagucccuucucaggguggggacaguguaaaugcauaggucacacacccagaaagcuggcccuggacaggaguguccccauauuugacagaagauugguucuggagucgggggcagggagagagagaggcuguucccagguucuggggaaaugaggaccuggaacccccaccccgccaacucccuggcaguacugguggggagccgguaagacccccagaaggaaagguuuggggaguacauagacccuaagcauaggguucccaaucucagauuuccaguccuugaacguggcucagaggcagcacaaaccugaaaggcccuauggacaggacaaugggaaggccugguucuguuuacagauaaggaauugcagagccccccaaacaugucuggguacuguuuaaaacccuaagccccuggagcuggugcagagcauggcaggagcagguggaggcaugcugaauuacugcucuuacuuuuaagccauccuggcagaaugaaggcuuagagucggagacugacucuuuuuguuuuauaaaaaugaaagcgacgcacuauuucuggcaaaucuggauuuguagaccaggauucgaccugccacuuccaagcccuaguuccaggcucauuuccauggccgagccuuaagaaaagucaggcaggaagcugacacagugauacaagugauagaugaagcugggaccagaguggucaggugguagacauaaggagaaguagagagaaucuagcaacucuuaggagguaaaauugacaagacuuagagggcacuggaaagaaagagggaggucugaucacuggcauaagcauuuggcuggguggaggugccauuuacugacaucaggaguacaggaggaggacaaguugagggguaggugagauggguuugguucaaacuuguucgguccaagauacccaagagaagaugucacauggacaacugaauguaugaugugaagcuuggaagagaagucugggcuggaaguguaaauuuuggagucaccaguuuugagggugguuauucaacaauaagcauggaugagacuccaaggaaaauaguugagaaagagaugugagggccuaggaauagcuugaagauccccaacauuggacaggcagguggaggggaugcaccuauaaaggcaagucagagaguaggagggagcugagaagccugcaucguggaaggcaagagaaaugcaaggggaaguggguuguugcugagaguuaaauaaagugagagacuaaaaaugcacgcugcauuuaguaacaaggaagucacuggugaaagagccaugucauugcagagacaggcuugcaauucccaaaggagagacugggagaguugaguaggggauacaagaauggacauggggagccauguuguuuggcuuugaagaggagagggaaaggcuauugcuauaaggaaaagugggauugaggaaaaucaauuaaagaugauuaaaguuauugucuuuuucauuuuaacagcuuuauugagguauaacuaacauucuauaagauguacauguuuaaaguguaacaacuugaaaagcuuugcuauaugaauauacccauaaaaccaucacuauaaucaggaauacacacacacacacacacgcacacacacacacacaauuuuuuuuuugauacagggucucacucugucacucaggcuggaguaucauggcgugaccaaagcucacuguagccuugaccucccaggaucaagcaguccuccugucacccaccucccaccccuaaguagcugagaaucacuacaagugauucuccugccucagccucccgaguugcugggacuacaggugcaugccaccacgcccagcuaauuuuuguauuuuuaguagagaugggguuucaccauguuggccaggcuggucucaaacuccugaccucaggugauccggcugccucagccucccaaaguucugagauuguaggcaugagccacugcgcccggccaaagcuaacuuuuuaaucauguuuuguagagaccacagggucucacuauguugcccaggcuggucucaaacuccugagcuugagggauccuccugucuuggccucccaaaguguuaggauuauaggcacaagccaccacgccaggccaggaauauauuuuucauccccccaaaguuuccuucugcacuuuaguaaucccuccuucgugcuccucucacucccauucccaggcaucugucacuauagauugcauuuucuagaacugcauauaaauggaaauuuauacaaucauauuuauuugcuuuuuuuuuggucugacuuauuuuacucagcauaauuauuuugagauucaccuauauuguuguguguaucgauaguuauuuuucuuuguuuagagacacagucucgcucugucgcccaggcuggagugcaguggcgccaucucagcucacugcaaccucugccucccagguucaagugauucuccugccucagccuccuaaguagcuggaacuacaggcaugcaccaccaugccaggcuaauuuuuuuuuauauauauuuuuaguagagaugggguuucaccauguuguccaggcuguucuugaacuccugaccugaggugauccaccugccuuggccucccaaagugcuaggauuacagguaugagccaccacgccugaccaguuauuuauuuuuauuauugagugguuuucuauuguguggcuacaucauaguuuauuuaugcacucaccuguugaugaacauucaagcuauuuccaguuugggacuauuaaaauuuaagcugcuuggaaguucauguacaaaucuucauaugaacacaggcuuuugauccucugcaguagauaacuaggcauggaauagcuggauguaauuuuuaagaaacugucaaacuuuuuuccaaagucaccgcaccauuuuacauucccuucagcagugcaugaggguucuggugucuccacauccuugcuaacacuuguauggacaaucuucucaaucuuagacacucuaguagcuucuccuucuuuuucugucccuaucccauuugggguggggacaacaaguaaggaaauggccauauguaggagggcagagggaaaggagagagagacaaggagacaagacagauauccucuggccaucaauacucucuugaucaagagugaaaugcuuuucucucuucauuaagagucuguucccuggggacaagcccagucacuagcaaauguuauuuuuuauggagcaucuggucaacauguuagcuuauugccuuccaggccagggacccaagcauggggcaggagcccuacagggaccuuggcugugggaggcuccucuacagucacugcagagcaggaacuuggggaagggaggguaaggagauucauuccucacccccgcgauacugguuuggcucacaccugauacagcaagaaaacaaaagacaauaguguuucucugcccucugggagaagaugugcugguacggguagggggaagggaaguuucgauuccagguaugcacuuauuccaccuguggaaagagcggcuuguccugcugaggaauccguccuguucagcccuaugagauauguauccuuucuaugaacaaaaggugucaauguauaaggagugaggaggauuaaaucauaucgaaggccuucaguaaacucuguuaaaauaauagauuuuuauguuugaggccagggguucaagaccagccugggcaacauagugagacccugucucuacaaaauacauacauaaacagauaaaauaacaaaauuuuagucaaagcuaagcccauaucuaaaguuggauauacauaccaagaguaccugcaggccaaugaugaugcugaauuuuggaaccaagaauguauaccccuaauuugagaguaaaaaagaacccagauuacaauaccuguagccgcugggaagaaaaccccaaagacagugaaaaaagauucccccgggcuguaaucgggcagcguguuguucuguagcaguucgggugaauauccaaugaaaccauguucugaaauaaagcaauggagagcaacguaagcccagugagaagacacaggacacauuucccuagauuaugguacuauuucauauaucgcuuuaaauauuggaaagguaggggcauguaugugacacacagcgacagagcgggucugcagaaccaucuaccuucccacuucuaggguugacuuuugugugcugaucccauagacacagauggaugacauaacaugaaaggaagcagugguuacuucugggaaggggagcauuuucaucuuuugcuucauagacuuuaauauagcugaaauaucuuucaaugagcauguauuuauauguuuguuuuccauuuaaaaaauuaaucgauauuugcaaguuacuuccguacucgaaaaccuuccacgggucccuaauagcuacagaaucaaguccaaacuccuaucaaagccuccacaaccuggcaacagccaccgcucccuacucaucccuugcuuuuucuccuccccagcagccacacccugaggaaggccacccacacccaccccccugccuucguuaggcagucuccuggccuuccagacucuucucccacaucucuaagcaucguagugggccaacucuucaagcucagcccaaauggugcuccuuugggcuuuauaagcacucccuaaucagaaucuauuccuccccccucacugcuguugacgcuaggucuggccacaguaggacuuuccccaacuaaacuccuugaggcaugaaauccaggucugcagaucucuaucccccagagccaagcacugcacuggugcacaguagguagguugcaaauaugggucacgcugaaaagaaccuuucucuuagaucucucagccuauggacacaucucgcuuccacacuuucaauuugacuuguucacagccuacuucauagcaggaacaucucagaucucauuuccucaaagcauuuuaaacauuuuuguacaucgacuuuaacaaacuuuuuucaagugguuucaacccugcaggcacguugcuucuuugucaaaggaggucacuuugaacagcaucugugaacaugcuagugggcuguggaauuuuaagacacaagucaaguguuguugguuucaggaacacccaggauauucagccucugcuucugaaucuugucucugagaaggaguugguuuguuccuauuaacugucguccaagagaagccaaucccugcuccuuuucccucaaccccuguagucccguaggauggguauucagcugucacuccauagccaacccuaggguuucagggacagaauuuccccaagccucauccuccacccgcucggagcuuaauuacagcccaagcuuccauccacaaaagaaggcuccugccacucugaugaguccaaugaggucgcccgcacuucacacagcuuccaagauucauaacuucauaagaaaaauauuuuuuuuaaaaaauaaugaaacgaaaucucagggaagcacaagggacccuugggaguccagucaggacuuaaaucauugucaauugcuuuauuuugccugaacacagaauuuguucuggcauauucaaucccaagugcuguacaacuuuucugaaugguuuggcguuuuuguagcuggcccuccccucauuaacaaaaaagcaauaauagcuaaguuaacuuuagcuuauccgcuggcugaccucacugaugagucuuaaggaggagaaaaccagcccagccugccuuggaaccgagcucagccaagcuggacuaaugugcaggucggaaagcacaucugagcggagggcugugugugcccggcaggcccgccucgcaggacagaaaacacuucaucaggcauauucaucuccaagggcccaagggcggcccugacacaggggaauauuuggucacugggccugaagggcuuugcccuggccagccugaagguucagagggauuucaggcccaauagaugagucacugggaagccuuuucucugcccaucccuucagcaagacccacaggcugagauaaugagucacuuggcucccucgugggccugccucaguugccaucucuugcagggccaaugagaaaugcagcccugccacauucacaaagugcacacucacgcugacacacgcucacgcucacacgcucacgcucacacucacgcucacacucacacgcucacacucacacuacugcuggcccagccugcucugggcugaagccaagcucaguucugaaucuugcucuaggaaauagucuuaacuuugcaaagaacgcuauggacaaaaauaugugucaaugcuuuguuuacaauaauguaaaaucgggggaggggucgggugcaguggcucacgccuguaaucccagcacuuugggaggccgaggcagguggaucacuugagauuaggaguuugaaaccagccuggccaaaaggugaaaccccaucucuacuaaaaauacaaaaauuagccggccgugauggggugugccuguaguccccgcuacucuggaggcugaggcgagaggauugcuugaacccaggaggcagagguugcagugagccaagauugcaccacugcaguccagccugggcaacagagcaagacuccaucucaauuuuuuaaaauuuaaaaauaaauaaaaaaugaaaaaaucagaggagguucuaaauguuuauguggaacugagacauuuuaaaugcuuauaaagaguuuuuaguauaagagaaaacuguccauguuauauauacuauaugcuaauucagaaaacuggaugccauaguauaaauacaaaaaaagguguauuaaucuauacauguaagaaacagcuagaagaaaacacaccgaaauacuaacugugguuguuuguauaaugcaauuacaggcaauucuuguacuuucuuuuuuuauuucuacaaaacauccacauuuaaguuaaagggcugagugcaguggcucaugucugcaaucccagcacuuugggaggcugaggugggaggauugcuugagcccagguguuuuagaccagccugggcaacacagaaagaccccuucuacaaaacacacacacacacacacacacacacacacacacacacacacacuuagcagggcaugguacuagcuacucaagaggcugggguggaagaaucacuugagcccagaaggucaaggcugcagucagcugugacuaugcuacugcacuccaguuugggugacaaaauaauuuuuuuaaaugaacauaaucuacuugucaucaaaaaauaucuuuuaggaaaacaaacaaaacaucccacaauugaaagcccacuuucucgucagcuuuucuauguaugaagagcuuuucuuucuuuccguuuguacucuguuucccaaaaugacuugaguggcuuaugagaaaaacauaaacaagacaggaaaaauaaaauaaggaccaaagaaagaaagaaacugagcaaaagagagagagggugagaacacccccagucguaccuccaugacccacagucugaggccuuauucagagagaauuuucuaacucuuugaccaagcgcacugaggcagggcauuggaucugguggcccaucccucacaugggccacuuuccaguggacaacaaggagcccccaaagcuggcacaguggacccugccucauuuccucugccccuauuuucccaggcccucaugacuugcaccccucaccuaucaccaccccaccucacgguccccuguccugagccaguccccaaagagucuugcucacugguccccauccugccugcuggggccugggucucuuucccacacccugaaccugguggcccacccagaccucaggcaugguugacucucuguugggcuuaugcagagugggugcccaggggaggcacucaugucucugacuggccgguacuggcuagcuaagcauggugugaggucagugggucacacccaggguagggcugagguccaugccgccugccaugcccuccgacaguggcucuuaaugccugacuugcugaugcccagaacaaagguuccuaauucuuuuaguugcccccauuugagagucugaugaauaccauggucccuguccccauagacaccacauuuugcauaccauuuuggggaagggcagauuucugaagccucucuggagagcauggaccuuaagguucgagaccucuacucuagcagcuacaucugcacgugagauugucccgccaggaggcaccuacaacuucccaaggccugacugccaccaugcccugccucagaguggacagcagcccugagagugacauagccaauaaugucuucaugccacaguccuugccaagcaauggccaagacugugugcacagagauugugcaggucacuccaaggacaccacagggcaaccucacuucugaaaauaaugcugagcgaccagugacugaacccuuccuacgugccagccacugaacaacaagaccuuacaaugucauacuuguacgaugacuaacugaggacacugaggcuccggaacgugaaaaagcuuguccgaggguuacauagccagaucugccuguauuucacccacugccucucccgguggcagaagccaggccucucuccaggagguggguucccaggcccuggcacugcacccccuuacagcacagguugccuuucagccccaggaaacaugcccacagagaucauggcaucucccccggccccauuuguguagggcagacaggaguccuauccuguggaacaccaugugccuaccgguaugcaacuggcuggagcuuacacagcugggaggacacagccuguccuggaccccacaucugagugaauucaggccuccaucuaccacacugacccucuguaauccaucccaaagucauuccccaggaauuuccuuuuuuuuuuucuuuucuuucuuuccuuuuuuuucuuaaagaggcagggucucgcucuaucaccgaggcuggagugcaguggcacuaucguagcucacugcaaccucaaacucccagccucgagcaacccucccaccuuggccucccaaagcacugggauuacaggcgugagccaccacgucuagccuccccagggauuuccaacacuuguuuuuugaccucagaagagucucuuugccucucuguugggcuuucaauuccucugcuggugaaacugagucuuguggucugggguccugucaucugacaucuuucaacucucgaaggccugggaugcauggggccugcagcugcugcgugugaauggaucuggguuugaccugaacaucuguuucucuauccacggaauaaaaauacuuugguccaguuugagcuguaugcuuuuaggaagaacaaaaacaaaaaggggggugggguggggugcggguaagacagagaacaaaugacaacaagacccaggcaggaacaggcagagggaaaguccuugaagcucugucugcagaaaggcuugaucuuuccacccggaauucggguaauucaggcuucuugugaugcggccagugggcuguggcucuucagggcccaccaucugcucccaaggggugcucgugggagccuacccuccuccccuuagccaaaggcaggcagcgggggucacuagugggacugagaacugcuccagcagggcugcuuggggugcccagcagccgggcaugggacccuugcccuggguaggcggcugcuaggggcucuggguggcaccugcggugcccccgacauccccucccccuacgccgcugggggcugcugaaauuagaagagggagucgggaagucauaccccucccugugggcgucggguugcacuguugacuaacuuagaaagcgagauuucuaaaaaugaugcuggggcugcaggcugcgggcugcgggcugcgggcugcgggcugcugccgcggcgggggcuuccggcggcgcucucuucugggucccccaccccuggaccagcgaccgacgaccagccagacagcccuuuccugcgaauggacaaugggagaggcuggcgcaaccgagaauagccagcgcggaggaagggcuccggacggagcuaggaggguggggcucggagggcgcaggaagagcggcucugcgaggaaagggaaaggagaggccgcuucugggaagggacccgcacgacgacgcccgaagggcgucgggggaagugguaggccccggagacugcgcgaggcuccucagcaaaggaagugggcgcggcgcgcacgcaagaccucgcacccggccucgcgcgccgccucuggacagcccagcgccucucagcaccuguaccucgccagacgcggccucacggagacggggaucugcagccaauccgaaacugccugacccaggggguccgcggaaaggggaggaaggggaguguccacgggccccauccugccacuugucacccacaagaguuccuucccaagcagccccauccucgcccggacacucacucagauacugcccagccccagaugggcuaagaggcacagagaugggcaauuaaacacagcaggccuggccucccugggcuggggaugggguuuuucuucugggagcugcaaagggugaagcaguuacagguuaucagggaggagcccagucaaaacugaacucaaggaggauagauuugggagaagucccugccaugcuuauccucccucggcgugaagcacagggcccccuuccaggcacaaggacccugaagaucucuggguggaggaaggcaagaacaguggcaaaaucaggaaucaggaaccaggguucgggcccugguuaugcgaggacucacugugggacuguaaacaagcccuuuucccucggagcuuugaaacgcaaauuuugagucagcgagaccggcaugggccagagacccagccuuccuaaugagcuccccggagaugccacgcuccugccugcagaucgaacucucaguagcacaguacgagaugauuuuucagaacccuucuaauucugaagucuucccagccagaagcccacucucaggccucucaggacacacuguccaaauacacaguugguuuccaauggcagagguaaaaucccaaaccagcuuccauaacaugcccuccucccuucccugacucugugauuguugauacaggaugugcuccagaaccgugaaacaagcucacuaccacaguuccauauguuaauaaaaccuuacuggccgauaaugagagauuacauggaagggcagagagaugaggaaaccuucauggucuaauucauuggccuguuuuaacaacugaggaaacugaagugcagagcugaagccaacuguucaaaagacacgcagagucaaaaggggaacaguaacccuaauugagaguacaguuuggaguccagauaguaucaagucccaaucuguugggcucucccauugaacugggucauaacaauccugguacaacuauugguguucaauaaaaguguuuugaaauagaacugaaucggcuguauugcguuggacuguuuugaaauuaaacugaaucgggcuguauugcuuuguauugaucacugccuggagauuuggaagaggaaauaaugauagguuucgaagaggcccccaaagaguccugggcgugagccuggagucuuccucggaccacagucuccucucuggcuucagcccuauugacuuugguccugcaaagagaggguggagagaggaugugcacaggguuuccagccuaagaccccacccagagagaaaauacacagagggagggcugggcauuccaacaguggccagaagggaaaucugaaguggggcuugaccugcccagagggccaggggagucccgcccagccugccuagaaaggagcagccuagagcccugccuggccauggggagagccuccacccugugggaggacuggcuguugugaaacagugggaaggacccccagggcugggcaacccaggggaugaaaggccagacugggggaugucagggcagccucccuggccugggagggaaggggcugaaagugucccauaacaagagcagcuccugccaugcccugcggucuaggagggcagucccggggcucuuucugagcuaaggauuccucauuugugaaaggaaagauaagccuuuucuucaugaagaaugguuucuaauaaccaagaaauuguuccaucugcuaacacgggcucuauuuuaaaugcuuaaugaaccuuuucucauaauggccuuggggucaguaagcugagaugagauuuuugccuagagaggccuacagcggaaagagcugucaaaugcccaagaaugugaaaagaaucugacuugaggagacacuagguucucaccugggccccaggaaacaagaggcaucuuggggugagaacagugcugucuacuuccgcugcauaccacucauuccaagugcuuuaccguauuaacucauugaagccucacaacuacccuaugagguagauggauuuuuuucagggaaggaaacugaggcacagagaggcaacugggauucaaacguugugcugccacugcugcagcagugcuuguccaaggcugcagggagucuuggaugagugccaggagcuccagcugcuccagcugggacccugcagagggguccagagggaccuggccccagcccagcccacagagcccccacuagccuacccuagaaaggagcccugagaaaggaaaaucuggccuccuuaucuccugggggaaaggaaugcacucucccuccugccaggauaacgggcuguuuuaacgggaagucuccacccuggcuguggguuccucccagccaccacuuauuccuucuggcugucucugccucuggcaucccacuucccaugcuucaacuccugaccccugacacccccaaaauaauccuaacucaacucauggcccccucaaaucagcugccccugcacagcuccaagcuggucaagaagucuucccugccccacuguugcuuggauauccucgccaggcaggcagcugagacggggugggaggucaagugaccccugcagggaaggggcagucaguaucaacacaccgauauguaagcagagccccccuccugccaagcaccaggcugaaaauauucacaugcucagaccccuuccccaccaaguucugaggccaugggcagcucucccccaccccaaguccuacccaagaaacaaagcagggccucccucagaaugccauggcuaaagauucaguaucauagaacuguagaaaguuagcaucacagcagucuuuagccucaaauccauuuuacagaugggaaagcugaggccugagaaaggagaugcccacgucacaaaguuagcagcugcucaggggagaccagaacacaguguggccaagcccuuguccaauauguccuauggguccccaucucucugcuguuacuggcuggcuacuugccuguuuuuuccacuagacuaugagccaggugggggcaggcaccacgcucucuuauuuucuggggugucucuggcaccuagccccaggggacaugcaaaaaauauaaaacauuaauaauaacaaacaauggaaacaacccaaauguccauccacagaugaauggauaaacaaaaugugguauaucgauacaauggaauguuauuccaccauaaaaaggaaugaauuucugauacaugcuacaacacagaugaacuuugaagaccucaugcuaagugaaagaagccagaugcaaaaggacaaauguuguauaauuccccuuacaguagcuccccuuuauccacagggcauccuuuccaaaacccucaguggaggccugaaauggcagauaauaccaaacccuauauauacuauguuuuuuccuauauauacauaccugugaucaaguuuaacuuauaaauuaggcucaguaagagacuagcaacaaugacauaauaaaauacaauuauauuauaauaaaaguuuuaugaauguggucucucucccucaucucaaaauaucuuuuuuauucuuuucuuucuuucuuuuuugagacugggucuugcucugucaccccaucuggagugcaguggcacgaucacggcucacugcagccuccaccucccacggcucaagugauccucccacuucagccuccugacuagcugagacaacaggcuggcgccaccaugcucagcuaauuuuuuauauuuuuuguagagacagggucucacuuuguugcccaggcuggucucaagccccugagcagaagcaauucucccaccucagccucccaaagugcugagauuauaggcaugagccacugcgccuggcccaaaauaccuuauuguacuauacuauuuuuaucuauuuuuggaccacuguugaccguggauagcugcaacugcagaaaacaaaacuguagauaaggggaacuacugccuaugaaauaucuagaauaggcaaauucagagaggcagaaaguaucauagaacagaaguuagugggggcggaguuucuguuuggggugaugacaaaguuuuggacgcaaaugguuaggauaauugcacaacagugugaauguaacuaaugccaccgaauuguacaguuaaaaacgguuaaaauggcaaagugugugcuauggauauuuuaccacaauaaaaaacaaaacaaaacaaacaaacaaacaaucaaacaaaaccucaagccauuucuuuccacagcacccuccccagggauccucagagauggcacccugcauccuugcuuaaggccugggcuccucccugccguacagaugugggaauagaggacaaagggggcuuccuggccaaggaugguggaaggugaggacagagccacaggcccugccuacuaguuguggccucccucggagugcagcggcaugaucacggcucacugcagccuccaccucccauggcucaagugauccucccacuucagccucccgacuagcugggacuacaggcugacgccaccaugcccagcuaaguuuguacauuuuuuguagagacaaggucucuguuuguugccacagggaacaccucuucccaccacagggaggcccuuccuccacgagaagcagggcggggaagcugcccagcaagccaucugaccaccagucaccaauguaggcagaaaucacugugugcucagggguuuagguggaaaggaccguugugcucgggaguuugccgacgucuggaauccuugggguuuuacucaagggcaaggugugugagaauuugcagcaaagccgucaagaaacacaaagugcagcgucucaauaucaagcacgcccaacuuccagggaagacuuccgcaaaaucaagggcgcuguuguccuaguccuagggucaacacauguucucauuuucaaaacuuuccuggucacugggacccaaggccugggagcagcauuuaaccugcggugccacuaaaugagagccggccuugagugagugugccuuuaacccgggcugcccugggcuacugccauaucaccugaccuugcagcuucaggcugcacuccgcuucccuuuguggggcuggcaggggcacucugcucucagccuucuagcucugagaggagaaaaccagaaguggccccuuccugugccucuguguguuccuuugcaagccguugugugccuuuucugcaggcgcuuauggagagugagguguguuuguaccaucuccccgucagauuaggaauccucaaggucagagacaaguucccuccucccuccggauccccuccucauccgcagguggcugcagucacuggggugcuggaugaguccagugaccauacauccugcccuacauccugccuggacagccugggaaguguuuugaugacugaucaacccagagagcacgaggggagagcaagaggaggagaaaggaugcugcugcuccugacugaacgugauugaggugccccaggaaacuaccuugcuaugcaaaguaugguccccaaccugcggcauuggaaccuucauuuuaacaagauccccagauccugaagcacugccuuagaguauaacccagggccuccagggaccuacucuuccaggacaagcaaugauaaugacaaugauuauuuauugagcaccuacuuugugccaggcaugacacuaggccucuuauaaacauuaucuuauuuuaugcuuuggcaaccuagcgaggcaggcguuauuaccugcuuuucagaaacaaagagagcaggucagagagguuaacuaccuugaccaauucuaugcagcaaauuauagcugagcuggagcuugaaccuggaggucugacuccaaagccaugucucugacaacuguaguauaugugaugcaaucuuucacauuaggccaacaaggacagccacuugccaacucgcuauggggcccagagauuuaaaggcaaaugcaauccccagggagaugucuagaggcugccccauugccuagugcuggccuggggugugggcaccuauguguugggguuaggucaacccuguggcagaggccucaauauuucuucaaaacacgucccugaagaugaaggugcaugccucaguccccagggagcaugaagauccaggcaagagggacauguaaguuggauugcgagcaggccuggaagcucuagcacuggccuugucugggcccuggagugaggguaguggggagaagagugggguggggggcccacguggguccuuuguauauuauuuaacuuucaaauuugcaauuuggggcaucaucuccugccagccucaggaggcggcacucuccugccagcuccaccucuggguucacucccacccccaacccucggccagcacucacaggcugcucgcaccacagagcccacucucugcaugcccacugucagcccaggacuuccugccuuguucucugggucuguagcuggcugccuugcuccccacccaaaugugagugacuugagggcacauaucccacuuugugcuuuauacagacccaccauccugccuccuaccccaggagguacccccaaaauggugaagccagaagugccuucagggacgcuucuacagucacauggagaguaaucugcaaauuccccacagccaggggacaccugccacgugcagugagaggaacacaaaccagcagcgggggggcacaggcaggaugugucggcccaccccucagcggucacccaucgcuuccucggaacucccagcugcucagggcugaggcgggcgaggcucagaaguguggaagggcccuccccagcuggugacugcauguggcaggcauccauacccggaacgcccagccagggagucgggccagcccaucccuccugcucacagagucacagagugggagcagacucgggggucgaagcugggcagcgcucgcucgcacuuccuucugcaaacuugaccaggucccacggccucuucagcccauggcuccuuucucugauccccaagccaaagccagcaaaugagaauaauccaguagagacagcuggguuuugggaucaggguaggggcucagagccaggggucugggauucuggucagucaguuuuucuucaucagaaucaaucucagaacaagagggaggccuaaggcaugccugcugcuggccaggggugauggggaccacugcccacagaaagccuucuaacaagggcuggauccaaacaaucaaggaacaaggaugccuaaagcauuaguuucucaucuagccagagaaauauuaaaugugcaacucacauaauuuuacaaacaagaaccaccaacauaaaauaaguggaauauugaaaauauucaacagguagaacaagucaaagaacaugcuuugcuuccuauucaggccaggaagggagagaaagagaagaaauggaaggugaggagggauggggagauggcaaagugggggcagaggggaaaaagagagacaaaaggauuggggagaaaaaacagagagagaaaagcauaaaggaagaaaggaugaggcacaaagaaaagaggagggagagcagguggauuuuggggaaugcuggacaauuggucaggcuuggucugcagaggcucagaaauccuuaccuggacaugagccuuuguuuauaauucuucacuguucuaacccugaaaaguaccucuguucuaauccuuaaucuuucccccuucaggucaagaaugccuuugagaaucuggcaguaguucugaacccuguccuagaaaaauacacuuauuuacauacaauuuugcaugcaacuucaggggcucaaggacucuauguuaaaaauacuuauucuagaagcuccacucugauugggagacccauaauggccaaagcaaaaacaccucaauugccagaugaaacuaaaaugagggugggauguguuguauucaagucuucacauugagcuuuaaucauaccauuggcuucagugacagaauuuagggccuaagcaccuucuccugguuacuaccccaacagucauauuggaagcaaggcugguuacuccaagggguccauuguguacauggaugguuauuucgcaguaaggggccugucaaagacagguaacaaugugugagucaaauuaacccuuuacagaucaauaggauuaguaaaucccauauacguaguaguuuccaaaucugaauguacauaagaauuuccaguaugcuuaccuaaaauguagauuacuaguccaaaauuugagaguauggaucagacuguuuuucuaaugaguuucuagauaauuccgauacaggaaaucuccaaaccaaacgcugagacacacuguucucagagaacauugcaagccugagaggcugagcuucuggucccacaggucagcugauuaucuacuccuugcagugcgauucuuguacacuaggggguaggacugagcacauauacaagggcaccgcaagacgagguuuggacuacugcaucaaaaaggcuaccuuuacaggggaaaauagaaugagcaaugcagaacaugaaagguagagugccaggagaaaccuuccaagggccucgaagacaguaguucccagagcugacuuaaaaaucaugauaaaaaacuaccuggagcacuucuuacaauccagauucccgggccucaggcuauuaggaaacgcgcucacacacacacaccaaguuuccucagggauucugauacacacgcaaguaucacaacuuguuuguuuauggcacuucaagcccaaggguauuuugaucacuauaccagaccauuaucauaaagacgcuucgaaaaacuaaagugcccuuauaauucuaaagcaaaaaacagugaacauuaccaggguuuucuucuucuuuucucuuccucuuccucccccucuuucuuuuucauugaggaggcuaauuggagaaggugggccacgcuggaaugcccugaauggguuccagauggugaagucauuggccucuuggcccaacuguuccucccuuuucccuggagugcuguacaaauauuaucauuuucuggcugugcagugacauaaaaaugguugagaggcucuaggucagguguaaaagaaacucauggaaagggaagaacagcucgguccaaaagaaauuguggagauacuuuccgauucucugcaagguggagaaucccaaaucagaugccaagcucagcguggauugguuugggcucaucauguuguccaguccccacuggcuuuggcaucugaucugggauugugagggggugcgguaggucucaagagaaaugcugaaggggcagcccugcuuccggcugcuuagcagagugguggcgacagggaaacccaggcacagauugcagauccuccgcccagggaggaugaccacgauaacaagacugucuuacguuuauuuagaaucuuccuuugccaaggcaaucguauuuauaguaguugcucauuuugaguauaacuuuuuaaaaacauuuugauuuucugaaauuuggaugucuuacaagcaacaugaggacuuaauguaaggcuuuuuuccaccugaaaauuuggugugaauuaaaauugauggugacuuggaauugaggaaauacguuuuauuacaucauuuaaucucuaaauaaucugugaggcagauauuauuauucucuauuuucuagaggaggaaacugacgcuuaggugauuuccccaaggucaaggauugagaaaguggcagagccaggacuaaaauccagguuccaguauuucuucccugauaaugucugagcagauuuguucauacacuaggaauuugggauugcagaguaauugcuccagaacugcuccaaaaacuggcugccacccacaguuacuggggcagagaaagcaagaagugacuuuccuuuugcuucaaguagaaauuugagggaaaagaaauagaaauguauauagguuuguaugguggcuguuuguuugcuuuaggccauaacagaagucccuugauuacuucaggagcuucagaauguaccaugcucauuccucauaccacgaucaccucugguacgugugaguuuaaaauggugcucauucggucauuacagauuuacuguuugaauuuguuauuuuauuuacuuuagaaugcuuuucauuuuuagcaaucaggauucuagagugucauaucuuuaaaagucuagcauuuuuauuucugccaguucaagaggaugcaggaagaaguuuaacagaagaaaccgucuucaaaauaauaaaaccccaaaauuauucucuacaauauccaguaagugcugauuuucuagaaaacaguuggcagggggagagagagaaggaaccaccccuccccccaaacucaaagaaaaaauaacuacuuuggacauauuauuucuaauccuuuaaaaaacacucuuccaggaggguauuucuuuccauuagacagauggacaaacucaaaggguuucggugacuugcccacagccacacggcuaacaagaagcauguguucugauagcauuaaucagaaaagcauauauugcugacauggauucccuguuucaugagggcagggaccaucgcuauccuauucuccgcuguaucccaaagccuaccuccuggcaccccguaggcuuugaugacuaccuauagggugggaggaugggaggaagaaagaaagggaggcggaacaggugugugugcagccaggcgcuccguccacccugccacuccucuucuuuggagacagugcucugacaaucuguuccaucaacuccauucuccugcaacucucaucacacuuucacaagcugcgcagauuacguuuccuaggacuguguccauccaucugccucacuggaugcugauccacucugguguguuucccagucagucacucagcaaagugcaaccgagagccaaccaugugcccgguacuuuccaagaugccaggauaaaacggcaauaauaugggauuccugugcuugagguuuuuacagccugaaaaacaaugaccucugcauuuccuacucagcaccgcgugccaucaacauccaagguauggggauuuucuguagcugccuaucaaacucucucagcuaccaccagugcuucuuucugcuauaucugaugccuuguuuuguuacuuucagaaacaccaaaggauggccgcaauugagggacucuucucaauagcauguucuugugcuucuucauuuaggacacaucucccaugcugggaaguacaagacaaauacgaggaguugggcaagugucgcacuaaguucugccccuggcugggcagcccacugacuucuaagagauaaugaaauuuauguauuuauuuauuuauuuauauauuuuuugagauggagucucacugucucauccaggcuggagugcaguggugugaccuuggcucacugcaaccuccaccucccagguucaagcgauucuccugccucaccaggagaaucuugugaugcuguaagaugauaaaaugccuaugugacgagacaauguggggcggaugacgcaggcaucgugacauagcacuuggcuauuauuggccuugagcucuggacuagcugggguuacaggcgcgugacaccacacccagcuaauuuuuguauuuuuaguagagacaggguuuuaccauguuggccaggcuggucucgaacuccugaccucaggugacccacccaccuuggccucccaaagugcugggacugcaggcaugagucaccaugcccggccagaugaugaauuuuaaaaucaaguuuuauuauggggaaacugaagacccacagauauuggggugcuggccuagggucccacagacagugguagagagaaugcuggcuucaagucucccagugcaaaauacuuuaacuaccguccccuuucacuucacuagucagcagcuucgcaaacugcauuuucaaugccaugcccuacaugggacuuauguguccugcuuguuuucuaauucagucagugaagagcaggcggccccagcagcuggaaacaaugugagcuugaugguuaaggacauggacccugaggucagaagccagggcucaaauucuggcuccauugcuuaccagcuggauaacugcugggcaaucuaaccucucugaacaucaguuaucucaucuuuaucauggggacaauaacacacagggacuccauagauaggauauagugagauguauaaugcuuaguauagcaccuggcacaaacagaaugcucaauaaacauuagcuauuacaguauccccccucccuuauccauuagggguacaucccaugacccccaggggaugccugaaaccaaggauaguaccuaacccuauauacaccacguuuuuuccuauauaugcauaccuaugguaaaguuuaauuuauaaauuaggcacaagaagauaucaaccacaauaauuaauaauaaaauagaacaacucuaacaauauacuauaauaaaaguuaugugaacgucucucucucaaaauagcuuaccaugcuguaugcacccuucuucuugugaugauguaagaugauaaaacgccuacgugacgagaagugaggcggaugaugcaggcaucgugacauagcacuuggcuauuauuggccucgagcucaagcccucugcuacuugacaguugaccugauaaccaagccagguacuaagugacugauggcaggcgguguguacgguguggccacacuggacaaagcaggguucaugucccgggugagacggugcaagauuucaucaugcuacucagaauggcgggcaauuuaaaacguaugaacuguuuguuucugguauuuuccauuuaguauuuucggacugugguugacuacgggaaauggaaaccauggaaagugaaaccguggguggcgggguggaagcuacuguguuacuucccuugcucaccgcaccaccuucaaaucuuaaauucaagaaauguacagcaaugugaauugacccaggacuuuuuucucaucuuaauaaauuauuccaccuuacuuucuucucugcuuacaagcagaaauauacucaguguuucaaaaaguauuaauuucggcgaggcuguuugguaaagaaugucugauaaggacacugugagauucugaugcaggaauugauguagacaucugacauaauuuucugauggcuuauuagaaauaaguuugagccgggcgcgguggcucacgccuguaaucccagcacuuuggaaggcugaggcggguggaucacaaggucaggagaucgagaccauccuggcuaacacggugaaacccugucucuacuaaaaauacaaaaaaguagcuguagucccagcuacucgggaggcugagacaggaggauggcaugaaccugggaggcggagcuugcagugagccaagaucacgccacugcacuccagccugggugacacagcgagacucugucucaaaaaaaaaaaaaaaaaaagaaggaaguuugaaaggacuaagagcaggguaacaguugaugaaccacuuuucuuaaucauuauugcuuacucuugccaaaaaaaaaaaaaaaacccaacuucguaacuccaauuauuuuuaauuuuucagaaaaguggcacauauucucagagaagcaagggaaauuucccuucacaucccuagaccguaugcucagggugaaagagacuauuguuugggucacagacuugugagccagacgugauuuucacaugcaaaugguggccacauacagagauaauccaggccccgggccaggcagagaccccagccggcugccucaucaugcucucacggggcauguggcugagcuguagugcugugaugagggagugugccauccaaugggagaggccauguguggaaaaggacuaaaaauacaaagcacgcuagaaaccgugcaaaugaauuuaguucagagugagaaggcauuucgucacugaaucauggauggggcuggccaagguucaccagaggaagugaaguguuugaguucaugugccagacauggugccggcugcuucgucuccaguaucucagggccaggccaucagugugugugaucaugcaugggucuaugugugcacccacucauguagccaguggcgcgagaaaaguaaauacuuauggcaggaucuuggacccuuuuaaauguuuucaucauuguuuuggauuauaaacuaacgagacaaaaaaucaaucaaaguucucauugguuaaaauaauuuuguuuguguuuaacaaguauguggauguucccgauggcggugguggaccaaagaugggaugagaggugggaugagaagggcgggaauggaaacaauuaagaggcauguacaaacaaaucaagaaaaugagaucacgaaacugucucccaaacugcaucuggucuucaucucuaccccaccucgacugcaucaguccaggcugugucuucucuagacuggacaauugcaaccacguuugaagggccccagccucagucccuccccauuugugccuacccuaacuccaggcagggcuccaaagagcaaaucugauucaaccccuucccugcuucaaagaaaagccuauugaccuuuugcucagcuuuuaugauuuccguaucuuuaaaacgcauguugaauuuuaaacuuauuucugguuauuuuguuuguuuguuugcuugcuuuucuaacuagagagacuaagaaaauucucaagauaugucaucaagccucuguuuauaguacauuccaucugggacuucugaauguugcuacauuaguuuuaacuucaaaaauauuauauacuaugugagcucaauuaugcuuuaaaacgaaaaaggaugaaaaaaaggcuauaaggaaauagcuuuuagauauauuuuuaaauuaaauauguauaguucuuaauaaaaauaaguuaaaauuauaauuuaguagguacuaucuacucacauauaugaauacaaauaugcaaggcaagaauacuggaaggaaauacacuaauuauaaauacagaugcuccuugacuuucaguggggccauguuccgauaaaccugucauaagugaaaaauaacggcugugaucugaacagagacaagcuacuguucugcuuuucaccaagaccugugauacaagccaauccuggaagcccuagaagcugaaaguucccugagcuucccucugccuccucgcuuugaagcaccaucaccucagggaacugggaagaacucucucuugaaccugaaaaggcucuguacccuucuggcccucuguccccaaacccugucccagcacacucagcuccagcacaccuaccuuccugcacuuucugaacucuuccaugcgcgcugagucuucacauaugcuguuccuguuccuugggaucaccauccccaguuuacuaccaggugaacacuugugugaccucugggguacacucgcaucacccucuccuugaagacaucucagaaaccccaaggucaagguucuuccacucuccuccaccugcaacuugcauauuuuccuuuaaaauacugacccaggaaauggugauuguuugguuaggggagagccugugccuuauucuuguguguauccucaauuucuagcuuugguucugcacauagugggacucaggaaaaguuuuucagugaacugauuagaguggaggagagagggagaucuagguggggaggagacaaagaaauacagagaugaagaggcacaugagccaaggaaggauggcggaaaugaaggaaucagggaccgaauguuagcaagacacaacuugacaacucacuguggaaaaucuuuucaggaauaaauacauuuucuuguuucaaucuaagguuucauuucuaaguaggccauuucucugcuuauauuuguuccuaguaagccccaaugucaaauuagcuuuuccuuuuuuuuuuucuuuuuugagacagagucucgcucugucacccaggcugcagugcaguggcgcgaucuuggcucauuacagcuccugccucccagguucaagcaauucuccugccucagccucccgaguagcuggaauuacaggcaugugccaccacgcccagcuaauuuuuguauuuuuaguagagacgggguuucaccauguugcccaggauggucuccaacuccugaccucaagugaucugcccaccucggccucccaaagugcugggauuauaggugugagccacagugccugggcccccagugggcuuuucuaauuauaaguguauccaacuauuauaagauccucuuuagacaacuuaagcuuuuucuuuagauauuguucccacauauuucaagcaugaaaucacuauuuucccuggagugauaccuaaaaacuugcuucucugcuguuugcaaauccucaaaagucagggaggaaggcucuuacagucacuuuggaagggugucaccaugcaaauucacaguuucugacugcugugauuaaguaucagcccauaagguaacaccuacugaagauaacaaguagucucaaauauuuaugaugacacuaagucagaaaucauauugcagcaacccaccaagagaaaauaccuucuucauaucucuuccaugauaccaucccaaauggcuucaaaaagacucagaaaucuguuuacaaagcacuauucagauuuccacaaauggucccuagaaucagggguagaauucacagugaucacaguccugaaucuaggacuguaaaguuugccagagcaagacagacaaugaucucucacaaagagauauacgaauacaccuuucuaaaugaaaaaugauacuuuuuggagaggaaauaauaaaauucucuaauuaaaaauuuuuuaaguaugguuaguuugucauugaaaaauauuaauaccagacuuaucaguuaagauggcagacugaauacauguaccuaauuucguucccuccccacauccugcuaauauauaucaaagaacuuuuuuuuuuagagguggggucucacuauguugcccaggcuagucucaaaccccuggacucaagcaauccuccccccuuggucucccaaagugcugggauuagaggcaagagccaccgcacccauuaaagagauuuuuaaaaggauauaaauccauaagaauggggaaaacaguagaacacagcaacaaaauuucagaaguuaaaaaguagauaguccagugguacagauaucagucccaagaaaauggaaugucaagucagcagagagaaaaucugagaaccaaucugauuuagcccuccaaaugcucagaggucucaggagcuggcagcaccagguauuucuggacaugggugugagagauggaggccuuggccucccaaagugcugggauuacaggcgugagccaccagcccccaggcaguguucugguuugacccacuccugagaccuagagguaggcaaugaggagcuuagaggaaaaauacagagcagcucgcucucccaagcacucccucuggucaucuagaaccccaggccuaugacggccccuccagcugcccagacacaugcccuuuucugggacucagauuugacucuaugaacagaaaguagguacauaaauaaccaaaagucuaagagugacugcuguggagaugcaacuggaaagaagcaaugguacugguaauauucuuucuuucuuuuuuagggucaggguucucgcucugucgcccaggcuggagugcucacugugaccucgaacucuugggcucaagugauuccuccugccucagccuucugaguaccugagacaacaggugugcaccaccauguccagcuaauuuuuaaaauguuuucuagagaugaagucucacuguauugccuaggcuggucucgaacuccugggcucaagugauccuccuaccucagccucccaaagugcugggauuacaggggugagccaccgcacccagugcgacuugguucucaaaucuaccuaugguaggugagguacucaccucucaccaccucuguuuccccacuguaaaaugggaauaauaguaucuacuucuuuuguaagaguuaaaugaauuaauacauauaaaguacaaaaaaucagugcccggcauauaguaaugcucaauaaagguuagcuaccacuguccucacuauuacagauaagcagcaucugacuacacaugauaacuaucugcaagugaaguucuuuccauccaaagguccacaaguccugacccuugcugaggggguccuucuccucauggcuuccugguguccacagccuuugccaucucucaaucagccacugguugcaaaugcgaguuuagaugaagcgggugacgcuuauaacaccuuaagucuuuucacacucaggauuaagacauggaucccuaaaaguggcaaacuuagccugcuggugggcugucaaacagcauagcugccuccuccaccagccagugccauaaggggccucuuugcaagagaaucgauacacagaugugagugaggacucaucauaaacacagguggucacaugggacucggagggagcugcacgggggcacagggcacagccagagcacuggcuggggagcugggagaacuggguuccaacaguggcuaugugugacccagcgaaggucacucauccagauuccacaugcccggguuccgggacucuuaagugguuuguugguuugccuuuaaauaccauguaauuaaugcagggagagagggaggucagucacagggcagugagucuacugaaaaacacagucuaucaucccaaacugacuucagagccagugcugaccugcuugggcuucccauccucuugucucggcagggcucauaacaauguuaucauuuuuuaaaacauaugccuaagcuaguuccuauucuagacaauuggcaggugcccaguuaauagauuauuccaccagacaguugaaugcauuggccauugaucaaaaaugaggucacugcaauccuaugugcuagaacuggaaaagccugaugagaaacaacuguaucuuucuuaacaaauagaaauccauauuccuauuucccuaaauuugucuugccuggcguguagcucagaagcaaaggaggauuuuguuuaaggucaagucggucuugcuuucuggccccauauguuugguuuugugacuguucaugaguguuucacaucagcaaauccccaacuggauuccaacugaccugcaggaauaucuggccaacacugccagaucccuggucuuucucucaaaccugcacagucggaaagaacaggucaagagacucuucgucccagcuaucuggauccuuguuuaaauuuuacucacuuacaucugugcuguggacacagguaauaugaagcacauguacuuuucucaaaaaaaaaaaaaaaaaucuaaggaacacagagcuguuguaucagaggcugcaacgucuucccagcacgugggcauucgcagacaaagcuaucccugcugaccugcugugggaaagacaugcacucugauuucaccacugacccggccgcacucuuuuguccaguauauaacgccucccuaagcaucuccuuuccuugcaaacaaaaaaacccuggaggaaaacuuucaaagccacaguuucuucucaguugcaacccuuccuuccuuccuucuucccaagaaggucugacugggcuugcaagcuggccccacccugggcugggccuccacacaggcauugugcgauccucugccauucuguguagacggaauaccugcgaacugcugccaacacaggaagguuggcgccucucuggagggaggccuggggaguauccaucgcccaggcgacugcagauaagcagcuaaggggcuaggguucuccacaccuccauguggguuccagagccuuucucuuguacuucuuuuacuguuuuugauucauccuuaauucauucacuuagcaaaccuauugagccccugcccacagcaagccccgugcugguguuggaggacacagaguugacugagauagauuccaguccucaaggcucucauguugcugagacaggccacucauggagcaacccuggcaccugggacuccuggagcccccagugaaaccaccuuucugcgaucccaguaucaaucccaucagcagggucccuuagaucacgucaccagagacaaagccaacggaggguggaagcaacaggagcguggugcagauccaccagccccaacuccaccuccuggguuucaucccucccuuagcaccagcgaggacuuccagauucagauuguuuuuggucuuaagaacuuucuugucacagccaaguggcaggcgggacaugguaauuggccuauguugcgcuuggaccuagcaaaugaguaaacuuuucaagacuaaaucaucaaugcuacccacucuggauccuccaaacaccugcucauuaucagcaucugcaauacaacaaguaccuaccuagguaguaacuaacauacauaauggugauucacaaagaggaaugagggcaguaagaggaaggaucccaggccuggccagaaaccccuauccaguagcucauaccaaggguccagcuagggauacaggcagagggaaagagaucagaaccagaaaaagaggaagaggaaaaagagucagagucagaaagggaugggaagaaagaaaaagaaaaaaagacaggagaaaccuaauaaagguuugaaaugguccuuggggccaggugcgguggcucaugccuauaaucccagcccuuugggaggccaagacagguggacuauuugagcccaggaguucgagacuagucugggcaacaugaugaaacccugucucuacaaaagauacaaaaagauacaggugguacacaccuguagucccagcuacucaggaggcugacaagugggagaaucgcuuaagccugggaaguugaggcugcaguaggucaauaucacaccacugcacucuaaccugggugagagagcaagacccugucucaaaaacaaaaauaauaaaaaaaagaaagccgggugcggugguucacgccuguaaucccagcacuuugggaggccgagguggacggaucacgaggucgggagaucgagaccauccugacuaacacggugaaaccccgucucuacuaaaaaaaaauagaaaaaauuagccaggcgccuguagucccagcuacuugggaggcugaggcaggagaauggugugaaccugggaggcagagcuuggagugagcugagauugcgccacugcacuccagccugggcaacagagcgagacucugucucaaaaaaaaaaaaaauuaaaaaaaaagaaaaagaaaugcuacuuggugcuucccaugucuuucauuguggccacaaauuccagcaggucugcugccucuuuaggggcccugugaucccuucauacugcugauuaacacaaccuuccaaggaaucauccaagaaaggggcagaaauucucccugaugcuggggucagacugcccaaggccaaggaugcagagggcuggggccgagcagcugggcucccaagcuggccucacccugugugcuccaggaggugcugcugaggcccugugggcugagcugggagcgccccugccuggccggacaccauucccugccugacgugggacuugaguuugguccugagcugagcgugucuauggccucuguuccugguggcacuggggagguauguuuuagccgccucagcuccugguccucacaguccacaucucauuuccugcuuccccuuaaagaggcucaccucuaacaguuuuaaccaggcaugaacgggcccagcggagacuggcagguucucagacccccuugauccgaaaggagaaaggaagcaguaaggaguucaccaacuuccuccaagggcaccccagagccagcgggugccagggggcaccagggaaucacgcuuuggagucaggugccucuggguuucaauccuggcugagccacggacuaugcaaacucaagaaaguugcauaaccucucuguggcuuugacuuccuugucuguaaaacuggaauaaccaucucacccaucucacucaguuguuucaaagauaaauagaauaaucuaugcaaagugccugacacagaguuggugcuccuucccaguucgucacacacauccacacccacaacuaagcagguguuugcuguacuuguggcccucagcugagugcaggucgagugggaaaugcaggaggaaaaggagccaguccuuacgucaggggcuaacugaagaagaguuccaguccuggcccugagccugugcccaguguaaaggggaugacagucuugucuccagggucuugccggccugagcgcugagguacuuggccuggauugccuugguuuccuccacugagccugggcgcccaucucugcagauaacagagcagagccugcaugaguagaggcugaaaggcaaagguucucaacccuggcugcacaguagcaccaggagcacuugaaaauacagaccaaugggcccaccccagagugcugauuuacucggucugggguggagcuugggauucuucuuuccacaccugaggcuccccuggugcuucugaugugcagacaggguuaagaaccccagggauggaggccaggcugugaggcuggggcccccacuuaaaccgcucaucagcuauucugagacuuucuuccucucugcugggccaggaagguggcuggagacugaggccugggcuuugaaguuacuucaccucucuaggucacuguuccugcaucuuugaggaggggaaagcaacccagcccaccucccucccaccaucaucaugagggucacaugagagagugcggaaggccaugcuguguagcaucacccaccccaccagcccagaaggagaacgugaaugccaggaucccacagccauuucacgcaaaagaguguuuccucuuaguaccucugugggcagugaggaaggguugagcccgcuguccugggacgagccuuuccagccaugagaggccagaaaacaaacagucagaaucacaacuccacacagaggccaucccgggcacugcagggcccuuccaggcugcccuagcucacuggagcccagaagacccuuccuggcaaagacauguagaugcccuuccaccacauggcgaagggagccacaaaggagacucggggacacgcccugcugggaggacgauucuacagaauuuuggugguagcuaacugcuggcucuucaucucaggaggauaacagagccccauccaagggggacccaggcagauguuccccaugggggcauggagggcucccuccaggcacccauggaugagccauccucacccguccgggcagaaaaggccacugagucaggcaucacaaccuuccacgcaguguguucguucuuugcacaaguauuuccugaauaccuauaauaggccagcaccgugcauccuaggaagaccccaggccuggcccuccgcagacacagugccaggccagcugcgaggcccagagagcagccagaacauccauguguucccugcaucccgaguggaacagccaccuggggagauucuggguguguuucuggguaaagaauauugauuuuuagcuuacccacuuuguauguuuggaauuuugucagaaagguuuuuuuaaaaauauauagaacagugaaaaugccucuucugguaaauuaaauucacucaacaaauauggcucuuuccgcuuccaaaccagcacaggcugcccaagcguuucgcccagcccaccgcuucuccugcucccaugcugcggggcgcuuuaccccagcccugaccacaccuccgagaucugggccacugucuucggcugaccucucacacuagccucgccauuucccccacaccuguuccagcugccauguuccucccgagucccagaacgugaagccaccagccagccagucaggugucagccuuaucccuuuucuuggccucaccccauaccccacccccaucucgucucuuuuccacccuagaggcccugccuggcucucuugaguugccguagcagccucucaagugaguccugccuccuuucuucaucccuauccugggccaguuuccguauugggacaagagcaaucuuucuaaaauaugaacuugagucagguuucccgcugcccccaaaauaaagcccaagccccgcuggguggcagacaaggccucugcguccgucucccuuaacacucagcucccagacaaucuccucuaaaaagucuuuccugacucuccgacuguacggggagcgccaggagacccgggugcccugugcaaaccccucucacaccacuuucaccacucaguaacucuucugugucucccuugcacgaagaacaguuaaaaugaaugaaaugccaugacaugcauuaacauggauaaauugcgaaaauauguuggcugaaagaaagcaaauugcacaaucauucacucaccauucaaauuauuuaucaagugaaaggauccaugcgguaugauacaauguauauaaaauuuucaaacgcugaacaauagccgacaucacuuagggccagcuacauaugguagaaaaauaaaaacacauggggaggaugagccuccggacaguggucccuuggggaacaggacggggucggugaagguacagcuuaaacugcaucuguaaugcuuuauuuauuuuuauguuaaauagagcucugaagcaaaacuggcaaaauaauauccauuaaauucgggugguggauaaaugaauaucuguuauacucuuuccuguauacuugaaagcauucaucaguacauuuuuaaaacuuuuuuuuuuuuuuggagacagagucucccucugucacccaggcugcagugcaauggcacaaucuuggcucacugcaaccucugccucccggguucaagagauucuccugccucagccuccccaguagcugggacuacaggcaugcaccgcaccuggcuaauuuuguauuuuucguagagaugggguuucaccauguuggccaggcuggucucaaacuccugaccucaggucauccacccauuucagccucccaaagugcugggauuauagacauuagacacagcacccagccuuaaaaauuuuaacaaggaaccagagucccaaaugcccucauuaaagucccugggguccugagcagacuguuauagccccucacccaaaggaucuccacgggccuugggccuggcagccaugcuaagacaggcaggaaggcagccuggagauguaaauaugauuuucauccuuguuuuuaaccaaugagaaaaccaaagcugagaacaucuaacauggcucaagaccacacaggggauccuggauuucagaccaugccuucuucauguacaauuuccugaacuacuucauccaagagcaagaacuuaggucuaauacggcauggugaagagaauuccagaauuagaaggagagcuguauucauaugcuucauaaaucagugaauaaacacguuuugcggagaauuguucagaaaggggcagaauuggagauacaaccaaaugggaaauuuagggauagcccauguggcucuuugaaugcaaacagaauggguuuggguuuuguccaauagcaauagaaagcaacugaugcugcuuaagcuggagagugaccgaggcaaagcacuguuuuacgaaaagugaucuggcuucagugcauaggaggugucagucgcccuuaggaaauggcuggggacaaccaaagggaagauccucaagggauaaauucugauuuggacauuaucuaaauggcccacagaggaaaugacaugugcuaaucuaaggugagaacugugggguuguaaaggauaaaagagcuuaagcuagacagagaaauaaaaguucuuuuccaaguuuuccaggcuuggggaaauggugauaggcauucagaugauaagcugauuauuggcuuguugauuaauugguggaaagggcagugggggaagaaaaggcuaacuaaagagaggagugagaaauugagggcuuucgcuuugucugccuuuaauucaagauggugcccagacagccagguagagauccgacaggagcuggcgauaugagagcuauauugaagaaagcuggagaagcaggggagagccacuggugcagcgaugguggaaguuuauuucugaggaaaaaggcacaaaaacagugacgugauagcagaggacugagccccguggccucccugcccacaucagggaacaggaaaaccaagaagagagcuaagccaguguuguauuguggaagaaguaggaagagaccauuucaaauuagcauagguggucaacagugcaaaaaguuucaagaauaagaaaugagucaagguccugggguugaagaucaggagauuaugggagccugagauaaaggaaucucagcagacagcagaggcaggcaugcuugccccaucccuucuacagcuccaaaggagugaccuuguccucacagccaagcacaagcccccucccucacccagcagaagcagcucccgucugcuacauucagcgugagauggaccugugccuggccuggcccaacugauccaccucccacagauggcagagggccauggcaggacagagagugugcagugcaggcucuggaguggaacccuguagagaccaggcuaccgucuuccuagauaaccaaaaagcuucagcuuggagaggcaugaguucauuucuaaaugcagaacauaggauucaaaugugccacaugucacuuuauuuucuaaaauguauuuucucuauauuugccugacuucuauggcaauaaaaucauuuuggcaugacacucaucuuacauaaaugaaaauaugagccaacagaauggcauuuuaguagcuuuaagccaaacaaauuccugagagggucuuguuuaaauuaaguuaucgugcuauuuagcuuuuuacagugaagaagcucugugucuucagagagccuugugcagugaugcuuguuuuuggaaggaugggacaggaggugaagaaaggaagaggggcccaggcugccaggcugcagaucaagaagucaggaggugaggaaaugaggacgaugagaaggacccacuguuauuggaaguuuggagaugaaaugagagacaagacauagagugagggugacaggggaagacaacuugagacggaaggacacaguggagggaggggugugccaggggaaagcaucugacgaaugacacucugcaccugaguaugaggcugccagccccuuugcccaccuccacucugcuccccgaacugaugcagccgggcaugucccuggcaggagaugagagaauucuucucuggagaauacgaacuauaccagagaaagaccugcagaaacgaacauuugggggacuuccaaugaaacaacgcaguuugccaccaaucacccuacugugaugcccaccugucacaacugccacccacuuggguuguggauggaacucccgaucagcucuguggugccucauuaccaacaauggauggacagcgacuaccagacauuuggagaaagcuggcagcaucugacagggagagcagaacaagauuguagaaaaagaaaucuggaaaagaaaauagggaaaauagaaagcaaaaacagggaaagauuauagacaauucaaagaaaaaaauacaagugggaauaaaauacaaaaaaaaauccucauuaaugauucaagaaaagcaaauuaaaagaaaaagauuacauuuuuuugcccaucacaugacagaaacuugaaaaauugagccucuucaauauuuuccaagguauggggaaucaguaacucuuagcuacuguuagugaucguucagaaugcaacaacuuuauuggaaggcaaucugguagaaccuaacaaaauuuuuaaaguguuugaccuuuguccugugaauucuauuuauaagcaaugauccugcagaaauuagcucaaacuuuugugcaggauguacacaucagcaauauuuaugauagcaacaaacuggaaaaaucuaaauacucaucaguaagcuaaucuuuaaauauaaaguauuuuaaaucucuaauauggaaugcuauguggguguuuuaaaagaaugaggacauccuaaauguacugacauugaaggauauccaugauauguuaaagaguggggaguagcaaaacaauguggaauuuaauuacacuuuuacaaagagcugugcuguguguguuuauguacaugcacaugugcaugugagcuugugcauguauacaaaauagacugggggccgggcgugguggcucacgccuguaaucccagcacuuugggaggcugaggcgggcagaucacgaggucaggagauggagaccauccuggcuaacacggugaaaucccgucucuacuaaaaauacaaaaaaauuagccgagcaugguggcgggcgccuguagucccagcuacucaggaggcugaggcaggagaauggcgugaaccugggaggcagagcuugcagugagccgagaucacgccacugcacuccagccugggugacagagcgagacuccgucucaaacaaaaaaagaaagaaagaaagaaaauagacugagaagcuaugugccgaucucccucuggggaguaggagugggaaaauggagugaagggaagaaacuuucacuugucacuugauaaauuucaggauauuuuauauuuuuaugaaacaaagacauugauuuugucuuuaaaauaaaaauaaagagaaaaauauaguuugacuuaaguguauuuauaacuguuuucugauuuuaaaauuaacuauugugguuuuuaaaugugacuucaaauucuuugacacuucuccauugaaagauaucaucucacaccaguuagaauggcaaucauuaaaaagucaggcaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauauguuuauugcggcacuauucacaauagcaaagacuuggaaccaacccaaauguccaacaaugauagacuggauuaagaaaauguggcacauauacgccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacguuagugggugcagcgcaccaacauggcacauguauacauauguaacuaaccugcacaaugugcacauguacccuaaaacuuagaguauaauaaaaaaaaaaaaauuaaaaaaaaaaaaagaaaauuaaaaaguaaaaaaaaaaaaaaaaagaaaagaaaaggugaaaauuaggccgggcaugguggcucaagccuguaaucccagcacuuugggagacagaggcaggcggaucaccugaguucaggaguucaaguccagccuggccaacauggugauacccugucucuacuaaaaauauaaaaauuagccagacaugauggcaagugccuguaaucucagcuacucaggaggcugaggcaggagaaucacuugaacccgggagguggcaguugcagugagcugagaucccgccacugcacuccggccugggugacaagcacaaaacuccuucuuaaaaaaaaaaaaaauucaucuucucuguucucucucucucucccucucccucuuucucucucucucccugucugucucucucugauuguuugcucugggagaagucaguuaccccuugucuuaaggauacuaaaacagcucucaggaaagaaccacauggaccacugaggccuccuaacaagaagaaauaccaacuugccagugagauccuccagccccaauuaagccuucagaugaccacagacccugaggacaucugacugaaccucaccagagacucugauccagggccgccagccaagucacacccaaauuacuggcuuacagaaaaggccagagauaacaaauguuuauuguuaucuuaugccacuaaauguugggguaauuuguuugacaauaauagauaacuaauacguggaccaaucucccucuggaaagaaguggagaaacugagugaaggaggagacuuucauucuuuacuuuacuuuuuacauuuuuacauuauacauuucaggauuguuuggaauuguuucguuguuuauauuuaaagaaaugggaagaaauaaaguuaggcuuaaguguacuuuaaaaaaacuuuuuuucugauuuuaagaguaacacuggucaggcgcaguggcucacaccuguaaucacagcacuuugggaggccaaggcagauggaucaccugaagucaggaguucgagaccagccuugccaacauagugaaacacugucucuaccaaaaauacaaaaauuagccaggugugguggugcaugccuguaaucccagcuacucgggaggcugaggcaggagaauugcuugaacccaagagauggagguuguagugagccaagauugcaccacuguacuccagccugggcaacaagggugaaacuccaucucaaaaaaacaaacaaacaaagaaaccacuggugaaaagggacaaaguuggaggauagaugcuaaccaacuuuaagacuuacuauaaagcuguaguaaucaagacgguaugguauuggagacagaauagacaaacagagcaauggaacagaaaagagaacccagaaacacacaaauacagucaacugauauuugacaaaggcacaaaagcaacucaauggagacaggagagucuuuucaacaacuggugcuggaacaacuugauauucaugagccaaaaaaaaaaaaaaaaaaaaaaaccaaaauaaccuggacacucaucuuacacccuucacaaaauauuaacucaaucuggaucauagaccuaaaugucaaacaaaacuucuagaaugagaaaaucuaggaguuuggcaaagagauuuuagguacagcacccaaggacccaaggcaugauccacggaaaaacacugauaagauagacuccauuacaguuuaaaacuucugcucugcaaaagacacuguuaaaagaaugaaagaaccaaccacagacuggggagaaaaaauuugcaaaacacacaucugauaaaggguuugaauccaaaauauacaaagcacucuuaaaacucaacaguggccgggcgcaguggcucacgccuauaaucccagcacuuugggaggcugaggcggguggaucucuugaggccaggaguucaagaacagccuggccaacauggugaaaccccaucucugauaaaaauacaaaaaauuagucgggcgugguggugcaugccuguaaucccagcaacuugggaggcugaggcauaagaauugcuuaaacccgggaggcagagguugcagugagccaagaucgugccacugcacuccagccugggugacagaacaagacccugucucaaaacagaacaaaacaacucaaugauaggaaaacaaacaaacaaacaaaaaaacacaaguuuuuuaaaagggcaaaagaucuugacaaacacuucaccaaaggugauauacagauggcaaauaagcauacaaaaacacguucaauaucauacgucauuagagaaucgcaaauuaaaacaaugaugagauauuacuaugcaucuacuagaauuacuaaaaaacaaaaacaaaaaaacugacaauaccaaaugcugaugaggauguggagcaacaggaacucucauucauuguuggugggaaugcaaaaugguacagccacuuuagaagacaguuuggcaguuucuuacaaacauagucuuaccacaugcuccaacaaugaugcaucuagguauuuauccaaaugaaugaaaaauguauccucacaaaaaccugaacauggauguuuauaucaguuuuauuaauaauugccaaaaacuggaggcaaccaagauguccuucaguaggugaauggacaaacagugcuacauccaguuucuuuuuauucagugauaaaaagaaaugaguuaucaagccagaaaaagacauggaggaaucuuaagugcauauuacuagugaaagaagccaagcugaaaaugcuacauacuguaugguuccaacuauacagcauucuggaaaaggcaaaacuauggaaacaguaaaaagaucagugguugccaggaguuggggagcauuaaaaggcaaagcacagggaauuuuuagggcagugaaacucaucuguaugaugcuguaaugcugcauacguaacauuguacauugucaaaauccauagaauguauaauacugagugaacccuaaacuauuagcaauaacauaucaauauugguucaucacuuccaguaaauguaccacauuaacacaggauauuaauaauaggggaaacuguggugggggagagagaaaagggguaugugggaacuuuuguacuaucugcuuaauuuuccauaaaccuaaaacugcucuaaaagugaauuaauuuuuuuuaaaaaaguaacacuggucauuugaaggaaaaguagaaauaagauaauuuagccacauauaaucucaacagaaagauaguugcuauuaugcauaguuccuuccagucuuuuuuucaaaugucuauguauauguccucauuuuuuaagaguugaaaucacucuguuaaauucauuuugaagguuuauaguuugguuucaguuuggauuuuuaaccacaaagaaaauaucccauaugaaacaucagugauaccaaaaacagauucuugaggagccaguugcuaugggaaugauugaaaauaaauuucaucucacacuacacucuacuaauguauugaccagaaggaaggaaaaauauuuggaguaacuuagaagagcagccaagaacuucuaaucaagaagaaggaaaauacaucaggcuagugugagguuucaaagaagccaguagcacggccuugcaauuucacuaauugagcucuuccagcaaccgugucacuggagggggaaguacaaggaaucagggaccugaguggacucugucuuuccuucacugacaguuugaugagccaaaggccagcaagucucccuccauaugcgggccaucucugcagggugguacauggccaggaaaaaaaaaaaaaaaucacuguuuccuuccuggagaugcgucaaauauuuagcaagcugcaaagccugggcuccaggugaucaguauggacaucacauuggcccugagcauuagagugggcccugggguuaacccuuuaggugccggaucguuggggcaucugaagguuccuggagagggacuaggaugccagaggguaggggauacucagggaguucaggggagugacaguuuuccaacagaagauuuuaacaugcucagaaguaguaaggccagaucaguggaugccaaccgaaugcugaccuucccacaaccaacauuuuucuaaaaggcaggacuguguaggugcacauccgggcuggccuccaaggggaaaagcagaguugcugucacaaaaagacagcauaucaucgugcaaaaacaggccccacuucucaccucaggcaacagcuuuagcaucaaacagaucucgcuaaauaauuuuuuuuguauuuaguagagacaggguuucaccauguuggucaggcuggucucaaacuccugacuucaggugauccaccugucucggccucccaaagggcugggaauacaggcaugagccacugugccuggccugguuuuuuuaauagcaagaaaauaaaaggacacauaggcaugggcaaggacuucaugucuaaaacaccaaaagcaauggcaacaaaagccaaaauugacaaaugggauacaauuaaacuaaaggcuucugcacagcaaaagaaaccaccaucagagugaacaggcaaccuacacaaugggagaaaauuuuugcaaccuacucaucugacaaagggcuaauauccagaaucuacaaugaacucaaacaaauguacaagaaaaaaacaaacaacccuaucaaaaagggggcaaaggauaugaacagacacuucucaaaagaagacauuuaugcagccaaaagacacaugaaaaaaugcucaucaucacuggccaucagagaaaugcaaaucaaaaccacaaugagauaccaucucacaccaguuagaauggcaaucauuaaaaagucaggaaacaacaggugcuagagaggaugugcagaaauaggaacacuuuuacacuguuggugggacuguaaacuaguucaaccauuguggaagucgguguggcgauuccucacggaucuagaacuagaaauaccauuugacccagccaucccauuacuggguauauacccaaaggauuauaaaucaugcugcuauaaagacacaugcacacguauguuuauugcggcacuguucacaauagcaaagacuuggaaccaacccaaauguccaacaaugauagacuggauuaagaaaauguggcacauauacaccaugaaauacuaugcagccauaaaaaaggaugaguucauguccuuuguagggacauggaugaagcuggaaaccaucauucucagcaaacuaucgcaaggacaaaaaaccaaacaccgcauguucucacucauaggugggaauugaacaaugagaacaaauggacacaggaaggggaacaucacacaccagggacuguugugggguggggggaggggggaggauugcauuaggagauauaccuaauguaaaugacgaguuaaugggagcagcacaccaacauggcacauguacacauauguaacaaaccugcauguugugcacauguuauccuaaaacuuaaaguauaauaauaauaaauaaauaaauauacauuaaaaaaagaaaauaaaaggacacauagaaaaugugcuaggcgaugucugugugaagaggagcuucuagccucaugaagcugcuccaagacacaccugcucaccugauccaggaacagcucacaccaauuguagguaaagccuauggggguuagggggagauggggugggcaaacucacaccuacaaacaucucuaaagcagugaagauccauaaggccacauacuggacucugaaaggcuuaccuggguccaggugggugaaagaacccaccacaaaguccaguguggacacggccagcaggaacagcaacagcagcuggaggcggauuauccauuugacaccugcgagguuaaugcccagcaaggccagaagcaccgcaacugaaauuccucgcacagcccagauauucccgaggcccagcaaauccgagauggauucagcaaagccggugauauacauggcaccugcaacacacugacaugcgauuccagguagaagagucagcaggacagaaagccaugggcccaugggcagaaccgcccagcgcugagaacccugcacccccaucggacacacucacuggcaccaaggcacagugccugggaccagugcaggguuaaaccagcccuucccacccgugaaccugccucaggccccauuucuacuugucuacaucucaacuaaagaaugaaggaggaacccaagcugagagcuggcugucagugauaacaaagaugaaaagacuaugggaggaagaagaugggacacugggcuaaagaggccuccggauuucucaguccgaguuauucaagaacuaaauauagaacaagaacacacagggggucccaucuacagagccuuaaaaggacacugcaguaaaccagauuuuucuucauuucucuauaggucaguauuauuuuuaaaauuaucuaaaacuuagcaaaaaaaaaagugaguggcacgucuuuuucaacgucauauguggcaaaggcuacccaaggacuaucuaggugaauguacuucauuuuacucacuauuugcuguugauuaaaugcauuauaugccccagauuuaauaaaguuacauguuaccuuauggauuuuuuuccaguacagaugcaaauaacuucuguccaguggaacauauaacccaaaagauuaggauuuguuguccuguaagacauuaacugauuuucuaucuaacccagcaaucuuauccuaacauuuauuuauucaacugccuaguuaugaauuuacuaaucugaccucuguccacccagcauccuuugcagaugcucuuuaacaucuuacuggcuccuccauuaauucauaaauuaaauaaaaucccugcuccagguuaggcuuccuaugaguauuuguuauauaaucuuuuuuuaaaaaaaugaaaugaaauccuuggcacauguuuuucuuauauuugccugagaaucaugauuuuaucuuuugggaaauauuugaaagaucauuucaaauuaaauuguugaaaauaacaucagucucacuuuuccuaauuccucagccucagccuucuucucuccucagguuuguccuucacugcccccagggccagcuggucacucuaaucacuguagcccugcccuugccauucucugggaacaaauucuauuagggccucauucguucaagucccuccuuuuccaugaggccucuccucaaccucuuuuucugaauaaauaguaagcuaacugcuaaggccauacaauuaauuaucugguuccauauucuauuaucaugucaugaacguaaguuugucuccccaccccaccaccaagaaugcaaauaucuuaaaaaauuguuuaugcugauuguaccucuucaaauacuugcauuugcuaaguauguugcaagcauucaauaaauacuuugugauaugcugaucauauaaaaggugcucugggaagcaggcuccaugaguuccagccauuuuguguaaaggcaaaaggguaauacaacuucuggauuugaaaggagcuugugaacaaggccccauucuucaaugagaucagcucacuuugcaacuaggcacauaucauguuugucagcaucccccaaauuuacacuuagcuuaacaguuauuccagcaucccauagugguaaacauuucuguccauauuaggaugagguggaaagcccaagaaaugugagggaaauacaaucauuucugagagagagagagagagagagagagagaaagagaaagacagagagacuaauguuuuccugcauucaucucagaacucaaacuuccucuuuacuaaacaccaagagugugaugugugauagugacguuauuucaucaguauuuggccaggucaacaggacucuucauggucaaaauuaucugagcaaaauaaaaguaaauaaaauaaaugacaaaaauguagcaauggauaccauuuauaugggcaccacuuucccagguaccugaugucucugacaugcagaggaugaugccaugggaccaucugcauccaaagcuuccaaacuguuuuuuuuuuccuagcaguagaacaauuugcucacgcaaugugagccaagcuguaaaugcugccuuuuguucccaguaacuccaguggaucucauccuucugguuuguaucuaaaauugcuuuuuagcccaaagaugccagcaacaggggauggggcaggguagggggugggggaagcuccucaggaggcuuguaagggcauggugguuaggagcaugaauugcgaagccaaaauaucuaaggccaaauccuggcugacuugggaaaguguuuuaaccccuccgugaaauacagauaaugauaguaaccuucaaaagguuacugugagaacuaaaugagaugauuuauguaaagaccuagaacaauaucuggcucauagaguuguagaaacaauagcuaccaccuguaaucccagcacuuugggaggccaaggagagcagaucacuuaaggccagaagucugagacuagccugggcaacauggugaaacuccaucucuacuaaaaauaaaaauaagccaggcacgguggugugcaccuguagucccagcugcuugagaggcugaggcaggaaaaucccuugaacccgggagacagagguugcagugagcugagaucacgccaccgcacuccagccugggcagaaaauaauaauaauaauaauagcuaccgucauuauuaugacuuuguuauuauucgcugcugaagaagaggaaacaguagcuagcuaugaauaucauaagauacuuuguugaugcuaaauagaugaugguaccaucacuggaaauuugcaauauaaguuguaaauaaggaugcuugaaaccaaagagacuuacuuuaaggaaagcaauuaacaguccaaaauuaaaccgucuucucacaaugagucuggggguagaaguggggguguuuauggagaguaggaaaguaaauguaucauagaaguuuaauauuuuguugguagaggagcuaguaaauaaugugucuugguugagaaguguagaaaauuaugauagaaaaggauaaguuuaauuaugacuucugaggguagacugucacuacuagaagaacuaaaagcauaguagaacuuccaaaucaaccaaaaugcaauagaaaaauaacugacacauguugccaaagucaaaagaaaugaaaaauaaaauuuuauauuuuuuacaaaguaaugaaaacgagaauguuuuauucaaaaacucaagaggcauaacuaaacuuggguucagaagagaaaaauguauagucuuaaaugauuuuauuaguuaaaaagaaaaauaggccaggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaagaaaaauaaaggaacgaagaauuaacuucagucacaaaaauaucaacauaaauaaaaagauaauagagagaaguauuuuauauaaagaaauaugaaauuaaugaaauagaagaaaaaauaacaaaagaaaaauacaagaaacaaaagcugaucuuuuaaaaaaaaauuaaauagauaagccucugguagccugauuacaaagaaaagagaaaaugcaaaaauauagacuauuaggaaaaaaacuacauauacagaggagaguaaagaaugaauagagggccaggcccaguggcucaugccuguaaucucugcacuuugggagaccaaggugagaggaucacuugaguccaggaguucaagaccagccugggcaacauggcaaaaccuugucucuacaaaaaaauacaaggcugggugccgggugcagugguuuacgccuauaaucccagcacuuugggacaccaaagugggaggauugcuuaagcccagaaguucaagaccagccuggguaacaugucaaaacuuugucucuacaaaaauaauuuaaaaauuagcugagcauaguggugcacgccuguagucucaccuacuugggaggcugaggugggaggaucacuggagcccaggagugccaggcugcagugagcugugauggcgucacugcacuccacccuaggcaacagacugagacccugucucaaaaaaaauuaaaaaaagaaugaauggagaauagaaaugagccauaaauuaugguauauuuauacuauacgauauuaaguaaccauuuaaaaagcauugguuuaaaacauugaccaagagauauaucuauuacuuaaagugagaacuacaagccauggaauaauguaugaaauuuguccccauuuuuuuuuuuuuuuugagacagagucuugcucugucgccuaggcuauagugcagcggcgugaucucaguucacugcaaccucugccuccuggguucaagugauucuccugccucagacucccgaguagccgggacuacaggugugcaucaccacgccugguuaauuuuuuguauuuuuaguagggacaggguuucaccauaucggucaggcuggucucgaacuccugaccucaugauccacccgccuuggccucccaaaguucugggauuacaggcgugagccaccgcgccuggccuuggccuuguccccauuuuuguaaaaacaagcaagcacuucaaaaauccauaaauacauguguauaagccgagggaaauguuccaaaagagaacacugggaucaccucaagggugugggggaaagcucuuuauuuucauugucuccaauguguuaacugacuacaaugaauaucauuauguaacugucaaagaauuuuauuaaaaaauacaagcaaacauauuaaaaguacccuuauguuuacgcaaaaacuaaaucaggguauaucaucacccugucugcccagguuuagggaagcagcccaggacucaaggccuucguccacacacucagcaacugcccagccuucccuagagcaauccagccaccccagaggcgguaccccuuccaaccugaaugcugcuuuuccuuggaaaacauuccuggugguuuguuuaauguguaaaugucuuaaggguuuguuauacguuaaacguauucuauuuccuccuaaaucuuagaccaggcauuccuuuucuuuuucauucuccacagagaaaagccuaauuccuucucacaagacacaguggguguugcucaccauuuuaaagagagaagguggccuauuuucaggguguaaugcuuccauuccaagguaauucuuuuagcaaaauugcaccuugacaaucacaggcauuuuccuuccaccuuaccuggaggaccagcgcugccccucaacaccccuccccuucugacacaaacuuccagguuuaagguuaaagaguugguggauuaacacauauguccugaauaugcguuaacacccauaacaaaaacuccaggccuauaucagguccauaaaaacuuuccagucauucauuguuuuuauacagaguccagcacaaagcaugugagccacuaaugaacguucuuccacgugucagcacaggcugaagcuagacauuuugguguucaggguaaacagucaccaagaacccucaggcccacacagguaaguggagcagggagugaggggagucuguaguccaucgucuccuccccugacaaagaguuuggucccacagagcaggcccugccaccaaggccugagagggaugaagggggaaggguuuuguaggaugcagggcaaugacgagccuuugcaagcuuuuguuuuacuuuuuauuauuauuauuauuauuauuuugaaauggaguaucgcucugucacccaggcuggagugcaguggcgcauucucagcuaacugcaaccucugccucccagguucaagcaauucuccugccucagccucccaagcagcugggauuacagacgugcgccaccacgccuggcuaauuuuuguauuuaguagagacaggguuucacuauguuggucaagcuggucucgaacuccugaccucaggugauccaccugccuugaccucccaaagugcugggauuacaggcgugagcaaccacgcccgaccugcaagcuuuuaaaaucauuacuuuaaguguuaauaucuccucaguuuugaugcucuagggaagggauugacaaacuggcucacuggccaaauccuuuuugcugauuauuuugguaaauaaaguuuuauugggacacaacuauacccguuuuuuguaagccauuuaucuguggcugcauucacacuacaguggcaggguugaguaguugugacagagccauaugacccucaaaacccaaaauauuuaugaucuggcccuuuauagaaguuugcugaccccugcuuggggguaaaaucagggaaucuguuuugacaaucauuagaaauaaaugaaugcacacaugcccuggaaugagggcugagggaguuaauaagaacaaggaauagggagccucaaaaccccaaccgcacccuagaggaaggaggagcucaaaucaauaacccaaccugucaccuuaagaaacuagggaaagaugagcaaagugaacccaagcaagcagaagaaggaaucaauaaaggucagagcagaaaugaauuagggaucagaaaaacaauagagaaaaucaccaaaaccaauaauuaguucuuuguaaacacaccuuuaucuaagcugaucaagaaaaaagaaagagaagacauuauuuaaauuaggaaugaaaggggagacauuaccaccaaacuuacacaaauaaaaaggacuauaagaaaaucuauagacaauuaauaugccgaugcauuagauaaccuacgugaaguggacaaauucauggccgagcacaguggcuuacgccuguaaucccagcacuuugggaggccgaggcgggcggaucaccucaggucgggaguucaaaacuagccugaccaacauggagaaaccccaucucuacuaaaaauacaaaguuagccgggugugguggcgcaugccuguaaccccagcuacucgggaggcugaggcaggagaauugcuugaacccaggagguggagauuguggugagccgagaucacgccauugcacaccagccugggaaacaagagcaaaacggcgucucaaaaacaaaaaacaaaaaacaaaacaaaauucccagauuaaaaaaaaaaaaagaaauggacaaauuccuaggaagauauaaacuaucaaaacuaaaucaagaagaaguagaaaaucagaauaugccuauauaaguaaagagauuccauuaguaaccaaaaaacuuucuaucaaaaaaaacccaggaccagauggcuucauggcaaaauucuaccauauguuuaaagaauuaacaccaacccuucacaaacuccuccaaaaaauagagaaggagggaacaccuuccaacucagucuacgaggccagaauuagccugacaccaaaaccagacaaagaaucacaaggaaacuacagaccaauaucccucaugaauauauacacaaaaauccuccacaaaauguuaacaaaccaaauucagcaauuuauaaaaaggauuacacacuaaccacacccugaucagggacuccuggcccgcgccagcgacaaacaaagcacaggcacuccagagacagugaccagggggacucuaauguuugggaccagggcccaaguggaaaggcaggaaaauagcugggaugcuggugcaguggcgucucaggccguggcugccagcacuuagaaaacaucuuaucugugaacaucuuuuuuccaaaucagcccauguaagugggacucucagcagcacagaugccugucuuuguccagggguguucacaccagugcccauccauggcaucugccucuagaggcucacuuggugucuguaccgagagggggaaagcaggauuuugccuaccuugcagccugguuggcuauaaaauagcagagaaguaaaaaaaaaaaaaaaauuuauauaccaaguccccaggguaauaaaguaaacugaccauuuauuacuccccucuccaacuacuauacuuaaauaacuuucugcagucaaggcaagugcuuuuuaagagugcagaggccaucuguuugccuuuccugcacugucuuagacacacacaggcacccccaccgcccacacaugcacacacgcagcucugugcuguucgagaaucagauauauuuaugcugaaacacccugcuccugcugccuaaaaauaaaagaaacaaaaccgaugcuuucucuggggagauucuugcacacucuaacuuagacaaauucuucucuuuaaacuguuuuuucaaccacccaccaccauuugcacucucauaaaagccuuuuucaauccaagaaaugcugacaaagaacugcuucuuaaugucuguacuuuguucccucagcauuaagucaccaugccuguguuuuagcuaaaaaagccuuaggauuucccccuacucgcucguuuucggagugccuccguccauucugaugaagcacacuccucauuaacauucucccucucagacagggcguccacacaagaggcugucagccucccugugaaggccacccgagcuaucaaaugcucccgggagcuccugcucauuugagaagugccugcuucuaggaaagcccuuuggcacaggcaaaauacccaucuucaguaaaaaagcgucccagggcccaggccaccuggcugccaccuggcugccaccugggcuucagccacugucaugcaaucugguccccagauugaacagcaagaaugugcuggccaggcccugcccugcuggucacaucaggcauccaggaggcgggaguggcagagggaaaggagugcuggacuaagaggucaggcccuggauagugacuugacucucugcugaauucccuucagagccccaaccugcucgucugucacaugcggcaauuguccccacccucgcuucuccccaggucaagugaggaaauggacaagaagaaaguggcagagggccaggcaggggaagcaucccgggcgcaggccucaccuguccaaacacauagagcagcccgauggugccucccgucugcccacccaggaccgaggagaucauggaguagacgccaccgcugccgaugcugcugcgcuccccgacgccaaugccagacagcaccgugacgagggccaccaggaugacgaaggacaccaggaacaugcccaggagcacuccuguguuucccugcagcagaauagcaaggagcaagguuggauuaggugaggaggccccgccagcucccugcugggggcauugaccaccuccccuccucccacagcacuggaauaggggccaggggugggggcacagagucaggacaacuaaaaaggacaaagcaagcaccacaacagccaaggccaggaagaaguucuaagugaaaggaagcguccuggcugcaaauucuucaaugacucucccaccuauaggguacagucagagcugcugaugcccucacgaggugccuccuaaucucacuuugugccugacgugcagcgacaaguucucuccccacccccaccccuccucaugcugauuccccugccuggaaggccucuccugcucauucuguaccuuugucagguuaacuccagcauauccuuuaggccucaacguuuaggauuucucaccaggaagcuggcccuguaacccuuucucugggcuccuccagugccagggcuuaguacuuuucacaggacuugucauauugagucuguuuccaagccaguuuugaccucuaggcugugagcuccaggggaggaugauaugguuuagauguuuggauuuggaucccuuccaaaucucaugucgaaaugugauccccaauguuggagguggggccuggugggagguguuugggucauggggguggaccccucgugaauggcuugguguccucccacaguaaugggugaguucucacucuguucguucacaggagagcugguuguuuaaaagagccuggcaucucucuugccuucucuccggcuacguggcacgcugcucccucuucaccuucccccaugagugaaagcuugcugaggccucaccaagugcagaugcuggugccaugcuucuuguacagccugcagaacugugagcuaaauaaaccucuuuucuucauaaauuagccucagguauuccuuuauagcaauguaacauggacuaauacggagcaggaucauguuuucuuccccuucauauucucagugcuuagcauaaccuccacaaaauagguguucauuaaaugcuuguugagcgaauaaacaaaccaugcauggcuggagaugaacacauguagacagacacauuucagugugaaaagcaagagucgcagagaggcaguggacacagcacuucuaagaaggagauguaaugucacauguuuugcaauagaaagcaaggaagacuccugauagucaagacuucauguguugugagugcuggagaggguccuaggagugggcagagccaguucaagagcugaguggccuaacaugagcuggaaaauuguccuggaagucaguuguacucuguuccaguguuuauaauauaaugcucaagggcuccacugcuggucugagacccacccuggcuguggcuaaggccgaaaccugagcugaggaucugagugugguguagaaugagagcuuaggaaggucuggucuugcccagacuucuuaugggggcuaagaauccuguacaucccacuauaaaggagcuuaaaucuccccaaauuugccuauguaaugguuaauuuuauaugucaacuuggcuagacuacggcaacuaauuguuuagucaaacacuagucuaaauguugcuguaaaggugauuuucagaugugauuaauauuuacuaucaguugaccuuaaguaaaggagauuacccuccauaguaugggugggccucgucuaaucaguugaaggccuuacaagcaaaggcugguuucccaaagaggaaggaauucugccuccaggcugcaauacagaaauucuuccugcauuuccagccuucagacucaagacugcagcaucaauccuuaccugcuaauauauacaugacauacuuacaucuccuguuggcauuggccuguuucucuggagaauccugacuaguagauucuacaccuugaauggccuccucucuuucacccaucuaguccagcucacccuucaaagccuggcucaacugcaucuccuccaggaaggcuuccugacaccucagugacugcagcacucauagccuguuccaccccaagggacuuaaugcuguuuucagaacucuccuaaugcaauaucuacccaccacagcuguuagcucauagggcggggcggggaagagaggaggggaugagggcccaggccaugucuugucuuuugugaucccacuggcacuaaguagugcuuggcccacagcaggugcucauccauguuuagauggugacuggcuugccuuuuguucugcgcaccuguguggucuacugaagucccacugcaugagauggcacugugugugggacugagaaccccugccccaggcacacaucugcuuggaagguccuaggaugcuuugcauaagaauuaaagaagaggccuuuuguuccuucuacagggggagaugaacugacccccaggaucucacacagcagaguccauccuaggcaauccaucccuagagguaggcggcccacaccucugaccaagcauccccaugcacagucuuaccuacaggguugcaguguggugggggaaggcaaccaugugggcgggcccaagaugaagugaagaauaccgggaaaacuacagagggccacaagcuggaggcaaaauugccaucaaucugaucucucugacccaucucaaguccggcucaugaugagcccugacuucugugcuccuauucugcaguuaaaucuauggugugagguuuccauuagaaauucggaagccuaucuucacaggaugcucauuuaacaagcaaugcuagcuauucaucgugcuugcuucuguuucguguuucaggagcaucugugcuucaggaaucuguggccugcacuguagaaugcaagaguggcagagcuuuccugucuugggcccgugagaggcuccaggccaccaacucagcacucaccaccagccagccaguccucaggaagagcacaaccccaaagauguugaucaugcaggaugugaacacaccaucccaggucccaaacagcacaggcucccacaugaacagcugggucuuccaccagggcuggggcugggccagggcauccugcaaacagaacacacagaaaucagcugaggggccauugggagggccagggauggcaugagaguggaacaggaggagggagguaggagaacucagcuuaaaaacaguccugucuuauugugccagggcaaguguguguguauacacacaugcaugcacauacacacacaugcgcacacacacaucuugaagcauaccucuacaaaaggaucacuguucucuuguaacaacagugauuccguauccauauguagcagagacucauuauucacaaacguaguccuuuuccucuggucaucacucaaguagucagggagucagguagacucccagccucuuugcagcuagaaguggcugugugacugaguucuagcccauggaaugcaggcagaagcaauagaugacacuucuaagugagugugagauucuggguuucaccuccuggggcucauggucaugagcccucuucauccuccaguccuagcagggacagcagcuuccggcaguugacauuuggccaaccuuacugaagcgcucuuugcuccuucagcccuucuaacaccucugcaaucagcccuguggaugagauucccuguuuaaaaugacugaaguuauuucuguuuuccuuacugagcacuaauacagugaucucugcugauaccccaggauucuucagcauuacuggacaauuguuuggaaucagaggcgaauaaugaaaaaacagauuccuugcucauuuuuccaauucacaaauaacaaaggcacuuauaaacacucaaauggaaacccuuuacuaaaaaaaccauaacuucguggauauacuaaaaugaucuuaaacaaaaccaguaguaacucacacugugaaugcucuuauguagguuuggcaauuaaucuaaacucaggcaugaacagagucuuccagugaccacaaacgacuacagcagugauuacgguucucagcugggugggguggguggggagagagaggcauccaaagcuaggagucacugugugcaaugaaucuggaccuggugagcaaauguuauccauaaacacaauaaaaaggcagaaaaaucaagaguuuagggaaaaauccaagauccagaguccacggggcauggcuccugaauggcugagaacaaugggugcgcccaggaucuagaaccaaaggcuaaggccaacggcaugugcucaaaaccaaaagggaggaucccagcuccucuuccaccuccuguaucagacauccacagaucaagaaggggccucgagaaauacucagggaucucaauucagccacaugggacugaugggccaggggaccccuugugucuccgucagucuccaacuccguaagcuucauuuaugcauguacaugacugcuugccuguccuucacaaaccacaaaugagcaaucuccugaaagucaauaauugucagaacaguccucgugguucggaacaaagacucugccaaucuaggcuuguccuugagcaaaugguaccaaaggaccugucuggggaaugcaggaguguuucccaggauccucaucucgaaauucaggaugggucccaacuuccugucucugcuuguguuccacuuccuaucguggcuugcuacaggccgacuguuccucaguaauaacagugacucucagcaacaaaaagacuaauacuguagagagugccaucagcuuccacaggagcucucugcucugcuccucacggcagccccgugaggcaggccgggagggggccccacugagggcugaggagauggaggcugagagaagaaaccugacggcccagucucacagccagggcuucccccagcacuuguaagaucugugcuuuucccugccccacacucaccuaaacauuacuugcccuuuuugccccuaaauuuaagucuuucagguuucaaauucuaacacucuggacuuugcauaacugcgaauacaucugccuuacccaugaaugccuuugugaugacagaaaccuuauuccucuuucacgcgugccuucauuuucccauucugaaggcugguuugcauaugcguuuguuuaccugcuggugugugaaaugccuuucauuuccuugaucucacuggacuagucaaucagccucaaggguagaaacuuagagcagguagaaacuucaggaaacccuuuacccugagaaugaaaauauaacugguuuaaaauggguuuggugacugagcccuggcagcuuguuucaggauauugagggguguguaccuaccuuuucucaccacaugacaaaaaacuauaacucagucuucccacagucugcucaucggagacugggugggaagagcguagguuugacuccaagggaguaacccugauguucuuggagaaagagagagacacuacauaagcccagcaagagacagagaaagaaggaaaaggacgaaaccaaaacagagagaaaggggaagaggaugagauggaaagccccagaauaaaaugccaaauaaagcccccgagggauauuucccagaugccacgcugccucccaggcauccauguagaaauagcagcuuggggcugggcgcaguggcucaugccuguaaucccagcacuuuuggaggcugagguggguggaucacuugaggucagggguuugagaccagccucguuaacauggcgaaacccugucucugcuaaaaaauacaaaaauuagccgggugugguugugugugccuguagucccagcuacucgggaggcugaggcaugagaaucacuugaaccugggaggcugagguugcagugagccgagauugcaccacugcacuccaggcugggugauagagugagacccugucucaaaaaaaaagaaguagcagcuuguguguccccgcucuucucacagaucccuuguccaggcucgccacauuugugaugccauucagacuuuagcuagugcccagagcucgccucuugggagaggacuggcuggagaacucaaagcagcucccuugcgucgugagagcucuugcucuguccugcgugcucucccguucucuucagcuccugcucugacaggcugaggggcaggaccacggucugcaguacgggcagacauguaacaugaggacagaaugucagcucccguccacauacacacaaaguacuggauucuccugagucugcauccccaauuccuuccccugaggcagaaggaaggaaccccucaacccaaauaggcccucccacaaaguccacgcuaagauucucugagugccaccacccagucauuucuguugcccaggggaggaggggguggaagcgcuggggugaugguugcugaagcuuaggccaguuccaggcucucuuguuaaacaccaggagagaggucuggucccaaccauggguagcucucuuuaggaccuagugucccagauuugggccccaguccucaauuccagcauaacaugaaucccauucaacauccuauuacauagacauaaugggcuggggaaaaggaauguacccuacacccaggauugagucuacagcaaaguagagauagaggaugagggggauaagaaaagcaaggggcaaaucaaucccucagaaagggcagcauaaaacaugccugagggcaagaguccucuccucccugaagacccucagccuggcaggggccagcuugacagguuccaggggugcggcgacuuggcgccuggcccaggaugaucccucugccaugcuccucauugcuagggucuuccuucccaagcccccaggacaagaagccagacuccugucccucugagcccaggggccugcgccccaugcuggaaaaaccaugacugccugguggguguuuuuaguucagaaggggaagucguucuccugugaauaaucuccauacuugagcgagguggggggcagauugguggggguaggggguugucuagaaagguggggaaguugcaccugaguaggaaauacucucaauccugcauccagcaagcagagcugaguaagaggcuggaaaguucugccagaggcaaugacaugagcucagccccagaagccuuuugccucaaacagucaccagcuaagucuucaugaaugcaucugcaaugucagaugacaccuuuucuccuuucugggagcuggaggaaaagcaaucaggugagaaauucugcuucuguccauucaggucagggguguagguggaagcaagacccagccugccccuuucucccaaagugcaccugcagagacugguuccaccuggauuacauacacaugcgaaccagcagauggcuuucugaaaguuaauauuggauuauuaauuaaacaucagagaauauacccaagcugcugcugaacugcaguccaaugggcagacugaggagccucauuccuuuccccugccucugaaccggccccaugugcuggaccacagggguugagagcugggccgggcgccagcauggcuguggguuccaugggccacaguccacaugugcagcuacaugccugccucagggggguuuuguaaaguuuagaugagaugauaguugugaaaguuuguguaaacacaaaacacaacagaggauuuuaaauauacaugaggauuucuucagggaaguuggaaggaagacaaagaagucuuuugacugcauuugcugcuuuccccagcuaacuugucuucauguuuaaaguggaauccuugcucuacagcucagcccugaaagcugcaucucuaaccccugcccagcccaggcauucugaguaagagagagcccaucccuucuguuuuguagugggaguuccagaauggaccuccauugagugcugccccaugugacugaugcuggaaauggaaauggcucuguagccaaggaagcaaggauccaauuggagccgucaaagucugauuucccuggguuaggaucugggcagcacccuuggucuguauagauuuagucauuccuagaaaugugaggucuucguggcugugucagucucuucuaccacagagcugguaugaaagcugggguugaaaucuagucauucccacagacucaaucuguuguuuuuuuuuuuucuccauaucugugcaucuucacacuuguucaaggcugggauucucacaagggcaugaccuggucacacauggcucagcccgcagaguggcaagaccaucagaggcugugaaaacuuugaugccgaaguucugccucccaggaccacacagcagccucaaaacucagagcccagagaugagcucuggaaaucugaugucgucuggcaaaugacaaaaccccacagcagccaugucaaggccaccuaaacaagggcuuccucugcccuucccaaccuccuuagcaaaagggcagagcuuuuccugcuggacacaggcugccgcuaggaagucuaccuggauuuaacacaaggaggagcaaaauagacccuaaugcccucccccuaauaacaggcgaaccagugaaacaucagcugcaaaaagguuaucauuccaggugcuucaguggaucagccacuauucuauccauuuaagaauucuuauguagugaguagacccauucauauaguuaaaauuuuuggaaucauguuaauauuuuacauauacucaaaaucaaauacaauuaaaucaacaaagaugaaaguuaaaaaucuaaauagaaugcaaagagaaacaaauuauccuagcuguauuucaaaugaaugacguaaccauacuuaaagcggaaaaagaacuaaccagaguaacuuaugaacacaguacuuugacuauguaucacauucgaaaacaaaaauaacugcaauuaauauuaaaugccagauagaaaauuuggguauuuguaggaguaugaauuaccaauucuaaaucugcuuucugugaauuauaagcaaauaacaaaauauauugaauaagagucaaguuucucacaguuggagaaggaauuccaacuaaggaaauaagagaagaauaacccccauacugaggaauuggaguuagacguauuaguaugaauuuaugguuuuuaauauauagagaccuagauagaucacuguacauauuuauauuuacauucuuucccucugcccacuuaaagugucuauaaggccaggcacaguggcucacaccuguaaucccagcacuuugggagacagaagcuggauaauugcuugaggccagguguuuaagaccagccugagcaacauaaugagaccacaccucuacaaaaaauagaaaaaguagccaggugugguggugcaugccuguaguccuagcuacauaggaggcugaggcaagaggauugcuugagccuaggaauucaaggucacagugagcuacgaucaugcugcugcauuccagccugggcuacaaaggagaccuugucucaaacaaacaaaaaaagugacuauaagccaagacaucccaguggcaaugaacauaccuagcacccagaucuugauuucuaaauaucauucuucacuuuaaggaaccagggcuccuugcagaaguugcuaauucaaggcuagggcagagaacguacaaaaugagucuggaauaucuuguaccagaaaguagggaagugcuaaaaagaaaaaaaugacaaggaugugucaaaaggacacaagagccacuugaaggggcucccacuagccaaaucuggcacaauuuggcccugaaaguaaauaauagcaauagaauauucaaggaauagaauaagaaucugaguccauacagacauaaauaaauuaauuaaccgauuuuuuucuuugagacagggucuugcucugucacccaggcuggaguacaguggcaugaucacggcucacugcagccucaacuuuccaggcugaagcaauccuccugccuaagcuuccugaguaucugggauuacagguaugcaucaccaugcccagcuaauuuuuguauguuuuguagagacagaguuuugcgcuguugcccaggcuggucucaaacuccugggcucaagugauccuccugucucagcccugcagagugcugggauuacaggugugagccaccccaccuggccaugacuaaucauaauauaucuauuucugcucauugucacugaguggaccuggaggcugagggcuggaagagcaacuggaauugcuguagugccaaauauauccccuuuuauacugauguggcucugucaaggguaucacuccugugugggagcaagaagagaaagcccuuccuuacaguggaaaaccaaaugauccauguggaaggaauuaugggguuagaaaaucaccauuuugcagccaucacagcaauagccagcucugccaagaaucaucaauggaugcuaaugcuagugagugagggauuaaugaggaagaggguauuucuauagucucaaagcaucuacaaauuacuuauuaacaaaaaagagaaauuaguaacuuuagaggggauuaaccuaguggacaccaccuuaaauaaauagccaaaguuaacaucaccaauaaugggacaaauggaaauuauguagcuccuacuaugauguccugggaaaaguacugcaucacugcuaugguguuccugccaaaaauagaaaaccuaaaucuaccugugacaggucaugccccaaacugagggacaucauccccaauucugccuauaaaauacaaaaaaacaaaaauaagaaaaccugaggacauucuacaaaauaaccaacauguguucuuuaaaaaaaaaaaaacaaaacagucaaggucauaaaagacaaagaaaggccaagggacuauuccagauuaaaagagacuaaagagauugucacaacuggccaggugcaguggcucaggccuauaaucccagcacuuugggaggcugaggugggugaucaccugaggucaggaguucgaaaccagccuggccaauauggugaaaccccaccucuacuaaaaauacaaaaauuagcugggugugguggcggaugccuguaaucccagcuacucgggaggcugaggcagaagcaucgcuugaaccugggaggcagagggugcagugagccgagaucucaccacugaacuccagccugggggagaauagugaaacucugucucaaauaaaauaaaacgagagaaaucacaacuaagggucauguaugauccuggauuggauccuggaaggaggucuuggggagaagcugggggauguuagugggauaacugguaaaauuuuaauguagagcuacagauuagacaauaggauuuuuuuuuuuuuuugagauggagucucgcucuaucacccaggcuggagugcaguggcgugaucucggcucacugcaagcuccaccucucgaguucaugccauuccccugccucagccuccccaguagcugagacuacaggcacccgccaccacgcccggcuaauuuuuuugaauuuuuaguagagaugggguuucaccguguuagccaggauggucucgaucuccugaccucgugauccacccuccuuggccucccaaagugcugggauuauaggcgugagccaccaugcccggcugacaauaggauuuuucuauguuaaauguccugauccugaaaaagauacugugguuagguaaaaaaacauucuuguucuuaggaaauagacacugaaauauuuauggauaaaaggacaugaugucugcaaauuguuuuuauaugguuuagagaaaauauauacauauauauagagaaaauggucuaaugauaaagcaaaaaggcaaaguguuaacaaguggucaaucugaaucgacugagucaagaguaugugggguuuuuuauuguauuauuacaacuuuucuguaaguguaaaauuuugucaaauaaauaaauagguugcaaaacauuaugaauguauuuaauaccauugaacuguacacauaaaaauaguuaagaugguaggccuggggcaguggcuuaugccuguaauuccaacacuuuaggaagccaaggcaggagggccacuugaagccaggaguuugagaccagccugggcaacauaaucaaaccccuucucuagaagaaggaaaaaaaaaaaaaggccaggugugguggcacaugccuguagucccagcuacuuggaaggcugaggugggaggaucgcuugagcccaggaguucgaggcuacaaugaacuaugcucacgccacugcacuccagccugggugacagagcaagaccuggucucaaaaaaaaauaaaauaaaauacauuuuuauaaccaacuauaauaaacaugaaaauacaguuccagaaaaaaaugguauaaaccuugacaauguaaaaauaauaaagcaacuauuaaaaaauggaaaugaaaugagagaaauggaaggaaguguaugugugccaacguccuauuuuucauaugggaaacaggaaguaaaaugauaacaaauugguaaccuaagaaacugagguauaagaauauuauuuaaaguuacagugagaacaauuagaagacaugaaaaccagaagccauuagcaaugacugccacuggggaauagaagugaaggaagagggaaggaaggcuuuucauuucaugucaugcuguauugugugaauccuucucacuucaugcauguaguacuucuaugauaaaaacccuagaccagccacaguggcucacaccaguaaucccagcacuuugggaggcccaggcaggcggaucgcuugaguccaggaguuugagaccagccugggaacauggcgaaaccccgucucuacuaaaaauacaaaaaauaagcugggcaugguggugugcccuugugguccuagcuauuuaggaggcugaggagggaggaucaucugagccugggagguuaaggcuccagugagccaugaucgugccacuguacuccagcugggaacagagcgagacucugucucaaagaaaaacaacaacaacaacaagaacuaacuuauuuuauguuuaaagaaaaaauuaccacauuauuagaaauauuuuaaaaacagaauggguuuuuuggcugaccuggcauuagggauaccauuuauggcuauaugucauuuuauucaguggaugaauucaccaaaagauuccugugauuucaaucacauuuuaaaauguauugaauacauggaauacuuaaagauggugaauccuuuuguaaaaucaaugucuaccucaaaauucuuuguguaucucuaaguuuuuaaauuuguuuuugcuuuguguuauucuuuacuaauaacuaccuaaaauuaaaaaggaaagugacucaaaaggagucauggcuuucgguuuuaaguugaauucuaugaacacggagacucaugguagagcaggaacgcaacuauuuuuggcuuagugaggguugcucagccaccauugccucaaguuaaucaguaagcuccuaaagccuguaaccagggacagugaccauggaugugauuuaccggauaucugcaaacugggaaaagaacaugcuagaauuuuuacacaggugagugguuuuuaccacacuacccuuuuuucuuucuuucugacuguucguguggggaagaagacauucacacaacaaaucaaaaacaaacaggcuggacacgguggcucacauuuguaaucccagugcuuucagaggcugaggcgggaagaucacuugaggccaggcaaggaguucaucaccagccugggaaacauagugagaccccaucucuacaaaaaauuuaaaaauuugccagacaugguggcaugugcugugguccuagcuacuugggaggcugaggugggaggaucccuugagucccaggaguuuaaggcugcagugagcuaugaucacaucacugcacuccaaccugggcaacagagugagacccugucucuaaaaacaaaaaacaaaaggaauguaaauaggaccuuucucccaagcagugguaaauguuaaagcauuauuguauuagaaaugcaucaaagccgggugagguggcugauaccuguaaucccaguacuuugggaggcccaugggaggauugcuugagcccaagaguucaagaccagccugggcaaaauggcaaaacccugccucuacaaaauauuuuuaaaauaaccaggcaugguggcaugcaccuguggucccagcuacucaggcccaggagguugaggcugcaguaagccaugauugaaaaaaaaaaaaaaaaaaaagaagcaucaaagcuuaaauagguacuaccucuaaagacuuuucacgucaagcgcacccacccuuugauuaagguguuaaaauucagaaagaaaaaauuuaggaauuagauuaaauuauacuugauaauuauugaagagcaaaaagagauacugaauugaauuauacugaaguauguguauuucuuuuuaauuuaauuuuuuuugagauggagucucacucugucacccaggcuggagugcagggguuugaucucagcucacugcaaccuccgccuccuggguucaagugauucucccaccucagccuccugaguagcugggauuacaggcaccugccuccacacccagcuaaacuuuuuuguauuuuuguagagacgguguuucaccaugguggccaggcuagucucgaacuccugacuugaggugaucugcucaccucggccucccaaagugcugggauuacuggcaugagccaccucgcccagccguauguguauuucucuuaauccuacuacaauuaauugauaauguucuaggaauauagaacuaucuaauguuuuaacuguuauucugaagagauguguuuuggccagagaaaguauaaaaugaaugaaaagguaagcuaaaacucaguuacucuccccuacaggaagccaggguguucaaucaggccaggcggccagaguaaaagcaccaccuaauggcaccuuauucaaauuacaagaauaguacuucagaggcauuaccauagcaucuaggcuuuccuugcaaaccccagacgauuaaaugauggcaaaugcaguauuuugucuauaucugaccauggaugaaauuuaccuuaaggcaguaagaagguuugaaguuaccuagucccucuauucauagcuaggcggaauguauuaaccauguuuuuuuuuuuuuuuuuuuuaaaucuguaucuaaugauguuaugacaacuuaaaaaucuugcugaccaaggacaugaaaaaccucuacaaugagaacuacgaaacacugaugaaauaaauuaaagaggacacaaacaaauggaaagacaucccaugcuuagaauuauuaaugagaagccgggcacgguggcucaggccuguaaucccaguacuuugggaggccaaggcgggcggaucaccugaggucaggaguuugagaccagccugcccaacauggugaaaccccgucucuacuaaaaacacaaaaauuagccaagcgugguggcaggcaccuauaaucccagcuacuugggaggcugaggcaggagaaucgcuugaacccaggaggugaagguugcagugagcugagaucgcaucauugcacucuagccugggggacaagagcgagacuucaucucaaaaaaaaaaaaaaaaaaaaagaauuauuagugagaagaauuacuauuguuaaaauggccauacuaugcaaagcaaucuacagagucaauacaaucccuauugaaauaccaaugacauuguucacauaaauagaaaaaaaaaacccuaaaauuuguaugaaacaacaacaaaaaauaagccagaauagccaaagcaauccugagcaaaaagaacaaagcugaaagcaucacacuacccaacuucaaaauauacuacaaagccaugguagccaaaacagcaugauauugguauagaaacagacacauaaaccaaaggaacagaauagagaaucuggaaauaaauccacauauuuacagccaacugauuuucaacaaaggugccaaggacauauauuggggaaaggacacccucuucaauaaaugguacuaggaaaacuguauauccacaugcagaagaaugaaacuagacccccaucucucaaccuauacaaaaagcaacacaaaauggauuaaagacauaaauguaacacccaaacuauaaaccugcuagaagaaaacauagggggcaugcuuugggacauugguuugggaaaagguuuuauggcuaagauuucaaaagcacaggcaacagaaacaaaaauagacaaauggggucauauugaucuaaaaaguuucugcacugcaaaggaaacaguagagugaaaagacaaccuguagaaugggauaaaauauuugcaagauauucaugcaacaagggacuaauauccagaacauacaaggaacucaaacaacucaacagcauaaaaugacuaaucccauuaaaaagugggcaaaacaucuaaauagacauuccucaaaagaagacacacagauggccaacaggcacaugaaaaaaugcucaacagcacuaauuaucagggaaaugcaaaucaaaaccacaaugagauaccaccucacaccuguuagaaugacuauuauccaaaaaauguaaaauaacaaguguuuguggggcuuuggagaaaagggaacccuugugcacuguuggugaaaaugugaauuauuacaggcauuauagaaaacaauauggaagcucauuaaaaauuaaaaauagaacuaccauaugauccagcaaucccacuguggguacuuauccaaaggaaaggaaaugaguauaucaaagggaugccugcacacccauguuuauugcagcccuauucgcaauagcaaaaggagucaaccuaaguguccaucaacagaugaaugaauaaagaaaaugugguaaauguauacaauggaaaacuauuuagccauaaaaaugaaugaaauccugucaugugcagcaacguggauggaacuggaggucauuagguuaagugaaauuaaccaggaacagaaagacagauaucacauguucuuauccauaugugggagcuaaaacaguugacuucauugagcuaaauaguagaaugaugguuaucagagggugggaaggggauuggggggaugaagagagguugguuaauggguauaacugcauaguuagauaaaaagaguaaguucuaguguucuauagcaaagaaggguaacuauagucaacaauaacuuauuguauauuucaaaauagcuagaggagaagauuugaaaugcuccuaagacaaagaaaugauaaauauuugaggugauggauaccccaauuacccugauuugaucauuacacauuguauauauguaccaaaauaucauauguacccccauaaauacguauaauuauuauauaucaacuuaaaaauguuuuaaaaucuugcuggccuaggaaagacugacccucucagaccuagucaauucucagagagagcaaaaggcuuagccaugaacacagcuuucuuaagcaaaacaaccaaugcugagucuauaccaccaaagaccaccuccucaucuaacucacacaccaagccaagauuucuccugaccccaaucaucccagagccagacacccggcaaccagaggccaccccuauaacccagagcccacuagaauuguucaaacugccaguccuaagcuguccaccgugcccugccuuuccucuccugcagaaaccccaauaaacccucacuccugucuucagcccccugagcaucccuggugcuucccugugacccugcguggcauaguguauucucucuucucaagcaagguaaguaacagaaaucuuucaguggcaucgaccucugcauguucucaccucuguaaguuaaaauacggcggguacaaaugagucacagaacccugccuaacucauuucagugaagaacacuuucacuccaguuucuaggugggacacuuuuauccagaaaauguccccacucuauuuuuuacaaauaugcagcauuuggggcccaguugucauuuucaggcaaaguaaccaacaggucuuuaaaguggaaagggggaaagacagaggagaaagaggaaaggaugucagugugcauaugaaaugcuuccgccgcaucucaauccugagaacaggaucugcuguuacuucucuccagcuccaggagcauaagccucuugucuucugcugccuuuaaaguugcuuccguccauugaccagaggugguuuuauggugaagcuaacagcuuaagccuuaggacgcaucauuuggcauuuggucccuuccaaagauuaugccaaauuuucuauuugcaauuuguauccuuuuuacuagagaguccauaaaaaugguauaagcuucaugcccuacaagaccugggauagugagggggucauggcucuaggaaucccagaauugagcccugcucuuccacccaaccauuugggccccaguguccucaucuuaaaaagaggggcuucaagagauauaaauaugcuuaaagaaaaaaaagaggggcuaacaagacugucuugucugaaguucccuuuuccuuccuccucagcugcauucauuuuucuacaucuacuaauaaagcaauaugcuauugccuggcacauggcugcugaggcucacauagcuuuuuaaagaugcuaaaacagcccugaaaaaugcauaguaaaaauaaaagucaguucuuaaccauacacuggcuaaugagcacucagaaaauaugagccaagcuuuugcaaugaagccugacacccauacucaaaauuggauaugucagggucaacucagggcuguguucuggggccaguagccuugcuucuaaccugguucugccuucuaaccuugcucugggcaagucacucaauauuuacguccuccuggacccacuauugcuggaacucaagucucugggcuugcuucuugacacgacaagcaaauggacuaggccagaagaucucugaggacuccuccaugucuugauuguuugguucuauuucuaucuaccucucuugccagugccacuucucuauucaccauugccccaaaacuugaccaggcucuaucuuaccacaccaagcuaacucagguaagccaucuaauugaagaggaaaagacagagaaaaaguguguauuaguccguacgugcauugcuauaaagaaauacuugagacuggguaauuuauaaagaaaagagguuuaauuggcuuaugguuccacaggcuguacgggaagcauagcagcuucugcuuccagggaggccucaggaaacuuucaaucaugguggaaggcaaaggcgaggcaggcaucuuaugucaccagagcaggagcaagagguccugggaggugcugcacacuuuuaaacaaccagauuucaugagaacucacucacucacuaucagaacagcaucgagggaauggugcuaaaccauuggugagaaaccacccccaggauggaaucaucucccaccaggcccuaccuccaacacugggaauuacaauuaaacauaagauuugguggggacacagauacaaaccaugagagagcaagagaggagaggacacagaagggaaagagcugggacgcuguacaagaagacggagcagagucagaacccaggcaggucucagcgaccuggaaacuccuccuccugugcuugggccagucacaaugguucugacggggagccugcucccacggccugcagcggguuuuuucuagaauaauuagccagacuuuggccugcagaccuccuagaaaaggguccacauggacccacuagugcuacacuucaagucucugugguagagcagaaugcagaaaagcaugaauccaguguacuaguuauauugguuuuuggugacuuauucucaggccagcuucccuuuuaaguuccuguugagacccuccaacccugagagaagaaagacaaaagccucaggcuagcuggaggcacuucuuauuccauaagaacuaggagauugcuguugguuuuguacuuguuuuaguauauccagcaggaacuggggauccuggcaagaacugucauucaauaaacaccugguaaaugaaaccgaguuuucucccuauucccaacgcuaagagcaugagauucugcaggacuucagaccuccacacagcuugucagcuugccaucuguuuuugucucaggcuaccugcuuucuccugccaacgcagucuuccugaaacacccagaucgucacaguccugucuguccaguaccuggcacagacaagcacccaaucauggcucauuagccuucuguucaccucccucugcacuggcuguuucuuucuuaguuuucaagccccaaguuucacagccuacuccgcugggcuucugugugcgaucggcuucauccaaucaucaaaugagcauuuuacuuagugcuugucaugagagaggcacuggcccagacccuuccacauauggcaucuccuuuaaucucauaaaaacccugagaaucagguccacucaccccaucacauaguuguggaaauagacugggagccuguggguaacuugcccaagggcccagccuauccagcagcacagucagaaugggaaacccagaacccagguuugagucuaccaccagagcacacaaagugccuccagacagaggccccuggaacaaggcuuggccugccagaaguucggugggucuccaaacacacacucacauucccaaaccacuccagacucacccaggccuagaaagcacacaucauccucaauagacugcccacccagcagguugucuggaacaaugucccacauucugguguuggcccaagguaugauuuuggguuugagacuccugccuuaugucuucugccugacucagcugugcugagucaugcauugauuugccaauggauccuucugcucauuuauaccacuacccccuggauuaaauacauacuccccuuaguuuaauuauuagccauuuauauaauauaagcugaaugcugaccaggaaccaagcacuauaccaaauauuuacacaaauuaucucuuuuaauugucuucauucucuaugguaguuucaaucacugggcagucauuuuguaggugaggaaacggaggcuuagugagguuacgaaacuuguucaaggucacaaaguauuagagccaggacuugacccaggcagcacaugcacccucgaccaccacaccauuaacacucagaucuacagcuccuucccagcugguucacuuauuacugaccaaucuacacacacacacacacacacacacacacacacacacacacacacagagagagagagagagagagagagagagagagagcuacccuaucugguccuaaaaugauuaaagccaaaccaagaguccauucauucacccuccaccuaacuuccaaguguccccacccuugccaaacuuccugugagccacuuucuaaucaccgugaccaagagaagagcaggucaagacugaagguggcaugacacccacuagccugucuucccacugggcacugccuccuaaucuuguguucugcaggccccaaagcuccuagcagaauuucugauccccaagacuggaauaaaauuguucaaagguucccaggaaauuucuugagggcuagccacuccuagaguucagcuuccagcauuuuagccaccuaacuuacucucuguucccacgcagagguccuuaauuugccaucuggguggcuuugcuuauaccauuuggagcaggaggcacauagcaaaaaggaugaaagcuugggacuuggcaucaaacaugccuggcuuuacagugcuacaguuauucuugugucaaaccaaaauaaucauaucaacuucagaauguuguaguggagauaaaugagguaaugcauauuaagugcucaguauacaguaagugcccacuaauugguagcuauuaucauuuucucacccucccaccuggaauaugcuucccaaguccaccauauguuccacuuccaccauuacuuuaagacuuaaugcaaauggcaacucacccaauuccuagccagguaaguucaguucaguagaaccaacacugauggggcaacuucuauacacaacacaccaugccagguauuggggauacaaaaauaaauaagacaugccccugaauuuaaguucacagcuuuaagggagacagaaaagaagcagcucauuucaaugcuacaugguaagugcagugacacaggaugcuguggaacagaaggggugaguuaaccaucacggagggcccuggcggccaagaugaggagucugagcugaauucugaaggcagugagaagcuauugaaggaauuuaagcagaggggucaaaugcacagaucuaugcuucauaaaagcaucacuuuaguagcaauguggaaaaagaacuuaggagaguaugaaucauccaaucaagaaaugguaccuuaacaagacagugcaggggagggagagagaaagaaaggauggauuucuaaaucaugaacaccaaaggccuuaaaauugggcauugggccauguccaauccuucgauguuuagcuauuaagggagaaggaggcaacacagaggucauuguauccaucacauuuuagaaaucaacucucucuuagggcacuuaugacaauuuaacuugcauugugguuuucuguuguuuguucaugugaucaaucaacuaaaauuuacuguccacuuaaauaccaauuuaaauacuuaaauaccacuuaaauacuugggugaagguuucagugacaaauuguugauaagaagcaucagcaaagaucaagggaaagauauaagcucuggggaauggugugguucagcuggaagguguggcaggaagaagaagauguggggaacucgacuugagacucagguggggucagacuguauagggcugaggcugaagaguuugagcccugaguggugcacaugaggagacacugaagguuuuaaacaggggagagaggaacagaugccaucacaggggagaucucagaaugucuuauuugucucuccuuugggaauuccugggccucacauuuucugucuggguuucuuguucauuguugauucucuccccucugauggggcuugucccccuguuacaaggcugggaaacccuccugccacucucuagaagcaggaaagaaacccaagggauggugaaaacuucauguugagugaucauggauggcaaagacccugggugcacauaguuucuggauaaacacuuuaguaugguuuauuauuauuauuauuucuuaagggaucagcucuccauuucuggguagagccacuucaauuccauaucuacagaaugcauguaacuaaugaucagcagggagaagauaaagaaaaaagaagaaaaaaaaauagcaaacaccagggcauucagaaauccuuuuggcuucagaacauaagaguuuuuucagaaauaaauuuaccuucuuacauugguuugauucagaauuaaaaugaguucauauuaucugaguccucacugugacugucuguggaagaccucucaggauggaguuuggaguugugggggaucccaggauucaaaauccaccacaaauaaugccaaagguuuucuguauaugaacaguuaauaauggcuauaauauuuuggcuauaauauuuucucauugaacuggaugaccaaaauagacuuuggaguuaauuacaucuaaagggugcgcuguaauguuugcauccagcccacugucuggggauccccgugcucacaggccuccaucacagacccuggcacauccugagccuaccugcugggcugccucauggaagagcuccugcaccugggacaucugggucauucuccagcaagcagggauccuggugaucuggacagggagacugcucugga

SEQ ID NO: 192625 - RNA, 47982 nt, Homo sapiens
gacaagccgggaagcuuggaggggucuauugcguacgcccaaggcgcugggccuggagcaggagaaagggaguggaggcgcgucggagacuaugaagcgcggcauucggcgggauccuuuccggaagcggaagcucggcgggcgggccaagaagguccgggagcccacggcgguuaauucuuuuuaccgugaggcuucacuucccucggucugggcuucucugaggcggcgagagauggucaggucuggagcucgaccgggccaggugagggcugaggaccugaggaguccgcuguggggauggagagggacagggggguuuucgggccaggaacuuguaaaacucugcucgaaaaaagacaaagacaaugcggcgacauuaaagugcugggacagaggugcagggaacaccuaaucuucccgucguaacacggccgcucggucucuagauguuucuguuuaaaucgucguagcccuagucuagagcgccggcuuuggggucaggcccggguucgagucccagccuucgccgcugcgucgagugacuuaaccucuccuagcuucagucaccugcagauugagagucuacuacuuuuuacugcucagaacuuccuauuccuuagcugcaaaauaggcagaaauaagcauaaaauccugucucaaagaauugagaagguuaaauaagagaacccgguaaaaacaucgaucacacaguuguuguagacauacaacaaaauuuaguucccuuuaaaacacguaguuugccaccaucuuaaugauaacagcagccaacauuuagauaggacuuauguggcagaugcuacuguaagugcuuuuauguauuacauagaauaacucauuuaauagucacgauauccuuaugagguaaguacuauuaucccuauuuuauauaugaggaaaucgagggcuggaggauucaaauaacuuggcaguuacacagcuguggaaacaagauucagacucacaaaacugaugccagaguccauucuucuuuuaaacauuuuaccuaguagauguaugacuuugaacaaaccacuuuucugaaauuuagguucccaccucacaaauaauaacucacaggguauggauuaagugaaaaugaaagaccuuagcacacuguaagucauucuacaaaggcaguauuaucuuguacuuguugguaggagauaugacuacuaagaaaugcuuauaugauucucaaauagcaaaauuaaaaguuuaaugauaauaaccucguagaaguaaguguaaaauaaagcaaacugauucuccuguauugugauuaggacacuccuuuuggagagcagcuuugcaguuuguaucaaggguuauuaaauugcuaauaaccuuucaccaaauaauuuucuuuuuaauccuaaauauaaaaaggcuguuuucaguagauagaaaggcuuauuccagguuuguuuuuuuaauugugaaaaauaugaagcaaaccaagaccauuauuauauuacuuccacugaaggaaauauuauacaaccauuaaaaauuuaugaauaugaaaaagauuuaaaaguagaaaacacaggauuuaaaauugcaaauaucuagguauuaugacuaaguaaaaaaugcauaugaaaaaagauuggaggccccaauagcaaagaacacaucuaguaccuagaucuugguuuccacguaccacuguccacuaaggagucauggcuucuuggagaaaugaccaacuccagggcugagcagggguaauauaagaagagcauggacacaucaaacuaaaaagcuucugcacagcacaggaaaugauuaauggagugaaaaggcaaucuacagaaugggagaaaauauuuccaagccauguaucugauaaauaauauccaaaauacauauaaggaauuucuauaacucaaaagcagaacaacacauaaccugguuaaaaaacgaaaaaaggauuugaauagacauuucuccaaagaaaauguacagauggccagcagguauaugaaaagaugcucaacaucacuaauccaggaaaugcaaauuaaaaccacaaugagcuaucaccuaaccccuguuaggaugacauuaaaaaaaugaaaacaaguguuggcaaggauguggaagaauuggaacccuuguacacugucagugggaauguaaaaugguauagcugcuauggaaaacaauauggagauuccucaccaaauuaaauauagaacuauaucacccagcaauucuacuucugggaauuuauccaaaagaauugaaaucaggauauagaagagauauuugcacucuuguguucauugcagcacuauucacaauagccaaaugugggaacaacccaaauucuaucugcagaugaacagauaaagaaaauaugguauauacauacaauggacuauuauucaaccuuuaaaaagaaagaaauagcugucauaugcaacaacagagacaaaacuugaagacauuaugcuaagugaaauaagcuagucacagaaggacaaauacugcaugauuuuacuuacauaaaguaccuaaauaguuaaaacucauagaaacagaaugugagcauggauugggcgugaaccagagggauuuuuguuuuuuggguuuuuuuuuguaaagaacaguauugggauaauuggcaacaugugaauaaggucugaauauuagauuguaauucuguaucaauguuaauuuccugguuuugauaauuauacugugguuauguuagagaauggccuuguuuuuaggaaacauuuaggaguaaaggaguauuguaucugcaaacuuaacucuaaugguucaggcaaaaaguacugcuguguauauauauugagagagaauauggaaaaugucaagguucacagaaucugagugaagcauauauagggcaucuuuguacuauuauuucauaguagaaacuacaaaaaaaaauugaaaggaauuguuccaauaugacaguuacuguuucaaggugcuuuuaucauggguaguuuucuuuaccagauuuucuauaauauagccuuguguauauuuuuuggagaaacaccauauguaaucuuacaguuaugccagacauauaccucagacaguguacuuuaauugugguaguuguuuuuggacucgauccaggguauaguauuauagugucauggcuuggauuuuuuauuaugauuccagccaagacaucgacauaaauauaccaaagggaaggacccugagagugugaugcagagaccaguggugugauguuauacaaggucuuauuuccuacauuguugguucucacugcuggcuucaugacccuccaucauaauccaaguuaucucaagacguauaacucuuaccaacccaguuuuuaaaaaauguauucucagugacauucuuagaaggauggagcacauauucaagcauauaauagaaugccguauaacuuuagaaaguuugguaguuacagcucaaagcuaucuggagaugaaauuaaauaugugaagagaaauuauaaauaaaacugccaacagugacuacaucuggaggguggaacuagggggggaaucagggacuuucucaugucuauuuaaaauuauuuugaauaaagauuauauuuaucugauauaaaauuauuaagauauaaaauaguauaccauggaaagugucccuucucgcucugucccccagauacucuguuucccuccccagaggcaaccaugauuaacuguuucuggcauaacucccaagauacuggaugcauguaaaagcaaaugcuuauuuuuuccuguuuuucuacacaaaagguuguccauuauugucacuuuuaaaacaaaaaaguuuaagaaaacaacagugguauaugaauuuaaaaagaaaaauuaagacagugagauguagauaaagagacaggguagaguucucacuuccuggucuaaucaggcauucuaaagaauguacauaaaaggaaccagaguuaagaacucuguccuauaucaugaauuaacuugcauguuucaaagaauuugggacuauagaacauauuuugggauuaauauagucugaacuuaguguaguaguuacuucugguuuaaaauaguaucucaauuuccuuuucaccuuaaauagacuuaaggaacaaauauauguguaguuugcuugacguuuuacauaaaagaaauuuaauauaugaauuaaauuauaauuguguauuuuuaggauauaucacauuaauuaaaacagugaauaaugugguacauacauauaauggaauauauuugaccucaaaaaggaagaaaaauuuugacacaugcuacaauauagaugaagcuugaagacauuaugcuaagugaaauaagccagucacaaaagaacaaauauuguauuauuucaguuauauaaaguuucuagacuagucaaauucauagaaacuaggaugauaguugcuagggucagggagaagaggggauggaaagguauuguuuaauggaugcagaguuucaguuugagaagaugaauaaaagaaaaaaaugacauuaaauuuugucaagauagcauauugaaaauauaauagaaaaauauuuguuuaucugcuauaauauauuaugucauagguguuaucuucaggaaggcacacuggaccugcuaaauuaacaaauggaaagaaagcguaaguacuugaagacguuuacaacuucagauuucaaggaauuuuucaggucuuugggcuggaugacaugucgucuaccccagaaaauuagguaggccucuaccaucacaagcucugaggaacaauuuuucaugucuacccauguuaaucauuuuaguauuuaacagucuuucugaucuucagaauguguuuauaaauucaucuuguacaugguuggacaagcuuucuugucuuugcuggaaagaaaaugacuacuuacuaauauauuuugggaaaaauauuuguaagaauauuaauaagcuuguuuuccaggaccuauuuaagaaaaauaccacguuuuaaugcagauucuggcuauuccauccauucugauucagaaagucagguaagauugaauagauacaauacacacuauuuuaauuaguuuucaaauaguagcuaaaaaguaggaauaaaaugcaaaguauuaauugcucuaaggaaguaugaagucuguugcuuuaaaacaucuuuucuaccaauaauaguuuguaaauaaacaaauuuuaaaacuacauaauuuauauuuuuuccuacacuaacagucauauacaaauguauucuaaaugacuuuauuucuuacaggcugaaacuguacacgggcuugaugguugugcuucuuugcugagggacauuuugagaaaugaagauucagguuuuuuuuuuuuaauucuuugcugaucaccuuaucucaagucauuauuuugauguaacaaauuuuuguuuuauuaauagguucagaaacagcauauuuagaaaacagaucuaauucuagaccuuuagaaagcaaaagauacggaucaaaaaagaaaagacaugaaaaacauacuauuccuuugguaguccagaaagaaacauguaagccuuuuuucucuuaguuauuuaaagauaauccuuaauuguggguauuuugaucaauuaucaggauuauacaguugauuuucauuuuaauaaucaguauuaguuagguuuaugugugcuuaugccuuucuguauucagcuucuaaucacugaguaguccacuuugcuugcuaucauuuucucaagaagaaaaauagaaaaagagacugucaggguuuuguaggagaaaaaguucaaacucagaaugacauuugggagguauauagagugaucuuaguuuccccugccacuuguuuucauagauaaucauaaauugguuguauuucaaguguauacuucuaguaguugcuuuaaaauuauuauauuuauauauauauauauccuaaguuggucaagcugaacuugucaagcuacacaguuaggauacaugguacauaggaagguaaaaucggaugaauaaggaaaggcugcugcugauugguggugaguauagccaaggguacuuuacacccucacggcuaacuuuuccuaguuuagaacaagaaaguuuugauuauguugucccuuggaggccuagaaaacaagauagcccaaaaugaagaugaaaaaguccacagugggaauucagauggacuagaauuagacuagccaguucuauaguucaggugggccagaaaugucagcacuguaguacgugcuuagauucagcuugggcaaggaaugaaguuuagaaagucauauaaagcaguagcccuauaaagagaucaggauuuaagcaaggaggcugagaaagugucaguagagcauucaugggacuagagguugauguuucagauagucccaagguagagaacuaaggcaagggaaaccuaacucaucuuggaggccaguaaugauagcuuuauauuaucuugaccugugcuauucaagaugguagccacuggccacauguggcuauucagcacuugaaaugugacuaguacaaccaaggaauugaauuuuaauguuauuuaauuuaauuuaauuuaaaauuaaauuagaaaacugauaauugauccaguuauuauaaaacuuuuaaguauguuuggaauaacuugggcaugugaaccuaccuuuucaaguguaaauuuuauuaaaucuaaauauagaccaaguauuucugaugagaauuuagcaucuagauugugcuuuguguaaaauauaugcuagauuuagaagauuuaauacaaaauuucaguuauuuauauuauacacugaaauguuaauauuuuggauauauugauuuaaauauuaugaaaaguaauuuuaccuauuuuauaugguuacuggaaauuucaaguuacauauaugguuuguauuauauuucuauuggacagcauuggucuaagcucaauacacuacagccaguuuuauaaguaauguuuaguuauuuuauuguguaaauaagauuuuauuagaaugcagccaagcuaauuuauuaauguguuuuuauuagcuguuuuugugcugcagugucagaguugaguaguuuugacagagaucaucuggccugcuaaaccuaaaauauuuauuugaccuuugaagaaagagugcuaaacccuggccuuaacucuuuaaagcagaggccuuuuuauuggggcccaacugagaaagaaaggagcgguagcaccuguuccuccagucuccuacuuuuugucuguaggcagguuauuucuuauccagggcaccuuuccucaaggaacuauuauuugcaauauaugugacuggcagugggugucaugguaucaacuuacuggauccugacuuaacugccucugucggucagaguuccaacaagaaacagauggcaacacucaaauugagguaauuuuaggaggguuuauuuacaaagggacucauaaagguaugaauaggguauaggaaaaccacagguuuugccuacuaggucaugcgagccuagugcuagcagcagagcagcagagcuguuaucaucucuaggccauaagggauuaggagagagagagguuacuggaucuagaaagagauacuguuuauagaauacgcuaccuugagaagagcagugagcuucauugaaaugacgaaggcagcccaagguggccuuauagaaagggagcaggaauaaguguauauccugacuucaugcuucuuccuuuccuugauaugccaagacucccauuggauugaacccaacugaagcccuacugauguauaucaggucugggauuugacucuuacaagcuaguaaguuagucuuacugugucauggaugcuagcagaagacaagacugcugggucagagacaaaggacuuuauuacucacagcacaggaagcaguaugugcaucagcauauuguguugguucucauucacccuaguucccauuggggugauaugguggacccauauggaugcugcacaugccuuagguuuagguugcagcugaggaacacugagcuuggggaauccgucacuuugguaguaagcaguaaucaagccugugcuugucccagagggaaacauuaccucauccuucaagguugcucacugcagacacaacccugagaagcggcccagguaaggaguuuaggucaaagccuugcuuuuuugguauauacagcaagacauauugaaggacugucuuuuugcagcccauauggaucagcauuccagggagaccagggugaagaccaguagagguggguuuggauuggcagauggaagauucuggcauucuggguccauagcguuaaauucuuauuuggauuacagccgaaucagcaguucuggccugugaucagggugcaauauucuuauuguucuuucucccauauuuucuuaaucagaaggaaggaccuacuuccacaggacaaucuucuuuaggguugcaauauuagaaauuaguuucuaguugugugugugugugguuggcagcuguuaaccaauaauacaagauuuugcuuuguuaccacaaugcucaaaaauacacaaaauccaagcucauaacuuguucucuuuaccgucuccaagugaaguaaucauaaagaacuuuaagcgaucuauuacagcauguuaacuaguauccauguauuauuuuacuuuuaacacacauuaucuugcuauuuuguguuaacugucuucuggggaguggccuccuuauguacuuucuaucugggaugauaugaucauugaaugccuaccugaucacugaaugccuauggagucagguaagcacaccaugaugcauucugggacuaaggaggcagagaagcccuuccagaauuguauugagcuuauuugagagugcuucuggcauuuaaaaaaaauauguauuuuuuaaauaagcaacuuuuacaugugauaacuguguugaaugcuuucaugauuuugcuuuuaguaacauacauugcugucuucaucuuggggaacuaaaccaaccacaggcaaaaauccuuugagcauugauugccacucauaaaggccagguguucuuacguauuucaaauuauaguaggcaucuaguggcucuuaccugcacuggauguuuguucuauauucgaguggcaggaauaacuuccugucagacagugcuugcacagcagcuagacuucagggacugaaaaaguuuuguggacugaguaaaugaauacuuuccuuucaugaauucuaguuaucaccugacaucacuuaaacauugccagaccaauagcuaaaauuuucauguagagugcguugguguaauuaacaagagcaagaaaauauacuucauuuguauuuguguaguaacaggcucauuugaucauugguuuguuuuauuuuaaaacuguguaguagucauauaacugcaguccuucccuuaugguuucuaacuugucuuggauuguuugcuuuaagacuucauaucguuaaguaaaguuacucaacauuauccguagagauuuguguggacugaguuuauaaaggagcagaauaugucauuuuaguucuaaggcuuugauuuugaagaaauagguuuggaauuuauuaauuuauguuaguugaugacaucugcuggcugaggcauaauguagcucagcuuuauuagaaacugugaaaaccacgccuugaaaagaaaguaaaugagagccugaugcugugaccugugugugaaaucugagaauucuucaaacuagccaauucuuaaggaccagaggaaauccaagagcagaaggaaagacccaggaaucaagaggaaaggacuugugguaugcuagauggccaugggcuaugaucucacccucuaucauuuuagauuucaaaguuaaaauauuuuagagggcacuuuuccauuugauuuauuauaaaauuguauuucugguaagaaauaguauuugcuuuacaaaaguuuauuaaccaguuuuguuugagcugaucagauagugaagguaacucuuauuacuuuugauuuuaaucaucucagaggggacauguucagagguuuauuacugacaucagauaguaugauuuaugaauaugauauauuuacuugucuauuguaagagugcagcuauuuggugauauuuaacauugaguuuuuacugugugguagacauugcuuuaagaaauuuacaaguguuacgucauuuacaucucucaauaaucuuauaaaauaggcauuauuaaaauuuuucugaugaggaaaaacaggucaagagaaguuaauuugcgcaagguuacucagcuaauaaguguuaaagcuuguauuuaggucuggaaaguacauuuauaggaguagaucaucugaaaaggaagcauaccccaagucaaaagggaagcaucugauaucuucagccauuuucguagucaaauauugucuuuuucuuuaaauuuuuuuucuauuuucacugguuauaguauuaaaucugccuuuaacuuuuucuguuuuugcuuuuacauggaaguuuuacacuuuuaguaauauuuuuauuuucaauaaacuauauuugagggauucucuacuuuuaaauuuuuaauuauuuuguuuuuuaaaaaauuaaggaauacuucucauaaauaauuuuaaaguacauaaaucucaauaaauuuuugcauacguauacaccccuguagccaccaccuagaucaagauacagacaauuuuuagcacccugcgaggcucccucccugucaguacccucaccaucaccuagacccucaucccuguguaaccauuuuccugacaucuguuuccauuugugacuuuuaccuguuugaugacuuccuauaaaugugauugaacacugugcgcccuuguguuugaccacuuucagucagccuuaaguguauuaaacauccagguaguuguauauaucaguacuuuguugguuuuuuaaugcuguauaguauuccagccugcgaguauaccacaguuuauccauuucugcuauucauggcuauuugguguuuucagcuuugggcuacugcaaaucaagcugcugugaacauucuugcacaugucuuucaguagacauaagcacucauuucuauugguguauaccugggaguggaauuguuauuucauagaauauauguacguuuagcuuugguaggugugacaaauauccauauauuuuucuaaauuuauuuuguauacugauaaccuaugauuuaccagaauauuuucauuucuguuaauaguguuuuaaaaaaccuuugggaaggggaccuaauuagggaaauaguauucagauuguuauaccaaucuauagguagugcuauguagaaaacuuuguuguuuuuuacuuauuacuuuguuaauaccgauuucuaccuuguucauagacuaauacuagguucuguaagagaaaacaaugaaguacagcccugcuuagagaaacuugugguuuagucagaaaggcaggaggaugaaagauaagcaauauaaggcagugugucaguggcauaugauuucuauagacaauaugugcucuaggguggugaagaguagucacuagacuggaaugauuggauuggaaaaggcuucauggaagaagaaaacucagaugagccuuggugaguggguagaauuggauugguaggaaugguucaugaacaauguuauuggaaggugagaaaagcuuguuggguaacuaaauuggccugccugaaaugaaaaauuggaguugggagugauggggcgauaguuggaaaaguagcuuguggucaagcuuuggaaacuuuaaaugccaggccaagauuuuguuuguuugguugguuuuguuuuguuuuguuuuugaggacccaaagcaucagaauuguacaaacuauucucuuuccuauugcauuuucccuugagaacaugaacugacaaggaacaaggugaaggaguuugacuggacuuuagggauaauauaacucccuuaaaagaaguguuaaaaugaaggagagauuuuacaaauggcaaguagcauaaaaaaugggaauuguaaagaauuaguauagaugauuuuugacuggggaaacuuaaacacuaauuacuuucagaaagaauuugagaugauuuucuuuaguaggggugauagugguaaagcccuucuaugaaguaugugauggauuggacuacuucugagagcccuuucuucucuuaaaaucuuacgguaaaaguuuuugaagaaucauauuucaagaacuuuuuucuucuuccacauuagcaucuucagauaauaagaaacagauaccuaaugaagcuucugcuagaagugaaagagacacaucagaccuagagcaaaacuggucauugcaagaucauuauagaauguauucacccauaauauaccaagcccucugugagcacgugcagacucagaugucacugaugaaugacuugacuucaaagaacaucccuaauggaauuccugcuguaccaugccaugcucccucucauucuggugaguacgaaugcuguuuaaaaaucgugaguguaaguucuaauuaaauugcuugguuacuguauaaaaaguaggauaugugauuaauuuuuucucccucuuacuuacagaaucucaggcaacuccucauucuaguuauggcuuauguaccuccaccccagucuggucacuucagcggccacccugcccuccaaagguucauucugugcguacaguucuuauacuacauaaguaacuauuugcuuauagcagucauucaggagggacuguugaauuuauugcuuauaacuuaaugcacuaggauuuaaagaccaguuguuuauuuuuuuuugcuauaaaaguuuuacauguuuauggccgagcgccguggcuaaacgccuguaaucccggcacuuugggaggccgagguggguggaucacgaggucuggaguucaagaccagccuggccaacauggugaaaccccaccucuacgaaaaauacagaaauuagcugggcaugguggcacaugccuguaaucccagcuacucgggaggcugaggcaggagaauuacuugaaccgggacccaggaggcagagguagcagugagugagaucgcgccacugcacuccagccugggcuacagagugagacucuaucucaaaaaaaaaaaaaaagaaaagaaagaaaaguuuuaccuauuuauuaaugacaauaaugaaggagaaagaggggaagagaucaguaggaggaaaaaaaucaaccauacugaccacccaaguacaacugcuguugacacacugauagaguucuuuccaaucguuuaauccucuguauagguuuuaguuucugguuuguauuuguuaacauuugcuuuccuuuuaaaauaaaguuauaagucaacaauacagucuuauauacugcugcuuucacuuaauacuuuauuaaaaacauguuuauuaauauauacccuuugaauuuuuaauaacuuguuaauacuguauuuuuuggauauaccauagucuguguaacuacuauaugguuaggaguaguaaccauauauuugaguuucuuauaauuaauauuauuauuaauaagcaaguuuuuaauaucagaaacuuacuaauauuuuuagcuuaaaaguaaguuggauuuuuuuccucagugcaauaaagauucuuguuuuuuaaagcuuaauuuacccuguaauaugggagcauuacaaggccaugacuaaaauagacuguuuacaaauaccacagaugguuuaaaagcaucaaaaauuaguccacuuugggaaauuacaucauaagaaaauaaguuuaaacauacaaaaaguuuuugcacaaacauauuuacagaaauguuucagcagugaaaaacuggcuguuacuuaaaugucuaacuguaugggaguaguuacacagacuauaguauauccucaaaauauagugguaacuacuuauuaaauauucacaaaaugaauauauuaauaaacauguuuuaauaaauauauuucauauauuugaguuuguuguaauuaauaccuacaaaugagugcucauacuucugaagacuuguuuuuaucuuucuuuaggaaguucaaacugauggcaacagucaguuugcaucacaagguaaaacaguuucugcaaccuguacugauguucuacggaauucauuuaauaccaguccuggaguuccauguagccugcccaaaacugacauaucagcuauuccaacauugcagcaacugggccuuguuaauggaauucugccacaacaaggaauucauaaggaaacagaccuacuaaaauguauucaaacauauuugucucuuuuucgaucucauggaaaagaaacgcaucuggacagucagacacaccgaagcccuacucagucacaaccagcuuucuuggccacuaaugaagaaaaaugugccagagagcaaauuagagaggccacaagugaaagaaaggauuuaaacauacaugugcgagauacaaaaacagugaaggauguacagaaggcaaaaaaugugaacaagacagcugaaaaaguuagaauuauaaaauauuuguugggagagcucaaggcccugguagcagaacaagguagaugggacuuauaacuuucuguaguaugguguuauacuaaauagcaaugucauguuauuuagcuaucauuuaaauggaguuugugguauuuuccauagaacuguguuuugagcuaauaagaaaaugaguucuacuuauuguauuauuuuuuaaguuuugaucccuucuuuccuguggauuuaaaaugcguuugagaaugucaaacauucagucuuuugcuugcaaguguguauuuauucugcuugauaauagaccuugaaaagagucaaccaaagagaauuuggacagauaaaaauuuuaauuagagaaugccuauaaaugauuaacucccugaguagacugauuauucuuccuguuuuaaaaagaugcagagaauucuuuccugucacuucuuuaauagccaacuguuagauuguuuaacaaaucucacuuugagaaguaacgcauaccuucuuaugcccuuuucaguguauuuuuaggacuuuuuuucuuaaaucaagguguuucugagccagauucuauucauuuguuuccauucuguauauguauucuauaguaauggcuuuugcuugaaaugaguuacaguuuugucaucuuggaaacacaguaauugauuuuggaagcauugauugaauaccuaacguuugcagaccaaaaaaaaaaaaaaucuuaaaaugcuauauaaauguagcaccauuagaccaaagauuuaguauauuaaaauugcucuguuuucagaccuucaacuuauuaccauuuucacagucagauacauaaucaugguaauaauaauaauaccauuagcugucauuuauugaacacuuaccauguguccagcacagugcuaaguguuuuauaugcauuaucucauuuaauccucccagcagcccuaugugguacuguuaccacucccauuuuacugaugaggaaacugagacuccgucucaaaauaaauaaauaaauaaagauugguagaagacugcuugaucauugaacacaguuguuuacuguguacauauacuuuucaugaggauguuaaaauaucugugaaacugaauacauuuuuguaacuuagaauacacuuucaacuucuagguuaucagaugauuaauaaauaauuuuaaguacuuucagcccguaguaaauaugaaugggaaugaggggacaaagauaaaaggcaaaagaauuaauaucuaccuucuaugccugugucuguuugcaaucuccaaaaacaucuacuguccacaauuauuaacaaacuuuugaugucacaucaaaugagauguggcugcuuguguucaaucuacuuuagaaaauuaaguaaugaaacuaucuuagcagacccucacucaauauuuugccauauuaacccccuaaaguaaauuguuugcuuaugccaggaucaaagguuguauuauaaauguuaauacuauaaccaguuauaggaaacccuauagcaaucauaggaguccacugugguccuuuguaacuauggacuaagaguuuuguguaagccacauuccuacuugacucuugaacugaaaaaaaaaaaaucacuuauguaauaauccugugauuuaagauuaaucuuuaguuuacugaacuuaauuucuuuagaauucugaggaaacaaauaccagcagcaugaaagagaaaaauggaaccuguauaauaaauuuauaaauaauugaguugaauuuauaacaagaauguacauaucuauaaagauuuucuuuuuuaguaauacauacuaauaaucuuguccaaaaauauaauauugauuuuacucauuucuguugccuucuauagaggauucagaaauucagagguugauuacagaaauggaggcauguauaucuguacuuccaacaguaaguggaaacacagauauucaaguugagauagcacuggccaugcaaccauuaagaagugagaaugcucaguuacgaagguaagaauugcucuuugaauauuuuugucuguaugcaaagaugucuccuggccagaacaaaggugcaaaugacauaccuaggacuucauaaguaaaauuuauuugcugucuuacuguauuucuacuuuucuuccucauuuuucagagauuuccagcauucucuaacucuuccuucugcccacuuguauguauuuucucccacuuauuuuaccccuguugucacuugguaguguguaggcagaaaaaugaaguaccucuguauauuuaucagacuagucuaaguuaugcugcagaaacgaacuucuaaaucucauuugcauagcacagcaaguuucuuucucccucaugccaagacuaacauggaucauugguggcucuuucaucaugugacucaggauccagacugccuccauuuuaugaagccacugucucaguauguguugucuaggaaaaagagaauguggaugugguaaugggggagucuuacauggcucaacccagaagugaucguuucgcuaccacuuauauuuuauaggcugaaacaaggcacauggcccugccuaauagaaaggucugggacauuauguuaaaagcaaacuguuuuucuucugcucucacaccacagcaaucgacacagaacacuuauaugaccaaauguguagggauuucuccccaccagcaagcaaacaaucaguucugcaacagacaccaguuggguguccuccaguucaauuccaacacuaucuaccuggaaaugguaucagaucccacagguugagagcucaguuccacaagacugagcucuacuuccaaugccaaucacaagccccagguuauuuugccuguguuucugacugauuggcuauaaaucgaaguucccuugaccuccuucuuugggcucaguuaauuugcuagagcggcucacagaacucacggaaacacuuaguuuaccacuuuauuauaaaggauauuauaaaggauacagaugaagagaugcagagggcaagguauuggagaaagggcauggagcuucuaugcccucggugggugcaccacccucuagaaagcuccauguguuuaucuggaagcucuccauacccuguccucuugggccuuuuauggaggcuucauuggauagucaugguugaaucauggucagcugugaagaaaugugauuugacaaaaaggguaugaucuaauagacagaguggggaaacccaagaaguucugucuguucaaauucuguuugaccucucuggggagcauuccuuucuccucaguaugaggcaggucuccuucagaaaugggguucuuaugaccuacaaacagacaagguaggucagagaauuuccuuauggccagcuguaagaaaggugggagaagauuagaguauauuuuuaguuccuauggccuacaauggggaggaaaaaggagcaggugaaaggauggcaagagaagguuagagagagagauucuguuuucugaggccugcuucugaggccuaaaguaccugaauauuaacaaacgacugucuuucaccuuuaucacugaagcuggucugaagcugcuucaggaaccagggacaaaaggccaaauauuuuaauaaaagguauguuuuugguuuugacugcuuaacaaauaacaagggcuguggguguugacagccaggaacugugaaugaaaacauauauauauauguauguguauauauacguauauauauguguauguauguauaugcaguaauaaacauacacacacaccacacacauuuauauacaauauguauauauaaaaauauauaaaauaaugucacagauauauacuuacuucuauacacccaggaaggaaaggagaaccuuaguaagcacucguguagccccaccacacuuagacauagaaaaaaguaaaauucuuugauauuuuuucuuuuggucaucuuaacuuguuggaauuacauucuuaauuuguuuaggaaagauguagaacagggaucuaaucuugaaauauaaaaggaaucacccacauauuagcaauaauaucuuaacuuugaauguuucagugaugaccaucaaggccaacacuucagugucuauuuauuaauacacuuugcaaaauauuggaguacauaucaggugcuucugcagcacugcaaugcgaaugugcccugagagaguguuacagcugcauaaguuauagacauuguguaagauaugaccugcaaggaucuacacaaauuuuuaaagaaacuggaaagcaauuaaauaguuggagcauagcuaaaauauacguaucuggagccuguagaggcaugauagcuagugagaugcacucauuuaggauucuuugucuagaggucauuauccuguagcuacuacgauauaagaugggguugcuggguuuaagaucuaauaucaucuuuagucuugaccuaaggaauuccuauuaccagcauaaauuuuuaaaaccaaaagugaguaaauaauaaaauaaugaacagcaaauacugcuaacauuuauugaauguuuuauauaugccagacuauuguccucgauaugugucaccucuuuauaucuucacaacagcuuugugaaauaggugcuauuuacucgcauuuacagaugaggaaaugaaggcacaaagaguuuauguaacuugcccaagguuauauaucuaagaaguuaagagucaagacucgaacccaggcaauuugguuuuagaguacagugaucuuaacuuguagacuuuuacacugucucgguuaggaaguagagauuuaauuauaccucacuauuuagguguauuuuguggaacauagaauguauuguaagccauucaaaguaaacaagcauauuauuuaaaggaaugacaaucaaauaauugguuccuuaaauaaggauaccaaaacuuagucugagaauauuguauuuuaacauugucaccauggaaaauauuagugguucuuauuuauuucgguuccuuagaacauuuuuaaauugccuuaggagcuaauucauaagccacucaagaaaaugaaguuuacuauuuuaugggccaccacuuguuucuaguuuuuuuaaaagguauuuguuugaugucugaccuaauucuucaacuggcaccagagcuauuuggcuggcugucuuuacaggacaaagauuauauagcaugcuauugccacuguuguuuacuugaccuucuaaaagaugaaauaacuaaaaaaugaagaauuuauuagauauguucuuuuuagcagaaugagguuucuggcaguaguguaggaaaguuugugccacuuugguaaucuauuuggaaagaauuacccauuaucuccauuacaaauaaaaauuggaauacauugguucauucgaaaguguuucucaucauuuucaauuuuuaaagaaguauuuuuuuuuuccuguuuagauauuuggaaacuacauguuucuuuuuaaccacaucuuucaggacuuucuuggaguuuauugccaucuuguggcuuaaaaaauagcuagaugcaucguuucuaugauauuuuggcauuuuuggcauuuaggcuagacaguuuuuaaugugucuucugauauaguuauucagcauuuagccuuccugguccccaaccacuaaaugucuguggugccccauuaauuuugaccaccagaaggccuggcacauuuccaaauuuccuggaugggaguuugguggguauuaccuccaguuaagagccauugagcuagagagugccaagaauucaugaccaccuccugauauuaaacucaacuaugagaccauuauguagccacacagaacauaaaaaugaaacgggagugaauggaaggagucaaggaugauguucagguucugucuucauaauuuaacaaauguuagcauaauucuuccagaugggagcuacuagaggaagaauagauuuguuuuauuucauacuguuaauguuuuuugaguuaggcaagguaauaggagagccugugaguuaagauuuagaccugcugaguuagacugucuggaguacaggaacaagaugaaagauggaaauguagacucgggaauuauucucugaacauguuuuuauugagcuuuuuguauagaucuggcacuguuguagacacuggagacaaucugauugaaaguaagugaucuguuaccagcauauaaguaagugguauauucaccaagaagguagagugugugaaugcagugaaaggugaauugcuggggaguaacaacuuuuuaaggaaagaacagaagauuaaaauuaggagagugacaucacaaaagucacaggaagaaaacaauuuauaggagagauuuugcauagcauuaaaauaaacagacaacaagaacaaagguagguccagaauaaauaucacaagacaaauuacucaaagaacuucagaaaaacuuaaaacaguauuccauagucucaaggaaauuaaagauaguaggaucucuuacagggagaaagacugagauugagacaaagugcucaaagaagaaaaagaaaaagagaagaaaagugaguuaagugaacucagaaaaauaaagcaaaaaaauuacaaaaaugaaagaaacaaauguaaaaucauuaauaaacagacaaacucagggauauuguaguccacuagaacuuaaguauugugaagccugaaguuuuuuguuuuguuguuuuuugggcuuuuagguuuuuuucccuaagucuuucuguuuuaauugcuacuaaauucauaguucagugucuccuacuacccuuagcuucuuccucuuccuaaacccuuuaaaaaauuuuuauuuuuauuaugguaaaauauauauaauauuuaccuuuuuauuuuuaaccauuuguaaguguacauuucaguggcaauaaauaaauucacaauguucuguagccauuaccacuaucugugccaaaacuuuuucauccccaacaugaacucuguacccauuaaacaguaacuuucucuucuuccuuuucuuacuuccucguaaguucuuguuuuuuguuguuuuugucucugaauuugagaaggcugaaauuuugucgcuuuauaguuugcaacuauauuucuagugcuaggaauugugccuaacacucacucuaacaaauauuuguuaaauugacugaaugcaugguagauaagcuugagggaaucacacaaggcaaaauagaaaaagaaugaucuaaaaauuauuaugaagaagauaauacauaugaaaaagaaaauagauauaaauuaguguuccugaaaaaagagaacagaacaaauggauuaaagacaauauuaagauauuuauaaauaaaagggaaaauuuucugguuguaccacuuuauucuagccugggaaacagagcaagacccuaucucuaaaaaaaaaaaaaaaaaagaucugugucagcagaugaauaggacauagaagaucucagaaaaaccaugcaaaacaaucaacaccaacacauaugcugguuaaguuacuacacccuaaggaugaaaaaaguuaauuuuuggaggcacucaaaagaaauagaaaauuauguaugaagagaaaaauuuuaggcuaucuccagccuuuccacggugauuuucguugccaggggaucauagaauaucauuuacaaaguucugagggaaagaaaguaugccccgagaaucucuaauguggucuagcuguccuuuuagugcaaaggcaacagucauauucucaagugugcaagaacuuaggaaguuuaacacccuugaacuccuuuaaaaaacaaaacaaaaaacuugaauggcaaaguccagucaaccaaaaggugaauucaaacaaaagaguagacagaugugaacauugaaucuauacauaaaacuaagacaaccguggaaauuaugguuauagaucagaauguguuaguaaucuugacaauaugaauuccaaacucugcauuuuucauauccuauuuccuaaauuuuagauuacuuaggaauaauauuucuugaaguaaagaaauauuugccuaaucaguuuugguuucacuuguuaauuucuuuccauuaaaaucauguaauccuaaauucaaugcauaauauuuuaaaauaguuuuuguaauauuaucccauuauuuuaaaauucuucuuagauauuuguuuuuuugucucugcauaugcuggagaauguaugaauguuauccagcaaauaaugauaguuauuucuguuuaacaaugugcuagacguucuaacaagugcaguaaggcaagaagaaauaaaagccagccacauuggaaaggaaagaaguaaaacuguuuuguucacagaugacaugauaacucuuguagaagauccuauggaaucuacaaaaaugcugcuagaguuaauaagaaagcuuagcaagguugcaggauacaagaucaauuguauuuuuaugugccagcaaugaacaauuugaaauuaaauuuaaaaucaguacuagaguagcaucaaaaaaauaugaacaauuuagggauaaauuugaaaaauauguaagacccauacacugaaaacuacaaaauauugcugagagaaauuaaagaucaguauaagugagagauaaaccagauccauaaauguaagacuuaagauaucacuucuccccaaauugauguauagauuuuauguaauuaaaguaaaaacccaagcaugcuuuuuaaaaauauuuaauugaagcugauucuaaaguuuacauggaaauuugaagacucuaaaguacccaaaacaguauugagaaaggaaaaccaaguugguacuauucaauuucaaaacauaaaggaauaguauucuaagaggugugguguaaaggugacaaauagaucacugaaacagaauagagucuagaaacaaauucacacauagagauaguguuuugcaaagauaucagagaaauucaguggggaaagaauacucuuuucaauaaauagugcugaaacaaugagagagucauguuuuuaaaaaaugaaccucaaccuuuaccucauacaguauacaaaauugacuugaaaugaaucacagaucuuaauguauaaacuaaaacuacaaaaccucugaaaggaaacguaagagaaaaucuuagggauuuuggauugggaaagauuuuaaaaauacaacacaaaaaauauaaacuagaaaaaaaugaguaaaguggacuucaucaaaauuuaaaacuucaguucuucaaaaaacacuuauuaaaaaugaagaagcaaccaacagacugagagaaaauauuuguaaaacauguacccgauaaaggacuuguauuagaauguauaaagaacuuaagacaguauaaauuuuuaaauaucaaguugaaaaaugggcaaaauauuugaacagacacuucaccaaauaaguggauaucaaauaugaauaucaaauaagaauauagaaagaugcuuaucaguaaugauuaggaaagugaaaauuaaaaccaugacaaaauaccacugcauacccauuagaauggcuaaaauucaaaauuaauaaauguugggaugugaaggauuucacaauuaacugaugggaauguaaaauaauuugaacacuuuggaaaaaaaguuuggcaguuucuuagaaauuaaacauauaucuaacauaugauccagccaguccacuccuagauauuuaagagaagccaaagcauguguccacacagaaacuuguugaugaguguucauaggaaacaacccaaaugucuaucaauaggugaauggauaaacaaauagugcuauauccauacaguagaauacuacucaacaauaaaaggguaagaacuauugauacaugcaacagcauggaugaaucccaaaauuacuauguugagugaagccaggcuaaaagaguauauauuccauaauuccauuuauauaaaauucuagaauaugcaaacuauaaauaagugcuuaucugggaggagagaguuaugaaaagggcuaugaggaaacuuuaggggugaugaauauguuuuuugaaaaauuuuuagcuuugaggguacacgugaagguuuguuacauagguaaacacgugucacaggagguuuguuauacauguuauuacaucacccagguauuaagcccaguacacaauaguuaucuuuucugcuuuucucccuccuaccaccuuccccucccuccuaccauccagaccccagugucuguuguuuccuucuuuguguuaauaaguucuuaucauuuagcucccacuuauaagugagaaugugguauuugcuuuuguuucugcguuaguuuacuaaggaugauagccuccaguucccuucauguucuugcaaaaaaacaugaucucauucuuuuuuauggcugcugauggauaucuuaauugugauggugguuuuacuacaucauauggcagaaaauaaaaugacacacuuuaaauuuauguaguuuauaguaugucaguuuuaucucaagcugucuaaaaaaaaaagaaugacuugaauaaaagaaauauuugccuaaguagcagcaguucuuuuccuuuuuuaaaauccaguauauuuaaauuucguacauaucuuaaaauagcauguguaacaucaauuuuuaaaauauccuuuuuucuguuuuuaucauguaucauuuuaaauagaauauuuuuuuaaaagccuagcccugaaagcagggaaugagaggaaugaaaguagcuacuuguacaguuagguuggagggaauuuuuuuaaaauaugggaagaguuuuaauauguuucuuggcuuaggcacaugaacuggcaaagagggagaaacugcagauacagaagauaaagggagugggauaggagcagaguccuugauggucuaggaggagaaugggauccagggcacagauaaggcuacucaucagacuagauggaaaaaaugagggcuaauacacauauggauacacccugggaccaaaggaugacuguguuuguccccaaaccacauuauuuuuagugaaaaaaggaaaguauacaauugagaagaggaggguaggaaugagaggcuugcagugaauuauuagaaguuuagauugguuacguuugggaagagaagaaucugaccagggacauacaaaaggauuaucgaggaaagcuucuguuguaaaggggaaaccuuuaaagaaaaucagaauuuuauuaaaacaaaaauaagcucacauuauacuguuguucugcagcuugcugcuuucacuucauaaugugucucagagaucuuuucacgucaguacaaguggaccucucgcuuuuuuuauuaucuguguauuaguauuucauauauggauguaccauaauuuauguagcauuuuaaguuguuuccaacuuggcacuauuaaauaauugcuguugugaacauccuuguauguaucuacaaggugggagaugcuuuugcacauguaaaacuguuucugaugcuugauaaccuagaaguagaauaauuuugucagagauuaugaacauuuuacauuuuguuggacauuucaaacugccauccagaaugguuauacugauauaaucacaugaauugaguuaauucauuuccuguacuaucaucagaaaauguuauuucuuuuuauuuuugucaauucuauggccaaaaaguaccuucuuuuaaauuugcaauucuucauguuagugaagaugagcauuuuuaucauaugcuuauaggccauuucuauuucuuaggugaacugcucauucuuauccuuugucacuuuuuacuagguugccuuccuuacugauuuguaggaguucuuuaaauguuauggaccccuugucuauaacauaugugcagguauuuucuuucaggcuuuuaauucuacagguuucaaauuuugcuaugguuaaaucuuucguucuuuuccuugaugcuugcuggauauugaguuucacuuagaaaugccuucccgacuucaagauuauguagauuucccccuaaaacuuguauaguuggguuuuguuuacauauuuuaucacuuuaaucaacucgaaauuaauauaugugagugaugugagguaggguacuaucauuuuagaguuaguaccaaaaauaaauauuuuaaggcaaaauauuuuuagguaaguaauucuggaaagauaauagagguaacuuuuguccccauaagcgauaacuucuuagaaguaaagaaaacacuugcauauguuucuauuugugaagcagauacauauugugaaguucauuguaacagggcagauuuguagccuguuaauauucucguuacuuaagaccauuaacuuuuccaucuaauaaaauuauuagaagcauagauuuguguuucagcauaugacaaacaucaggcagauagaugucugauagcagucagugcuuguagguauucuaguugauaguaaugacaaaucuuuuaaaaaguagaugauuaacuacagugaugaagauacacagaaagacgaugagaaacagcaugagcagauagaaaaggaaagaaauagaaaaaaaacaacaaaucacugaagagacaaaaaagagaaauuaacacuuuccucaugaggguuuuuuuuuuuuuuuuuuuuuuuuugaggcagagucucacucuuucgccaggcuggaaugcaguggugcgaucucacucacugcaaccuccaccucccagguucaagcaauucuccugccucagccucccaaguagcugggauuacaggcacgcgccacuacgcccagcuaauuuuuguauuuuuaguagagaugggguuucgccauguuggccaggcuagucucaaacuccugaccucaggugauccgcccaccucgaccucccaaagugcugggauuacaggcgugagccaccgcgccuggcccaugaggggagguuuuauguuguuucaggcaaccuuaaaaauuaucucaggccucauaauaauaguaguaugguuuuguuuuuguuuuguuuauuuaguuuuugucuuuuggggaugagauggacuucugcugucuuaguggguuuauguuuuaucuuuuuugauaggcuaucacauguauacuauuaaauuggcuugguaugcuugcauucauaguucuucauuauuucuuuaggcaguugagaauuuugaaccagcaacucagagaacaacagaaaacucaaaaaccaucuggugcuguggauugcaaccuugaauguagguaaaagaacuuuaaggauugauaaauuauuuguggcuccggaaauguugauaaagaauugagcuuuuguaauuacuuugaggggauaaauuuaaaauauuguagaaacauaagaaaauaaaagaugcugucacuucccaauaauauacaccuuuuuuuguuuguuuguuuugaaauacaggaguguguuuccuuuuacauaucuucucuucauauauaauugauuuauuuaacacuuacugaauaccuacugugugccaggcacaaauagaacuauauauguacuuuuuuaaaaaugagaucacacuguacauacuuuuccacagcuucuguuuauucacuuaacauauaauggacacuuuugucuaucaaaauacauaauuaugcaucuuucucuuuaagaauuacuuggguauucugcuuauccaggucuaccauaauaugguccuuugcuaauaguacuuuccccuuuuuucccagugcaaacaacauugcagugaaaaucuuuguauaugucuuugugcauauaugucagcuuuguuuguuuguuuguuuguuuguuuguuuguuuugagacggcgucacucuguggcccaggcuggagugcaguggugcgaucgugucucacugcaaccucugccuccaagguucaagugauucucuucccucagccucucaagugucugggauuauaggcgccugccaccacgccugucuaauuuuuguauuuuuauuagagacaggguuucaucauguuggccaggcuggucuugaacuccugaccucaagugauccacucaccucggccucccaaggugugggauuacagacaaugagccaccacgccuggccagcauuuuuguaggauagauuuauagcaguagaauuguugagccaaaggguauauacaguugcaauugugacagauauugccaaauuguccuuaaugaucacagagcuuaauaaagaaacuauaauaguaccagaagaaaauauaagaauuuuuauuuuuuuauuuuuuuggaggggaacuuuuccuaagccugacaaagacucaaaugccacagaggaacagauugauaaaauauguccccagaaaacuuuuucaguuucuacauagcaaaauuauaaauacauucaaaacauaagcaaaauggagaaacaauacaugacaugaugaaggcuuaaucuucuuaauauauaaauaugucuuauaaaucaauaagaaaaaaauaugauugcccaacagaaugagcacuuuauaaaaguguucaguuucaccagagugauucagaaauuaucacugugucuccacuguuaaccaaaggugaggaaagggagaggguaggagagaggaggccuagaggacaaguggggagaucaguaguugccacuuuaaauagcuucucuuauuuauauuaucugaucauuuaucuuauuguuucuuugagaucauuacuguguauaauuacuuguuuguuaucagcucugugagaacaggggccacgucuguguuguucaucucuguauauucagauucuaauacaauaccucacacauaggaagcauucgcugagcauguauuugcucaacaaauggugccauauacuuuuaucgccaugaaaaagaacgugauagaucuauguguuuguauacaacagucuuaugggaaaaaaaggcaaaguuagaaauuguguauaguauguguguguauguaguguaauuaauaccauauguaaaaguguuuucacgaaagauaccaaaauuaauacugauugucucuggggacagagaggaggaguggaagggagauucuucauugagaaucauugacauucugugguguuugaauuuuuuaacuuuguacauguauuauucuuuuaaaaggauuauguauucuuucuuuuaaaaggguuuaaaaaauuaaugcuuaaaaugucaacuggaaaagaaagguaugacuucugccaaucauuuuuaaaaauauauguaguauuuauguagaacugcucaugcaauuaaucguuaaacaaaaucaauaaauuucaggccuuuuuuuuuuuuuuuuaagaaacagguauuuuccaaguuuguacuuuuuagguuugggaaacaacuauuugauccauuuugucuuaacaguguuuucucuucagucauugaauaugucacugcaaaaucaauuggaggagucacuaaagagccaggaauuacugcagaguaaaaaugaagagcuguuaaaagugauugaaaaucagaaagaugaaaacaaaaaauuuaguaguauauuuaaagacaaagaucaaacuauacuugaaaauaaacagcaauaugauauugagauaacaagaauaaaaauugguacguauuuagacaguaguuauggucacaucuuuuaaaaggaauaaggaaacugaaacuuuuguuguuuuagaauuggaggaagcccuagucaaugugaaaagcucccaguuuaaguuagaaacugcugaaaaggaaaaccagauauuggggauaacauuacgucagcgugaugcugaggugacucgacuaagagaauuaaccagguaaaauugacuuccuuugaauaacucaugccuuuuuuauuuuuagauguuuuuauaaacuucaaaauaauguuagaccuguuuucucccccauaucuuuuucucuuauuuugccaauguuuuugcuaauuucuaaugauguuuucuucuguuccaauuaaauuaguuuaggaauuucaaaccuggcgaaauguuuuuuuaaaaccaugugauucugggcaggggguccugaugagaagcugaagacuuguauagcaacaccauugagcccucugguucugaagcuagagagaucugacuggaaucccagcucugccacauauuagcugaguaacuuugagcaagccauuuaacuucucuaaaccucagcuguaaaguagggacaugaauagaguugucaugggaaacuaagaaaucauucaugaaaagcacuuagcaugguaagcccucaugccauaugaucuuggguaagucagccucuuucagcauuauuucaucaguuaaaugagugaguuggcaguaccccuugagaucacuucauucccuaacaguauuuuucuaaaauaaaauuaccucacucaauuuuucuaugauauucacuuacaaaauucaguuuucuuuugagauauuugcuaagaauuggauucucaacugcuuuuuaaaguucuaggcgagaagucaguuaucugaggccuaaagaucugcagaucugacuuugucuucgaaugauccuagaaguuccaaauauaaaauaaucuugaauauaaaauaaucuuccuuguguuuccaaugaacagaucgauuuugaauuuucaacuuccccccucauuuugaaugauaaacuuguagggaagcaaaugaaacaguaauauauaacauuuaauuuauuaauuuaguuuuauaaauguauuugaaauuaaugaucuguucacauggaaauauugcccuuuuuccacauuuauauuucauaggauauuugcauucaaacuuuuauuuaacaauggcaaaagcaagacauuuuuuguaaucauauaauuauaauugauuagguucuagucagagguucugaauauuggcuuauaccagucuuauucaaaauaaaguaauagaaugucccuucuuauggaagucuuuguaagguaucccaaggaauguuuccuuuuuucuaaggaauaauuuuguggugagaauuuuguuagugucaaguauuuauacuaagagaaaccaguaacaaaaggccacauauggugugauuccauuuauacgaaauguccagaauaggcagauucacagagacacaaaguagauuaguaguugccaggggcuggaggaacccagggguguagaaugggaaaugacugcuaauggguaguuucauuuaggagugaugcagauguucugaaauuagauaguggugacaguucucaacucuaugaauauacuaauaaccaccaaauuuugcacuuaaaaggaguagauuuugugguauguaaauuauauguugguugcagggccucaugccuguaaccccagcacuuugggaggccgagguggguggaucgccugggcccaggagcucgagaccagccugggcaacacagcaaaacccugucucuacaaaaaauaccaaaguuagcugugcguggucgugcaugccuguagucccagcuacucgagaggcagaagugggaggagcccaggagguggaagcugcggugagccacuaucaugccacugcauuccaacgugggcgacagaguaagacccugucucaaaaaaauaauaaauaaauauauuaaaauaauaucucaauaaacuguuauuuuguaaaaguuauauaugguauacagucuguuuaguaaagaaaaaggaagaaaagaaaaaaauagugagucagcauggucaagugccaugagaguuugcuuaggaguuacuaugagcaucugcuucauucuaaggggcaacucuuagccccaagcagaaaauccgaugaagcggaggauguaguucucugguaguuuuccuuccuucucacaaucuuuuuugucauacugcuaaauucagcuucuuuauggguaugaaaucacaagcugauaucuuuuauuuauaaaguacuuugauuuuuuucaaaguucugucuuuccuaugucauuuuauuuguccucaucuauggagggaagauuuuaguaucugcauuuucauagaugggcaaacugaggccacgcaaauuaaguauuaguagaauguuaauaacagagcugggacuagaacucacaucuuuuaauuucuagccagauguuccucuugcacauggaguggcuuuagccauggugacaacuccaugccugauuuagccuaaguaaacguuauaauuuuuuuaccugggagguagacggaugaauggauggauucguuuguuuauucaacaaacauuaauuuuguauuauguuccaaauauauaugugugaagcauacauaaaaauauuuaauuacuuuuaguugcuaaauauccacauugacaagugaagagcuuauucuagugcuuuacugacauauguagggauacaucuuuuuuauuuauuuauuuauuuucuuugagacauagucucacucugucgcccaggcuggagugcaguggcgcuaucuuggcucacugcaagcuccgccuccuguguucacgccauucuccugccucagccuccccaguagcugggacuacaggugcccuccaccacgcccagcuauuuuuuuuuuuuuuuuuuuuuuuuaguagagacuggguuucaccauguuagccaggauggucucuaucuccugacuucaugauccaccagccucagccucccaaagugcugggauuaccagcgugagccaccgugccaggccagauacgucuuuuuuuaaguaaaugcauugcacauguugacaauacuauucaacauaugcaaugcauuuacuaagaaaauugguaacaaaaacauaagaaaaaucuuucagaguaacaguauaacuuuucuagaaauuaguagaaauggaagcccaaagaaaaaagggacuuaccugacuuucacagcuagugucugaacuaggaccagagccaggauuuuggauucugucuucagcuuugcuuucuguuuuaaagaggacagcuuuucucugaauaaagaugcuccauuauugagggauucuucuaccuguguaggagauacuuuuguaccugcucauucuuucaaaauaacaugcagucugccuuuuccauuguuuauucagaaugaaaaaauguaacuggagccuuuuuuuuuuccuuaacauuuaucuaacauagaaguauaggaacugaaaaaguucauuaauucuugcuauuugccuuuauaaaaggcccugucuagaauauuagauacagacuuuugcucuccuuuucguaagacuaaagaauuuuccuaucaguuuuuuacauuuuuguuaagcacguuuuuaugcugggcauaaauccugccucaugacuacuagcucaccugucagauugacugcacucuuaugaaugauuguaaaaacaugaugggaaggcuuagcacaguaucucauguagaguuuagcacuaucccuacauuuucuaaagauuuagaaacagcuucaaaauucuaaguacguucauugaugucaguuuuauacuuuuuuuuguuuugaggcagaaucucgcucugucacccaagcuggaguccaguggugcgaucacagcucaguaccgccucaaccucccuggcucaugcaaucuucccacuucaggcucccaaguagcugggaccacaggcacaugccacugugcccagcuauuuuuuuuuuuuuuuuuuuacuuuuaguagagacgaggucucgccauguugccccagcuggucuugaacuucuaggcucaagcaguucucccaccuuggccucccaaagugcugggauuaccagcacacccagccauuguuuuguucuuuacauuaaaacaaaacaaaaaagucucugagcuuaauuauaucuaaauucauccacauuguugauuuauaauuucuuugaugacacccuaugcaauucaauugguuaggaacaucucuaguacuauaaguggauugcugugaccauuuuaauuuuacuuuggacguuagaguguaaagcaccagcauccgacaguacagauaaaucuacaugcucuucuacuccuucacucuucccauagucaccuuagucagauaggcauaugguuuugguauguguguuuuaaauaaucuccgaaaagagauuuuguaaaauuucugaaugccuuucucagacuuugggggaggaguaaugggacugaaagguacauguacaaggucuaaagaaauaccacaaacccucuuucuuuuccuucuccaaccuuuaaugauuuuaaaugugccugugucacuuuuuuuucagaucuuacuacaacauguuauaaaaccauuaaaaugugaggaaaauuaauauuuuaaauauuaauuuaaauaauauuuuaaauauuaauuuaaauaauauuuauauuuaaaaauauauaaauuaaauaauauauaacauuauuuaaguaaauagugaauaguuucaaagagcauucuuacaaguacucauaguuauuuaaauuaauauauuuuuguaaguagccuagaaagaacccugcauuuguuaugaaaaugugccaguuuucuaaguauuaaaaaucagugucuuuagcugaauuauguauaauagaaacaccaauauauccgcuugucacaguuuaggugcucauauuccuuccuuuaaaauuuuaacguuuucauauuucuuacagagauuuuuaauuucagagacaauggugagucauauucuguuuauacaucagaagauuaguaauugcuacuaauuuccagaaauuaagcuuuuuuaaaugucauugucccuuccuuucuuuaucucugauuuuaucuauagcaacaguaauuuuuuuuaaaacuggaaagaaacuucaauauaaguauuccuuuacugaaaauaaacaaaaauaaaaauuucgguaugcagucugaucaaauuaauuagugggucauuauucguuacagcauuccuucaaagauauguuucuccagcauauuuuuguguuguaguaacaacucauuagcuucuuuuaauaucauaauugacaaauuaauaccauuuuaacuauauuuaugggguacagugauguuuugguauauguaaacaaggugaaauaacuaaaucaagcuaauuaaauguccaucaucucacuuauuguauuuuggagugagacauuuggaauuuacuuuuuuagcaauguuggauuauuauuaaguauaaucacccuaggcuggacgugguggcuuccgccugcaauccuaacacuuugggaggccaaggugggcagaucaccugaggucaggaguuugagaccagccuggccaacaugguaaaacccugucucuacuaaaaauacaaaaauuaccugggcaugguagcaggugccuguaaucccagcuacucggaaggcugaggcaggaguaugacuugaacccaggaggcagagguugcgaugagcugagauugcaccacuguacuccagcuugggcaacagaacaaaacuccaucuaaaaaaaaaaguauagucacccuacuguucaauagaacccacaaacuuauuccuucuauguaacugaaacuuuguacccuuugacuaacaucuccccauuucccauacccuaccuuacauccaccacaaccccagucucugguaaccacuauucuacucucugcuucuaugaguucaacuuuuuuauauuccauauauaagugaggucaugcaguauuugucuuucuguucuuggcuuauuucacuuaacauauggauguccuccagguucauucauguugcaaaugacaaaauuuccuggguuuuuuuuuguuuuuuuuuuaaggcugaguaguauuccaauauguuuauaugccacguuuuccuuaaagaaauaaucauucauucacugaaggaaacuuagguuuauuccauaucuuggcuauugugaauaaugcuacaaugcccauacucuggguguguguguauagauagauguguguguguguguguguguguguauauauguauacauauauauguguguguauauauauauauauggauauguacauagacaugggauugcugaaucauaugguaguucuauuuauacauuuuugaggagcuuccauacuguuucccauugugucuauacuaauuuacauuccuaccaacaguauacaaggguuuccuuuucuccacaucuucaucaacacuuguuagcuuucaucuuuuuuguaauagccauucugacaggugugagaugauaucucauugugguuuuaauuugcauuucccuaauguugagcauuuuuucuuagacauauuggccauuuaaauggagaaauguccuuugcccauuuuuuaauuauuuguuuuuuugcuguugaguugcaugagucccuuacauauuuugaauauuaaccccuuaucacguacgguuugcauauauuucucccacaccauggcuugucucuucacucuguuagauuguuccccuugcugugcaaaagccuuuuaguuugauacgauuucauuugucuauuuuuguuugugauaucugugcuuucaaggucauaucuaaaaaauuauugccuggaccagugucauggagcuuuucccucauguuuuuuucugguaguuuuacaguuucaggucuuguauuuaaaucuuuaauccauuuuuaguauauuuuuguaugcauugugaaauaagaauccaauuccauucuucuguacguggaucuccaguuuucccaucaccauuuguugaagagacuuuuccccauuuuguuuucuugucaccuuugugaaaaaucaauuggccauaaauacauggauuuauuuauguccuguuccauugaucagcaugucuguuuuuaugccaguucaugccguuuugauuucaauuccuuuaauauauuuugaaaucagggaauguggugcccccagcuuuguucuuuuuacuuaagauauuuuuggcuuuucaaggguuuuuuuuuuuuuaaugauucuguaugaauuuuaggauaguuuauucuauuucugugaaaaaugacacuggaauuuugauaggaauucuguugaauuuguaggucauuuuggguagcaugaauauuccaacaauauuauuucuuccaaucaugagcacaggguagccuuccauuuauuuguguuuucuucaguuuauuuuaucaguguuucauaguuuuuaguauauacuaauaauauauguauauauuuaguaaauacuaauaauauauguguauuguucaccuccuugguuaaauuuucacugaaguauuuuacuuuguuuuuuguugcuuguuuuucuuaauuucuuuuggguaguuuguugugaguguauagaaauguuacugauuuuuuauguugauuuuguauccugcaacuuuacugaguuuauaagcaaaacaguuuuuugguguuuaggauuuucuguguauaaaaucgugucagcaaacagacaauuucauuucuuccuuucuuauuaucuucuauuuuuuuucucuugcauaauuacucuggguaagaguuccaguaauauguugaaaagaaguggugagagugggccuucuuaccuuacucuugaucuuagaggaaaaacuuucaacuuuucaucacugaguaugauguuaacuauggguuugucauauauauggccuuuguuguguuaagguacauuccuucuauacggaaucuuuugagaguuuuuucaugaaagaguguugaaauguaucaagugcauuuucugcaucuuuugcgaugaucauauaguuuuaaauucuucauucuguuaaugugguauaucacauucaucgguuuuauacguugaaccauccuugcaucucaaauguaaauccccuuuaauuguguugaauaauucuuuuaauuuauuguugaauuugguuugcuaguauuuuguugaggguuuuuuaagucuguguucaucagagauauugaccuguaguuuucuuuucuuguaguguucuuuucuggcuuuguuaucagagucauauuggccuugaacaguguuuucaaguguucaacaagaacacuuggccuuguucaguguuuucuauguaaaacaaguuuggaaaaauucccugcacuuugaauguuuggaagaguuugagaaggguugguauucucaauccuucuuuaaauguucuuuaaguguugguuagaauucagcuauaaagcugucuuguccugggcuuuucuuuggugggagacuuuauuaagaacacuuaauauccuuacucauuauuggucugcucagacuuucuauuccuucaugauucagguuugguaaguugugucuguauaggaauuuauccauuucuucuggguuaucuaauuuguugguguauaauugcucauaguaacuucuuaugauucuuugcauugcuguguuaucaguuguaauaucuccuuuuauuucugauucauuuaagucuucucucuccuucucuuagucuagcuaaggguuugucaauuuuguuuauuucucccaaaaaaacaaacucaguuuugcugaauuuuuccuauuguuuuucuagucucuauuucauauauuucuugcucugaucuuuugugauuucuuccuucugcuaauuuugggcuuaauuuguucuccuuuuccuaguuccuuaagauguaauauuagauuauuugagagcuuucuuuuuugauauauguuuauugcuauaaauuucccucuuagaauugcuuuugcugcaucccauaaauguugucauauuuuguuuucauuuuuguucgucucaagguauuauuuuauuacccuuuuaauuucuucuuugucucauugguuguucagcagcauguugcuuaauuuccacguuugugaauuucccaaaauuucucguuauugauuccuaguuucaugccguuggaaucggaagaugcuugguaugauucuagucuccuuaaauuuguuaagacuuauuuuguggucuaacaugaucuauccugaagaauguucugugugcacaagagaagaauguguacucuguugcuguaggauggaauguucuauauuaugucuaugagaucuauuuggucuaaaccaagcuuguccaacugauggccccugagccacaugcagcccaggauggguuugaauguggcucaacacaaauucauaaacuuucuuaaaacauuaugagauuuuuuuuugacaaauuuuuaagcucaucagcugucguuaguguuaauguauuuuauguguggcccaagacaauucuuccaguguggcccagggaggccaaaagcuuggacaccccuggucuaaaguguaauuugagaccaauguuuccuuauugauuuucuaucuaaaagaucuguacaguguugagagccggguacugaaaucccccacucagucugucucucccuucagaucauuuaauaguugcuuuauuauuuaguugcuccaauguugggugcauauauucuuacaauugcagauugaugccuuuaucauuauauagugaccuucuuugcuucuuuuuacaguuuuugacuuaaagucuguuuugucugauaugaguauagcuaccccugcuuucuucguuuccuuuccuauggaauauauuuuuccaucucuucacuuuccgucuaugugugugcuuuaccuuagagugagccucguguaagcagcauacaguuuuugauucauucacccacucugucuuuugauuagagaauuuacucuauuuacauucaagguaauuguugauaggcaaggacuugcuacugccauuuuguaauuuauuuuguaauuguuuuguagauccuuuuuuucucccucuguugccuuccuuugugguuugaugguuuucuguaaugguaugcuuugaauccuuuucauguuuugugcaaauucuguagguuuuugcuuugugguuacccugagguuuacauaaaacaucuuauacuuaggcuauuuuaagcugauaauaacuuuaaucacauacaaaaacuacacuuuuacuccccucuuacacauuuuaugauuuugauuucaaaauuuacaucuuuuucuaauuuauauccuguaacuauaguuguuuuuaauaguuuugucuuuuaacccucauauuaggauaaaaucgcuuuacauaccaccauuaagguacuagaguauucagaauaugauuauguguuauaccauugaguuuuauaauugcauguguuucaugguauuaauuagugaucuuuuacuucagcuuaaagaacuuguuuuagcaauucuuguaagauaggccuacugaggaugaacucccuuagcauuugucugggaaaguuuuuauuucucccucauuucuggacaguuuugcuggauaaaguauucuugguugacagguuguuuuuguugagaaguccacuguuagccauauugaggcucccuagugugugauguuucuuaucugucacugcuuugaauuuuaacaguuaucuuugaauuuuaacaguucaguuauggugugucuuggugaacuucucuuuggguuaaauuggauuggagaccucugagcguccuguaccugaauauuggugucuuucccuagauuuggagaauuuucagccauuauuuuccuaaauaugcuuucuggucauuuuucucucucuucuccuucaggcacuccuguuucucagaugguaucucauaauaccuguaggcuuucuucauucuuuuucauucuugauuuauuuccucuucugacuggauaauuuuaaauguccucuuuucaggcucacuaauuccucugcuugaucaaguauacuauugaaguauuugauugaauuuuucaguuuagauacuguguuuuuuaucucuaagauaucuauuugauuuuuaaaauuuguuucuauuucuuugucaaacuuauuguuuuguuuguuaauuauuuuccaaauuucauuuaauuuuuuaucuauauuuucuuguaguucccugaacauuuuaaagagaagauuauucucaauucuuugucucucauuucuuuagaguccauuauuggugcuuuauuucuuuuaguggugucauuuuucugauucuucauaauccuuguauccuugcauuggugucuaugcacuugaagaaguggccaccucuuccaguuuugcaaguguuaugcccuaccccaccucucacuugaggugaaggggauagaccuucacuauuuagucuagccugggauucuggauuggccaucugguagugacuauaggcaggcagaccuugcuguuggguucucuaacugggcugcuaccugugcuuugaggucaguggagcuauugacuguacuccaugaucuugugaaaccaauggcugugcuccgucaaccagugaggccacugacuggguuccaaggucagguggagcugccagcugggcucugcaaucaccuuugauugggcaggguugcaggcuguauucccuggcugagugcuacugcuguuuagaaucuaauugggcaggguugcgggcugggcuucaguguuucuggguuugcugcccagccacucgugacaggcagggcuggagauuccuccacaguaugcagucacagguuugccucccugccugggccugggcaaaaccucaggcuggacuucaaagcugaauggagucacugcuuaacugcuaagguugagcagggccaguuaacuguguucugcagauauguaaggaugcaguuuugccuccuggccucaggaaacuauauguacagcugugaaguuagguagggacacuaaagucuggcagggccagaugccgaccuccacagauuuaugcuaaugugcacuugccucugggucuggggaagccauaagcagaguacugaggcugcaugggguuaccgcucgcccucucaguucuuaugggaccagaugcucucuucaacacuuaggugccaccgcauacuugccuccuggccuaggaaaacuuuaagcagagaauugagacucugcuuaaggguuggggaaggcuuggaugugauagugguagggacucggcccuggcacaccugucaacugugcuuucugcaaagcagugcuauugacuggucucucuggucugaugcuuccauuggcaggagugcagagucauugccaagaucugugcuguagccgcuaugagcuguaucccucuuuuuuguuuuccgcuaaccccaaguguucuagcccuguaggaacaaaugggguaauacagaagugggcuuccugagaagcaucccagaaugccagggaaguugaguauucaccuccagcuuucuuuuucugugguagaaacugcaggcccaggggacuccucucugugugguacuuaacuggcuuggaaaggggugaaacuguuccuuuuaacccuguaaugcagcuuuucucaguucugugauccaagagagugucucagcucacuccugaguucugggauauucaugaagguguacuugucuguggauaguagcuaguucgauuucuaugagggggaccagagccaggaaacucuuauuccaccaucuugcuggagauuuuuaagacuuauuaaaagagaugucacucuccucauaaccuagaaagaggcauuuuuuaaaaauagagauauuagaagaaauagcaggagccauugccauuugaagaacaauuagaagucaaaauacaguguguuuaagaggacaguguaagccaaguuggaaaaaauuuguuuuuaguuuuguaggagaaaauaauuuauccuauauacagagauauaaucaccacugacuguuuaguauagagauuucuuuuuagcauuuuauguuuaugugugugacuacuuuuuagaaaaauauugagucuagauuauuuauggccugcuuuucuuaauauaaccuuauguaaugaacauuuuccuaucaauaaauaugcuuuacaacaugacuauaauuaggagcuaugaugcaguuauaccauaauuuaccugaaccaguucacuuuuuugaagauaaagauauauauguccaucuaucuuauauuauaacuaauauauuuauuaauauaucuuuggguacaaccucuguguagaccaguaggauauuuuuauaaguauaaauuggugggccaaagagugugagacacacaaaguuuuaaggcuuuugaaauguauuggcaguuuccucuccagaagaguuauaccacuguacacucccaccaguagcaccugccucuccaggcuucucuaacaguggguauuauucuuauuuuacuaugcuaauuugauaagcaaaaaaaaaaucauuuuuaaauuuugaauuuauuugauuaaaaguugaacucuuaaagcaugcuuauuggcuagugguauuuuuuuguuaguuaccuguugauguccuuuguaucuuuguuuaaauugguuuuuuggguuuuuuuguuuuuuguuuuuuuuuuugguugagauggaguuucgcccuguugcccaggcuggagugcgguggagugaucuuggcuuacugcacccucugccucccggguucaagcaauucucaugccucagccugccgagcagcugggaucacaggcgcacaucaccaugcccagcuaauuuuuguauuuuuuaguagagaugggguuucaccauguuggccaggcuggucucgaacuccugaccucaggugaucugccugccacagccucccaaagugcugggauuacaggcaugagccaccaugcccagcccucauugauuuuugagaccauauauaauucaauuuaaauagacuaaagucuuaguauaaaauggcuuuaggcugggcgugguggcucacgccuguaauuccagcacuuugggaggccgaggcggguggaucacgaggucaggagaucgagaccaucccggcuaacacagugaaaccccgucgcuacuaaaaaauacagaaaaauuagcccugcgugguggagggcaccuguagucccagcuacucaagaggcugaggcaggagaauggcaugaacccagaaggcagagcuugcagugagcugagaucaugccccacugcacuccagccugggugauagagugagacuccaucucaaaaaaauaaaaaaauaaaaaauggccuuaauaggacuacuaauaaaggcugccaucaaacaaacaaacacccacuuagacugaaaccgugcuaaauacuuuauaccuuauuauuuuaucuuauuuaaucuucauuguaguucggaaauaucuucauuuuacagcugaggaacuagagauucagaaagguuaaaugacuugcccaagaucacagcuaaugauggcacugggauuuaauuccauuucuaacuucaaaccuucugugguuuucguuauacaccuuucugguaccuagcuguugcuuauaccuauuaugccagauaauuaucucuauccuuuuuuucuaguauugugccacacacacacacacacacacacacacacacacaaacacauauauaaugaagggaaauaauuccuagcagaauccauaacaaaugaauaguguguuucccuuuguaucuuagccuaccuuugugaggccaguuuuuuacucuggggcucaauuuguagugcugcucaagaaugaaccuagugcugcucaagaauaaaccaucucggcuggguaugguggcuuauaccuguaaucccagaacuuugggaggcugaggcgggcagaucacuugaggccaggaguuuaagaccagccuggccaacauggugaaacccugucucuacuaaaaauagaaaaauuagccaggcguggugaugcgcaccuguaaucccagcuacucgggaggcugaggcaagaggaucacuugaaccugggaggcagaaguuucagugagcugagaucauuccacuguacucgagccugggugacagaaugagacucuaucucaauuaaaaaaaaaaaaaaaagaguaaaacaucuccauaccuuaaaaaaaaauucugagccucuauuuuuagacauagugauagauucgauacagaccaauguauuuuaucauuguuauuuuaauuauuauaugcucuugccaaagcacguucugugauuuugugcuucuaguugcuuguuuucauauuaagaaccagacacuucucucaaauccuuuuuuuaaagauggagguauagauaagugaauuaaagaaacagguaaaaaauaauaauuaguguucuggauucuucuuaacagaacuuuacagacuagcauggcaaagcuucucuccgaucuuaguguggacagugcucgcugcaagccugggaauaaccuuaccaaaucacucuugaacauucaugauaaacaacuucaacaugacccagcuccugcucacacuuccauaaugagcuaucuaaauaaguuagaaacaaauuacaguuuuacacauucagagccacuuucuacaauuaaaaaugaggaaaccauagagccagacaaaaccuaugaaaauguucuguccuccagaggcccucaaaauaguaacacuaggggcauggaggaagcaucugcaccuggaauuauuucugcccuuucaaaacaggauucugaugaagggagugaaacuauggcuuuaauagaagaugagcauaauuuggauaauacaauuuacauuccuuuugcuagaagcacuccugaaaagaaaucaccacuuucuaagagacuauccccucagccacaaauaagagcagcuacaacacagcuagucagcaacagcggacuugcugucucuggaaaagaaaauaaacuguguacaccuguaaucuguuccucuucaacaaaggaagcagaagaugcaccugaaaaacuuuccagagcaucugauaugaaggacacacagcuccucaagaaaauaaaggaagcaauugguaagaucccugcugccaccaaggagccagaggaacaaacugcaugucauggcccaucagguugucuuagcaacagccuucaagugaaaggcaauacugucugugaugguaguguuuucacuucugacuugaugucugacuggagcaucucuucguuuucaacguucacuucucgugaugaacaagacuucagaaauggccuugcggcauuagaugccaacauagcuagacuccagaagucuuuaaggacuggucuucuggagaaaugaauucagaagaaaacucaucaggugcuucuuuuuaaaacuagaacuuggcuauauugaauguguauuuuucuuuagugaaaugauguuuuauguuauuaugugugaaguaauauauuguacaaguaauaaauguauuguugagauauauugacacugaggagcuuauaaaaacaagucaucuuaaguucacaauugcuacaagaagaaaguuguggauaacuaggaaauuauuguaaguaauguuuuauuucaguacuuagcaauuagaguucuuuuauuaagauguaucugcuggauuaaggguacagguugaaauaguucuguggcuguccuaagaaauaaugggaaaagaaucucuggauguaaguuuuucuguugaaacuagaggguuuuuuuuuucuguuuacauauacuuuuuuuuaauagcaauguguuuuuauuaaacaugcugugugccacaggccaguguuguuggugaaauauauaaacauuuauuuaaagagaaaaguuaccaguaucuacaccucuuaaaaaacauugauuggucuaaaaaauauauagauaacauccuaaguuaacauauggcuucuuaaaacuugggcacuuuuauuuguuuuuaucccaaauucauguuuuaaggccuuuaaagaauagucagacugauaaagaagugcuaacagauaagcuauaguuggggaaauuuguggguuuuuuuuaaauaagaaauguuuauuuuuguccuuauauuuaaacaugauggaauuuguaaaucuuggcauugauuguaauucugccuuuuuggaagaauuuuuucucccagcauguuagcugagaauauucucuauuuuauaaauaauaugaaguagguuggucucucugcuucucuauaccaggacuucuuagcucaguaucaucucccuucauguaagcagcacguuuuaacucuuaggaagcugaauguuguguuaucacuaauacuuuguacaggucaccugccuacucuaauuguccuuaguacuuggacaggcuuuaucauuaaagaguguucuccuaaucccagaaccuccucguguuuuuuguuuuuuuggugguuuuuuuuuuuuuuuuagguguuagugcuacagcguuugaaggagccagcuguagucucuuugauauguucagauuuuccagauagagauuuaagucuaaaaauuuauuaagugaauucuaaacuauuucacacaagaguccauuagcaucuuuaauuuuauuuaguauucaugaauuaauuuauuggcaucuuauuuggagguaauaggccacaacucuuuaacaaauaaguucagaaauaaaaaauaauaaaaaaggaa

SEQ ID NO: 192626 - RNA, 272007 nt, Homo sapiens
ggcgcugagcgagcucggagcccgcgcugugcgccugcggccggggcgccccgccgagcgccggugccccggcucccgggccgccuucgccgcgcgggugagugagcccgccccaugcuuuuguccaggcgcgggcccuggaagucaaggcuccgagggugggaguucugggugggggcugggacccccaccgucugugccucccgacuccccuaauggagaggggccccggggugcggcgaggagucaggggcguaaggagacgaccccagugacgccaggcugcacgaguuuucuuuuggggagaugaagugcuuggggacacugaugcgauugccuuucuaggaaucauccgaagggggugccuuugauuugaggggcggaggagaagcggacccuucucccagcucccagacccucgcuagaggacucggugacggccucugggaagggggugccacgugaagguccuuccagcccaaaugugauuccgggaagguagggcggggaaggcggcccgcgagugccagaccuggccaucccaggcgaagcuggggcgcgggcuuugcagacuuguuccuacuccauacuccucauuuaagcuccuuaccucgcucugccuccuucgcguuaacuggggucccauuguugagggaccuuguucgccgaugauugcaguuggaaaguuuuggauaaacuucucaggagaugugaguugucaaugguugagguagaccccucccuggaacuuauggaacuaaaacccuucaagacccaaaggacugaauuucuaggaguggcauugcagaugugaagaugggcugauggggaaaugguuucaaggauauauauuuuuuuuagauugggguguguguguuggggugcggggcacuuucuauuucguagccagaaggagaagacccagcucuacuagagucuagagggaguaaaauuagcuguugugauucagggagcuggguggguguagggaaacaccugggcagugggcaugaugccagaccucaggccguugguuuuuaccaucccuccucuccccaagugcaaagaccagaguauaugcaaugacccgcccaccccacagccuuugagagccugcccuggagcugcaucccccuuccaagagaggcuguguucuucuccaccugaauggaauacuuuuugucaaaaugcacuuaucaauaaauuauuuccagauggugggcuuaggaggaccauuuggggaaccccgcccacacuucaaagaaucaggaaucaacaaugcaagucucugggagaaguguaggugcaucuggugacuuuacuagguuccuacaaggcauuuaggguucuaauagaacuguuuucuuuucucuuaaauucuugaccuccuucucucuuccgugauucucuuagucucuuccccgccugcacacugugggacuguggaggaugaugcugcuggcaccacagugcucuagggcagcauggaauuuuccuuccugcccagagugagguuaccccuuuuucucccacucucagugggccaggagccuugggucugggaggaaccugagcaguugguccuggguccggagugguuggacucuggaugcuggauuggguagcggguacucuggggacaugcacaagagcuuuuuuugccaagaugugcaggucugucucauuguucacugaugauacaaaggaugcuggaccucauuugcagcuaagcaugagcuuggagaaccaccccacaguggggaagcauuuaugcugguuuaucucccauguucaguuucuuuuguguaauaacuggcuagcugaggaggaggguagcugcagcauuguagauguuuccuugucuuauuuuuauuuuuauuuuuuauuuugagacagggucuggcucuguugcccaggcuggaguacaguggcgugaucucagcucacugcaaccuugaccuaccaggcucaaggaauccuccaccucagccuccugaguagcagggacuacaggugugugccaccacaccuggcuaguuuuuuggauuuuuuguagagaugggguccuaccauguuguccauacuagucuaaugggcucaagugaucgcccaccucugccucccaaagugcuggguuacaggcaugagccacugcacccagccagaguaguugcuguuugugugagguuugcucaccccuucaucaggggcugcuuccccaggggccagaucuuagaaaacauaugcagagcagacuaggccuuggaacauuccuaggcuaacugguaaggccagguggccccaccugcugccugaaaaugguagacagacagcuacagucacugcagaggaggggcuccuggcuggcagguggcggggguaaucugcugagaaggcuugucagagaaggaggugacccagauggugcagaggggagaggccuuugaguuccaaggguggggaaagguucugggucucuggcuagggagaucuuugcuggucucagaggcauagauugugaaugcgcuggggucaccauauacucagugucuuugagaaugaccccuugcuuuuauccucaaaauauaagaugagccuagaguuugaaacacaacuaguuggcuugucugucuuuuaggaaguucauaaggugggguggggguuucagaaugcagccuugcuuggggacauggguacagugucccaugaguauggggugucuuauuuaguaucuuucugagaacaauacuugggagucuggaaauauaagccuacuuggaagcccagcugcaccucucacagcucaaaccaacccacacaggcugggagauuguucauucuuaaaagcuuccuguccugucuuuucagcaaauguaguaaaauuuagaaacaacacuuaaaaaguauccuuucccaacaaaagacaauguccucgcucaacuuggccagcagagggugcaugcagaggacaugaggcagggccauuugcauggaaaauguccauguggaugcuuaggccugagcagggucuauuggguggccugagugcucagaaucaaggaaccguccagcagugagccagagugggacagaacgaugucacugugaugagcuccuaugccaugugacuucuaucucuucccugugcucccccagccuccuaccuuacaagcaggcagacaugguugugcggggaagcagugcccauacaagccacgccccucucccaccugcaccauucugcagauggauucucuuuauucuuccuugaguuuuggcugcacacuuuuccauucguuugaugccaacagguugagcaaaugcauuccccucacaaacucaagguggguggaccuccguauuugcacugcgggccaacaggugcaucccuccuccuuguugcaugcaccuggugugugagggcugcagcccccaugaaauuuacugacagccagcccagucagcuggggcaggaggagagccagcaacaguugcugccucaugggcuggaagguaaggcuguguuuccagaugcucccaccaccuucuuuucccugcccuccugcucacuguacuucagugucugagggugaaugggcaccccacuagggagcuguggaaauuuuuguguagauccagcuucuuagauuucccacguuguccccauccccccucuguugguacuuccuugccccccuuccacccucugcuccucuccuucccugggucuucagugcagagcccucuggagacagaaagccccuuuggagacaaaagaaaagggaugaggagaggauuuccuuuucuuucagaccugcuucuugauuuuuuuucccuuggcucugggcgcucagaucugaugcuaauuuguuaauccaggaccuuauggguuauuucucauaaucuuugggggaaccgaacaccugcaacuuggggcuuuuauaguugaggaugcuguuuaccuuucuuguuuucagagaugaggauuucugauguauaguaggucucauucagguuucuggcaggaggaggcagccaggcagaaugugaucuuugguguuaaacuuggguucaguuccaucccauucacuuacuggcuggguguucuugggcauggguuuuaaccucugugagcugacuugaguuuugucaucugacaaugagggcgguuauaaaaauuaaaugaauauaggaauauaaauaggcacaaaacaaagaauagcuuuuauuauauauaccgggcaguguucuccaggucuauauaaugacuuguaaaucaaccagcagacacuaaugaugucuacuuucuauugagcucuguagaggcuuauaaaacaaagguaaaugugggccaggcacgguggcucacgccuguaaucccagcacuuugggaggccaaggcagguggaucacaaggugaggagauugagaccauccuggcuaacgcggugaaaccccgucucuacuaaaaauacaaaaaauuagccaggugugguggcgggcgucuguagucccagcuacucggcuguagucccagcaacucgggaggcugaggcaggagaauggcaugaacccaggaggcggagcuugcagugagccaagauggcgccacugcacuccagcccaggcgacagugugagaccccgucucaagaaacaaacaaacaacaacaacaaaaaacaaagguaaugugucuaugcuaagagacucuggguggguagcaagagagcuaacacauagguaauuagaaaacagggacaacaugcaauuuccaaguuucauuaacagaauuaaaggaugacaagaaauucaggggcuagagugaugcaggaaggccucaaaaauggagaggaggaagggaggguaagcauuugccaggagagaggaaggcaggaacauuuggcuccggugucugaaggcuguuagcuccuuccuugcugggcccuggcacaacaccuuugaccuugcagcgcacucccaaacaugcaggugugcuuguccugagguuuauuuugggggugguuuucauucuggccuuguuuucccucugcugccaauaauauuucugaaacaucugaaauuguuuuauuuuauacucgaucaaaaauauuaagaggcaauuggguggccagagugaaagcccagaggcccguagaagacuuuuggguuucuggggcuuuguguucucuuuucaugccucauauauuguagcucacuuccuaguucuggaaucacaggguguuaggacuaagggucagguccacuugaccuuugcauuggacugaagaggaaacucuggccuaagaugccaagugguggcugggcaccgugguucacgcuuguaaucccagcacuuugggaggccaaggcggguggaucaccugaggucaggguucaggaccagccugaccaacguggugaaaccccaucucuacuaaaaaucccaaaauuauccaggugugauggcagccuccuguaaucccagcuacucgggaggcuggggcaagagaaucacuugaacccaggagcagagguugcagugagcugagaucauaccacugcacuccagccuaggcaacaagagcaagacuucgucuaaaaaaaaaauccaaguaguagagccagcaucagccagaguucucaucacuaccuauccugguggaggauggugauggcauaggaaggugaacggccugacauaggcaggaagaauggauacacauugguucccucaucugcccaccugcuucucuagaguccuuuaaggcuguccucuuuagucugaggguccaauggggagcaggagugaauguccuaccuuuaucuggccugugaucacugccaucugucugcuucagggccccuggauaccgagugcuguuccccuuuccuggggucagacuacauggaaugucaucugaggcugugggaaacaccaggaagaugccccggguuugggggcuagcuucagcacugucuucugcuaugugacgugguaucuccaggucucagauugugcaccuuuaaauggacagagaagcccuucucuacucaucugaugaggcuguaggcagaugaacacgugcuuggcaaccugugcuugugcuguggucguaaggguaguguccugcuaggcacugugcuccuggaggucaccagcugugguucaucuuguauccuuacucauagccuggugccugacacaccacaggugcucaguacaucuggguggaaggacuggcuaaugggguaaauggaggugcucagagaagauucuaagggauuugcugugugccacuccaugagaaggcacuuuccacucauucaccucacuucuucaguuaugucuucuguagggcuagguauacuucauucuaacuuuucuccugagcuuuaugcaucuuuccagccaaguacugaguccauucacagaacaugacucaagcagauguauuccuaaacuuccccauuguccaaguuaaauuuccauuugguauuuuccuauuagugucaacagggugaucauuuucguaaucacuugguugcugaucuuguggaaacgaguauguucaugaggaagcagcagguggcuuuagaacgugccuggaggaacaguucuuaucuugcaaccugccucugauuacuaucaaaagcuccugccuuuccaauagucacucaugguauacaugauacaaucaacgcaguugcuacugauguuacccaauaguauguuuuagggaguucucaggcuucuuauugugauugggcaggcaccuagggacucagcuccuccccugugggccugcugauuaucccaggcagagaaacacuugguuuuacuuugauauuacuauuuuuuccugaccagaccguacuagcucacacuuggaguauuaacuguggcuucucuguagcccaaauacaucguacacuugauugcuuuguugaucuaaaacauagucugacugugucaccaccuucaggaacccccgguggcucccuguuucacacagaacagccuuaagccauucacaggccucuauaaucugaccuccaagcccagucucauagcagccacccccacacuccuugaucccacuacaaccagacuucuugucucagcccaauugauacuuuccugugucucugacugugacugugaguucauccucaccuggaauauucuucacuugucuguuugauugacagguucuucuauccuuaaacauuuguucagggaaugaguuaaguuccuaauaacugucagauacugcccccagaggcugccucugaccuuuucagccucaacuucucuagaaauaagucccuguaaaauucuuuuuacagagacaagucauaaauuauuaugguauguuuuuaucauuuguuuaauuuuucucaugcuaaaauuuuauaucuguaacuauacugaaaaaacaucaagggaaggacauguuaaugccucuguuuccucauagcagugguuccagaacuggcugauaacaaaaucucuuugggaaccuuguuugaaaaauaaucuauggcuccccagucccagcccagacuaccuugguggggucagggaaucucugguuuaacaaagcuuuccagauguuugugaugucaaccugauuugauguuucacuauguaauuguuucuauuauuucuuugauuuguguauuaggaaggauucuucaaaauuaacagaaaccaauucgggccagcugaagagaaaaaauaaagguaauagcaugauaaaagauggauucuuauauuuucuuuauuccaaauuauagccacuaagauucguaucacuuuauaguuucucaggaaaaagcacuuccuuucauauagacaauuuuagaaaaguuucuaaauuacaauauaccuuaauuuuugaaauugcauaccaguuuuuucaucauuauaaucaaaauauaaagauccuucugaacuaugauaaugugauaacugauauaaucuaucagaguuacauaugauuucaaggugaaaugcuguuuuucauaaucuguguucaugauuuuugaauguugaugcauucuugccuuccuggaauaaacacuuagucauaauguauaguuuuuuuaaaaaaaaaauaccccagugacuuugauuuucuaauauuuuauuuugguuuuuuacaucuguaguccuaagugagauugaacuauuaauugucuuugcuucccuuggccaguuuuguaugugcccacaauuuugacauuuuuggcaccuuuaggauugacagaauaagucugaggaauauuaaagucuaccaggguuuugucuauguauucuuuagauuaaauuuugaguucuagcuuuucuauaaguaauauugcuaaaaguuagauaucuuuuucuaaaaguuaacuggaaacuuugaaaaaaauaaauauucaguaucuaccugaucaucuguugcacauaaaucagucacaccaacuuuuccuaguuucgguguauucuggucugguaaauuuggcaguuucuacugucuuuuuauuccauuguuugacaaaugaucagcauuuucccagguacacaauaacuuuucuuuucaaugcugcaucauaauagguuuuuuugaagacucuuuuucuuucucauguaaaaaaguagauauaauuuauauacaguaaaauucaccuguuuuaauguacaauucugaacaauuaauacauaauuaugaggaaguucaguucugaauuuugacaaauguauauauagucauauaggcaccaucacaauugagauacagaagagcuccaucaccucccagaauugccuugugagcuuuuguugucugcucucccaccaugcagaccuuggcaguuacugaucugcuuucucucccuguguucuuuccuaucucggaaugucauauaaauggagucaugguuuguaggcuuuuuagugugccugcuuucacuuagcauuaauguguuggagauucauccauggugguggguauaucaauagguuauucguuuuuguugcugaguauuauuucauuguaaagacguaucaccguguguuuaccuauuccccaguugaaggacauuugggcuguuuccaguuugaggugauaaugaacaacucacuaucaauguuugugaacagauuuuuaggugaacauagauuucauuucacuuggguaaauaucuaggauugggguuucugggagguaugguaaauguaauggaauaccaaacuguuuuccaaaguggcuguaccauuuugcauuccugguaguaauauaugaggguuauauuuuccacaucuuugucaguacuugguauugucagauuuuaaaaauuuuagacauucuaauagguauaguuuuaucauauuguguuuuuaauuugaauuuccuuagugacuacugauguugaacaucuuuguacuuauuugccaaacauauauugucuuuggugaaguaucuguuuaagucuuuugcccaaguuuuauuggauuguuuguuuccuuaugauuuagauuugagagcucuuuauauauucuggacauuaaucuuuuauuggguacguguuuggcaaauauuuucucgcugccuguagcuugucuucucauucucuuuaacaaugccuguuacugcaugacagaagucuuuaauugugaugaaauucaauuuaucaauuuuuaaagauguguuaugcuuuugcuguuauaucuaagaaauacuaaccuaauguggagucauuaagauuuucuccagugcuuucuucaagacguuuuacauuuuuagguuguauauuuaguucugauccauuuuaaguuaauuuuuauacaugauguaagguauagauagagauucuguugugcauaugaauguccaauagugcuagcaccacaaugaaaagauuauccuucucuuauugaauuguguuuguaccuuuguugaaaaucaguugagcauguauguguggucuauucugaguauucugucccauugauuuauguguuuauucuuucaacaauaccacacuguauugauuauuguagcuuuauuguaaguuuugaaguaaggaaauuugagcccuucaacuuaguucuuucuuuucaaaauaguuuuggcuauuacagauuuuuuggccugacauauaaauuuuagaaucaucuuguuggcaucugcauaaauuccugauggaagucuguugguauugcauugaaucuauaagucaauuuggagagaauugacaucuuaacaauguuggauuuuuaaguacauaaauaaacuauauuucuccauuuaggucaucuuugauuuccuuaucaauauuuuauaguuuuuggcauauacauauugaacauauuuugucauguuuauagcuauguauuucauguuuugguguaauuuuuaaugguacuuuuaguaaaauucuguuuuccaauuguucauugcuaguauuuauaacuacaauugauuuaguauuuuaauggauuuuuaaaaauuuaaaucagaauaaaguacagcaaaauguguacuugcagaguuugaaaaucuaaugugauuaguagcuagcuaaaucuaauguguaacuuaaacaauuuaaaaggcugggauauagaaucaauuuucagcccucaucugcucuuaacuauuucccugagcuuuuuaauuauuuuuaagcaacugauuuuuguuuguugaccuuauaucuuuugacuuuucuaaacugacuuauuaguucuaguagcuuuuuuuucuagauucuuugagauuuucaucauagauaaucaugucaucucugaauaaagauaguuuuauuuauucaauuccaauuucuuugccuuuauuuuacuuguuuuauugugcugguuaagauuuccaguauaauguuaaacaggaguggugaaaacagacaucauugccuuguuuccaaucuuaggaggcagguguugagucuucuaucaucuuguaugauauuagucauagguuuuuuguagauacuuuuuaucagguugaggaaguuuccuuuuaauuugcuuagauuuucuuugucuuuaccgugaaugaauaaugauuuguucaggcgcuuuuuacggaucuguugagaugaucauauuuuuucuuuuguccaugaguuggcaaacuuuuucacaaagggcagugugagaaaaauaauaaauauauauuuggucuuuauuuucaguuucuggcauagagcuucuaaaacccugggaguuuccugagugagaguggugagaggaaugucuuugguuauucauaauaagucccuuucaaccauaccugaguuuaugcuggugaggugacacuuggugagccccuauauagcuucaggaugggggcugauugucagaggaaacaaccauguaauuagaagguuggaauuuucagcacacccugcccuaacaucuggggaggggagaagggcugaaaacugaguaaaucauuaauggccagugauuuaaucagugauuccuauguaacggaaccuccauaaaaacuccuaaucaaagggguuuggagagcuuuggaauugacuaagcacacugagaugcuggcaaggugcuggcaaugccuggagagggcauggaaguucccugcuccuuuucacauaccuuguccuauguaucucuuccauuuggcuguuccuagauuguauccuguaaaauaaacuggcaaauauaaggaaagagggcucucaaguucuguaaaccagucuaacaaauuaucaaacccaagaagggggucaugggaaucccuaacuuaucgucgguuggucagaaauaagaggggcccaggacuugugaucugaaaugggggcagucuuggggacugagcccuuaagcuguaggaucuaacacuaagguuagaucuaacucaagguugauaguguuagcauugaauuggauuguaagacgcagcuggugucuagagagagauucaguugguaugaggaaaaaaacuccacauagcugggugucagaaguguucugggaguuaaaaacaggucauaauagccagauaacaaauauuuuaggcuuugugggccauaagguacuuuauucaacucucuacucaacucucauaaaucuccucuacucagugauucagcucugccauugcagcaugaaagcggccacagacaauagauggauaagugaauggauguggcuguguuccaggaagcuguauuuacaaaaacaggcugcagguuggauuuggccugcuggucauaguuuucccagucauaguuugcugauccuugcuuuagucuauugauauguggaauuacaguaauugauuuucaaauguuuaaccagccuuacauucccagaauaaacuccacuugugguauauuauuaaucuuuuuauauauugcuggauuugguuuacucaauuucauugaaguuuuuugugucuauauucaugaaggauauugauccgaugucuuugucugguuuuggugucaggguauauugguagccuuaugaguuggaaaguguuccuucuucuauuuucuggaagaguuugcauaaaacuguuguuauuuauuccugaaaguuuuaguagaauuugccagugacaccugagccugaaguuguuuugcggcaugauuuucaacagcaaauuaaauuauuuaauaaauauaggacuguccagguuauuuguuucuucuugagugauuuucgguaguuuguaucuuugggauaauuugucuauuuaaucuaaaagacagaauauuuauaaauguucauaauauuaacuuauuauccuuuuaauuucuuuaggaauuguaguaaugucucauuuucuauuccugauauuuauaguuuguaucuucucuuuugcucuuggucaaucuggcuagcaguuugugaauuuuauugguucuuucaaagaaccagguguuuguugguuugaguuuucucaauguuuuuuguuuccagauucauugguuuuucuuuaucauauauucugcuuguuuuggguucaguugcucuuccuuuucuaguuugcuaaagugaaugcuuagaucauugauuugagaccuuucuucuuuucugauaauuucuaggguucuccuuuucugggacaguuggguugggaaaggggacauggagguguagaaccaguuuuccuaccucuaagcauuuauuaggagagcuuuaguaaaagccuuaccagcagggagcccugaggcuucugcuugggggugggaccaaugggaaggaggcgaacggucacaccauggacuguuucuuucaugggaagcaguggccuggucuucccacccugacagucuaggacccuaaugcucaucugccucccaauauggucuguagaaaggagaggaaagggaguuggaguuccugcaguuuuguuggaugaaaggguucucuccuaauaguuuagaccaggagcugguggacuuuuucuguaaagaggcagauacagauagaaaauauuuucaacuuugcaggcuauaccaucucugucacagguauucaucucugccauuggagcacggaaggagcuguagauaacauguaaaugaaugggcauggauguguuucaguaaaccugguuuacaaaaauagacaacaagcuggauuuggcccaugggccauaguuugccuacaccuaccugcuuuagucuacuaauguggugaauuacauugauugauuuucaacuguuccagacaaguuguauucuugagauaaauuccacuugguuuagagcaucuggucugugcuggcccugucuuuguuucucagcuugcauugucacugagccaugagcuucucagggguagggccacaauagggccaucucugaucuccugucagguauaugguagauggcuagugaaccuuuguggcuggguggaaacaccugugcccuucagugguacucugcugcagcuuccuuuuugguccccccaggagccuagaagaaacggagguuggguggaggaguugggcucaagugcugucacugcaggccccaggcugaucuuucauuuugagacucuuuuagaaaugugacucauguuuggucugugaggcauugcuuucuaauuacucucuguccuuuuucugggggaugugguuggcaccauagcuggcaggcucaggaauucaggccuccaggugccagcccagugcugguguucuaaaagggcuugauugaccccuuuccaggaccauggcuuucuagauccuuuuauagaagagugugccugugugugggaaggggcagagcaggaggguccaugcccuucuggcuccuaagugaccuucaugccuguggaguguggacuagauagagccaugugacaaggcauuacaaauggauuuugcacagguagauuucaucguccaucuuagccaauuuuccuaauugauugggagggcugggugggcaguugaugggaagguccuggagcuaacagaccuggguuucaaucccagcucaagaacuuauuagaugggugaaucugggcacauuauuuaacuacucugaacuucaguucacucccuuauaaaauggagauguaacaacuucccagaauuguugugagggguauguuaagucccucacuuucucuccugggcugacagaggugagcagagugguggacaacagaagugcaaaacgacuugaaaacaugggagaauccauuugcagacugggauauggagagggugugcugguccccuuuuccugccuagaauauuucagagcugaaagauggggaggggugauucaagggccaagccucugauucugcucuggagcaagaccacccuaggucuggaugaugccuuagguuguuugggccucuugucuuucauuguucagccagguucacugggauaggaaccuggagcugugccaguccugguuuagaggaauuaguugcauaauugccuuggauuuaaugggaaaauuuaaggccucuuggaccuguugauaauaauaacccuccuuaugacuacccagugugggaggagugaggagagucaccuccaacugccuucagaacaccaccaccuuuucauguguucugagguuucugcuuuccucuugacaagguucaagacccuuuugcacacguguuaggggaugaggacccugcuuuccugcagagucugugaguuaagggcacuacagcuccuaggccgcccugcucaccccagacugaggccucauugccuucugggacaaucagaccaaggcuuuuacuggagagcucauaaaacuuguuaaggaucaagaacuagauaaaguuccaauuuugucacccugagauaaucuuguauuauuguaccugaaaacaguauugaaacacagaucucauugugacaccccugguuaaaaacaauguuaauccccugcuaccuaaaagacaaaauuucagcuauucaacguggcauguaaaauaggcugcaauuaggccugccacauaaaauauucaguuauuauuuugcuauaaauacuucucauuuggauaauguuuuacaguuuauuuguacauuuugcauuuaaucuuugucaaucuuaugauauuguucuuguucccacuuuguaguugauggcccaaaguuuagggaaguuaaaaggaauuuguccaagaucagguggccacaauaaagucaaacuaagcacaggguauaaauuagugcucacuugcuacuuccucacuguaugaccuugaacaaguuuauuuaucuauaaagaaucagggauaauacaacaaacuuguaaaguuuuugugaggauuagaugagagaauccaagcaaagugcuugggggaaugccuggcacauaguaagugcucagaaaauguuggguauuauuacgauacucuauuuuaauuguuccacaauuaauguuuucaguuuuuaauuccacuauuauaaguaacacuguuauaaugaucuuuguccaaauaguuuauuuuuucuguuguauuauuuccuuggauuauauuccaagaaaagcauugcuaggucaaaagauacgauccucuuuuuuugccuuuguuccauauugccaacuagcccuuuagaaggaugguucccauuuaaaaggcugcuacuagacccaugagagugaacucucucccacuggugguacuucugugcaaccucucagcccaucagagggcauauaccagucauuuaucagucauugaggauuauaauuaucaccuuucaaaaagaccaacagauccuagacugguuggagccaaacuuuauaaacuagguugugccuacagcaagacauaggacccggcuaaucagcaaacuguacuaaaaacucuaggaauggcugaccucucaacucacuuucuguagggcucugugggagucuuugcauguacacagcagguagauaagaaggagugguguugggggaggcaggaguugcuuaugagcuguggaccugaggacuguagggaggaagacuguaugggaaccauguguggcuucagacuuuuuauguaggagaguguaugcauuuguuuggguuguguaacaaaguaccacagccagguggcucaaaacaauggaaauucauuuucucacagcuccagaggcuggaagucugaaaucagggguucaaacagagucaagcuuuccucugaagguucugggaggauccuuccuugacucuucuggcuucuaguggcugccagcaguccuuggcauuccuugggugcauguguaucacuccagucucugcauccaucuucacauggacuucuccccucugugucaguguauguucacaugauguccuccucucugugugucugcguccaaugcauccaaauuuccuccugguuuuuuuuuuuuuuuuuuuggauacuagucauuggauuaaaucccauccuaauucaguaugacuucaucuuaaccugauuauaucugcaaauacccuauuuccaaaccaggccacauucacagguaccagagguuaggacuucaauaagauuuuuggggggacacacuucaacccaugacagauggauugggaagagaaaauggaacauguccauuuuucauaucacagacuacaccguggauggggcuguugguggagaaaauuauggacagugguagugucacuggugggaaugcuggacaguugucuggggccagugcugcuucuguucuuggccuccccagccccacuuacccuaaggauuugucacaaaacuagucacugauaaguauuaggugcuucuagcugggaugaugcagccauagcagaaagagcuuagccaccgagggaaagggguguucuaggagccaguggggagucauagaaauaacgggacugggcagacaugcagaucucagguuaagucucaggcuaccuggaacaccauggccucaguuuccccauugaagggugaggagggagggacugcauagcuucugacgucccuuucuguuuggcauuauauaauucuaacaggagagguaacauuuuagagacacccaagcuccuugacucuaaggguuguccugaggucugucugggugacgaggugugagcagcugauauggguggguacuggggaggggacaaugugguauuuuccaucccaggucuuuccaacaagacuuuauucaagucaccucuccaugaggccuuuccuggccucucuaaaauuucaaccucauccugauauuucauguccccucuuucaguuuuaauuuuucuccuuauacuuauccccuauccaacaugguuuacauuuuauguauuuuccucacuaauugucuguuuuucccacuaaacaguaagcuccuugagggcaaggauuuuuauccaauucuaaaauaaugccuaucacauaccaggcacuccauacguauuuguugaauaaaugaagaugugguaaacuugauaaauugggugaaaauuuaaaggggguguaccaguuauauucuuugaaaggucucaauccucccuggcuccagcccccuagccaagacugcccaggguccugccauaaguagcaccuauuucugcaggguuuguuccagucaucaauugcugggagaaaacucucccaaacaguggcauaagacaacaaucauuuuguuaugcucugggguucugugggucaggaauuugaacaggacacagugggaauggcuugugaagaccugaaaagcugaggugacucaaacagcuaggggcuuggaucauuuggaggcuucuucacuuaccaccuggcuucuagacugagacaacuugaaggcugggcucagcugggauaccuggagccagagugccuacauauggccucuccauguggcuugggcuuccucacagcaugguggcuggguuucuggagcaaguguucccagaaggagcauuccaugagagccaggugaagacucccuggucuuuuauuaccuggccucagaagucacauaguguugcuuuuugccguacucuguugaucaaagcagccauaagccugcaccuugguaggaggagugucaaagauuuugagaccauguuuuaaaacugccacaagaaucuuaccacuuucucaccggucucaaucuaaaguuaaccugaaguaaaaaucugccaccuucagaucaggacuuauggugaauuauaccuguucucuaccucacucuucacuaauggagcuucuucaggacagagucugccauguuuguuuuuugaagcaccuagcacauuaucuggcacacaauaaguacuaagcaaguuagcaagcaagugaaugaaugcacgaacacagggaauggguguuuucuguggcuggcuuagcacugcuaaguagcuacaggaagacuugaaacuccugucuauuaaggccaaaguuuucuaaccaguuuccauucauauucuucacugcugaaagcuguggguuaggaauagauuccuguggaagagacaugaguauggagauagaaguuguaugguauguuagggaauacugguaaucugguuugaugauagcuaauaauuucuguauuuuccuaggacaauggcagaauaaggcuagaauguaagggccuuguuacaggacacugaguauggauauuauucauuaaugaagagucaucaaauauuguugagcagcagaguacauguaauaggagcugugaacuaggaagauugacuugccagugacauucaaaccagauuggaguagggaaccccacagauaggcaaaacagagauuugaaauccagguauguaaccagggccugaaccaagcuagaaacugcaggaaagccagcaaggggagggaugugagugauugugagguuagcagguguuugggcccaugugagaggugacaaaaaagagaauguaaaagaugaugcaacaaucacauauauguagagauggagucugucacucaagcuagagugcagugguugcagucucgaacuccugggcucaaacgauccuccugcuuuuagcuucccgaguagcuggagcuacaggcacaugccaccgugccuggcuaauuuuuuuacuuuuuguaaagacaggaucucacuauguugcccaggcuggucucaagcuccuggccucaagcaauccuccugucucagccucccaaagcaccaggaacacucuuacuuuguagggacuaauuucuauaauuuuguuauaaaaauuuucaaguauacagcaaaguuuaaacacauguauggugaauacauauauucccuccaccuagauucuaaaguuaacauuuuccuguauuuguuuuaucaccuaucuguccauccuuccaucgucaaucaguccaucuuguuuuugugauauguuuaagucacagacauuaggaaauuguacauuccccuaaauacuuaagcaugcauaccauuaccuugaguugaauauuguuuacguuauuuuuucuuuugagguaaaacuuauuuauagugaaaugaacaaaucuuaagcauaccauuggaugacuuuggacaaaagcaugcaccugugaaacccaaaccccuuucaagauuuggacauuaccaucauccuacagaauuccuuuguauuucuuuccaauuucuguccccacccuccagaugcaaccauuauucuaauauuuaaggcacagauuuguuuugucucuccuagaacuucacauaaaugaaauuguaugguauauauucuuuggcuuaauguuucuuucauuuggccuguuuuugagauuuauccauguuguuuuguguaucaguccguuccuuuuaauugcuaaagaguauuuuguuuauggcuauaccacaguuuacuuaucccauuuccaguuuuuggaaaaaaaguuguuuccaguuuggcuauuaugaauaaagcugcuaugaauauuuuuguauaggucuuuuuggguagacauauguuuucauuucucuuggguaaauaucuaggaguggaauugcuaggucauaagaugagucuauguuuaguuuuguaagaaacugccaaagugucuguuuccacauuuauacaccuauauuuccaauguaucagaaucuaguugcuucacaucgucaucaacauuugguauugucagucuuuuuaauucuagucauucuuguggauacugcuauggcaguauccuauuauaguuguaauuugcauuucccuaauaauuaaggauauuaagcgcuauuaugugccuauuggccauuuauguaucuuucuuuuugaaauauuauucaaguauuuugcccauuuaaaaauuugaauugucuuuuuauuguugaguuguaggaauuuuuuauucugaauaccaguucuuuaucagauacgugauuugcaaacauguuuuucuaauuuguagcuugccuauucauuuucuuucuuagagcagaaguuuuaccuuuuuuuuuuuuuuuuuuuggcaaggcuauuuuuuuuucuguguccaaagaaacuuuuaccacccccaaaauuaccaagauaaucaccauuuucucaucuagaagcuuuauaacuauaguuuuuauguuuagguuugucauccaucucaaauuaauuuuuguguauagugugaaguagggaucaagauuucuuuuuugccccuguggauauccguuguucuagccccauuuguugcaaaaacaccuuccuuuuuguuagguacuguuuuuauucucuugcagaggaagaaacugagacagagcuagguuaaguaaccacaccuggcagagacagauccaggauuugaacccaggcagucuggaugcagagcccguauuuaaaccacuguguuauaauaacccuucuuacguggaugacagguuuucaacgugagugcaggcagcucaguguaaagcccugguagggaauucaggaagcaggggaguucaguuugggauugagcuggggagcccaugggauaccugagugggcacaguggggagaagauagaaaaaagacggaaaaacuuggaagaacaaguaggggagaagggaggugggggcugcugaaaggggauguuauuaagccuaaccuggauuucaccuuuuuuauuuagcaucaggggauugguucucugucauaucaauccuggucuagaagagucaugaaauaggcaagauacagcuagucuaaaucuuuugaauuuagguaguaagggugacaugagcaagagucauaaagccagagaagauaaauagauuaaguagagguagggaaagucagcaagcaucauguuuaggaugccuacucucuguuagacagaccuggcuucaggucuucauccaggccuugcagcucacucugugaucucaggcaaguuacuucauuucugugccucauuuuuccucaucuguaaaacagagauaacaccaaccucacugaauuaaaauagacaauggauuuaaggcacuuagaauaguagcucaauaauggugugucagcuauuuuaagauucaguauuuuaagaauguggucaaggcccagaaauauaguagacccucaggaaaacuugcugaauacacagaugaacuacagggacacaggauucuccaguuuaaauuguguaacugcauaguuuuagcacagauggccaugaaguuacaguaagaagcuaggaccaugagcugagcuggucucuaaauacucaagguggugcaggaggcagcccagacuggugacgcugagccagcauggccuuagagccuuccuuaggaagggcacugacugcuggcucggauuccaauggagcccccacgggccuggagcucuggagugggcagggaaggugcuucugcucugagugaacagagagcucccugacagcaagcaugaggauacuccugccugcggaaggggugacaccucaaguguauuguugcccagauggcccacagaaacccaugucuaucccugguuuugaugacuauguccugaucuagccccacuucuagaaaagcccauuuaaauggaguuuguaggauugacauuuugaguccaguccacucuccauauaggcaggaagcagagucaauuaaguacuugucaaguaccugcugggguaccuguugagacucugugcuggauuaggacacuuguuuuccugcccaccgggagcucaauguaguuagugaaugacacacuuaaagagguaugugguauaugccagauguaaauggccaaagacagcuugggcagagucauauggauaaaugcuuucuacaaggguuguuacacuaaugcuagacauucaggcccucuggcgucuacuccagcuccaguaccuucucccuuccaacaguaauaacugauauuugaguguucacugugagggcagcacuuuagagcuguuaacuaagguucuccuuaugaugaccccaugaggggagcucuguuaguaccucuguauuuaagaugagggaucugaaggacagacaccuacaggcuucuacaggcgcauugcuggugagcgauggugcugggugugaacccagcugucucgcugcagagcuuaucuugguaggcccucggggcugcuuggcuaguuucuuuuucaaauauagagcaggaaggaggaugauugacauuuucuuucaugaucucaacaugcaaucacacaguguccaaucaguuuuuuuuuuuuguuuuuuguuuuuuuuuugagacagggucucgcucuaucgcccaggcuagagugcaguggugccaucucagcuaacugcaggcuccgccucccggguucacuccuuucuccuaccucagccucccaaguagcugagaccacaggcgcccgccaccaugcccggcuaauuuuuuguauuuuuaguagagacgggguuucaccguuuuagccaggauggucucaaucuccugacuucgugauccucccuccucagcuuuccaaagugcugggauuacagguguaagccacugugcccggccugugucuaaccaguuuuuaccuaaauauggcccccuaugcauuuuacucugacacuggcucagcuaaaauauucuuaauuucagaagaagaagcaacaagacagaacuacuguguuuauugaccaauuuaggcugucucagggcacagcucugaggaugggagcacacugaguacuuuaacgauccacggcaaggugacagcaucuugggcucagacacaagaauuauucucagacagggcuuuuuucagugccauaaauuuaagcagcuggaauucuuuuccauccuauucaaccuccugaagugaagaauuuugccuuuuauugggaaaucugcauuucauuguauagcuagaacacuauguccuuggcucccugauccucuagagaaggugggucuuuauuuuauuccagguucugggugucguuaggcucaaauaccaaaaagucucuuucagcaugagaagcuagagacacagcagugcccugaucaaagaauucgagcagccagcuguccaccccagugcaacgcaggccuuguacacaggguguagggaagaacugcaggucuaggagacagugaugcugguugcucagcaucauggcucccccuacaccucuggucuggagccgugugccgggccugccagggcgugagcacugcucugcugucugcagaaucaaaggaggguauuuuaaccagcauaacagaaggcaucaucccagucacugauguccuucaaaauaaccuucuucagaaaguauauacuuaugcuagugaugaugccauugcucagaauguuuuuggaauuucacuuuuagaauuguguuuaguuuagaaucaugccuuuuuccuuccuucugagggggaguuuuuuuuuuuucuaacugcgucugaaaauauuaaagaauccaucacuuaaaaauuuauauauguaucuguuuuuuuuguaucuguuaccuaaaggggaaauuacuggcagcaauuugauccccacacguuaccagaaacagauaccagucauuuaaacuuucgugaaccucauggguaauacacgcuaucucauuguuaauuugugcuuaccacuacugagguuggacauguuuccauguauuuuggcuauuugugaauuguuuguucuuguccuuggcucauuuuucuauuaaacgauuugucuuuuacuccuugagcuauagaagcucuucauaugauagugguauauggacaguucuuuuaauaucuuguguugugacacagcuucaucuuuugaacauaaauuagauuuuuggaaaugcauggcuugugacugauuaagucaggcuaaagugacuucagcaauguuauuucaguacccaugucuggaaggacuuaaacuugucacggacuuggagucagauguaaucaggaauagacagacuguguuggaggugugauuaggaugaguaauugacuaguugagaagcugaugaaaacuucauguauacauaccuaaaacauuuuaacuuaaaacauauaauguuaaacauuuaguugccaaacuuucaccaugggacccaacuggguuuacaaaugggagccuauguuaucuuacuuguuugcucuaugccuguaaggcauuuucugcacauuccaguuugaaucuuuuuaguguagaauggaauuuaggcacuuugaaagccauuagaaugcagaacucuuuuaguuuuuauaauuuuucccuguuuuuuacaguugucccauccaaaccuaauucaauaguaauuuuuuuaacaauucauuucuaucauuuaacuuucacagaaacagaucuuuuauauucacauuuaaucacuuuauauacuauuuaaauuauauguaaauuuaguguuucaauuucaauaauaaauacaaugggcauaaccgguuuuagggacaagccagcugacucuucguaagcacacagcucuccuggaugaagccaguuugguaggaagagagcuguuaauaugagugaacagauacauuuuagugaaaggaggcugcuauguuuuggacguccgcuccaaaacucauguugaaacuggguccccagugugucaguguugagagguggggccuuuggugggggugauuaggucaugugggcucugccuucaugaauggauaaauccauucauggauuaauggauuaauagguuaaugaauagauuaauccauucacagauuaauguguuaauggauuaauggcuaucaagggaggagaacuggugguguuauaagaagaggaagagagccuugagcuagcauggucagcauacugcacugccucaggaaucuuaagaguccccaccagcaggaagguucuuaccagauguagccucucgaccuuguacuucucagccucuguaauuguaagaaauacauuucuuucuuacuccuuaguuucugguauucuguuauaagcaacagaaaauggacuaagaggccuauggcuaucucaggcugucuggggaccuaagagacaaagggaaugggugaaagguuagaaucacauuucuggagaaccuaguccuauuuuccuuuccuuaguacuuugagaccucucccacucuggagaccucucaguucucccaagcugcacuccacauuuuucugucuaugaaaccaucuucagguccaaggacaauaccacaggaucugggcacuauugcaagugauaaacauaagcaugacaagcagauagcucccaagagccucuguagcaggagcagcagcaagaaaacuaccaacccuuagggcacugaagauggcccagaauccaauaccagcggguacccaaaaguccuuuguccuucgguuuacauuaugcccguggcugagagucaucaggccauaggccccaagugcaagugggaggguugaagugcaagggaaaauuaauauauacaggccagggugacaggcccaguguaggcuauuaggcuggauuugccccaggauugaaaacuuaguuagggccauagcccaugacacacaauuuuuuuuuucuuuuuucuuucuuucuuuauuauuauuauacuuuaaguuuuaggguacauguguacaaugugcagguuaguuacauauguauacaugugccaugcuggugcacugcacccacuaacucgucaucuagcauuagguauaucucccaaugcuaucccuccccccucccccgaccccacaacaguccccagagugugauguuccccuuccuguguccauguguucucauuguucaauucccaccuaugagugagaauaugcgguguuugguuuuuuguucuuacgauaguuuacugagaaugaugauuuccaauuucauccaugucccugcaaaggacaugaacucauuauuuuuuauggcugcauaguauuccaugguguauaugugccacauuuucuuaauccagucuaucauuguuggacauuuggguugguuccaagucuuugcuauugugaauagagccgcaauaaacauacgugugcaugugucuuuauagcagcaugauuuauaguccuuuggguauauacccaguaaugggaugacugggucaaaugguauuucuaguucuagauccuugaggaaucgccacacugacuuccacaaugguugaacuaguuuacagucccaccaacagcguaaaaguguuccuauuucuccacauccucuccagcaccuguuguuuccugacuuuuuaaugaucgccauucuaacuggugugagaugguaucucauugugguuuugauuugcauuucucugauggccagugauggugagcauuuucucauguguuuuuuggcugcauaaaugucuucuuuugagaaaugucuguucauguccuucgcccacuuuuugaugggguuguuuguuuuuuucuuguaaauuuguuugaguucauuguagauucuggauauuagcccuuugucagaugaguagguugcgaaaauuuuaucccauuuuguagguugcuuguucacucugaugguaguuucuuuugcugugcagaaacucuuuaguuuaauuagauccuauuugucaauuuugcacaauuuuuuuuuauaccaaagaucagguguccucaguuugcaauauggaaacaauuuggguuugggagucauaugugaauucaaguccagccuguguaacacuuugagaaaucacugaacuucucugagccuguuuccuauauugaaaaaugaagauaacauugcccugguuuguaugaguagcugaugugaagauuaggaacguauauaaaaugcacuguaauacauaaagaagguccccauuaaauaaaggcuguuauuauuaagagguacucaauaaauauuugaauggauaauauaguuaaauggaaaacuggcuguguuaggguugacuuggcaaaagcaaaaccaaaaagaagcacacaugugaaauaaccccuguuguuaggugguuagcauugagauuuaugugccucauucaaccugguacccuggugagaccaauucugggcaguucccaguguaugcacaaacgagaggguuguagugguguguuacagaggaaaauguuccaauugggaaccaacuuucuccuuccacacucacaggcaacaaagcguuccuuuccagguaaagaggaagaaaaacuacugaagugucauagauucuccauuuguugauuccaaacuagguguugucccuuuauauuuccaguaacugaguaaggauaacaucacaaacacuggggacucaggugcccaggccccaguguaccaaguucuguucuggaaagaauagacuugcaguuuugagauauaaacaaauugcaguauucacuguuuccucuuucaucucacucuuucuaccugaaauguuuacacucgaaugaguggaaaagauuauauuagucuuuaaaauuccugacaaaguccucugcucuagguggcuugaucagugaaagcuuugguguaaaagcagaaggucccaaaucucuagggcagguagugguggcaaaaagcaggaucggggucuauuugcuuugguuaccaugcuugucuuuuggagugagaggcuuuggcaaagugaugaugcuucuggggcaccaguuaggaaugguuggcauucacagaugaucuccuucuccuuuuuaaaaauuuuaauuuuguuuuuauuuuuuuaauuucuuguauuuauuuuuuuaaggacagggucucacucuaucaccaaggcuagagcagaguagcacaaucauaacucacuguagccuccaacuccugggcuuaagcaaaccucccaccucaaccuccugaguagcuagaacuacaggcucaugcuccagccugggugacaggaugaggccucaucucuuaaaaaaaauaauaaacaaugagaucagguauauauaaaaacauauauaaaugaaaaauauaguuauugaaauaagaugcaauagaugggauacacuggagacugguuaccauugaagcaugaguuaacagauuggaaaauaguacggagaaguuuagccuggcugcggcacagaaauauaaagaugucaaaaacaugaaagaacgguuuaaagguauggaagguaaaugacaggcuucaacauuauuuaauaaaagcuacagaaagagauuuaaaaagggaauggaagugaagcaauauuuaaauaaaugauuaauaauuuuccagaauugaguaacaacaugaguucucagaacaaaagugucuccuaauacuuugaaagcuaaacaaaaguuaacccgcaauuagacauagugaaacugcagaaacugcuuuuuauuucucuucagaaaagagaaaaaagagcaacuuaaaaauccaaaauaaaaauacaaguuauguauaaauaaaugacagacugacagguauuucaucagcaacaagagagguaagaagacagaggaguaacuuuucuguguugacccuaaaauacuauaccuagauaaacuaucccaggagaaugagagcaaaacaaagaccaagaauauaaauacaaagaugcucacugaaauaacuauuaaaggauauauuuugaguguuuguuucuuuuuaauucccauuucuauuuuagauucaguggguacacgugcaaauuacaagaauauauugugagaugcuaagguuugggcuucuauugaucccaucacccacagauaggaaacacuguauccaauaggagguuuuucagcccuugccccucccccuccuuuuggagucaccagugucuauuguucccauaaaggauauguuuuggaaagaaaaaauuaaacagugagaaaauauguacaauguaagaggcaaugguaaacauagaaauugauaaaauauauuuauauuuauuuguuagcuaugcaaaaaauucauaaguguguaugguuugaaaaacaugauuaaaaugaagacuaggcaacaauagcaagauggugcagauuuuuugggggaaaauguuaaagccauauucagagucaggaagauaauaauuauagauuuuuuaagaaaaaacuauagucaucaauuguacccagaggguuaggcuacauuacuaaacucaguggcccaaaauaaacauuaucuuauuuagcuuccaauucuuuggguugguugggcaauuuuuaaaucugggccagcucagcagaucuugauuggacucuaucaugccucuauggucagccggcgacuagaugaucuaggauagccucacucacaugucuggaaguugacugucugauccuuggaugucuuaguucucuuccaaauugcuucucaucuuccagcaggcuaccuugggguauucacaugguagacccagguuuccaaaugcagcaagagagaagcauuuaacuguccaaaaacuuuuuaagccucugcuuauguuauaugugcuaauguccuguuagucaaagcaugucacauugccaagccuggauucaauggggagagaaauagacuccacaucuugacagaaguaaaauaauuuauggguguuuuuggaaucuaucagagucugcucuuuggccucauuucucaugcaugcaaaauaugcucauccuuauccuaagcucucugucuuauuuauagcaucagguuggaagucuaugaucucaugauuuuaucacauucagauaugaaagaggguccucagcuguagcuccuuggguacggcagcucuugauccagaauuuaaaaugacaagucaccugcucccuacaccuccaucauauaguggugagacgggcaggauaacuggaauagacauuucucuucaaaaaggagaaaaacaaaaggcacauagcaguuacuggucuguaacaaaucaaaauuccccuggggcaaauguugccaggucaucuaaucuaggaccauugcuucugcucucuggggugucuucccaguuuguuguucuccaaggcucuugacuccauucucuaguaucuugguucucccccuuaaaaagccuuuccuuuuccauaagaaauagugcagcugagucccucucucaucugucuuucuuuccauaguugagggcccagagaccucuuuguggcuuaaucaauuuuagucccuuccaguccaagcugaugguguuuuguugggaugauuuucuuuaaaauauugugggcuuucuauguaauaggauauagcccaacucauuguauaaaaacuacacccacaauuuuuuuuuuucucucuagaguuauucggugacuugggauuaggcuucugucaggcccuuaagauucuuaggagcuuuuuugacaagauaaggugugcuaggcacuuucuuaaauccuucagaggccuuaacaaauggucauacaacccaacucuuaauuugcucuuuuaaggccuccuuuuacucugagaauauuuuacucaaagguugucaaauauggggagacuggagacgagguacaguuuuauuuuccaacaccgcaaauccuggaccuucuauauuccaucuaaauucugguugcaaacugaacauuuccuucuuuagcucaccuuugucuugccauacuuuagcauaugcaguuaagagcuccuaaaugacacuuucgaaauucugucuggagaucuacuuagcugcaacuaggaguucacuagggucuuuucuuuuugaaaaucucaggagcugguuuuuugaaaagaucagcaaaauugauagaccgcuagcgagacuaauaaagaagaaaagagagaagaaucaaauagacacaauaaaaaaugauaaaggggauaucaccaccgaucccacagaaauacaaacuaucaucagagaauacuauaaacaccucuacacaaauaaacuagaaaaucuagaagaaauggauaaauuccuggacacauacacccuuccaagacuaaaccaggcagaaguugaaucccugaauagaccaauaacaggcucugaaauugaggcaauaauuaauagccuaccaaccaaaaaaaguccaggaccagacggauucacagccgaauucuaccagagguacaaggaggagcugguaccauuccaaucaauagaaaaagagggaauccucccuaacucauuuuaugaggccagcaucauccugauaccaaagccuggcagagacacaacaaaaaagagaauuuuagaccacuauccuugaugaacauugauguaaaaauccucaauaaaauacuggcaaacugaauccagcagcacaucaaaaagcuuauccaccaugaucaagugggcuucaucccugagaugcaaggcugguucaacauacgcaaaucaauaaacguaauccagccuauuaacagaaccaaagacaaaaaccacaugauuaucucaauagaugcagaaaaggccuuugacaaaauucuacagcccuucaugcuaaaaacucucaguaauuuagguauugauuggauguaucucaaaauaauaagagcuauuuaugacaaacccacagccaauaucauacugaaugggcaaaaacuggaagcauuccuuuugaaaacuggcacaagacagggaugcccucucucaccacuccuauucaagauaguguuggaaguucuggccagggcaaucaggcaggagaaagaaauaaaggguauucaauuaggaaaagaggaagucaaauugucccuguuugcagaugacaugauuguauauguagaaaaccccaucgucucagcccaaaaucuccuuaagcugauaagcaacuuuagcaaagucuuaggauacaaaaucaaugugcaaaaaucacaagcauucuuauacagcaauaacagacaaacagagaggcaaaucaucagugaacucccauucacaauugcuucaaagagaauaaaauaccuaggaauccaacuuacaggggaugugaaggaccucuucaaggagaacuacaaaccacugcucaacgaaauaaaagaggacacaaacaaauggaaggaccuuccaugcuuauggguaggaagaaucaauaucaugaaacuggccauacugcccaagguaauuuauagauucaggccauccccaucaagcuaccaaggacuuucuucacagaauuggaaaaaacuacuuuaaaguucauauggaaccaaaaaagagcccacauugccaagacaauccuaagccaaaagaacaaagcuggaggcaucacgcuaccugacuucaaacuguacuacaaggcgacaguaaccaaaacagcaugguacugguaccaaaacagagauauagaccaauggaacaaaacagagcccucagaaauaauaccacacgucuacaaccaucugaucuuugucaaaacugacaaaaaccagaaauggggaaaguauucccuaugcaauaaaugguuuugggaaaacuggcuagccguauguagaaagcugaaacuggauccccuccuuacaccuuauacaaaaauuaauucaagauggauuaaagacuuaaauguuagaccuaaaaccauaaaaacccuagaagaaaaccuaggcaauaccauucaggacauaggccuggguaaggacuucaugucuaaaacaccaaaagcaguggcaacaaaagccaaaauugacaaaugggaucuaauuaaacuaaagagcuucuucacagcaaaagaaacuaccaucagagugaacaggcaaucuacagaaugggagaaaauuuuugcaauuuacucaucugacaaagggcuaauauccagaaucuacaaagaacucaaacaaauuuacaagaaaaaaacaaacaaccccaucaaaaagugggcaaaggauaugaacagacacuucucaaaagaagacauuuaugcagccaaaagacaaaugaaaaaaugcucaucaucacuggccaucagagaaaugcaaaucaaaaccgcaaugagauaccaucucacaccaguuagaauggcgaucauuaaaaagucaagaaacaacaggugcuagagaggauguggagaaauaggaacacuuuuacacuguuggugggauuguaaacuaguucaaccauuguggaagacaguguggcaauuacucaaggaucuagaauuagaaauacuauuucacccagccaucccauuacucgguauauacccaaaggaugauaaaucaugcugcuauaaagacacaugcacacauauguuuacugcaacacuauucacaauagcaaagacuuggaaccaacccaaauguccaacaaugauagacuggauuaagaaaauguggcacauauacaccauggaauacuaugcagccauaaaaaaggaugaguuuauguccuuuguagggacauggaugaagcgggaaaccauccuucucagcaaacuaucgcaaggacaaaaaaccaaacaccgcauauucucgcucauaggugggaauugaacaaugagaacacuuggacacaggaaggggaacaucacacacugggcccuguuguaggguguggggaggggagagggauagcauuaggagauauaccuaauguaaaugaugaguuaaugggugcagcacaccaacagggcacauguauacauauguaacgaaccugcacguugugcacauguacccuagaacuuaaaguauaauaaaaaaaaaugaauaaauguacucagaaaaaaaaagaaaaucucuuaaguuacugcaagcuuuaguuucaccaguuguucugucucaacccaacacgagccaucauuuugccagccugcuauagcaguuucuucuccauuucuccggcaaacuguuuucuuacugcuuuucucaccacuagaaaagccauuauuucaaagccaguaccacauguuauaauuuuucuuauggcaccaccccacauuugaaagcaacugcuguaucaguuagcuuuuacuauauaauaaaccaccccaaaauuuagagacuuaaaccauagcuauuuuuauuuauaucacaauucuuuggguuggcuagguaguauuucugaucuggaccagcacaacugaucucuuaacuacaugcaacuaaagcuauucuuugaggaaaauuuauggccuuaaaugcauuuaugaaacauuuaacauaugaaaaauaaguugaggucaggcaugguggaucauagcuauaauccaagcacuuuaggaggccaagguguggaucacuugagcucagaaauuugagaccagccugagcaacauggcgacacccugccuccacaaaaaauacaaaaauuauccggguguagugacgcgggccuguagucccagcuacucaguaggcugaggugggaggauaucuugagucugggaggcugaggcuacagugugcugugaucaugccacugaacuccagguugggcaacagagcgagaccccaucugcccucaauuccuaccaaaaagaaaaggauaacauguugaauagguauuacuauaaauuuuauuuggcuauauuuaaaagauaaucuaaaugaccauggcuuuaaugaccuagggguuuaacauuugccauauaacaagaaguuucgagguaguccaaggcaaauauggauucuccauuaugccaucaggguccugggcucuuuuaacauccagucaucuaaacauaauuuucauacucaugcuugcugccucaugguugcaaaauggcugcuuuacuuccaguuuagcauucacauuccaagcaugauggagaaaggacagguuuugaaaaaggcaugugccaagugaguuggcuaccuuuaauuagagagcuuucuuggaagcccuauguaauaacuuucacuuauaugucauugguuagaacugugucauuuggcaguuccuagcugcaagggagccagggaaguauaguguuuuuuuuuauuuuagcaugguguauugccuucccaaaccaaauaaggguauguuaguacggaacaagggagaauauuauaaauauuguguaagcaauuauuguugucuacuauauauauccuacucaagaagcuagaaaaaaaauccuaaagaaaccuuuggaaaaguagaaggaaggaaacaaaggaagacaaaugaaauagaaugucauuuggaggauuaaaaaagugauauagauaaaacccuaguaaggcuuuuuuuuuuucaaaauaagacccacaaauaauauuuugaaugaaauggaaauauaacuccugauaugaaauugauaauaaacaucaaaaaccuauacucugaaaauuuuuauguuaaaauuuggauuaggaggacacauggguaacuuucugggcaaauauaauuugccauaacuacuucaaaagauauagaaaacugcaguaaaauaacaauuauaaagaauuuaaacugauaguuaagagacuucuucucccaaaaauauaaggcuuaaaugguuuuuugcauguagaacuccaagaaguaaauaauccuaauauugugcaaacugucuaagaggauagaaacuggggaaaagcugucuuuuuaaaauaaugauaguauaacuuaaauauccaaauaagacaagaagaacacaagaaaggaaaauugugggccaguuuuauuuauaaauauaaaugcuuaugaaauauuuacaaaucuauuucaaauauuuacauucugauuaaguagaguuugugaaaggaauagaaggaugauucaacauuagaaaauauauuaaugucauaaagaauauuaacagauuaauaaugccuauaaucuauuacauacagaaaaaacauuagucagaauuuagcacucauucacaauugaggcaaacuucucagaaaacuaagaauagaagagaacuuccuuaacuugguaaagaacaucuaucaaaauaguacagcaaaaaacaauccuuaacaauacacaguaacaucaggcucgcuuucaauaaagucauaaaaaagacaagaaugcccuuuauugcuauauucagcauuguacaggagguucuagccaaugcaauaggacaagaaaaaugugaauauugaagauaaagauuaaaauguucuuacuugcauaccaauaagauuuucuugggauuuuuaaguggaagauacagucaucccucacuauccaugggagauugguuccaggaccucccuugggugucaaaaucuguggaugcucaagucccuuauauaaaaugguauaguauuugcauauagucuacauguauccugcuguauacuguaaaucaucuuuagauuauauguaauacccaauacuauguaaaggcuauguaaauaguuguuauacuguauuuuuuauuuguauuauuuuuauuguuguguuguuauuuuuauuagauuuuuaaaaaauauauuuuggauuugcaguugguugaagccgugggugcagaacccauggauauagagaaccaacuguauacuguaagaauuccaaguuccauaaauacaguaucaacauauuaaaguacuauuuaccaggaauaaccaauuagaaaaauuaauagauaaaggaucccauuuucagcaguaacaaaagccauaauauacccaggaguacaccuaaccaaaaaguacacaagaauauuuaugaagaaaauuacaguuguugaaaggaaaaaaaaaagagauccuuaauaaauggagaaaagggcuauauugauaaacuggaagauucauuauaaaggugccaguucuccacaaauuaauucauaaguuaaauguacuucuuaguauggaugagcauauggaaugacagucuccuacgcugcuggaaggacgguacuacagcuuuaggaaacaauuugguuauacccuuuacacccaggaauuucgguccuagauggagaaucuuucuuguguaccugaguagacguuuaauauuaaaguguucauugcagcaaaaaaugggaaacaguccaaauuuccaccaguaggaaaaugaaugaaauauuaugcauacuauauauagcaguaaaagaacuauaguuauauuucuuaagagaucaaucucaaaaacaacauugaaugaaagaagcaaguuacaggaggauaugaaaagaauaguguuuauaugcguuuuaaagccuggaaaacaacacuauauauacaguguuugugcuuauacugucuuucugugcauucacacaaacaugucugggaaugauaaaacaaugaguuuauaaugguucuuacgggaggaacagacauggaaaugggaagaaaggguucccaaagagacacaaauguaucugauguucuuuuaaucaagaauccguuuugucgcuaugauagaaaucuuucaccauuaaaaagugcuuuauccuaaaugcaaugagguaucuuggauuagauccuggaacauaaaaauaacaucaguuaaaaaacuggugaaauccaaauaaagucugguuucuuaguuuugaaaaauguaccauggugauguaauagauuaacauuaggggaaacagagugaagaguaccagggacucuguaucaugucugaaauuuuucuaagaauauaauguuauucccaaauaaaacauuuauuuuaaacaguggggaggugguggaauuuuuuaauggcuugaauuagcugggcauagaaguguguagcuguaguccuagcuauuugggaggcugagauggguggauugcuugaguccaggaaucugagccugcaguuagcuaugauugccauuguacuccagccugcgcuacagagcaagacccugucucuaaaaaauaaaaaaauauagcugggcauggugguguguacuuguaguccuggcuacuugggaggcuacggcagauggauugcuugagcccaggaguuugaggcugcagugagcugugacugcaccacugcacuccaaccugagcaacagagugagaccuugucucaaaaaaacaaaacaaaacaaaacgaaaacccaaaaggugcucaugucuauuuccccagcauugucaacuuugaacucugucccugagguggauggacuccugacauguccuugcgguaaauauuuccuggguauaaaugaugcuucuagucuuuguguccugcaugucucaucugcccuguuuuaggacacuccuagaggguaccagucucucugcaaagucuucuuuauuccaauuucaugggucauuugguacucaccuaagacccagagaucuuagaguuggaauggacccuaacagagugcccugugcagccccuuuccacagggaggucaguccucuggaggauaggcugaggaacucagugagcaaaaaggacuagaacccagaaguuugcuuccuagaauuaucuuugcugucaccucauugucucuuacaauaaaggcaaaagagacugaauacccucucuuauuuguuuguuugcuuugaaaacuaguggagaggucaggcacuguggcucaugccugcagugccagcuacugagguggcugaggcaggaggauugcuugaggccaggaguucaaggcuacagugcacuaugauuguaccugugaauagccacugcaugcuagcuugggcaacauagcaagauccugucuuuaaaaaaaaaaaaaaaaaaaaaaaaacaacugaggagaagaguuauauauuacccagaaauggugacacacacuggagcuggaguuaucaaggugagguuggugcaucuuuuuuucucugugcuuacagaccuuccuaagauuagacacugucugcuucugagggaagagugggcugggugcagacagaacuaagaguuguagaauguaugccugccccuccgucuuuaucacaacccgauggaguggucaauugcuccugucuuaagaugaguuaacaggcuuagaaagguuaagugacuucccuaagguaauaaaacuaauaagagguaggccuauauuuuaggauucuaagaacucaugacuaaggaagaccccucugaaggcagggaggauguauuccccagagccaacuuuuacucuugaaagagcuguggcugggaaugauguggaaccugagccaagacagagcagcuagccuaggacagguugaggacagauccagguggugaggaucaggccugccagggcuacaugccaccauggauuccucccucuggaaaagaaaguuauacaaguuggcuuccugcuccuccuaccccucauuccucuguuccauccuagcuugggggcccauguccacuagccuuccugggaggccucccccaaaccaagguccuugcuuugucucuguuuaauagguaugggagaggcuuaugugacuaaagaggacaccucagagcuuggucgagauaggugugugagaguaaacucaaucauuaugugaaugugguuguuggcugaacacagagcauaaaccuagaagauuugugggagcaaggagggaaaaugccuuuuaagagaggucuccaaggagaauaugagauuaguugagguucagugaguuccuuuguugcugacucaagaagcauauuugaagggauaagcccucucacuuagagcagaagcaucccagccuuguugccauagugacagugcucaaacagaggcuuaaaaaacagaaaacaccaugucagaaggauuccuuuggagcuaugaugccccaguagaggucccagcuauugugugcuauggaggagaggggcagggaauuugaauaguuccccuuccuuccuguuucuugcuguggggcuuuuguuuuggucuuucucucuggacugauacggccuuuggaaagggaugugucucugcagaaggaaccagucuucuuuuaaaccugugucagaaguuggaggcaucucucuuuuucaggcccuuuucuugguuaugcugccuguuaacuugccauucuggaauguagcagaguuuucuguaaagccagccaccuuaccuuuauuccuauuagaacaugaaucuguuugaagcaagcuacauauauagucuccuuguccugcucccuagcuuggaugcucuuagaccuggauguucauucuuaucucauagaggaaggaugaaagggcccuuacaaccagacagaccugugagauguggucacuagucacuuggcuuaucuggccucuuuaaacugugccccaauuugcaaggacauauuaaaauauaugauuauuucuccuaaucugucugauuucauuguuuccaguauuuuugacaucuggucuucggcaucuuugcuuugacaacaugguuuagacuucaguuugcuuugacccauggacugcugagacuugagcuauugaauuacugauacgggaguugugagggguguguugagucuguuacuccuucugguucuaggucccugccugauaagcuguauuccacacuauccgaagaucauaccuuaagccucagcaagcccucugucuuaaauaucagaguguguggguucuguaccuugucagauccgacaugguguccgucccagcagcacauugggagcuagccaaaucuggauuagacauagucuugccuuagggcacuugcagucuagugauagaagugacgcuagaaauguaagcaccucaaaggagagaucuuugucuauuuugcuuuguucauuaauguauccccuaugcuuagaacacugacugguauguaaguauuuaauacaaauguguugcauaaauggacacaaugucuaugaacaaugucaaaagagaaguacaaaugaauaaggcaguuucagagagauaagauauuggcagaggaaaugaacagacaaguugaucuuguuuuuuguuauugacuauaugauucuuuggaauuuguugagacuugcauuauagccuuuugcaguuuaauuuuugaaaauauuuucuauguguuugaaaagaguaaugcauauuuuguaauuaucaggcauaggguucuauauaugucuauuagauuaagcuuuuuugcccauggugacaaauuugggaguuuucacacaaauaauugugagauuggauuaaauugagcagaauuggccugauucugagcugugauauuggagauaguuacuagacccccauuucuaaaacugaugaugccagggguauucucuaccucuuuaucucacuucuguuauuauuauauagugauucucuuucugauuaauuauauuaaagucuuuugucugauauuaauuuacuuauuccaacucuuuuaugguuaguuuuugccuaacuuauuuuuucauuuauuauuuucaaugccuuuguguuuucuagguucaucuuaugaauaguauauagguggaauauauagcuacagauauagauagauauuguauauaauauuguauaauaauauuuuaucugucuuuuaaugggugaauuugguccauuuauauuuauugugauuucugauaaaguuagaguuggagagacaugaguauaccuggauggaugaauugcugauggccaugaugggagauaaucuaccacaacaguauaccagaagauaccuaauaaauguuaguucucuuuuuuaaccccugucucuagucucuuccuaguggauauuuggaugauuuaaguagauuuuuucugauuagcuccuuggguacaaauguuauaucuuccugacacucucagacucucuaaacccuagcauucugaccuuguaggugguguauaaaagaacuggauugauuguaggggguuaaagagggaguggguggaaaggaaauuguggcaggagauguugaugacucauugaaaacauaugaguggaaagaaaggcuagaaauaugaugguagcuagaaaagggaguaggucucauuguugguauuuuuaagagaggaugucugaagacggaaaaaaaggaacugacagaaaaugagugguugaagguauuaaugaggcaaggacuaagcuaucacuuaucagcuucuuuagagugagaagcagggagaaagggauauacagaaaaauauuuuuacaagguauuccauagaaauauacaucucuacuaaauuauuaguguaaacuauguaaagauaggcaauaugacuuuuaaaauauagauuaaucucauauuuccuuaccaagcucuuaauaaacauuaguuaggccaacuggauuuucugucucuacuauuuuauagcacuaggaagaacuuuuaauucaucaagucuauacucccaucuaagauaggagaccuuucauagcauccuucacagauaguuguccaggaccuuuugaacacuugugguuuuaagaaucuaccaccugaaauaugaagcugcugccuuuguccagagguccgguaguaagaagcuccucuuuuauucaauagaaaucugccuauauguaacaagcucuuucuggaacagcauaucaugaauauaauuucauuauauguuugaagucuccaccauguaucuguuucuucguacuccaucuucuaacauuaccugagaccugucucauaagaggacuucuggauccccaagaaacuuuugccuuuuuaaaacaaggaauuccaguuuuuugcauucagacuaaagcaguugcccagaaccaugaaugaaaacggaauuuugucugauuuuuaaauaucuaaauaaaaugauuauguaguuuuuuucuuugucacuaaguugauacuguaaauuacacugauuuucaguuguugaaccagccuuacauuuucaggauaaaccacacagaauaauaauauauuuuuuucaaaauauauugcugaauuugauuugccauuauuuuguugaggauuuuuguguuuauauuuaugaagaauauuguuccaugguuuuuuuuauaaugucuuuaucuuauuuucauaucaaguaauguugcucucauaaaauuucuuuaauugagguucucuauuucuucuugugggaauuuugguaguuugugucuuucagugaauuuuuguauuuuaucuaaguugucaaguuuuuauauuaugacauagauuuguuuauauauauauagagagagagacuuguucuauauauauggauucauauauauauauauauauauauaaugucuguaggauuuguagugauguucucuauuuuauuccugagauuuauuuuuguaccaucuuucuuuuuuuccugaucagccugccuacaggcuuaccaauuuuauugaucuuuccaaaaaccaaacuuuuggcuucauugauuuucuuuucauuguuacugauuucugcuuuuaucuuuauuauuuccuucuuucugagaaauuugguuuuaauuuguucuuuuucuaguuuauccuaaaguggaagcuuagaucacugaguuaauacuuuccuucuuuacuaauauaagcacuuaaugcuacacauuuucuucugaccuuuuccugcauccccccaaauuugacauauugugccuuuuuauguccauuccauuugaaauauuuucuaauauucauugugacuuauuuuuugaacugugaguuauuuggaaauguguuguuuaaucugcaagcauuuuaggaauuuguuagauaccuuccuguuacuaaguuuuaguuuaauuucauaacgaucagagaauauuucuauguggucucacuucuuuuaauuugauucagguuuguuuaguagcccagaauauggucuaucuugauaaaucuuucauaugcauuugaaaacaauguauauuuugcauuuguugggucaagugucaauucagucaaguugguugauagugguguucaccuuucuaaauucuuacuuauuuucuguguacuuguuuuaucaauuacugagagaggaguguugaaaucucuaacuacaauugcggauuuuccuaguucuccuuucaggccuaagacuuuuuggauaauguauuuuggaacccuguguuagauguguacacauuuaggaguguuacauuuccuuagugaauugauccuuuuaucauuaugaaauuacucucuuuaucccugguaauauuccuuuuccugaaaucugcuuuguuugauauuaauauagccauuucaguuuucuuuugauuagugcuuacauuuauaucuuuucccauuguuuuauuuuuaacccauuucugucuuuauauucaaggugagcuuuuuuuguggauagcauauaacugggucuuacuuuuuuauacagucuaacaaucuuuaauucauguaguuaggccauuuauaauuaaugcaauuauugauaugauuggauuaaaacuaccauaaauauuuuuuguuucaucuuuuucuugucccuuuuauccucuuuuucugcuugccuuuguauuuauugagauuuguuuguuuguuuuguuuuguuuaagguggagucucgcucuguugcccaggcuggagugcaguggcacagucuugcucacugccaccuccaccucccaaguucaggcaauucuccugccucagccucccaaguagcugggacuacaggcacgugccgccaugccugacuaauuuuuguauuuuuaguagagaugggguuucaccauguuggccaggcuggucucaaacuccugaccucaguugaucugccugccucagccucccaaagugcugggauuacagacaugagccaccacauccagcugagaauuuuuauuauuucauuuuaucuccacuauuggcuuaucauuauacuucuuuuuaaaaauguagugugugcucuaguguuuacaacauauaucuuucaucacagucuaccuuccaauuauaucacuucacguaugguauaaaaaccuuagaauauuauacuccaaguucuuucuucucaacucuugugcuguuguuguuaugcauuuuucuuuuacauacccuauaaacccauaguacauuacuacuauuuuuacuuuaaaaagucaaucaucuuuuagagcaauuaaacauuuuaaaaaaugucuuauauauuuaccuucauuuuaaccauuucuggagaucuuaguuuauuuguuuggauucaaauucugucugacauaucccuucugccugaagaaguuucuuucuaguucucauuaugcaaguuuguuaauaauuaauucucucagcuuuucauuuaguuuccaaagucuguauuuuucuuuuauuuuugagaaauauuuucaggaguauggaauuccagauugacaggguucuuucuuucaguaccuuuaagauuuccuuuguuguuuucuggguuugcacuuuuucagaugagaaguaugcuuucauguauucccucacccugucugccuuuaagauuguuucuuucccuuugauuuucagccacuugaagauuauaugccuagguguguuugguuguuuuuguuuguauuuauacugcuugaaguacucugagauuuuuggauuugugguuugauguccuucauuauuuuuggaaaaugcuuaauuauuauguaaguauuucuucugacucauccucuauuucuucucuuucugagauuccaauuauaugcauauuagaccauuugauauuauuccauagcuuuuagauucuuuguuuucuuuuuuucccccuacucuuuuauuucuuuguguuuuaguuuggauaauuucuguugacucaucuucaaaaucacugauuuuguuuccccaguuguguugagugugcuugugagccuguugaagccauccuuaauccauagaaacagaaaguagacuauugguugccuaggguugggaaaccuuaggguaggauauggggagugacugugaauagguauggcauuucuuuuacaggugaugcaagugcacuaaauucauugaggugaucagugcacaacucuuugacuauacuuaaaaagcauugauuugaagacuuuaaauuguaugguauaugaauuauaucucaauagagcauauauauauaaaauauguauuauauaauuauauauuauauguaauauauauaauauauaauuauauauaauauguauauauaauauauacaacuucaucuuuuauguucaaaggcuacauugauaaaacucugguuagaaucaggaaggagcaagacaucuuacugauggugcugaaggguguauagaacaaaaauaauucugaaggaaauguuacaggcugggcacaguggcucauaccuguaaucccagcacuuugggaggccaaggggguggaucaccugaggucaggaguuugagaccagccugaccaacaugguaaaacccugugucuacuaaaagugcaaaauuagccaggcaugguggugcaugccuguaacccagcuacucaggaggcugaggcaggagaauugcuugaacccaggagguggagguugcagugagcugcaccauugcacuccagccugggcaacaagagcgaaacuccgucucaaaaaaauaaaaagaaauguuacuauaacugaagcugguggaaggauaggaauuauuauuuugucccguguuacauacuugauucuaaguguuggaaaaugacucuauuaaguaggaaguguucuuaauuaguccaugucuuuauguuuccauguguuuuguaauuuauaguuauuagucuuauaaauuuuaaaaguuccaagucauccugaugcuuugaguucuaccuaguggucaaacuccucucuacuauguguccuuggacgccugacccaccagguacuaguguuaucugguagugauacuguugaauuuuaaugaccuggcugagaguuuccauauuaccuccuucuguuauaaaacaaaauacaaguaggccuguggagaguucuccaaacugagaauuuuaguacagcuuuccuacaggagguucacuaagaaauccacaaacaucaugugguagccuaccaggugcuccuuagcugcaggaaagauacccaugcccuggaguguuguauguuuccagacacucagaacacuucuaaguguuucuugauguuucugguauggcauaacccccaaaauauauuaagcaaaauaaagcaagguguagaagaguguguauaauauguuauuauuuguauuuaagaaaaaguggguauaaaaauauacauguauuuucaaaacauaucucuagaagaugugauuacauggcugauucuggaagagaaguuggugcuggauaccuaggagcuggguaccuagaagcaggugugggugaaagacauuucacuauauacuuuuguaucuuuucaguugaaggggcaagggaaaacuucuccuuugcccucugaagguucacuaaacaucaaaugacaaaagguggauuaauaguagaagaggcacauaaauuuauuugaucauaguuuuccaugacaugggagccuucgaaugaagacccaaagauacaaaggaaacguucauuuuuaugcuuagguucaauaaacuguggacaacuguguaaaaauaugauugggcaaaaaggguauaaucuaaugcuaauagacugaguagggaaacucagcaaggccuuucuguuuguauuccuccucucugugcagcauuucuuccuucugauggggcaagacucucucuggaauggggcucuuaugaccuacagucaaacaagguaggucagauaauuucuuuauggccaguuuuuacacagaaaggccagggggagaaguuagaauaauauuuuuagguuuccuggcuggcuuuaaggaaaagggauucugguuucuauaaccugccuuggggaagagggauucugguguccuuggaggagaaugaguggccagagacaggagggaagaagaaggucagagagaaacuuuugcuucugaggcugcuucugaagucuucauuuugggguauuguuuucugagcccccaaacaauuucaaaccauauaacuguauuugcuauucaaacaggaauacaaguuaaauuaaaacaaaaucuuccuaggaugguuaauuaaacuugaggcucagauuggcccuugauaauuuacucuuuguccuuauuucucaucccuggggucuucugucuucaggucuuccaccccugaucaguugccugccacagacauauucaaauauuccccuccgucucugagccuaauagaaacucuacacagggaugaagcaggauuucuaaaaucucucuugugacugauugccauauugaaccucaggcuuucuagaccagugguucucaaccuugagccugcaucagagucaccuggaggacuugucaauacgcagguuucucagccccacacccagaguuucugauucagcaggucugggguaggacccaauaaucugcauuucuaacaaguucccaggugaugcuaauuagggaccacacuuugagaaacacugcucuauccuaaaauaguuucuccuaugauggauugauguguaguuuuuguguuccaguugugucuucauuuagacauauaaagaaauaaaaggagagcuauguuccuuuccaugggcaugcuuauagugcaccauugcccagcucucuguccagccaacaauacccuucaggcucguuaugccucauaagacaauaugcauuuuaccaccagcagagcugacacaucagaaaccuggcauccuccuucaucucuacuucccggagcagacauucuuguggucacugccaucaacucccuguaaagacuuaauugguauuuuagagcaggcacuagaagagucaugcuaauuacucauuucccuuccaguguuucucuccaguggugcuauuagcauuuuaggcaagacaaaaugcuuuauaaugcucuuuauaaugagcauucuauuuaauguaggacauucagcuccuuucccuuguucucaagucguugugacagucaauaaucccacugcgcaucccaaugcucccucaaucccccuaacccuuaaccccgugcaaccugccugcaccaccuuuacccaccugcacccccaccuccaggaugggugaugagggcaacucaacuuuccacugagaaccaccaagaccuuuauuaaauuaccuguccagaccuuugcuuuagaucccugcaaaaaucccaagacauauuuuauuauuuuccuuuuuaucaaauguugauauuaaaaaguuaccaaacucugaggcugggcgcaguagcucacgccuguaaucccagcacuuugggaggccgaggcauguggauugcuugaggucaggaguucaagaccagccuagccaacauggugaaaccccaucucuacuaaaaauacaaaaauuagcaggacaugguggcgugcaccuguagucccaacuacuugggagacugaggcacaagaaucacuugaacaugggaggcagagguugcagugagcugagauugcaccacugcacaccccagccugggcgacagagcaagaucugucuccaagaaacaaaaaacaaacaaacaaacaaacaaaaaacaguaaugaaaugccaaauguuuccuuuugaaaacccuauugguagaauuguccauuguucaguggacaauuuuccaguguuguucaguccucucucuggagagagaccuuuuggagauuagcacuggagggcccuguuaccugaugaaguggcuucguguccucauuugacaaggagaauugugugaccucuccuguuuccuuuuuugccaugagugucagggaacucggggauagauguaaugccugauaggguugaaaaauuagcuuagaaaaucauuucacccauauuaucagcuuuuauauaguuuuaauuuuuacauaauuaacagcuuuauuuuuuguuuucuugugaguggcuucuaauuauuugagaagcaggagaguauuaaaugucuguggugcaugugaguugugaaauaauagccagauguggccuaaucagcugggcaaaagaauggaaaugacagagcacccaggggccucccgugugcauggggcaggguagggaacugaggauagggagagcagcagguuuggaggcuccucuggcugguagaaagcagaagggggcugcugagaaugaagggccaggugugcucacuggagguggggucaagguuaaggaacuaagaagcaauagguaucccuaaaccuucaccagagauggauauacauugagggggguggcagcagauguccugagcuugaccuuucucuucaaggucaagagauguccugcugggauugccuggauuagcuuaugagacauguggaaaccauuccuuauagaaacaccuguucugcuugagcucucauuugguccuguggccaaacagauuacagggagcaacugggugcagacaaggcuggcauuccugaaaugaacuuucugcugacacuuccuguccagguggaaaagagcaccuggcugugggacuguaauggggugggaauuccaccucauccugccccuucuuugagagccccgucucucccguuuccuuuucaaagugucccucaaagugucaggggaagccacaacccuaaacucaggguuuccacccucucucucuccuuugugauuuauuaagggauuguguaaggacguuuucaguguggaaguccccugcugaaaugcugucuuagucuaucugugcugcuaugacaaaauaccugaggcugggugauuuacaaauaguagaauuuuuuuuccucacaguucuggaaaauggaaguccaagaucaagacaccagcagauuuggugucuugugagagcuguuuucugcuuccaagauggugccaaguugcuuuguccucacuuggcagaagacagaagagcaaaaaagggccucaccaguucgcuccagccccuuuauaagguugcugauccuauucuccagggcucugcccucuugacuuaaucaccuccuaaagguccuaccucuuaacacuguugcaucagggauuaagauucaacauaaauuuugggagggaacagaaaacauucaaaaacagcaaaugccauugugagggcuugauuuccuuuggauuuucaaacuauccuuuucaaauuaacacaccaucuggauggguagcuuauggagggcucugaaauaaguuauuugucccucugaggaaauggaauugcuacuuacuguagguauuuauuucccucuuaagaagugagauuuucccucagaggaaaacaaaagugucugaagggaggagaagggggaacuucaggagccugggccaggcugagucgggggucccguguuccaccuugguguggugcugggggaacagagcauaucagcccagcccugggacagugaagguaggagagacacuccucuagaagcacagugcuuucccaguguguugguguuucuuuuccugcccugucagcccuuuauuccccuggccaugucaccgaagccagaucccugauagccaggagccagcucccuccagaaugccccaacagccaccuaccugcacugccuuucaccugcaggaaggcagcucccauggccuuccucccucaccccugccagggccucucccuagacccugcaaucuacccugaguaccaccgucaugguucugcgucuguccucugugggggaagaaaguaccucguucugguucuccuuguaacuauuguuccugaacucuaaacguauaacccccccacacgguaauaaaagccacccaucgucacuguugggaugcuucccuauuucuacauagccugucccagagugauguacuccucccagccgcucccacaucccuuuugcgugucugucucugauuuggcuuuccuuuccuccuucccacccacccagguggcucccggcugccucugcugcaguucagagcaacuucaggagcuucccagccgagagcuucaggacgccuuuccugucccacuggcccaguugccacaacaaacaacagagaagacgguggugagugaacagaguuuacauuaugcuguugaccauuccuccucaguccacccuggggaggcugcagagaggggagcugugugucuuucuaggugcccagaagagacugcugcccccaaggugagauggcaccuggccagcugcccaagcagguaagagugaaggcaguaugcuguagcauugucuguugauuuuggcuuagcuggucagaauucuugaacuggcgaaggugguggaaaucaucauuggaacuagccaggaaacaagauuaagggccugcggguugcccuggcugcugcuagaaacuguucacacugcacgcugugguacuccauccuuccaagcuggcugaaaacuuucuccuccugcugcuccaggaugcugcucugacuaacucugguuuugauuucuccuuugacuccaugguuccuuggcaagcaggcauuguuggggauggaacacagguggaacuuuguguuaccuggacccauaaccauagcuaguucugugggacugagcagcugccagaacacuauccauaaccuggucaccugcacucuguuuggugagaaauccugugugauaauagguguagagugagccuguuuaacaaagacagugccuucuuugggcagcuguacaauaguaaauauucuaaauaauauuccaaaaugugggugaucguuugggauuucauauguguaauuuggggcuuaggguguuuccauugcuuucugcagcuuuagcagugaggaaggugguuucccgcugcuacccuugacccccuccuuagggucuaacuacuacaguacuucagggguccucagcuaacaucagccuggggugagggugucaguuaacucucagugcagaggaggcuggcagggccaaaaccaauaccagugaaacaaagaaagugagaagguuggugggugguggaccuggggaggcaugaauuaauaacaggaaguguggucugugauuucaaaaaaauaauacugauaauuucccccauggugcuaaaccugcuuugaacuaugaccccaucauugacuugagggaauagcuucuuagauuacuuugaaagacauaucgaaguauguagggccugcuguuuuguuaaggaaauaaaucccauaacauuaaaggaauuuuuuuaaaagugacuauaagguuggacucuaauauggcugauaaagggaaaagcaguguccugcuacugccugaaagaaaacacagcauauguggcucagaugggggcuuuauuuuaggauuugugggaggcuggaccaaagcgaacacugaacauaugagcaaggcguucuuuaaaggaaagccuuaaggcuuuucacacugugaagcaccguagguagaagaucaaaggaugcacaaaauaaugcaagucccuucuauuuuaaagacacaucugccuggccaaaagucaggaugaaaguagugccucugguacuggugagugggcuaugccagaagcccucuuuguuuagucaccuacuuuaugcugugacgggaacauuugcagugaggaaaagaaguaaauaaaaaugagauaaaacuucaguuuuaaagccuaggggcacaugacaccauaggacucacccaguauuccuuucuuugcaucauuggggccaugugagcaaagcucuugagauacaucuggucagugcaaaggcagucuagaacucaugcccuucuuugugagucccuuaaagucugagccaaugggacacucauagguaauacaggacuccuuagcaaguuguaaacauuuuuuaaauuuaauuuaauuuuaaaaaauuuacaaauaauaguugugcauauucauggaguacauggugauguuuugauauaauuaauauauggugaucagaucugggcaauuagcauauccaucauugcaaacauuuaucauuucuuuauguuugaaacauucaauauccucuucuaccuauuugaaacuauauaauauauuauuguuaacuauagucauccuaccaugguauagaacaguagaacuucuucuucuuaucuagcuguaauuuuguauccuuuagaaaucugucccuaucccacccuucuuccuacccuucccagccucuaguaugcucuguucuacuuuuuuacuucuuugagaucaauauuuuuuagcuuucacauaugaaugagaacacaccaugucuaacuuucuguuccuggcuuaucucacuuaauauaauguccuccaguucuauccguguugccgcaaauggcaggauucauucuuuuuuauggcugaauaguauuccauuguguaucuauacaacauuuuauuuauccauucaucuucuguuggauaccuacauugaucccauuucuuggcuauuguaaauagugcugcaguagacauggggauacagacgucucuucgaugauuuccuuuuuuccuuuggauaaauuuccaguaguagaauugcuggaucauauggcuguuuuauuuuuaguuuuggaagaaccucuauauugguuuucauaguugcuauacuaguuuauauucccaccaagaguauaugaguuuccuuuucuccucauccuugccagcauuuguuguuugucuuuuugaaaauagccauucuaacugggauaagaugauaccucauugugguuuugauuuguauuucccugaugauuagugauguugggcaguuuuccauauauuuguuggcaauuuauauuucuucuuuugagaaaugucuguucauaucauuugcccauuuucuaaucagauuguuuuucugcuguugaauugaguuccuuguauauucuggauauuaauccccugucaggugaauaguuugcaaauauuuucucccauccuguagguuuuuucacuauuuguuuuauuugcuucccuugcuaugcagaaacauuuucauuugauauaauacuauuuguuuauuuuugcuucuguucccugugcuuuugaggucuuauucauaaaauauuuucccagaccaauguucugaggcauuuuccuuauguuuucuucuaguaauuuuaucauuucaggucuuacauuuaggucuuugauccauuuugaguugauuuuuguauaggaugagcgguggggggucuagucuuauucuucugcauuuggauauccaguuuucccagcaccaucuauucaagagaguauccuuuucccaaagauguucuugguaccuuugcugaaaaucaauuggcuguaccuauguggauuaauuucuggguucucuauuuguuccguuggucuaugugucuguuuuuaugcuaauaccaugcuguuuggguuacuacagcuuuguaguauauuuugaggucuaguagugugauacccccagcuuugucauuuuuggucgggacugcuuuggcuauuuagggccuuucauuguuccauacaaaguuuaggauuuuuuuucuauuuaugugaagaauuucauugguauucuuuggauaauauugucauuuuaacaauauuaauucuucugauccaugggcauaggaugcguuuccacuuguuuguauccucuucaaucucuuucaucaguguuuuguaguuuuucuuguagaggucuuucaccuccuugguuaaauuuauuccuauuuuuuuuuaguagcuauuguaaaucggauuugcuuucuugauuucuuuucagcuaguuuguugcuuguguguagaaaugcuacucauuuuuguauauuaauuuuguauccuguaacuuuacuaaauuuguuuaucaguucuaaguuuuuugguagagucuuuauauauauauauauauauauauauauauauauauauauauauauauauauauaugguguuuuucaucuuuucauuuccagauguaagaaucccuugagcauuucuuguaaggccaguuuaguggugaugaauuccuuuacuuuuugcuugucugugaaauauuuuauuucuucuucauuucugaagguuagcuuugcuggguauaguauucuuggcugacagaguuuuucccuucuuucuuucaauaguuuaaauucuauucuuuccuggccuguaagauuccuuuugagaaaucuccuguuagucuaauagagauucccuuauauguaacuuggugcuuuucucuugaugcuuucaaaauucuuucuuugucuuugacuuuugacaauuugauuauaaugugccuuagugaggaccuguuuggguuuaaucuauuugggguucuuugagcuuucuagaccugaauguccaucucuccccuaagacuuaggaaguuuucugcuaauuuuuauugcauuaauugauuuccuuuuaguucuuuuuaaaugauauccaucucuuuguugaauuucucauucaaaucuucaauuauuuuccugauuucaucagauuaucucacugauuuuccuuaagauuauuauuucgaauuguuuuucuggcauuucauauauuuccuuaugauuggauucuguuacuggauaauuacuaucuuucuugggagguaacauauuuucugauuuuuuuaugguuguguuucuacauugauuucuaugcaucugguggaaaaguugccucuuccaauuuuaugaaguaggcuuuguagagaaagacuuauaugaaugugucuugugaugucgguucaguggggugcauuugccuggguucuagguggaugcauuaguguagucucuguguaguuucuucaccuguaauccacacuaguggcauuugugauuucucagugaccuaggcugaaagaguuuguggugacaguggugcagcuuugcuaggcugggcuugcugggcucuuucuaagguuggaggauauaaauguaaaugauggauugaccaaauuugggucuagcuugcuggguuugggagcccagggcuguuauuuuggccaggagcaugagcaugcagauguuuggccaaccuagugugccugucaggaguggucuguggggcugcuuuucagacucaggacaggaugcggacagaaguccacuuggcuggacucagguuguguuugcuggggacuaccuacaggucuguuucuuaugcuugugacacagcugcaugguugccugcuuggcuggggggcaugucugcuggggauggcccauggggcucuuucuucaucucaggacaugggcuuauagcugcucagccagccuggugaugugucugccaggggcagcccaugcagcugcuuauuaggcccaggaugcaggugcaagacugcucaacuggugugguggcaugccugccagagguggcccacagggcuauaucucaggcugggacguggacagacagcugcucagccagccugggagaauaucugcugagggugguccacagcguuguuucuuagguuugggacccaggugcaaagcugcucagcuggcauaagggcauaccugccaggaauguccuguggguuucucaggcccuuuuuugggggugggggugguacagggccacuaggcaggccagggacaugccugcaaaggggggaugcuauuauggagcuguuucucagguccugaguguggaugcauagccacuuugcuggugcaggggcauaucaacugcuugaaggcucaggggccucuccuauuuagaggagggcaugcaaccauuuggcuggcucaaggguggguuuuccccaggcagaacuggcagauuguuccucuggcuggaagugcaauggcagggguugguuucccugcuguacaggaccagagucacagcugaucuugggcccaugcaacugggguuguggcuacagccacccacauaagcuugguguaaggaaaauggagcuccagugcuggaaggugcaguacuuacuggcccccagagcaggaugcaauccagagguggcugaggucucaagauugugccuugcugcagcagcuuggcucacaagggaugggagagaugggaagugcauacuuugugcuccgaauucagggcaauguggcugugugaauuccaguggcucuccaaacugggcccaggacuuguaaggacugugggauucuccuguuguaaggacuguagguguuugcaaugccaguggggaccgguggggaucuucugcuuaucuuuuccuugcaacaagaagucucuccugacuccagacaaucuuggcaggggagauagaucugcagagguuggguggcuccaugcugcccuccuggacaccacagguguaucuccaugcccugcuacuuucuaacacucucccuaccaacauuucuuaauagauguuucaaaagggcaaguaaccuguaguuuccuccauagguauuuucagagaugucaguggaaagucucuuaucugaauucuaugacuuuuuuuuucuuuuuuuuuuuuuugagacaggguguugcucuguugcccagguuggagugcaacagcacaauuauagcucacugcagccucgaccucucagguuuaaacaauccuccugccucagccuccuaaguagcugggacuauaggcacacaccaccauauccagcuuuugaauucuuuguagagaugggaucuugcuguguugucagggcuggccucaaacuccugggcucaagcaauccucccaccucagccucuugaagugcugggauuccaggcuugagccaacgaacccagccuuaugaauuccguguuuuuaaugaagaugaucauucugcuuuugauauaauaacuuugaacaaugaauuaugauauauauaucaaauuauauuuacauaugcuucauuauuauuuuucuuuuuuuaaugaaaguacauguauuuuagagagcucuauauugcuugauauauaacuuguaguuaaauaugggguuugaucauguuucuuuaaaaggugggcauuaggaccuugaucaauaguguaaccaucucuuacguuauuguuucuaugaaaaauucaguccccuuccccagaaaagaauguaacucccaucaauguggcuaacaugacaugacauucuaccaggcaugacuuucauucauuuaacaagugcucuuugaaugaggagugaggcaaagucccugcucucacguaauuuucauucuaguggaacaggaagacaguaacauccagcagugauuuuaaaguacaguaagagccagaugcuguggcucacaccuguaaucccagcacuuugggagaccaaggcggauggaucaccugaggucaggaguucgagaccagccuggccaacauagugaaacccugucucuacucaaaauacaaaaauuagcuggacaugaugguguaggccuguaaucccagcuacucaggaggcugaggcaggagaaucacuuggacccaggaggcagagguugcggcgagcugagaucgcgccauugcacuccagccugggggacaagagugaaacuccgucucaaaaaaaaaaaaaagaaacaauaaaguacaauaaggagcauaaggggaugaagagauuggguagagggguauuuuauauaggauggucaaguggucaagaaaggccccccuguggaggugauauguaagcagaaaacaauaaaauaaaggagggggucuugagaagaucuggaggaagaaaacuauucaggguaggaaaacuguccauugcaaaggcccugagucaggagugaacuuggugugguuggaggaacagcaaagcaggccagugaguguaagagugggagggcagagcuuaauaggagaugaguuuggggcagugagccagagcugggugaugcagggccguguaggccaugguaagggguuuggguuuuauucuguguguagugggcagccauuggaggguguuaaguggggagcaccgcaaucugacugugugagggagcuaacuguagggaagugagaguggaauuagggaggcacauaggagacugcuacaguggucuaaaagcaugacaauggugccuuggauggcugguggcaguggagguggaggggagugauaagauuaaaguuagaaccagucagagcugcuuauggauuggaaguggagggagaggagugagggaugaauucugggccugagcacuuggguggacaguggagccuuuugccuggaugggaaaugcugugagaagagcacauuuagcuggaggaaauggagagguccuguaugucuuguuagauaagccagucgagaucuggaguagacagugagaugucaaauucuggaggucaguggagagggugggauaagaaauguguguggagaucaccagcuucuggaugguguauaaaaccacaggacuggauuugaucaccucaggagugagcaugccagucauuuagagacggggaaaaggaaguaggaagaaaaacaggagagcauggcauuccagaaaccaagggaagaaagucugucaagaagcagggguggugauuaacuauguuaauguguuagugcagccacgagguguuuaaacccauuaucacacaaggaaugaugcucucuuggugauuuccugcuuucauauguguucguggaccucaucuucccccauuaaacuggaaccucauugaagccagggaugauuucuuucuucuguuugcacuuagagccacuuaaagcugucccuuaacugccucacuccaaaagcucugcagugugagguugaggccugaagugacguuuccugaggagcuacuuuuggaguuguguauuggguggguguggggacagugaugacaaggaaguccaggacuagucccuuccuaggcagaagaggcuacugauaucccaacucugaguagaaggguuggguggcagaggagaagacagauggaagaaguaggacagaugcacaaaugugucagauucuuaacuucagaaacugucagccccacaaacguggucauagaacuucaaccugaggaagcagggacacugaugggucaugaugggcucuuugcccacugauugaugcagcagugggauucuuuaccauacucuguaaaguacacaugacccccugcugcagaugaagaaggauggaggagucccucauggcuucccuugaagguuucuuacacagaacuaccaguucagguucuuacaaagacuggauaauccagaugguaccugugucuggggaguaauucuaugggcugcgcuuugggacagcaguggccucuucucuugaccagguuucauuucucuguauugaugaggaguacccaggccugagggucuggccauuuuugacuagaggcaguaucuguguuggaauagccugaagacccugucuuagccuauuuuaugcugcuguaaaagaauaucacaaaccagguaauuuauaaagaauagagacuuauuucuuacaguucuggaggcugggaaguccaaguucaagggcuggcuucuugccagggccuucuugcugugucaucccacgguggaagguagaaggacaagagagaauaagagagcaagaggaggguuggacuuuuuuuuaaauaagaaacccacuccuacaauaaugaacccauuccugaaauaacaugaaucuauuaaugagaacaaagccuucauuacuuaaucaccucuuaaaggucccaccucucaaaaccguugcagugggagucaaguuuccaaaacaugaauucugggggacacauucaaaccacagcaacccccuacaggguuggacaaacuggaaguuaaucuauauagguaaaggguuggguuuucuggcaauugggagauugcgaugagguuuggaucuuguccugucucuuacauaaacauaaugaaagcagacgacccauaguaucauaggaaagcauaagaguaauuucugguuggggcacuugugaacacuuugacaaaauggaaagccaucuugggggaggcaggaccagcaguugagccccuacaacacaaaggagacccugggugcgggaugaagguggaccccuagcccuguaaaguuuaagcugguaggaggccugcagaucaaggguucauccccuggaguuuuucuuggaacuuauuacuaaauguuuccagauaaucccugaucauggggccugauaaaauucauucuuacugcuaaaacuauguuaagauaaaaguuguuuuuauucauuugcuauccauuaaagccaucacagacuaauuauuuuucaaaagaaagaaaacuaugcuacagcucugcaaguaacuuaugaccagauguugagaucuugggauacccugcccugcuuaaaauauauuauaagagaucuuuagacaguaaaaucuaaaaauaaaacccaaaauauaaaaaaagaugaauaauagcaaagcaugauaguucaagaguuuuguuggcuuuuuaauuuuuuauuuauuuuuaaaagaaucauuaguuauaauuucauaccaguugcugagacuuagauauaccaauuuuguaguggggagggaggguaauuauagaaagcaagagagaaaacuuugaaaaucacuguuagcucagccgggcgugguggcucacgccuguaaucccagcacuuugggagaccgagguggguggaucacuugaggucgggaguucgacaccagccugguuaacauggugaaauccugucccuacuaaauauacaaaaaaaagaauagccaggugugguggugcacacucguaaucccagcuacuuggggaacugagacaggagaauugccugaaccugggaggcagagguugcagugagccgagauugcacuacugcauuccagccugggcaacagagucagacuucgucagaaagaaaagaauaaaagagagagagaggaaagaaggaaggaaggaaggaaggagggaaggaaggaaggaaggaaggagggaaggaaggaaggaaggagggaaggaaggaaggaaggaaggaaggaaggaaaucaaucacugguagcuuagcugaauaguccauggguaucugcaagcuagacuuuaucaugcacacaaauccucgaucuaaaaaugaguggcaguggaaguagugguaggaggcaggagugaagaucaugucccauuaauuuaggguaucugaaaaagacguggagccaugacugcuucuguaucuaccagcuuuccacuuagcugccugaggugaguagaaauuauauuaggcauuuccauaaccuuauccuuaacuguguucccuccuuuucuuagugccugaggugagucuggcaguaucuguacuucccugcucccauucauacaaccauguucuuagauccuggcuugauguggguuagucagcuguucuaggccagauuucucagauuucuguucuuaccuguucugcccaacuacaacagcugguguccugcuggccuuugccugagucacacccucaggucaugcauccccaccuuuuacaggcaggguuguuagcaugagagcccugcucugugcucucagugaaggaugaagggagaggagaagagcacccuaggaugcugguagaacuuucaguucucuugccaacaaauugaaugaaguuagaagcucuccguaaguuuuauucaguacagaccuggugucugaugcuacaguuaagagacuagauuuagaaggaggguggugcaccuguuuuggugggaggaaugaaugggauguaaggagagaugauggucugugcaucucagacaaaggaacuuaaaaagaggagucuucaaaagaaugcccccugcaaaaaaaaaaaaaaaaaaaaaaggaggcuuagaaauaucucaaaugaacagaaauuugaauuacaauccagaagaugaaaaucaacaggaauaauaagaaaauaaggaaacauucuuuacuuaaaaauuuuaaaaagucagcuaaacguugcuaggaugugaagggguagaugacauuuuaagauaaagacuaugggaaaggaguuuauuuugccacuaucuuuucuauaggcuuuugcuaauagcugugaagggucuuagauuucauauacuuucaaguuaaggaguuaaccugccacaguuucauaccugcuggcagaagaugagacucaugggguagagauaagggacuuuaugauucacaacaguaacaguaaucagaacaucaucauuuuccuguacugguucuuugagcuccaacccccacagguugacaccaagagagccaggugauaccugcacacacaguggagagaauuccugagccuagggaacuugagagcucuguaaugaacaguaagugugccugcacuuugcuccauccugagggaaacucucucuuugaaggcuguuugcuaugcaaaucuucuugaaaagauagucgggaacaaaggcagucagugccucugcuugcaagaugugcaaaacugugagagacaugaagaauggucucccaacuguugcaucaauaaaaaggaaaggaagcuaauguuuauuucauccuugucaugcaccaagcacugaccaggagacuucucauuucuugccucaucaaaguuucaaagcagccuugcccagggugguacuguuguuguuuuaucgguaaggaagcuggugagucagggaacuggaauaucuagguggaggacuuguguauguauuauguacuucuuauaauguaagcauugugcuaagaaguagcuaaaacuuaauuagaugcuuaucaggugccaagcacaguucuaagagcucuccaugaauuguugauuuaauucaccacaacuaagauuaucaggugcugcugaggaaacuaaggcacagugggugacagaacugagauucaaaucugcacauuuaaccacugugugguugcgaguuguggguuuuuguuuuuguuuuugagagagggucuggcucugucgcucaggcuggagugcagaggugccaucucugcucacuacaaccucugccuucuggacucaagcaauccuccugccucagccccuugaguggcugagaccacaggcaugcaccaccauucccaguuaauuuuuguguuuuuuuguagaguugugguuugccguguuguccaggcuugucucgaccuccugggcucaaguggucgacuugccuuggccucccaaagugcugggauuacagguucccugugguuguguucuuucuucauuccucagagucauagcaagagggucauagucaaacuaaugugugcccagaggaaguggauguauuugaaaacugccaaguagaaauaguugaagugggacugauuguguuuaaucugcagaaugauaaaggauaagugaugccugucuucaaacauuuguaggcaugucuuauagaagaggagaguucacucugugugacugcaggaggcagaauuggguccauuuacggggaggcauaucauggcucagcaaaaaucauuucuugaauaauacagugcccccugacaucauaagggaauggacuaccugugagagugguaacucagugguuaccuuucaaagaugugcugucugggcucugucaagguccccacaauaaaccccucugcuauaggagcugggcaauggaagaggauggcccuaaugagguucucuagaccuuuccuaagagagcugacccugcuaacagugaccugaacuccuuccccugccaugcccccugucccuucuuggagccucaggccucaggucuguuggacaugcacagagaugguuucugcaugugugaggagggugccuuaccucuugagaauccaggaccacccuaaggaucuggaggaguuaguucugcagcuccucgcacucucaggccugcccuauuuuugguuccuuacccgcuaucagccuguaaucaccagccucauggcucagcuauacccuggcaaaucucguugcacacaugaggcccacuguugcccaguuugggacagaauaagauucugugguucugugauucacucuuuccuugucaaguagcccaagcuuuaaaaagcaagugggaacaggugguugggccagugcugcucugugaugaccuugcuacggcccccugacaacuccccugguguagcuguaggccugggcugagcagaucugauccagaugcaggcccagaggggaacccugggcagguagggaaaggaauuuggggagaugguaagaaacaggagugguggcaacuggcuucacaguauauguuccacucugcuagaaauggccucugcuaggggcuaaagacuccccagaaguagucuugucuuaauuacucuguggacaucuuuaaaagaaucucauuuucaucaaaggguuuuaaagagugaugcuuagcccaguguaaagggcauagucaagaucugauccugaaauaauaucucugcuauccuagaugucaggagaaacuaaaaauauccucauaacccugaggaauucuugguuuauugcacccaucucuuuucccucugaacauccuuccagaaagugagagagugaggaagugagccaagaagcuuuaauuacccaaucugcugacauuauuuuaucugcgccacugauauuaaaucugcacagcauuccacuuaaaucucagugcuaacagcagccucuacaaacuugggccuuuguccuucugcuggcuguggcccaugcucuguuucccacccuacugcacccuccuucagacuucuuaaauuccgaagcuuucuguggcaccggaaaugaucugucuguggaauguccauacuucaggaaaguccccgaucuguguguguuuauucccaaauucugcuccccccaacucagccuggcuguuugugguugaguucuggcacgugcccaucauuacagaaaccuggauuuggcaggggcauugugccauauuucuauuauuggcauauuuggagaaggaggagaaagucugucuaguuuuuuuucccucucuuuuauguacaaaugaaaauuucugucuuauguuauuaacuuuucuggccaaccagugaaauacaucuucaauuucagguugguucccuggaguguggaaguuuucucuugguuuaauguugacucugucgccuaauagcugguucauuuagcacccaauuggugcuaugguuauagcugcaacaggccacauuuaaggagggcuuccagggaaccagcacuguguugaggacuucaguccucaugaccucugagacaaguguuguuaccaucuuccccccauuauagggaggacaugagcugaaagagguccaagaacuuugcugaaggucuugcagcagagcuggggcuggaagccaggcaguguggugccagagcuggcugacuucagcgccuacuucaugcuuccaugcaugcauacauaugccauacauacauaugggagacccauaggauguaugccaucaaugcauacugaugugcacaccagugcucccaccauccucccaggaaguguugauaucauuauaaaacucuguccucagcaaguguguauuaagaacuuacugugugcagauccaaagauguacaaacccagguccugcucauaggcauugcagcuggggagacaaggccuugaucugcagaaucugagcugggcugagcaggggaagcuucaucuguuuuguucacugcuaugucuccagggacuauuauagcaccuggcagguaguaagcucucaaaaacgugaugaaugaacaaacuucuaauuaaacaaagccauuuacauuuuuacaaauaaaugaaagaacacaugaauuucuaaaaaguuugaaggacauaaacugagauuagaggacagccuuuuaaauuauuuacguuaagcgguauaaaaagcuccccauguuguccucauuuuucuuacuuuucauagguuggugggcacgaugugauggauggggugcuuguggacccaugucauagauagggcuuuagaggcucuuagauccugcuggguggggagggcuuagagaagagauggaccuugagguuggaguaggacucagcuggguggaaaagaccaugggaggcauuccagagcugcccccacuggcaggauuauacuggagagggcagaagccucauguuuugcuugauagcaaucguuuugaacuucacgacuucucgaagcuuggauccuuuucugucuuacucaauacuugccucacuucccaaggcuugccuaacuugguuggguaucuaaguguacaucccuucaaaccauguaggaaucccuggaccugauacuugccugaauucuggcaccagaucaagaagaacaagcuuaaacggaggcugaggcaggagaguaaaauacuggggagccacaagucagcaccaggcaaguugacaggaaucaagaggaccuggaugcaagagccauaaaaucccaugcacucugacucaguaauugaaguucuugaaauguaucuuggggaaauaaucuaaaggauuauuauggaaauaaaggggccaggugugguggcucaugccuguaaucccagugcuuugggaggccaaggugggugaaucaccugaggucaggaguucaagaccagccugaccaacaaggugaaacccugucucuacuaaaaauacaaaaauuagccaggcauggugucaggugccuguaguccuagcuacucgggaggcugagacaggagacuugcuugaaccugggagguggagguugcagugagccgagaucaugccgcuguacuccagccuggguaacagaaugagacuccaucuaaaaaaagaaagaaagaaagaaagaaaggaucaguuuauguccaugaaacuguuuguuuuaaugaaauuggaagcaaccuaaauaguaaauaacaggggcaucauuaaguuuuggcuugucuacuugcuagaauaugauacagucacugaaaauaagauuuaugaagaguguuccauaucugaggaaaagcaugaaaaaugaaggcaaugauaauuuguauauauaauuuuauuuuuaaaaguacauacauagaaacagauuggaaaaauauuacagaaaauuauaguauuuauauugggggaaaagucauuuguaaucguacucacgaccaaacuuuuagccaauauuguuuauuuguuuaugaaugacaaaagaugaugagacaagggaacucgggugaguucaacauuccuguaaagagucagaaaccaagacacugucugucuagcaaaggaguaaggacagcuaugagaacauguccaaaauaacccggagugugaaauaacagguuccuggacagaggggacaugaagccugagcuuggccggaauagggugaauguggccggggaagauaccuuugucuuuuguuuuucuagaggcuugguaucuguaaccaaauuuaucccugagcccgagacacaggaacagggcccaugagucaguguuucuguggcagccuucugggucagugccuacacaggcagggcaggcaccaaauuugacacagcugcauggggaagauaucuuugaagucaugucuugugucuagacuuagggagacaugggagugauuaggguagagguggccuuauguauagcccggcuccccugaauagucccagcaugaguauucaaagagcccuuuccauucucaagagcucucauuuggauaauauguuauguggucacccuaauuauugaaaaggagguuggaggacauucuggguugaugacaguugcucugcugguugccucuagugcuuaagaggccgugaauuguccgggcaugguggcucaugccuguaaucccagcacuuugggaggcuaaggcaggcagauugcuugagguugggaguucgagcccagccuggccaacauggugaaaccccgucucuacuaaaaauacaaaaauuagucaggcguggucgcacaugucuguaaucccagcaacucgggaggcugaggcaggagaaucgcuugaacccgggaggcagagguugcagugagcugagaucacgucacugcauuccagccugggcaacagagcgagacuccaucucaaaaaaaaaaaagagagagagagacagugaauuaagauucccugacgcagaggugggcccagccugauggagaaguggcccagguguuguagaugaauacaguucugcugucuauccugauuaagauaaccaagguaauuauucccaagcugccccagcauguggcuagaauucauauuuaacuuugacccaagagcuccuuuuccccuugcagucuuccucccccaucccacaaaccugguacaugaccauuaaaaucucaauaagcagaagcuuaaguaaggguaaauaauuugccagcugaaccuuccccuauuugcaaccuuuuagcauuagcaaguucuugacuuuucaugaaaaagcccugguauggcuagugcaaaaaucaguucaaaugguagaggaugauaacuuuaagcagauagggacuuggccugagugggcucuguuuacuuccugcugucugcccuuucuucuaucggcucugucaaggcacguuuuuugggaaccccauuacugagcagacugccaaguugaccaucagugaucuagccugggagccaagccuagguucaucuugcaagaaaaguggggugggauuguggagaaggcccccuucccugugcccacaggagaauuggugugacccugagugccccaauaugccuggcuggacaucuugggagcacugcgaaacaggagguaaagaccuucacaaaguaucuccucacagacagccucagcucaguggggcccccagucaacggagaagccgugacaggcacagcugacuggaugugugaacaaacagauuaacaguuggcccugcaucagggauuuccaaaguaaagagacaucuaggucuuucauagauguuuuguucaguugguugguugagggacacaggugacaaguguuggggcaaacucuggcuuuuccuggacuuaagcaagaaauuaccuuuuggcaccuggacacuguuuuaagucucuaguuaagagauaaggggaaaccacugucucacucaagagagaacgcucugcuuuagaggccaggcuagauauggaauuggccgggaucuguggagaggacaccugagcaagcaugggcuaaugucaaaccauagcuuccuagagagguuggguggggaaaccugacuuucagugggggagaaaguaccacugcaaagucuuaaacugaaacagguguaagcaaguugguucugaccgccccucauuugguuuaagcuuacaucacaaggaacaggugcugucaauaaugaauucaguuuuucucuugagcccagaagcagagcgggaugaagccauuaaggugauagaacccagcccugacuaauagguaugagggggaacagaacuggggggcaagaguucuucaguguaggcguccugaaucucuaucgcugacucugagaagucccaggggucugcuuucucuaagaacaguuccauauuggguaaugacaaaaaaccagagugagauuaaaaauggauucuuuauauugagcguuaaugauaaaagcuccaggugauagcauucuguucaauguuauauaacuguuagaaauggggguuaguaguuagaagugaauuguuaauuuaauagauauguuuuuauagaaaaaugauacaaauaaguaugugaaguacugcuuucuggccuaaucaaucacaccuggaggggccuagcuggcuggcugcuguguccaccagguagaagcuuaccuaaauugcuugaaagaaaauguucuggcacuagaauugccguuucaaagcuuuacagggaugauaaacaacauacugcucuucagagcacuauaccaaucuuguuacuguuggcgagagagagcaucuaacacucaauaaaugcuaggcacuccaggcugaaugcuaaaaaaaaugaacugcugccuuuguuuagcacaguguccccgguaggguguggaauuucaaguucaggaguagacaagcaugaaggguuuuagggccuuugaacaggucaaugccccauuagcuuuuuaauuuuccaucccacuuuccuggcuccuggggcucuauuuuucucuuugauaaucuguuuucuccaauaggauuccaaauucccuauuggaaguugagccucauauccucaaggcccaugaucccugagccagguaugagugcagcuaauagcugauggugguccauugaucucccuguuggcccugcauuugccuguacuucccccuugcagcugauggaggauccuguguggaagggcucccucaccccgagugcaaauggcucccuguuucagaaaggguugagaggggacacgcacuuucuccucuccacuggaaaccagcugagcugacaccuccgagcagaaguuccucuuuguguuccugcugaugggcugugcucucaguugaucauugguuuuuuccauaccuucuccagguucucagaggucaccauuucuuuccaguuagccccauucuagaagagauuuagggcugggagaaaaggagaaacauguguuagccucauuaguaucuuuggugaagugugaggagaaaaagguagccaugauugcuagaaaaaugagacuguuaagggagaaaagugugucgaucucuguuaucacccaucauugcagauggcaaaaaucaguuguucucagcaacaucacugacugcccugcagacaaccuggaacuggaggguguccuuugggagacaggcagggcaugguguggaagggccugugugagucacaugaggacagccaagggucugacuggacucccggccaguccugccacaggcauugcaugcagcuggugcuugaguggguucaccugccuaccugaggagcacgacagggaaggugagaacuguccugagccuguuggggggauuguucaucuagaagagacaugacuggcauccccauuggcagagccagggccaggcuuagagcuggcuuacauuuccucauuuuguauucuauugagcgccagaaaugaagcagagagggcugaacccugacacagugggccggcccaagccugagauugaggcccagaaaggccuaggcucaacagacgccagcuccagacccagggccacccugcucacccauggcucacagggagaugcagauugaacucuucguuccagagaguggccaccuugauugggaagggaagcaggggcaggggaggagagggaagucacagggagacuaugggaaccacgggaaacacggccauucuguccugaggucugggggaggggccuauguccgcguuucaccuacagcacuuaugucauuguauugggaggagguaguugaaccucucaccuuauuuauaguccuagcggguauugugggcacucaguaaauacacagugaugggugugcggacagguaaugaguucugagccuuaggcccuaguucuuccugcucugcugagagcacaaaccugauaaagcuugagaaccaugaucagguaaacuguucgaaauagucaggagagucccaucuucucaauccuuuuguccagcuguggaguaggccuuuuagacaaacaacaguggccuaagaaguuggaauauagaagaggauuccuauguauaagaaccgcaggaaauuaugaacuucuggaauuuccuugcugagagggcuguguguuguggcuguggcauuuggcuacugcguguacguccuauuuccuguaauacaaggcuuagcucaucacuagcagacugacaagcuagucucagaagcagggcaacugggauugucaaauagguuuccuuaguaugcuccauccugcuuacuggugagagguuuaggauagugugucugagcugcugucugcagagcagagugugcgaguggcucugcaggugcuggagcucacagagagacugccaggaugugcaccuaagauuauauguuuagaggucuucuuuuuguuuguuuguuuuuguuuuuuagacgaaguuucacucuuguugcccaggcuggagugcaguggugcaaucuuggcucaccacaacuuccgccuccuggguucaagcgauucuccugccucagccucccaaguagcugggauuacaggugccugccaccacaccuggcuaccuuuuuguauuuuuaguagagaugcuguuucaccauguuggccaggcuugucucgaacuccugaccucaagugaucugcccaccuuggccucccaaagugcugggauuacaggcgugagccaccacgccuggccugcuuagaggucuucuaaccccagagaggucaggacacucccucagggccucacuguuagcagacccugucccugaaauguuguggccuuaagucaguuucuucucuguaggccuugguuuucuuaucuauagacugagaaggugagccaggggcucucugaguucugugauuaugugcaaucuagcagcagagccaggacaggacaccaggaccuuugaacuccaguccacucccagcucuuccguguggcaucucuaacaaugugaccuugucaccaagggucugaagccuggaaucagagaccucaguucaaauccaguugauaauaaguagccguuacuuauuagcuuugagaacuuuggcuacuauuacucaacuucugagugcuuccuuuaucuuuaaaaugaaaguaauacaguauguaucuuauagaauuacuuugaaaauuacaguaaacuuauauaaagcccucaguacaguaccuaguccucaauaagcauucaauaaauggguuguuuguauuagugacaaucgauaugugguucagucacugcacuugucuggaccuuagguuuccuuucuguaauuggaccagugcuucucugacuuagccaucccugaggacaguagagaaagagcauguauucuaggguuaggggcuugggguguagccuguagcagcuugcagaaagccuggcauuucuuugaacuccuauuuauuuguaaaaucuacuuacaguugguauccuauacaaugaucugaauuuuuugguuguaauauaaaaaugcuucacccaaaucuuugaguaaaguugauguucuagggugagguagccucaaauaucccaaagggcauacagccacaccccucugggcuggaggugggauugaaaguaguuucaaaggucccuuccagcugugaaauuccaggcaccuagaguaagugagucucauccucaaaggaccuaagguugguaccaaagaauucuaaaggaaccugagaagcgggaucccugugcccugccccuggugagaauggacagggcuguguggaaguggaacuagcagaaacagggagagagacagcccucugcagugaagggugaaggaggcuggaggaagagccgggcugugucugggccugacugucggccuugagcugaugacccuggcagguuuggcuuggcagcucuccaucuccccagguaauuuccaggaagcacuaagccauuguuucucauccacagcuggaggcugucuggggaggagcccucauaucucaggagggcagugagggcagggggugaacugcauguggaaacauagagcuugucacacugccaaggccuccuggccauucugaugcagcaccuaaggcuggggucugggcuugugcccagccagugggaggagaguugagggagucuggagaagggcagcaagguuuuggagagaacacagagauuucuggccuuugaaugggaacaaucucuaacuacauucugggaaccucucugugcauggggaaagacuaucugcugaugguggugucagccuugcacaaauuugccaguaugcauggucucuuccucaggcaugagggauucaaaugaagucaccccguuuguuuagggcaaauguaaggguuuucccugggcaagggauugaugacuuagucaaauucauacucagcagaugucaugacaauaaaaaucuaaggggauaucaauacauucguuacacuggaaauuuccuguuguguaagguauuuguuauaauaagauuuaacauagcuuuuuuuuuuuugguggggggauggaguuucacuccauugcccaggcuggagugcaguggcacugucucagcccacugcaaccucugccucccggguucaagagauucuccugccucagccuccagaguagcugggauuacaggcgccugccaccacacccagcugacuuuuguauuuuugauagagaggagguuucaccauguuggccaggguggucuugaacuccugaccucaggucaugcccccgccuuggcuucucaaagugcugggauuacaggugugagccaccaugcccagccauaagauuuaacauaucuugauaaacccuuucuaagcauguugccaaguuggauuugaaguucagaaggacuggauuccaguacugcuuuaugaacuauaugaccuuaggcaagacucaccuggucuuugagcuucggguguuccauccauaaaguggugcuauaaaauaucucaguauguuggccaggcacggugguucacgccuguaaucccagcacuuugggaggccgagguggguggaucaccugaggucaggaguucgagaccagccuggccaacaugcugaaaccccaucucuacuaaaaauacaaaaaaauuagccagguguagugaugcgcaccuguaaucccagcuacucaggaggcuaaagcaggagaaucacuugaacccaggaugcggagguugcauugagccgagaucacgccauuguacuucagccugggugacaagagcaagacuccaucucaaaaaauaaauaaauaaauaaauaauaucuuaguauguugugaaguugaaaugggauauugauuaggaaaguauuucaucaguuguuaaauaaguagcuaaauguucauuuuaaguaaaaacccuuuugguaacauuagcuaaguaucaccauccucuaggcccuccacaagcuagucucaaucaauguaaugacuauuuuucaacauuucucuugacccaucucuuuaccagaugaguuuccuugcucuuauauacaggcaccaccaucucccuagaucagcucuauacagacggcucaccugcuuagauuaccauggccuguucucugugcuuugccagcuucagagaucucaacucagucuuugaagauacagugguccacucuggacccuaguuuccucauccauaaaauaagggagcggacuacaugauuuagguucucuuucaucgcugacauucugcaauccagccauuuuucagugugcaaacaguaaccuagaaucugagaagaugagagcaaugcauauuguccaacaauuauaaguaauugauuuaaaaaagcacuuuaaaagcaugaauuaaaaaauaaaauaaaaauaaaagcaugaauuaauaaucuauuccuugugauauauagggcaauguuuguagcaauauuuaaaugaacuaaaacauuuaagugaaaugugaaaccugagucuucaucauaacugacuauuaucaaauuguuaccauuuuuugagugcuugcuacaugccagacaugguuagaaauuacuuauuacaguuacaauguauugaguauuuugaguaucuacuuucugauagcugcuuaaagcugcugcuaaucauacuacccugcagauguacagauggggaaauugagguuuagagaaguuaaguaaaucacccacggucauccagccacuguguggcaguagcaggguucaagucuagguguguguaacaacaaagccugugacgugauggcuccacccaaguccucugucuugcagucaccacugugcuuccucuuagguuguaaaucuguuguuacuacucuccuaggacuggugguuaccccagcuguguuuaugauacagcucuggacuugacccugaauuaggaauuggcccucucucucuuuaguugaggcagccagccugagaauuguaugggaaaaaaacccuagauuuuuaugggaaaaaccuccaccuagauuuagcaccuucccuccucuggcguguuggagaaacccagucucggcucccuccucacuucccuccgugugcaccugccuucuccugucagugcuaaccaaggauggaaguaaaacuagaaauccuuaauaccguuugccaggcuuugggcuucagccacgggaggcagauuguguugauggauguaauuagaaaacugcaaaccugcuucucaaaucccagguccuaaaggaguugauaaaccagguuggcucaugucucauucuccuuugcugugucacacggggaaggauuuggaauagaaguauccccaggccuuucaguaauggaagcucgagucaaccauggaugcaccagagccaaacgagugauggcaacugccuuuggccccagggguccagcaggagcuguggacagcuggggcuggugacagucuucacuugauaagagucugggauccuacuggcaaccaugucaccgcagccccuccugucagcagugcuuccugcucccucuuccaagcggaagaccuguuccagcugaauggcuuaggcucacauggaaaggaggacacacacagaagcgccuuccuucuucccucuccuccaaucagucagguguuaguugagucacagagcuaauguuuucucaggggaaacaggccaugggaccuggugccuccccuaaacugcauagagaggaccaggggccacauuuagaagccaggccugggcagcuucucucacaguucacuugugcccaugcccucagaauugaggggucuuccuagcaaaguauccucugggcuugucccuuaagaucauccccacagaaccagcucccugcagaaagcagagaggcaguguguauuucaggccauuuuagacagaaggcaugggaucuacagucugcagguagagaaccugcucacagccugcuccaggggagugugugaucugcagaaucaugaggugcauuuccuuccugcaccuucuuuucucaagugggcuuuccuaggcuucucacagaccacuguuggagaggaggggagggcaggacagacuccugccacagagaggugacccuuuuuacucccucuccuuucugggucuccucucaguccugugacccuacagcaccaauagcacacccuacugccaugggcugcccaaacccacuugcuagcccucucccuggcuucccucccugcccccugcaagauuucuguuucaaaauaacucaaauuaccaaaugcuggcagaauugagggagugggagggagaggaagaaugaagugauugaaagacagggaguauauuccauuuaccuuaugagcaaaugauacuccccaacauccugccccauuaauuuugcuguuaauaucugccauucugcuaagggauuaaaugaguucuaagucaccuuaaguacuuagucuaaugccugacaguaagugcuaaauacauggcaacuauuauuaguucucucuuuuucuccuuuuuccccugggauuuucccuuagcucuuccagccccagcucuucucuggacagaccucauccaaucagagggcuccaccugggagcuggccagaagcagaggagcuagaaucacugcacaggugugggucgggacugacccagcccucagagucuuccuagccugugccgcugucucacaggugugucucgaggaccaggugugccugccugauuugccugcuuggcgggcagcccugggcagggagccccaacagaagucuuuuugguuggauauaagcuuugccuccucuccugggguccugcagcagcucaucccugccugggcuuggaucccccugcuggaaccuuuccuacuugcgcacaugucuuguggagagcugguggcagucuuagagaaaggugcacuaggacaggaaaugcccagagagacccuucaggccguguagagaggaccagagaaggaagguggcuuuccugagaucacacagcugguuuggguggcagcaccacaauaagcaugagagucacugacucuucugugcuaucucacccuccagugccauccggauuucuccugugcaccuacuuugagcaagguugcuuuuauucucugagccucugacagaaacuuuaaaaucauaaaagcaguaacaccauuaacgauagcagucaucauagauucagcuccuauucugugugagagacuaggcugaggucgcuuuuuaugcacguugcugacccucguaacaaucuugcagcuacgaggcuauuagcaguagccgcauuguacagcugaaucaacuaagauuuugagagauugucaauugccucaagccacccuccuagggauuggaagccaugagcucgguucuuguucccugagucgauuuccugggcuucagugggcuaaggguugugaggcugccccuaccugaguacucacaccucaucucauaggguuuaaaacacaaggcacaguucugcuuggcagaauggaguggggggcaugguauuugagaaggagacaguggugguaggaguucaauaaguauacuugauaccccaaacuuaauccugagggggugaaaccuaagaaugaagugagugaacuuuaggauuauagcuggagugugcauuccgcuaauuuaguuauaagcagggcucugguucuggcuuuaauuacuuuugcauaugacuuguaucgcagaaaacuucucucagccuguucccaucaaaucccaaauaaagcaagaauuccagcaggaagaaaacaacuccaggagaccaggccuugcuccuucacacugugcgugagguuagguguguggauuugauuagaucugugugccugugucuguguguguguuguuguugucguuguccccuuuuaagaaaauuuaaaaauaacuuucugccaaagaugugggcaccaggguuguguugcugagcagaaaugcuccucccacccguggucugcugcucugcugauguggcccagcugaugugggcagcuugucugccugcagaagcucagccccuccuuuaaugugucuuccaagaggaaaggcccaggaagccauggggagggagaggcugccugguggcucagggaagaacucagcuguugggacaagagugggcuggcuuugccugcuuucaugugggaacccagggaccuggauccaagucacucaaggaugccagcaggaaacccugagauuguaccccgggcaggcugugauugugcccauuucacagcugggaagacugagaaacaaagaguagaaaggaugcaaaucagaacuaucaugagguaccaucugacaucagucagaauggcuuuuguuuaaaaguccaaaauaacaaauguuggcaaggcuguggagaaaaaaagaaagacacuuauacauuauuacauggugagaguguaaauuaguccagccacuggggcaguuuggagauuccucaaagaacuaggaguugaacuaccguuagacccagcaaucucauuacuggguauauagucaaagaaagauaaaucauucuaucauaaggacacauacaucuguauguucuucacagugcuauucccaauagcaaagacauggaaucaaacuaggugccuaucaaugguggagcagauaaagaaaauguggcacauauacaccauagacuauuaugcagccauaaaaaagaaugaaaucauguccuuugcagcaacauggguauagcuggaggccauuauccuaagcaaacuaacacagaaacagaaaaacaaauaccacauguucucacuuguaaguggaagcuaaacaugagguauacaugaacauaaaaacagaacaauagacacucuagggauugcuagaggagggaaaagggaggggagcaagggcugaaaaacuaucuguuggguacuaugcucccuaccugggugauggguuuaaucauaccccaagccucaguaucauguaaucuaccuuuguaauaaaccugcacauguacucccuuacucuagaauaaaaguuuuuuuuaaagggaaaauaaaguaaaaguuaaaaaauaaagaagaccacuuuucccuuucuccuuguguauuuuaagaaggacagaaaugagaguagaugguaacagagagaguagggagauaggcuaauguggugguucucaaaaugugcccuggaugucccugagacucuuccagggucccuugagguccaaguuauuuuuguaagaaaacaucauuuacuuuauuucacucucauucucuuucaagcguacaguggaguuuucuaguagcugugaugucacaauagauuggaugcaaaagcagauaugaaaauuuagcuguuuucuacuagccagacauuaauuugcaaaaaggagcaacucuucucauuaaauucuuuuuugucuuagaaaauauauuuuucucuuaaaauguuauuuauguuagccuauaaugggcuuauugauguuuuaaaaugaauuaauauuucccaguuuuaauuuccaauacuguaaauauugacagcaguaacucacaaacaaaagcucucugggggcccucaauaauuuuuagaagcauaauggggcccacccugagacaaaaauguuugagaacuacugggaaagcagguagggggucuccuagguguuaaaagaauaccagcucuucaagaaucagauaugaaucaagggaaaacuuaaauucaugucauugccgauucggauguccacagucugccccaaggugugaguugcauaggauguuccuuuggaacuaugaaaauaccuucucuugcuggaggaaaaggucuggacagggcaucaccuugcugccucauuuuagaggagugcuccaaggaucauuccugaagcucuccagggcucuggaccaacgaggcaaagucgugcucaacaugaacacagucuguggagucugggccucaucagugcaguuccuuaugagaaacacagcacaggaguucuccauccaucugcuugcugggcuugcauccugcucuagggaucauaaacagggcuucuucagcuuagggaagaaagagcugggucucaggaggaaauaucuuaugaucccugggugguaaucccaggccagaugugccaagggguuggagugguguuccaggccagauguggaauugggagagugcccagccccuccgaggacucagcucucugcuugacaggguccucccuuugcuccacacucagauuagaaucugcagcucugaacaaguaaaaauaaaaaccugugagcuuccaccccuggcucccccaggacuccauugagagccucugcaguggcagccagagguuucaaaggucaccccagcugggcggauuagaacaacagaucucccggaccgggugaaguuggcugcucagcggaaggcaaauugcaccaucugcgagcagagucagaacaaaagccccuuaacuuuuucggucuggcccugggcucuguggcgcccggcacuccuucggucuccauucuuggcuggaccuuggacaggaaccucugcaguacggugguggugaaguguggcugccucgcauccugacucaugugagagcugccgaggaagaagcugcgguaaggugugucccguucacuggugugugguccugcccagcuuugcuccgguaggucauagcaagucagccuggcacagccgaggagcagcgcacuccggaauuaggagugauuagagaacuugucaggauuugagugcauugcagagaggauuaaggugggagagggagcugucagugccuggggcauuugcacgugggugguuuugcugccucugaugugugcuguuguuggagguaggguucacgguagacugcggagccugcuugggagccccucccucuagggaagguaugauauuuccaagaugcccggcaaacugaccaggugcuucaagacaaugaucauuuaaaauguauacacuuuggguagggaaggggauaacugguuucucuaaacuuguucugugguauuacuugagcccugauuuuuuaaacuuuuuuucugagucauuugccuuauaguuacaaucucuuuucgcuguaguugaaaguguuccuuucuggguucaagagacaauuuaaagugcuuuugaucaaauuaaaguccaguuaacucaaugcugcuucaaauaguuaauaaauuauguuacuugugaaagccucauuuagaggugggcguuggcccaagcaucagggggugaggggugagggguaagggggguaagggggaguuuccagcucuugaaccacugcucuuuuugacccucuccccuguuuuuucuucuuacuucucuguguuuccccuuugaucuguguuuagcuuguauugaauaagacccccuagcuggguguguuugauucuagccacugagcauugcucugcauuagagaaauuauuguagaaaucacccaaccucucugguuuucuugauuggaauauaguccacaggcuugacaagggauuagagaggaacgagguuuggucuaauuuacuuuauuauuaauuuuuuuucugauagagcauuccacauaugucaguaaccauuaauuguguggcagagaucuguuuaugcugaugauggcaguggguggggcgaugggcugagggugagcagagcuguuugguguggcugggcucugguccuguccgcaugguaguugaguaacucucccccacaaaagcacuuugcaagggacuagauguucccuugcuguauugauuugcguguuccuuuucuaaccugaagccagaccucuccuagggauggaugacuccugucuaaugugcuguugagaucaagcaggugccuuuugaugagaacaucuggggccuucaggagauuuccaugggccucugauuuuagaucaagaggacuugcacagaggguccugagccacuccuaccuuccaggaggaucucaccacuccuagcuuccagcuccccugaaagcaaagguagagaagagucuugugucuucaaagccaggccugacagcagaagggggaggcacaugcucugccccucuuccucuguacaacucccaacccucugccuauugcaucucucauuacuggggauggcaagaaauaccucauuugagaugugggggccuccgagaagccagcagauuuugacuuuguaaucagaccuugauuugguuuucacuuuuuagcugugugaccuuagacaagaguaguuggcuuucuaagccucuaugucuucauuugugaaggggugaucauuagaacugcucuuucugauugagaugggugcccagcaugaugucagcacguacaccuugcuuauuaaauggugcugcuaguacagacacaaaggugcugcgggaagcugcccaugggccucaggcccuccuccccaccuucccagggaauucugccaucugcuuccugcuacuguuuuccagucaucucacucauagacccuugccugaagauaucuggggcuucuugcugucuuuggugaaagggucuauaucuauauucaggguggagagacgggcaucccuuugggaacuggaugauaaugauguugacagccacugcuauugaaugccuuuuaugcuauauuauggguguuacauacacucucguucaaaccuucccuucaacuuuaugaggcugauaugaucauuccauuugacagagaaagagacugaagccaagaggguuggagcaccuugcccagcucacagcuggaaaguggccguguccccggguuuguggcagggucacaaaagucugauccucaugauaccuguccccaccuucaucccaagucucuacccgguccuggcugcacaguguaucaucacuucaccucuguggcagaggaggagggcacagggagcaguguucuuacuggggugugguccuggguagcuaugugggauaucagaugaugcccauuccuuccgcagcccuguguuucuacggucgccacacaaacaacaacacacaugccccacucauguaacugcugcuguauaccaagucucuagcuuggcccaugguagauauuuaguaaauauauuuuaauugagugaaugaauauaucuugaugcucgccauuaaaauuguaguaugacugcuuuuaaaugguucuacaaacauauacuauaugcuauaaaugcuauagaugcuauaaauauggcaaaauguuaauuguuaaaucuaggugauagguauuuggggugcucauuuuaucauucaauucuacuguucuguauguuugaaauuucccguaauaauuuuuuaaauuuaaaauuucuauaucaucaaauucuuaucauuauuuucccuguaaauauguacccauaaaaccaccugguauuccacuguauuugaccaguucucacuguuggauuuuuuaaaauauagucuaucuucuguccuaaauaaugcaaauaguguucuuauaaauaaauuuugggcuguaucucugauucuuucccaauaauauauuucuaaauguaggauuauugggaaaagacauggaaguauuuuuuagaaucuuuuuaccaaauugcuuuccagaaagacuacaccaguuuuuauuccccacagaggguaugagcaugcccaucucaucauggucucaccagcaguauauguuauguuucuuuuuaaaugucauuuaaaugaaauguuuugguucauuuuuaaaaaguaacagcuuauucuuaauuugcacucuuggauuauugucggagccaagaguguucagugguacauccucugugcauuguucaggucauaucauccguccauugaucuguugggcugcuuucuucugauauguaaagaccuuuguuuggugcaaacauuuuauuccagguuaucacccaucuucuaauguuguugauaguauuacagaauauuuuaauuuuauacauaugugguagcggcucucaacuuuuccccuuguuaucccaacuuuuacuuuuccuuucccaucagccaauuugacugcuuacaggaggcaagagggccuagugguuaagaauagcagcucuggcgccaggugcuuggguucaaaugccuguucugcccccuacuaaaugcaugaacuuggacaaauuucucaaucucacugugccucaggugucuaauccacaaaauggggauaccaagauuaucugucucauaguguuguuguaaggagcaaaugagcuauuuauuauuuauauuuauuauuuauaaagggcuuggaagaguuccccacaucuaguaagugcuacacaaguguuugcuuuuauugcuaccuacugcagggaaccugugagucuuaccauucaacaaggaauuuuguuugcaaagcuaauaucuuaucagugaaagagaaagcuggguuuaucaagcaggggaugugcccuauuacaaaugagccuagucccuuugcugcuuucacuugaacuucaaaagagauauccccauuuuauuuuuguuagagauuauuaaauuuaaacaaacuaauuacaugucccagagagcauuguucauuugugucaguuuaccugacucacagcauaggacuuaaguaugugaccagacagccaaagaaaaugaacagaaaagcaaaucuaggaauauggcuucucuucaguucagcagaugugugccccacgucugggccagucaucagggauuuugugguaagaaaugaucgucagccuggaucuguccccaccugcacuuggaaccugggacagggacacuuuggguguauuccaggugguggcaguuguuguccaauggccuugacuggaguccgaccaccuagcucuucucaacugcaacguuuucccagccugguucuucagauuuuucuauggauuuuggaaacucccccugaaacuccaccaucuuuccaacaaauccuuucucuguuuacaagagccagauuuagcuucucuugcuuucaaucaagaacucagauauguacuuauaauaauuccacuuuuggagucauuuguaaggaaaucuuuaggaauucgggcauagauuucaguacacauagacucaucaccgggcaucauaaaagauuuagaaacuauccaaauggccagcaguagggagauaguuauguaagucauacaucaauaugauggauauuugaaaaucaaauuucuuaaaagcaacuuuucccccuuauuuuaagaaaaguuguagggaaaaaauagaaaacauuguuuacauaguaugcuuucaaccauguaagauauguguuuuucuauauugauaaaaacaaaauuggagggaaauguaccaccauucuguauaauagaauuauggauauuuucacuuaaaaaacuuuuauuucagguucacauuuucacauuuuaaaagagcucuggagccugccuggguuuaacuuccacuucugccacucaauagcuguguaaugggcaaguuauuccaccugucugaccucagcuucuuuauuugcgaaaugaugacuauacauacuucaugggguuguucugaggauuaaaacaaaugagauaauauaaaaagugcuugauacagugccuggaacagaauguauucucaauaaaugauaacuuauuauuuuuacauauugguaauuuucaaguuuuaugaugaaauguauuuaaaauuaagaauaauaaaauaucacaaaagaguugacgaucgcucuaaugaguagucgucuguuacuucucaugucagccccuuguucugcuacccuugccagccccagucacaucuuaucuaguccccagcaggcccuggaccaggagucagggcuuaagguguucuugucagugauaccaucauuuugcucugucuccuggggcaagugacuuacccucucugggcuucaguuauaagcagaggcauuagccuggguaaucugaaaacaccccccuucucugaugaucugugaucuuggagccuuguucacaaucugguccucagaggugggauguccccccaugccuaccuccuucccuucauucagccaagacucucccuuuaccucacccaggguccuugccauauuaaccccaaacuaccuuccucucuuggaguauggaucccauuuuucuauagccugugagcucuugcaguucaggcuaaagcaguuucuacuuucugccagaagugcuuaauguagauguugguccugaagaguuagugacuauuaaauacagauuauagauaucuauuauaagaacuauuucuccauucuuguccccagcuuccccuuuccuagaagaaggggucagugaaaagauggaaaguuccccacaggguuuugaggaggcagggcaucgcccugggaaccggaguguuugucugggaugggcucugccuuguccuggcacuuuguguauaaaagacagagccucucaucuucacagaggagcuguggguggacacugaccuaacuggggaucugcuccacguaaaagccacaccuccagacuggacacaccugaugccugaagggaagacagggcugugcuuugucugaucugaccuuguccucuuccuuccuuuuugcagaccaugggggaugugaagcugguugccucgucacacauuuccaaaaccucccucaguguggaucccucaagaguugacuccaugccccugacagaggccccugcuuucauuuugcccccucggaaccucugcaucaaagaaggagccaccgccaaguucgaagggcggguaagaaguguggcuggauggggaggcuguggggaaggaugggcaggggccgcugcuccuugucaagccuuuuccugggccggcuggaucuaauagaaggcucaauuuucuuuuggaccuucauguaaaacgaaccugugccacuuuucucuuucuuuuguuugugaugggcuuuggucugugcuggagaacuuggggguggggaggacgcugcaaguugaccauccugugauguuuugcuguuaauguagguuguguucuggguacaugcuauauaauuacagaaaaagaagacgcgguccgguggcaggaagaauacagcuuggguuuauauauguccucaaaucuggacaguugagaauugacuguaauuuuucucuugcuuuuuccguggaaggagaguuuaguuagccgaccuucuuguacauccauuugguauacccggagcagugauaggaccucucauuucacuucugucaccugucauaaaugaauacuggucacuugccguuacugggacuccacuucuucuucuacaaauaggcaugaucauuccuugucuaccuuguacucaaaggagaagagaacacugaagaauaguuguacuaugacucagcagucuaagagggagcuccugaaagcuuguaggagggggucagguggaugauucuuuuugcaugaugccggaccuuaccuuuguguaaguggcaggucuggcuacgugguugucuggagaguuugcagggguugcugccuugaaaauggccuggggcuguacugaauugcaugcugugcauggaccuguguagucaagacuguuugcuaaugauucugaccuacuaguccuuucauaucucuuaccagaagauuguuggggauguuagugauguuccugaggagucuguuucucucugggcacuaccaggaugagggcugucuucuguugcccugacucugguucccucuguccucuuauccucauagcuaacaggagagaagcaacaggaagaaucgcugggggcucauaaaugacuuagaugacuauaaaaaggaaugaaguacugacucaugcuauaacacggaugaaccuugacacauuaugcuaagcgaaagaagccagacacaaaaagccacugauuauaggauucuauuuauaugaaauguccagaauaggaauaucuauagagacagaaaguagaaagguggucaccaggggcuggggggaagagagauggggaguggcugcugauaggcacaggauuuauuuggggcugaugaaaauguucugaaauuaguacuggugguuguacaacuuuucaauauacaguaauuauaaaauacugaauuauacacuuagaaaacuaaaaaguaaaaacauuugagaaacggaucagacagcaaaauggaucuuaacugcacacacagucuccuaccauacugcuucugagacauaaacuccuuccucaagucaaacaaauauggagaggaagagauggcggccucuaugucaugugaugaugcuuuugcuuccuuugcugaccuuggugucaugaaagaaccaugccuugagugacucgauuuggaacuugcaucugcugagcacuggccaggagccaacacacuggaguucuuuguugcucaguguccucugguuggcaagccaugccuucuauguggcuaagguuuccuucucugagaaaagacaacuggcuguuucuguauuucuggcccacagggguggaagaagaaaaguugauagauaguaaaaguacuucaugaaguuagaaaguauacuuugguaagacaguauuuuucuuaaggaguugaaauuuacauaacauaaauuuaaccauuuuaaugugaacaauuuagucauuuaauucaguguugacugcaguauucuuaaaauguagcuuuuucuaugugaaaauuuuauuuuucuuauauggaugaaauaguugaccuuguauauuacauguggacuauaugucaaaaugcauguguuccuuaugagucagacugcagcgcuacuugaccacuuaccaccugacuugaauuaacccagaacaaugccuuggcagcacacugguguauacagaagaaagacuauuccagagagacgucgaaagcauccagcugucuugcagagacaaaugcagagggagagacuguagaagaaaaugcccuggaagcuagcaugcugcaaguguguauuguuaguguaggaaacaacacagagacuuuugcaucagggaagggccacaucacaugaucccagaagaagagagcugguuguucugauaccaaagacgaaguuaaacaggggguguuucugaccuggugaccucaaagaagugaaaaguuaggugguguuagccugagguggcauggguuuugagcaggaguugcugguuauaauaagcuccaaacacucaaaacuugcaguucccuauugggcauagucaguggugaucugccuuccaaugcaugucagccuucacuguuggggccacuugaccuugccugcagcugaccccucccuccagguccugggacacaccccucccuccagguccuguucuaggugcucaaucgucacggaaccaguccugguaucacucucaggauggccucaggagcacauuucucugguaacugagcucuugcagaaccucuuaugagugacuaacuuaaaaaguaugccuucaagcaacuucuuggacccaggcuggucccugucacagcugacaggaaucuucuuccuggccucugcccacagcaccucugccugcuuuccuccgugaaguugcgcccacgguggaggcaguggagggaccuaggacuucccagcuucuucugaaagagguucagggaccgucccaucacugagaagcaaaguggacaccacagaugugagaaaguucuaaagauuuauuuccuacugccuuuggagcugccaaucagaaguucuucaaaugugugcuuuugguuuuuauucucguaagacguuaagaacuguugccuacucugccccauuuccuuuuuaugccuguuuuuagacaaaggacuuaaugaaccacuuccuucaauaaagcuccucuuucuaucuagugacuugggugacauuaagaugggauaacaggcacccccuggggguucaagccucuuuccaaggagcuccaaacgacgagaugcucaucucugugggcucagucccucacagccuuuagggcuuuuccaccuugugggagauacauuggguagccaacacauaacccaugaccaggccccuuugccuuugcccuguuccaugaugggguccacuguagaggcuuccguugcagcuaaggguagcccagugacacauuugggcugaagucagauagggagcuucuggaaaagcccuugcuuuucugauuaaaggaagauaaaaagacaucacuggugcucucauauuucacccuuccguugcuuccugccuugaauacagguguaaugccuggugcuugggcagccagauuaaaaccaugaggcaacaagccugcacgcuaaggauuguuugggggcagggggacagcaguggagagagugaaaagaaccagcagcuaagagacacaaauccuaaagcucaaagccugucccagauacaaucuuugcagugauucacacaggaaauguuaccgaaaguauuccuaacugauaaauagcucgcgagaugcauguggagauagugucuccuuaaaugaagggaaugaauaggagagaagacauugcacagggauggggguuccuuauucugaguugauugugguccugcagugaaaucauucucgaagaauucauucacucccuggcuguggccauuaggcuugaaccagcagggccuaggguuuaugagaggaagucaacaacuacuauuugauuagcaucuacugauuugaccuaagccccuucccuccucuccccucuccuucccaucucuucccuuccguuccuucuuuuuuuuuuuuuuuuuuugcuuugccagcccaaagcuugaggagacuauauuuucaggaauuaauacaacuuuaucucauuuccaccuuuagacccaggcaaccagaucccucuucccgugcccacaaccuagaagccccuguuccuuuauccagcuguucucucuccauagagcagcagagcaggagaccugucugcccaagggauacgcccaccggagccaaaccucccccaugugcugggcacccaggacccaggaauuuuuuaccaaauggcccugagcacacuucuaacaccuguguaggccuccucccaugaaaagauguugcuaggccugggggggcggggucaaagggcagcuguuugcuugggaggacagugagguagaugaaaauucagacgcgcgcucuguguucugcucacgugccuaguagaacaggauguaaguaggguggggcgagaagugcacaggacugcgccacugucugguguucacugcugggccucagggguggcugggggcuuccauguacagacagccagggcuccacgaaugccaggggcugguggaaacaccccuagcugcucuguugcccaugcugguagcugaaguguugaugggcuguuuuccccagcagagucaaguaugaaaagagcaauggugggaaaaaugcugaaauuacuggagauuucuucccuucuacccuggaauuuauucuuaucagaaaaaaaaagcaaacauggugacaagcccuggcugugcugugacucagaugagcuaauacuuuagugucucuugagaaguacagcccaaaugagguuucggcucacacugcuggccuuagcguuugcugaggugggcuuugugauaaagagccagcccuggcccugucaaggcauguuucugucuaagcuguggaagguggaggaagggaacaugagaauacugaaccauggaagcaugaauaauuccucaguuuccacuuuauacaauaguguaucugucucccaauaacuuucaacucaguucacuuccagcucagaagcagucagccaccauguuuagcacuuuaacaaugagaacacauggacacaggaaggggaacaucacacucuggggacuguugugggguggggggaggggagagggauagcauuaggagauauaccuaaugcuaaaugaauuaaaugggugcagcacaccagcauggcacauguauacauauguaacuaaccugcacauugugcacauguacccuagaacuuaaaguauaauuaaaaaaaaaaagaaauaacaaaucaaaaaaaaaaagagaaauuugaaagaaaugucugguuugcuuucuguccucaggagucuuaaugaugugguucuggagaagaaugugcauauagaagagcaagauaugacaguguauaauuaggugcuugaauuucuucaagaaauaguuucuacuauaggaauugagagauuaagaugaggcugggaguggcuugaagacugguuuccugcucugauuucugcccuuccaguucauccuuccuucugcuacuuaagugaucuuccuaccacguggaucugacggugccaccuccugcuuuauacgcuggaaccuuggaugguuccccuugcaugaaauucugcagcacugcuuaaaaggccguugaugaccagcuccucacccuccagccuugucuccuuucccucccuucuuccaucugcuguauuuuggugaugguccugcucccuuggcccacacaggcacagugcaaauccuuugcucuagccccaacuuuguggagaaaggguaaacaagaagcauauuuuaucucccuauugguuugggguuaggaaugggguagauaugauagaaaggggacuaacauauuuguuaauggcuuauuggugcuaggcuuacaaucuuaaucauuuuauccuccuggcaaggcagcuuuuauccugauuuuuuguaggguaagaaccugggggcuccaagggauuauaacauuuacaccaguaagugauggagccaguuuuaauagaccuaagucucauguucuuccugccgcaugacacugccccuucacaugucucaucugguuccuugaacgcgaugaccguuucuuguccaucuuugaauaagaugaaugccugccauaugaugaaugcucaagcaguguuuggugccccugaggagaaccacgguggugaagugucuaagacucccggugucuugccauucaagcccauaaggauuuggccguguacuucuucuaggguccugugucucuguuaccccaucagcacucccugccuggcuucagagcccucauuccgcaccagccacaccccugugcaccugcuuccugcuccuccacagccugugccuauaucaagaaugcccuuccuucuuuccauucuacgcagccucaggaucugauuuaaauucuaccuccuucaggcuacuuuccuaaugcuuccuuuuaaagcauuucauuagaguacagaagagccaugguuauaggauguggaaaauucacaauaaucauauaagaucauucuugacuaauagccacaggaaagaguugacuacuuuggccuuuuaaaaagguauuauucacuaauaaucucugugccuauaacuauguuacaaagaaaagcaugauuuaaaugcuaaacuauuuuuaaaacaaaaauucagacaaaguuaaaaguuauuugccuuagcccucacuucuacucuauauagguggccaccauuaauaauguugaguauccuuucagaaaugauuuauacaaauauuagcauauaucugaauauccuuguauauacacaaaugggccauguauacauaguaaccuacaauuugcucuuucuauuuuuuugugaguucauaguaggaaauauauauuuaugggguacaugagauauuuugauaaggcacgcaaugugaaauaaacacauuguagagaaugggguauccauccccucaagcauuuauccuuugaguuacaaacaagucaauuacacucuuuauuuugaaaaauacaauuauuauugacuauagguacccuguugugcuaucgaauaguaggucuuauuuuuucuuuuuuuuuuguacccauuagccaucccccccuccucccccacccccacccucccacuacccuucccagccucugguaaccaucugcaacuugcucuuuuuacugaaugucuuucgguguuuuuguuuucacacuagcacacagauccacuucacagcucuaauucugaacuuucuaacccucaauuguucccuucucugaacgccuauaauacuuuuauauauauaugagacucauuuuuacucuuuaucaauuuuuuuuuuuugagauggagucuuacucuguugccccaagcuggagugcagugacacaaucgcgguucacugcaaccuccgccucccagguucgagcgacacuccugccucagccuccugaguagcugggacuacaggcgcgugccaccacacccggcuaauuuuuguauuuuuaguagagacaggguuucaccauguuggcuaggcuggucucgaacuccugaccucaggugauccgcccaccucggccucccaaagugcugggauuacaggcgugagccacugugcccggccuacucuuuaucaguuuuuuaaucaauuuauaauuugauccauuauuguuuaucuuuugcuucuucaaugagagugagcuguucaagauacagaauugcauuguccaauaggauaccuacccacuagucacauguggcuacuuaaacuuaaauuaacaugaauuuaaauuaaauaaaauugaaaauucaguuccucagccgcaucagccgcaucagcacuauuuaagugcugaauagucacauggggcuaauggcuaccauauuggacagcacagauucuugaacauuuccauuaucauagaauguccuuucggacagggcugauugagagccuucucacacauaauucaacuucccauacuguauaucacuaacccacagcuagaagauagacuggaaauaguugucccauucacaauaaaaugaaggcauuacauucuugagaauuaagugaauucucaagauucauucaaagaaaaaugugaucuguugaugagagaaucuuuguccuucaucuucauuguagaaugcuaaccuugauaucccagcaagcuugaaugugcucccaaauuuuccacaggugucuauuccacguggcugguagcccaggugucacagaguuuccaaaguacucaaagggaaagcagcaguaugagaaguggcagggcaaguauuacugaaaauuuaccauagucaacagcugguggucacuuuggguucaaaaugguggacugaacagaugucuuaacuucccuuccugacaaauaugacaucgaaauaaacaugaagcaguccaaagagaaugcauucauagcugcgcuaaaaacgugagagggacauuaguggaugagagauuuucuuggcauugcauugaaggacauauuagcucugccugcagaacaguuaaggggugaggcuucagccauauauuugagauuaaaggauuuggagauuaggaguggauguagggcagaagucggggugauuaaaggaaagccuauuuacuaaacauguauauggagagaauugaagcuccugcuguagauguuaguuuauaagaaacaggauggaaguguguuggaugugccaucaucugcccacuugcuccaugaccaagccugugacuaugaccaaguccucuaugugaagccugcuaauagacauuccccauguggggcuugcaguccgcccccucauucagggagauaggacuacucccaagagguagaaaauccacagaagccaccugcauuuggaaacuaguucuucagccacugaugguuaacaguuaauucauggacaccagaugucugaaaacaacauuuauacaauauaauauugcuauaagaaaauuguuguuuuuaaaaaucaauccauagacaaaagucaaaaguguucauuauaguuacaguacagaaaguaaauccuguaaguuuuggcaagccgaaaguagagggauggugaaugguaagguagagacagaaaaacagaggaagagaaaaauauagugacacuaauguccccaucuuacacagugggaaguaaagagauuccaccuaaaauggauggaucaaauaacagguuuaaguaugugacuuaaaaccauaaugacagagguaaaaaaaaaaaaaaaaaaaaaaaaaaagaaagucaacccaugagccguauuuggcacacagaccuuuuguguuuggccagugguguucucaaaaaguuugagcaaagauuugcaaauggaaaauguacauauaugauucguguauaaguggcuuuucuuuacaaaugagagcuggcaauguuuccacauggccacacuggcccagagggugccgucacugugucugacauuaguuuccaggucguuauaguccccaccauuccaaggcaucucccaacacuaaggacaagugccuguugccagugaggaccuugcuuuucuccuagccaagucuauauucauaaugggaaagcaggaaauggacaggaagggccucgugacauuucuugucccagcccacauucccuacauguguuuccugcccagccucuguaggcauuggaguuagugauuaugcuauaaauguccaauaaaagaucuaaaaaucaagucaaggccaggaagagggaggcaccguaagccagagaaauuucucaucacuccugugggacuccacuaagugcugucuaaauucuuaaaucaagaaauagacacagagcaaaauaaaaauaauuaaaagaaaaaaagauuaugucaaggguuauagcugagaaguaauacuguugcacggaggggaaagauaaagaaggaaagaaaccuuuagccauuuuauacccucaacuuucaccuuuuacuuuguacacauucuuauugcuugaauuuuuuguaaacaguagacaggaauuacuucuguauauuuuuuaaaagcacaauaaaaaugccugcaagaagacucaguacagcugucugaguucaauguccagauucuauuugacagauggucaaagaugaauacacaguuuacagugaaagaaguguagacaaaguccgggcauggaaaauauauaacacugcauuuaaaaaauuacacaacucugcuggcauuuaaacaaauggaaaucaaaauaccuuaaaaguauuuaugcaccuaaaaaacuagcaaaauaagauaccaagagcccacugcuggggcugugaggaaacaggugagguuuuccuuuguuggaaguacugauuauugguucagccuccuuggggcuuagauuggcagaauguuacaagggcaauaaaacuguugaugugccuugccaagaauucugcuuuugacacuauaacuuaacucuuaaaggagaagaaaaaauguaguugcuacaaagauguccaaagcacuauuuuuaauaacaaaaaaggaacuaguuuguacucaaaaggagauagauuauuauacaaacacaucaauguggcaaauauuacauaaucaccuauuugucauugugguagcuauauccauaaaugaaaaugcgugugaauaacaaaguaggaagaaaaguagaacaaacacugugcacacucugaucacaaccauagaaaauccaucaauguguucacuaccuaaaauuagaagaggauuuggaacuguaugaauagaauuauuuuuuguuguaaguucuuuaagugucuguguuuuuaaaauuucucagugaugguuuacuuacuagauggcuggcccugucuagauaugucugucucucuacuaauaaggccuuaggcuccuauuguuuuaacguguuuccaauuaucucgacugucugccuugaaauggaaacaaagcugaguggcaaaaugaccgaugagagauaaagagaccagauugggguuuucuuccucuuaacuguauacucaaagugguguaggggaucuacacaggcaugagcgauagcacugaggucugguucauuuguucacauagauacaauuucuggagagcccaggauguucagauuccuucuaauaucuaucuuccuuccaacucuaaguaaaguuaauaaguaagacacuacuuucauaaauaaugaccaaugugaguugagccuccucugugcuccagacucuggagauacaaagaaaaauaaaacaugauugcugucuucagugaucuugcaacuaaugaauucucaauaucaaaacagaaaauuaaacuuuccuuccucuaugaagccuuuucuagcucuucuaccucauugcauuucuuuccauuuccauauuccaagaggguuguauucugcacucuacaauuuagauuuuaauuagauaauuaacguaguguguuguggaaagagcccuggacugggguucuaguucccacauaguugccuuaaacuuucuacaaaccacuaaaccuucccgagucucacauuccuucuuauaaaaucacgauucagaugaucccuaagacgcuucaacaucugaaauucugugaugugucuguuguaguguguguucucuguuuuacaugccuaguuuuuauaaaacacaccucggugccagcuccugguagaugcccaguaaaaagagauuauuuauucagucuguaaguuuucuaaauauuaaucucuugucuccuuaauguucuguuuuuauuuaagaaagauuuugaguguuuagauuugauucauucaaguaauguuuaugaagcacuuuaccaugagcuggcuacuguguaggcuguuugugguuugaggaggugcuuggggagggcuggccaucauuugugaggacugugguguugagaucuacacacaucaggcugagaguuggaccaaaucaucuugaccguugcucccaucuucaacauuuuauuauuuuauucagugccuauuuguauuggaguugguguuggaguuuucuuugugguuuguucugaucacaucugauuuuuaauaguaugccauagguuuguguggcauuuuacagaaccccuucuaguuuuguuagaggguagagagugcuaguuacccccucucccauuugucagcacuuggggaaagauaugcagaaugaaauggagggaaguaugugcauggagggccagugccucuaagagcacagcacccuccaggagagcucgacugaaggaugaggccaggccucuagugacccccucaggauuccauuuguccagccacuggagggcagaguuacuggagacuugguggcccagugcucccagagcuccucccucagucccuuccaggcuucaucuacugugagggucuucccaacaauuggcuuggagcacuuccucucuggccagaagccuccaguuguucugacugcagacuccuggccuggcauuugccuuucuccacgauguggggcuaguuccccagaccagcacucuucccaguugccaggcccuacauucccugagcaggucccgggauuugccucuuggacuuccaucauccuuucuaacuggagcccggaccccuaaucugucauagugcuacccugcuucuuccaaaugucaccucuuccagggagcccaucccacuuuuccuugccaguuguggucucuuuccugcugaaucacccuggggcuuuccuguacuguguaucuuuggcuuuauguucugguuauuuaaguacuugucucuagaaugugagccucuagacaaucucuuauucaucuuuguguucucuauagcaccuaggacagugcccggcccgugguagauauucagucagacuugguuaggugauggcugagcagggauggauuuaaauacucuagggcacugcagucagcccgugaugccaaagugcugucauuugcaaacguguuuacugggcagcuugucggcuaucuuaaggagcugccucucuuaagaccaacagugugaucuggaaggagggcaguucugguaucaugugcuugggucuuugucuuuaauucagucugcccucugggcuguaguuuccucauccuauaaaaugagagaguugaaccagaugacugugaugccccuuccuguuccaacauaacaugguuucauaaaaauacauuuauuucuauuuuauuuuauuuuuugagacagaaucucgcucuguugcccaggcuggaggacaguggcgcaaucucggcucacugcaaccucugcccccuggguucaagcaauucuccugucucacccucccaaguagcugggauuacaggcacgugccaccaugccgggcuaauuuuuguauuuuuaguagagaugggguuucaccacauuggucaggcuggucucaaacuccugacgucaggugauccacccaccuaggccgcccgaagugcugggauuacaggcaugagccaccgcgcccaaccauaaaaauaaauuuuaaacaagauuuuggaguagggaccuggugguuuuaugagcaugcuuaccaguugaccccacugcuacgugacaggcugacuuaagugacuaguuugcagguucguucaguaaacacuaaugguaugcaggauguuuguacucaugcaauaaacagaugacagagaaaaccaagacacugucccuguauucaaagguuugacauccucaacuugcugaggcucuaaaucugcacuucccacacccucuacaugcacaucaaccuugagugcuggcaugucgugugggaaugaggaaguguguucugaugucacacauuggaccugaugucuccuucaaauuaaucccuguccccugccucugcugaagaacucugaaauaaaggcgggugggagauggugauggugagaagagacuuauguccugauagugauggugaggaugagcaauagacucacuuguucuucucucaugugguggcacgcugagucccugagcaacuccucuaagaauugcaggucccucucagccacucagaaaacuccagcagggauuacggcaggacgaggugggggcaggcagagccuguugagagcuggaguuuagauggugagcacagagucccaagccugggagggagguugucuguggagugugaagaacuuggcucaacccggccaccaaaugcugggaagccugacaggggagugaaaaaugagccuggaagaguuggagccaggaaggcaaggaaaaucaaaucaaaucuggauccugacuuaaaaggcauuaggcugaggggagccaggcaccugaacauacuuuccacagccugucaugcugggccugccucauccgugugcaaggggacguugggcccagggagacugguucccaggccaccaucccccagccagucugcucaggcgcaggcacaaccccaucaaaugccauacucuguugagcuagaggacaggagagcugcuguggcucagucccgaaaggaguggggaaagacuguuucuggagcagacuggcgccagucagucccccacaugcacagugaacacugguacugaauuaaugaauuaucugagacaaagcucuuuugucauaaacucaagucauacccaaccccacccccacucuucauuuuuagcugccaggacauagcuauuugggguuugaagugaaauucuggacaccuuagugcuggaaucauucguggaggcacuuugucgagagugguuucucaaggugggauccugcagaagccacugggugccugcaggguccuacccagacccacugaggugagaccaaggaaucugcccuugaacacacugucccuaaacagguucuucuaugagccacucaaggggcagcuguuagucuccagagauggaaacaaaggucacaccugcagguuucagccgccccugggcgagcacaugggaaguggcugggcaguggaggaaggggugacugggcuucugcgucuugccugauuuuacuucugaggguggcgggucugacaaucucaggcccugggaaggggcugucuguugaugggcugcucgagcauauugcugacuuauagauuggugauuuuuuuuuuuuuuuuuuuuugaggcagagucucacucuguugcccaggcugggguacaguggcgcaaucuuggcucacugcaagcuccaccucccggguucacgccauucuccugccucagccuccugaguagcugggacuacaggcgccugccaccacgcucggcuaauuuuuuguauuuuguuuaguagagauggggauugaugauucuuauuaucaccauuaucuccccauuaucacccucccgaggaauccccuagugcaaauuuaauaccacaguuauacucuauaccauauauguguacuggaguauaucuguguguauauguaaaaagaguaagacuuuuugccccuuacuccugagaaccaauuaucgcccccccuuagggaugauauuacccccuugagaaugcaucaucauauagauuaaauuuuauaaugcuuagaaucuucuucuggaguagagguguggagucagaauagagaagggaaaauauggguaggaaauaauaaaccugggguaagaauagcauacagaaauaagcacuguacagucuuguauuauaguuguuagagaugggcugcaaauaugacuauuagcuuucuggaaaucauuuugucuguaaaaaauaagcccauuugcucaggagaugcagucaaaggccuaacuagugggaacucuggagaucacguguggguauauacacaugucccugugcauaaacaaggagcugucuggaugcuagagguggcaggagaugcuuuuugggcaguagacuggagaccccuggcucugucauuguucuguguucuaucuccccuccuacccugaacucagaucaccacuaucgucugcuccacacccucagcccaguucccaagcuggcucaggccccuucucacugcucuucgccucaucugccuuguggcccucaggucucuguucuacacuuggucaugcuuccugaaccuccccaaaguuucacaggggaagagagggugagcgcaagacucgagcuguggcagaguguggguauauaccucaggguggaccaguucaccuugaccucuucuucagggagcaguggccagccccgugcuuauaaacaugggcuugccagagcucaaaugaucaaaaaacaucaggacaggaaaucaagaaacucuguguuguggggccauggaaagaauagaaagcacagauuucguagccaggauaucugaguuugaauuuguucugcuuacauucucuaggccccauagcugagaugggaauaauaauuccuacuucccagcauaguuggaggguugaugcaauggcagaugugcgcaagcacauagcaguugccuaauaaaacaaugggcaucauaguacuauaguaauacagucaggaucacugaucuguccacagcaccacucuaaauggcuuacuuugagaauguuuuaaaguaaaaaugcaauauucuacuuaagaaagcagauaagcaaagguagaaagaaggcuaaaauuaccuaugguucugcuuugcucucggucuuuauuauuguuuuguuuaaucguucuguccuauaguuauuuucuaagcuggggguuucuuuuguuuucagcauagggauaacuacaggaucuacaggggcauaguggcuuguggaagcaucacaggccaugggucagacuugauuuuuaauucaaucccauccuuuaccaacugugaucaugaguaauuugccaacucuccaggucaugcuccuaucuauaaaauggggauaauacuaccuauaauauggcauuacuuaagugaaauaucuuugcugcauauguaauauaagugcucaguaacuuuuagucauaacuaaaauuauucauaguguuuuguauccugcuuuuuucagccaacauagcauuuuucaaaucacucugucaccauaauuuuaauggugaauauuccauuaaaucugauaugcuaccauuuacugaaucauuccucuguuggcaguuaucuugaugguuuccaacguuuccuuuuauaaauuaaauuuucaucaacaucuuuauacaugaaguuuuuaauuccauauuuaauauuauuuccuugggauugauuaguuggcagaagagaggugaaugggacaaggauucgggcaucuuuaagcacaaguacuuuccaagaggcuugucuucuucagcuugcacuguuaucaguaaggaagaagacauagcaccaguuuucauggcccaccugcucccugaucugugagauucaaacuugccuugucacaucuggggcaccucccuccaccaacuccuuccugccccagcucguagcuugguucccuccaaaccaagaauccuucaguagaccucagucuguaucugcccugcagcuuggccucuuguccugcugccacacggggaccagcagggccugcagguaccaagcggucaggagggugggaggcaggaagccagagaguccagugagagcugagaccgguaauggcgucugcugggguggcagagggagcgagaacagcaagcagacucagagaucaggccuguucauccuagucgucagaaagaucaagacagccuagggcucaggagaccucagugccuaccaugaugccugacacacaguaggugauuaagaagugaaaaccaaaggcugggcagugagagagccgugaguuuaaggagaaccaucuucuucccagagguucacugacuuucacugauagaggaccucauuaaauuucaagcuaagagacucuuccagccacacagggucgaauguugaacuacuugguacuugucauuccccuuuuucucuuuucuucucugcauaucaugguccuggcccacauagucauuaauuuuaaucauuccauugaacucauauucuuauuuagaguauauuugucaauuugucuucacugggcuccagacuaggagccuuuggguuggauacugucuccccuaauagagagugagcauccuaaggcaggugccacaucuacuguacugacucuaaaauaggugcacaacaaauacagagcuggguucuaagaggcaugaaaugcuaagacucaguucuugcucacuaagcauuaaugcagccugauugaaguacuaaaauguaugugcaugcacacacuuuccugaacuuacauuuguuuugugagaucugccgaugcugagagccaggugagguaccccaugccuauaaucccagcacuucaggaggcuguugggggaggauugcuugaagccagcaguucgagaccaccagccugggcagcaaagcaagacccagucucuacaaaaaauagaaauaaaaaaaauuagcugggcauggugguaugcaacuguagucccagcuacugagaggcuaaggugggaggaucacuugagcccgggaguucaaggcugcagugagcuaugauuacacuccaaccugggugacagagcaaaaccccaucucuaaaauuaaaaaaaaaaaaauuuaccauguugaaucugucuuuuccaucuucccuauuagaguaggcacucauugugggaggagacuagauccuuaaccuucuuugcauccccagugucuagcacaguaacggugaagggugcucaacgagccuuuauccagcgcauaaacaaacacuaguagugaacaagacccuaugcucuauggucgguauauuaauacaauaaaaugugcaacaaaaaauauaggaaagaagcauucagaagaccucaugaagaaggccgguuucauucuaggccuuucuaggagucauuaauuuauucaauuacaaaauaagggugugguguuuaacagugcucuugaagaauacuccuaaggggacacuggugaaauaucuugccaaaagacuaggaagccuugccauaacuuuuugauacuuggaacuuucuugcccgugauucuguuugacuccccugaaaaguagugagcuauggaggaacaagccugaaucuggggaccuuguguaaauuacuuaucuucuuugagauuuuuuuuucuuaccuauaaaauuaguaugguaacacugaccuuacagcgguauugggaggauuaacugaaaugauuugcauaauguagccuguacuucccgagaaugaacgcccaaccccguccaugcuuguacagcagggggaggaguaacugccuccggaggacugugaugcagucuccacugacccugcaaaaguauuguaaccucugccugaccugcuuguagguugcuuaggaggagagcugagaagugacaggaaaaagguuuuguaugcaguuuaugaguuaagagaauauuacuuaauuguggguuugauggaaaacauuaugugagguugguucagaucuuuccagaggucugccagcaaccucagaaguggagccuuauugaaaacagcuggggagaagguuggcgcccagccucuccuugcuuuuccaugccccagagcugucucacucaguggacugagcucagccccaggacccugccaagggcucuggcagccucagcuggagacaggcaguggcucugcccagcuuggggcuccaucucaaagaucaaaaccaguuaagccaggaguuugccaggccaccagucaguauuucuuccaggucuugaaauuagccacugacuugaguucuugcaggaugaguuaaccagugcaacguuuucguggcaggggugugggcugccuacuggaugugugauggaugggcuguguuguccuuugaaguccucccagcuguccugcugggcaccagcuagagaaugaggauacuguucaaagcacagcccucccauauguccauucagaagccucacccuccucugcuacagaggcuuuucuaucggaaggcugcuagcuuugcuacagcugaagcccauuugguuuuaucccaacuacucaccaaccaugucgauuucagcugaauuuucuugaagacaaauauggcaugccacucccuuauucuuucauuucaaagggacauuuagucacugccagucucuuguuuuauuuacuuucuaaaaaugugcuccuacuaaauuugcauaauuugaauuucaguaaguaaaauuuuuaaauuuuuuuacuguucaugaaaguaaaacguguuccuuacuuuaaaaguuuugacauacagaaaguauagaaaacaaucccaccauccagugaugacagcuauuuacacauuaguagauuuccuuuuuauuucuuuuuuuucuauuguaacaaggagaaaguaaaucguuaaaaguuacauuauggauauuaaguaacugguuuuauaugcugccuuuuuaguuaaugcuuucucauauucuuuaaaauucuucaagauaaaucuuaauaguuguauaguauuuuggucuuauuauuucaaauagacuauguuuuugauauguugauuucuaauauuuaaucuuuuaaauaaacauaaacaucuucauggacaucuuugauaauuccuaagagauauuagaaauagaauuauugaaucuuuuuaagucuuuggauagcuauuuccaaauuguuaaaaauagccuuauaaggucaacauuacuaugccaauuuuauaggaaagaaaaaugaaguuuaaauuacuacccuuccuucagcaauguuuaagaauuuaauuuucucacacucauaagcacuaguuaucacuuuaccuauuaacacguuuuuuaaaugaaacauaucacauuuuauuuuacguuuguuugauuaauuuuaaacauuuuuauauguuuggcuacuucagaaacuucuuguucauguccuuuacuuuuuuccuucuguguucuuuuuauuuagucaugcaaacuuuuuauaucuuaaaaaguucaccuuuuuuacacauauauuugaaauauuuuuaauuuguuuaccuuuuaauuuuuauccuaaguuuacuuuuguacagaaauuuuaaauuuuaguguucacauaucuuuaugcuuuccacuauuagugucaugccuggaaucucuaagauuauauccacauuucuucuaccuuuuuuuacuuuuaacauuuuaaucaaaauggauguuucuguguguaaugugaggaagggaucuugaauaggauuuuuuucaaguuauccacacuuacugaauaaucuauucuuuucccauuaguuugaggccaccuuuacuguauacuaaagucuuauguauagaguuuguuuuagcauuuuucuggacuauuucauuagucaauaugugaaccaaaaugguuuuaauaauuguugcuuuuuaacauuccauaucuaaucauauaauccuacugguuacuuuuaauacaaggacaaaguauuucucuuuauauauccaagacuucucguauguuguuuagaaaguuuugaaacuuuaauuauauaggaucuucacauuucuuaaauuuguuccuaggugaagugcaugugcauaccuuuccuaaucguaauagcuacuagauauggaaacaguuuuaacuuuugaguagguuauaacuggcuaaagccaauaucagagguguagacgguucccaaauuaugauaguucagcuuuacauuuucaacuuuaugcaaaaaugauacccacucauuagaaaccacacuucaaguacccccacaacuauuguuuuucacuuucagugcucaauaaauuacaugagauauucaauguuguauuauauaauaggccuuguguuagaugaauuugccaacuguaagcuaauguaaguguucugagcauguuuaagggaggcuaggcuaagcuaugauguuugauggagucacuauguuaaaugcauuuucaauuuagaaaauuuucaacuuaggaugagcuuauugggauguaacccaucauaaauuaaggagcaucuguauaugcauagccuuuaaugcuuuuaucauugaacaaaaauuacuaaaaauuagugagccaaucauucaacucgcaaaaucaaagacuagaacaagccgaaggaaagcagaagcaaaacauuuauauaaaaggagaaaugauuguauuacaaagagaaaaacaauauuuaggaauaaacuuaaggacuggucuuagaaauaagacauaggcaaacccuacuaggccauucaaagaaggacagaaaauauaccuaacauuuggaaaugggacucuaaccacugaucuguaguugauaaaaaugagauuuucaggguaaacuccgauuugaagaucuugaaagaaguagaugcuuuucuaagaaaauuaacuuaaaaaaaguugaaaaccugaaaaguucaguggaagaaacugaaacaguugaagaaauauauccugagaaaguucuggauccacauaguuuuauagaugaguucauuaaaaccuucaaggaguagaucauuccaagcucuguauuuguagcacaaagguuauuuacaguaugaaauggaauauuucuuucauagucucucucaccuuuauacauucaguucugugaaauucuuggaaaacuaggauugggguuguaaggcaucuuagaggguaggaaggcuucuuuugacaacaucccagccagaugguucuccagucuucuuaugaacauucuggggacggggaucuaccgugucacaguugguccauuugguuguugaggcauugcuggucuuacuuauaugaaccuaaaucugccucuggagaauuauggaccgauuuauccuuggucuguccucuggcacuacauagcauguagacuuuuauacaagagcucaucauacauuugaagacagauaugcccuccuuuugguguguuuuacuccaggcuaaauagaccaacuuccaucaacuauacuuuauguuccuucaauaaacaucuguugagcaccuaccaggugccagccgggcacugggcaucacccccucacacaccuugagccgcuuccucaauauccuauuaacacguggcacuuguaccuggacgcagucugucagugaugcccauguggaaugggacugcccacucccuguguggacaccaugcucuguuaauauggcuuaagguuaaauaauguuuaaaagacucaugcucggcuccuuucaauguuagcugcccuuccacacuaauuuugucuaguugaugauuuagaaccuucacaagacuuauucucuccuaauauaucuugauucggaccuuuguuuuauuuuauuuugagaaagcauuuugcucuuauugcccaggcuggaauauaauggcaugaucucagcucacugcaaccucugccucugagguucaagugauucuccugcaucagccucccaaguaucugggauuacaggugcccgccaccacgcccagcuaauuuuuuuuuuuuuuuuuuguauuuuuaguagagacaggguuucaccauguuggucagccucgucucgaacuccugaccucaggugauccaccugcuucggccuccaaaagugcugggauuacaggcaugagccacugcacccggccugacuuuguucuuuuagaacauugauucuaucagccaauauguauacucccaggauuaaugccagcuuuaguacucgugagcagccuugcaguccauucaaguaauaaauucauaauaaauaauaauaaauucaacggaauaaaaauguucaacaaaaacaaaagaggaaguccugggaccuaccagagagaccaugacauuaauuuaaaaauacuuauugaucaccuacuaugugccagucauugugcugggaauugguaauucaccagugagccaaagcuuuguagcucuuuccacagacaguuacagucuagugcgauuagacaggcaggagugacugugcacacagaugaauuauaagccgugaugaggcccacugaaggaaaacccagggugcagugagagcauaacagcaugacuuaguuugggaaaucaacaaaggugucucugaagugacacccaggcugggauauaaagauuggagaggagagacaucagucagcuagcuacucagugcugccaaaaggaaguggccaugcugaguguggagacaaguucagaauagguguaaugccuguuucccucucaugaguaagucacagucuugcaguaaguugugccaaauauaccuggaaugaauagaaacauaacccguguuacuggcauaagggcugucaccucagauugucaugagccauucugguuuaaaauauucucauuuuuccaguaaaguuauccaaauaugcuuggaguuccaguauuuugauguugaaacuuuuauagcaccaacuccuucuugcaccuggaggcugcucguaaaucucucaucagauaauguauccugauuuuuuuaauggaaaauaugguccugugcuucguguagggcagagagaaauguggaaggugaugucauggugauuaguugucucagauugucugggacaggccugauuuuaaguagucugaacugugaucagaucaacaugcacucguuuuuaaaaugugaccacuguagauaauaguguagaugcugcaaggaggaagcagggcaagaucagaggcagccagaguaacgggaggcucucuagaggcagagcaagugguccuggagaagcaggcagagagggggagagugcacuugcguggccuuuuggaauugcuccucgcuuggcucugccagcagugcauauuucuaaggccccuauccuguucaccagacaguguauggugaagauguuucgaaaggacacaauuaggaggaaaaaucugaugugugacacaucccauagacaaauagaaauagaacuaugauuauccccuuuugcgacaaggagguaagugaaaauugauuguaucagcauuuagcccuggcuuuagaauauuauuuuucagccuuacaaacaaauacuaccuacuuagagguggaucuggguccccaguaccuaaucucuagguguauuuagagaacuaggcccacuguggccaagggccaggagcagcaguggccugagcccugcaugguguuaggggucuuugccuuagagaggggcugggugggucauucaggucagggcuguccuuacugaaugggucuucccuucaggugacauagcugagcagucagugcugagaauucugacucuguccucaccugcauuugguggcaguccuucccaggggcagaagaaacagcugagggccagggaaacauugcuuuuuucauuucccccugaccagcaaaaggaagggaaaaacaccaagcuuggaaaggggacccugacccuggacccaguuguaaagcucuuaagacagaaaacggcuuuggaauaagcacugcucucaugcuugcguccugcagcugggggcaaagggcucuccaggcaugccugcuucuuuugggcugcagguuguccugguuccccucagcuucuagggcaacagcccuccuggacagcagugucagccgaguggucacugugagaagcugcugcugagaggccaggaguucggucagcauucccagagccuaggggcuccuucagaagccaaguggugaugguaggaguccaggcucccuuaggcugaagaggacucucuagaguguaacaaguuuacagacccuuccaauuccuaacccgaagcuggcccuuuuaacaacacaaaauaaagucaucuucucaagggccaccaggccucucucagcagcccacuccccugaagacacccacaggcaucauucauccuuagcaaguacuuccugucacuuccugacacccccaugggacugacacccacccauccuuacuucuuccccacuccucagaccuggaggucacuauggcuaacgugcuuagugcagcaaaggccuuagggcagcucuggcaccagccaugcauuuguuuuuguuuuuguuuuuguuuugagacagagucucacccugucacccaggcuggagugcaguggcgcaaucuuggcucacugcaaccuccaccucccagguucaagugauucucgugccucagccaccugaguaucugggauuacaggugcaagccaccaugcuuggcuaauuuuugaauuuuuaguacaggcgggguuucuucauuuuggacaggcuggucucgaacuccugaucucaggugaucugccaaccucggccucccaaagugcuggaauuacaggcaugagccaccacacccagccucaugcauuuguuuuuaacagacgaagaaugaguugcgcugcgccugaaauucucugagcuggguggucugagcaguugucuguacugagaccaagcccuaccugcaggcuucucaacccacugcuuuugucuaacaguggcucagcugggccccagcccccgccaauucuuccuccccgaggaucacagacuugaaagggacacuggcgggaggaggaaaggaaaguuugaguuuuguuuuuuacuacguaacugggcagcuuuucccuccauuuuuccagaugcuucuuuagaaaagagauuucaguggcauggacugggaagucuaauucugcuuuaaauguguguuuugaaccaggacucugaccccuuuggugcuccccagcccccaaacaggccaccaacaaauacccagagaacaaccgcaggcaagguuugcucacaauggguccugauuggaggguuguugguauguguuucuuuucuuuucugcaaccccugggccauugcccuaaaauuccugagcaauagcuugugagagggcugugcccuguggaacuaaguuggcaagagccaauagaucaggcggaaguggcugaggagagcuacucugguucagcaagagcuguuuaugugcuggcacgaccuggaaucugccucggcucacaaccuggggucuccgaggaccccuccuaaggcgggcagggcuguugggagcuaucucgcuucuagugcaaacuggguucacccuuucccuacaaacccuugggcgccagccccagcccuguaagucaccccuacugcugcuccccuggggcagaugcuauauuaagaggugguccucccuucuugcucaacucacagcaacaccucuguggagcccucacccuccuccgugcucccaugguccucagcacacaccucuuacacagcccugacugcaugugcugugggccucgaggcugcgagccacuucugggcggccuggagccuguguggucacgaggcagagaagggggaaugaggguggagagaaauaggcaggccaggucuuauucauagcacaaugagaacucauuggaaauuuucaaaacagagaguggcuuuggucugauuuauuuauuauaaggcaguguaacauuuggcaaagggauaaacauauagcuaauugaaacagaacagagaguucugaaauagauuuuuauauauuggcucauugacuuuuuuauugugguaaauacacaugaaaugaaauuuaccacuuuaaccauuuuuaaguggacaguucagcggcacuaaguacauucacauuguugcacaaccaucaccaccauuuaucucuggaaccuuuucaccuuguaaaacugaaaguucccacccauuaaacaauaacuucuuacuuccuuucccucuagccccuggcaaccaccauucuacuuucugucucuaugaauuuuacuacucuagguaccucacauaaguggaauuauaauguauuugugaccgucuuacuuuacuuagcauaaugucuucaagguucaccaguguagcauaugucagcauuuccuuccuuuuuaaauuuuucccuauguaaugccaaaccacagaaccuuccuuuuuaaggcugaauaauaucccauuguacacauauaucauauuuugcuuguccauuuaucuguugaugcacauuuggguugcuuccacuaucuggauguugugaauaaugcugucaugaauguggguguacaaauuccuuuuuucuuuuguuuuuuuuccuuucuuuuuuuuuuuuugagguggaaucucacucuguuacccaggcuagagugcaauggcgcaaucucggcucauugcaaucucugucuccuggauucaaacaauucuccugccucugccucccaaguagcugggauuacaggcaugcgccaccacccccggcuaauuuuugaauuuuuaguagagacgggguuucaccauguuggccaggcuggucucgaaccccugaccucaggugauccaccugccucagccucccaaagugcuggauuacaggugugagccacgacacccaaccuggguguacaaauuucuuuucaagucccugcuuucaauuauuuuaaguauaugcucagaaguggaauugcuggaucauaugauaauggaacuuuaauuuuuugaagaacucugccauuuuacauuuccaccagcagugugcgacgguuccaauuucuccacgucuuugcccauacuuguuauuuucuauugcuuuuuuuaaaaauaaugguguccuuaaaaugaguuuuuaaagaaagaaaaugaaaacuuauaaaccuaugaggacagaaagaaugaggagagacaacagcaaaugagagaugucaacaaacucguggaugauggcaugugaauagaugguuggcugaguuggguuucagucuucugacgcgcuaugccugugguuaggagaguaggcaaugaugaagcaauuggaagaugacauacuuccagagccuggguugcgaagugaagcugaaaacuggaagaugaaagaucugauaaggagcagugaggccccgguuccccgcuguaguccaugccccagaccccucuccuccuguacacccaaggagacugaaagcuccuccguggagaggccaaagcugaccagcugucacguccuagacaugagguacagcugcaggcagggcaaagcguuguacucaaaagggagaggggccgagugaaagucagcauguggaaaauaaccaacuuaccuucccacccugcgauggucuucccucacucaguguacuaaaugcugguagacagacuucguugcuguacccacccuccaccccacaccaccaaagcagcaacuaggaagaugccuuuuuauggaaacugauuaucucaagggagaagaucugcagauauugauguugauguuuuaauuucaaucccucuaccaugaggucugacacauugacaggucccaucugugcaccuggaacuuuguauuuccucacuuacauacaggaaaaaucaguaaaggaucaucagauguccaagggaauccucuguuauggaacagacauaaagaaccgaacaaggaaccaaguagaaacagaagacugcaggaaacagaacuucaaagaaguuucucucaccucagagauaagauguuaugucuauuaagcaagaagagaagacaauucaaaacaauuuugagaaacugaaaaaggguuuuuugaaguuaaugauagccaaaauaauaaauucaauauacuaguuggaaaauaaagucaaagaaaucucccagagagaauaaaaagacugagguagaaaaagugugaaaagaaauguaggucagucuaauagggcucauguccaguucaugggaguuccaugaagagaacauugaggaaaacaguagagagagaauucucaaaacacaaacauuccucaaaacugaaagacaugcauugccaguaaugaaaauaucuaccaacggucugacggacagugaacaaagacccacaccaagucaggucaucaugaaauucuagaauaucagaaugaaaagaagauucuaaaaguuugaaaggaaaacacacacacaaccccacacacauaauaguucacagaugauggaucagggaguccguguggcauuaugccucucaaacagcaacacuggaugccagaauugccuucaaaugccacgaagcaguaucuucagaguucugaagaaaaaaaaagguuuccacuuaaaauuccaucuccagacaaaaugucaauugaguauaaagguagaauguggauacuuuuggaaaugccagaucuaaaaauuuuaacuuuccaugcauucauucuuagaaaacuauuggaaugguauucuaucaaaacgguggcauagaaugagaaauuuccaagaggauggugagggaaugucccaggaccacuaugcaucaagcccagaaaacauccaguuuagauuagaggaggaugacaaaauguuccgggaggguuaucucuaaaggagaaaaaaauaacagcaacugaugaguuaucugaugcauuugaccauuacugagaagaauguaugguucucuuaagaaguuggaguccuuaaaaaacuaaggauaucaaaguaaagcaguuauuaacuccaggaaaaauaaaaaguucaagauauuuauuguaauauacuauguggcauggcagugagcaaaguuagaauguagugaagaccacaauuuuugucaugucgauguguaaugucauuuuguggggguaagggauggauuuaugugggggcagauuugagagcuuaaaguuuacauuccauacagagaacuuaagagauugucuuaguccauuuaaaguuugugcugcuauaacaaaauaccacagaccgaguaauuuauaaacaauaggaauucauuucuuacagcccuagaagcugagaagucuaagaucaaugcaccacuuggugagggccagucuuucuguuuccaagagagcaccuuguugcugcauccuccaaaggggaugaaugcuaugucaucucaugguggaaggccgaagggcaaaaaggggcaaacuaccuccgucaagcccuuuucuaagggcacuuaaccccuucaugaaggcucugcccucgugagccacaccugagccacaccuucuaaugcuguagcauugaugauuaaguuucaacaugaacuuuagaggggacaaaaacacucaaaccauagcagagauaaugcauaaaauuaaaaagaauaaaguaggccaggugcaguggcucacaccuguaaucccagcaacuuugggaggucaagguggguggauugcuugagcccaggaaauugagaccagccugggcaacauggugaaaccccaucuuuaccaaaaauaugaaaaauuagccaggcaugguggcaugugccuguggucccagcuacuugggaggcucugggugggaggaucgcuugagcaugggagguagagguugcagugagccaagaucugccacugcacuucagccuagguaacaaagugagaccccaucucaaaaaaagaaaaaaaaaagaauauuaguuguguaagacuauuguuuaggaauaauggaagaaauaucagaagaaaugacuaaaagcauugaaggugauugcccucaaggaaguggaaaugggagugggagggcggccugcuuucuuaugacuuauaguaccaauucacauuuuaaccagguacggguguuuuggugaggauaaaaauauauauauuuuuugaggcggaguuucgcucuuguugcccacgcuggugugcaauggcaugaucucggcucacugcaaccuccaucuccuggauucaagugauucuccugccucaggcucccgaguagcugggauuacaggugcccgccaccaugcccagcugauuuuuuguauuuuuaguagagacgagguuucaccauguuggccaggcuagucucaaauuccugaccucaggcgauccaccugccucggccucccaaaaugcugggauuacaggcgugagcuacugcgucuggccgagaauaaaaauauuuuaauaaagaucuggguuuuuuuagccuaauggccagucagacacugacauugcuugagaaacaacuuuugauuccuucucugacaugauucucuaugcaaaucaugaugccuuugggcagcuugggacauggggcagacauucaagcauaaagggacauuuucaugaggcugcugucugccacuugugccagguauuuuccagcagagucaaagagaugcucuccuggccacauggauacagguggcauaaaagauccugcuuucauagccccaccugcuccacuccgucccucagagccgccaccugggagagugagcagaaugcaugcuuugugugguggauucugacccaacguggagcagguguugggucacagagacaggcugcagagaucagaaauucugaaacaaagccaaggaagccaagucaugauguucucaggguguugagacccucaggucacuuuugcccacccuugcuuuuaaacagaaauugucagagaauaagacagaacaaucuguggccagugucugagucuugggcagcaggcucugcugauggagggguuauagucucuguguuguuuggggagcagcccuccacuccauuccuacugccagugaaguaugucucucccucucuccagguccaaucaugacuggcuaaaaacuccagauuuauuauccagauuuauuuccugacacucacccauccuucuugaaauuccagggcugcauuagucagugaggcagaaauccaggggauggucucugucuccaaggcucaaaugguauuuugggaguggaauaauggcacaguaaaacugcagacuggauauuuguuuuaaaauguguuuuuuaauaauacauaaaaacaaggaucacuuuucaaauuggguuucggucuuuaaauaaaaauaauaagccaauucaaccagagcagaauguucucaguuaaaggguuagauuuuuaccuaguuaagagugugaugccuugaaguugucuauaagaaugaaaguuguguaagaugaggcauaccaagcccauaaguuuauauguucugauauuucuuagggcagaaguaguuucaugccauuaacagagcugggagugaaauggaguuuaggguaccucauuauaaaaaaaaaauuguugacuuugaagaaaagaagagaggaaaagucuaaccuuuagaaucuauuaaugugguauuguacaugugcuaucucaguuaauuauaaacuucucagccaggcgugguggcucaugccuguaaucccagcacuuugggaggccgaggcagauggaucaccuuaggucgggaguucaagaccagccugaccaacauggagaaauccuggcuuaacuaaaaauacaaaauuagcugggcgugguggugcaugccuguaaucccagcuacucgggaggcugaggcaggagagucacuugaacccgggaggcggagguugcggugagccaagaucacaccauugcacuccagccugggcaacaagagcaagacucugucucauaaauacauacauacauacauacauacauacuucuccauggaaguagauucugauaucaucugcacuuugcaguuacguaaacucagagccaaauaaguaacuugcucaaugucaggcagcugaugauugaugcagcccacauccacacauagaucugucugacuccaaaggccauauaccuuccugaaguaaguaggugggacuuuuuuuugcaggugacagaaacuccagcuagguuaagcaaaagauauguauugucucauauaccugagcggguccagagucuaccacagcucugucaacucugucuccauuucuucucuucacuguauauaucagcucuuauucuccagauggcuuccuccuucugggaggaggcaagaaaauagauaauggggcuugggagagaacggcugcagauaggcuaagucuuacaucuucucaguuuugggucucugugaaaagagacagcuuuggucucucaauauucaaagauaaaguugcagggaagaucucucauuggcuggcuuggaacauaugccuauuguuugagaccaagugcuuuggccaggaggcauuuuaccaauuggcauccccaccgggucuaacacauaauggguggaaagggaggaggcacuuccuccaaaggagaggaaugcugcuuacacuggcaggcaggagagccuagcaaaucaaaaccacgucaaaccacagcauuaauuuguuaaaccucugcaaugccacaugccucucauuaauacuuaauaugucugagagugcaucucuauuugguagcagaaacuggagagcugccacagaagagugaucuccugggcuugcuccuccagcugaagacacaguauccguggagacccauggugagaguacagccagaaccccaaaguuuuguguagagguucuggaaagccuggagccccacaacuaucccagaagggcugggaguuaaaccagaaggacaucuguuuugcuaugaaaacaaugcauuugggggaacaaggaagguaucaacgugagaaguugcccaucacacuuaaaauucuaugucuuuggccaggcacagugucucaugcuuaugauccuagcacuuugggaagccaaggcaggcagaucuuuugagaccagaaguucaagaccagccugggcaacauggaaagaccccauuucuacaaaaguacaaaaaauuagcugggcauaguggcauaugccuauagucccagcuacuugggagguuaaaguaggagaaucaccugagcccaggaguucgaggcugcaaaaugagcugauugugccacugcacucuagccugggcaacagagugagaacgugucucagaaaaaaaagaaagaaagaaagaaagaaaaaucuguaucuuuguuuggcugcuccaaaggguuuuagaugcuuauaucauuaaaagggaaucaaaaaguugcauguguugauaagguuggucuagauaaaaggaaauagaucuuuuugauuaagcgguccagaagggcuugaauuguaacccccagcuacggagcuauaacuugccuuguguuuucagugacagaaacaaguccucagccuugcagaugucgaggugcagggauuccuaugucucgggucauaggaaaagaaagcaugccauaggaagugagaguggcugaucacagagaaagagacuuugagcaucugucccuggagacccacauggcauuugcugagccauugagaggaacaauucucugcauucugguuuuauuuacacggaagcacuuuuguccucauugguuuacaaguuggacauggggguggggagcauccagcaguuuaagccucucacuaauugcuguuuuuaguugguauggucucuuccugauggguucuguggguucaguuaaggcuuuugacuguuggcaaugggauuauucaaagccuuaauuaagugccugccugcuuauggggcugagugccaguugcugacacagacgcaggcucugaagcuuggucaugccaugccccuggcucacccuucacucuucacccucauaacauacccaugagguaaguuuuauagacauuuucuguggucugauuuguuugggguguuaauguuuuccuucuuuuuuuuuuuugugcaaccacguccauuuauuaucugagugagcuuauacuuggagauggggcagaagaagauugauucuucuucagcuaaucccucagcaccauugguuuuauuuccuacuauuuuucaguuuuuaaucaccaguccucuucuagucuuuuaucauaggagaaacaacacuuguaacaggguaagaaguucacaguaauguguuacaggcaggcaggcaacaaucaugaauacauagacaguguugcagaaugaggcuuugucagcuuaggggagauguccaucuagaagaauuccuuaauguccccuccuccaggcccagccuuucccagcaucccuucaguuacuuaacaaucaaguaaauacucaguggcaaccccucgggucuguuguucccagcccuaaagauucuucagcucacugcucauaucuucuuggugcaucuucccaauccccaguguccugcugggcagucuguuuucucccuggccucagcucaauccugcuuucucuccuuccuggucuuccuccaucccugaugugggcagagccucaguuccuucuuccugcucaugugaccuaucugcgguugggccaccgcagcugugcccugcagcuguguggguuuguagugugugcauugcgccaggcccugccagacaaaaaagacaugcggcagaucugcagaaucagcacaaucacccccuuucugcuacucaccaagcuuggagaagauggauauguugcuuugagucuuggaggaccuauagggacaaagaauuugccccugcucugagcacaggcuaugguagcccguccuaagcaacugaggauaaguugaaagcccuugauauauguuagagaaaaaccaaaauguuuagugcucuaacagauguuuugcuuuuagucauuaaguaaaucucaaggcagcaccagguucuggaaacugccucucaagugagacaggcagguagaaugcaguggccaagcgacugccugccugcagcucagcuuucuccucaaccuucagcaagcacagaaugagcccucauuccuuuuaaaggccuuuugaggccauaaagguuuuugaggacauuuuaugaagcuggagcacaguuuuacuauuuaaaauuauuauagggguuauggugacuauaucuuuauuuuuaugacaaguuguugguuauacccuugauuuauuugauaccgggcuuuuguucaagaauacaaccuccaauuaaaugugguuacugugucaagaaugcgauucucuccuuagagugacccucuuuggugccauuuccaaaacucauuguggugaaaacucagggcugucuauucauguuugugagcauuucuucugugguuacuugguuuucucauauggaggauuagaggguacuaaggcuguggguuggacccagaggagaaugcaggggaaaggaaagaaucuucccuaagaagcuaagugggucaccauuuaaaaccauaauacuucagagaugggaggaaccuuagauaccaaaagcaauuuccuccuuaauacaaggaaggaauuacaacccaagaaagcuaggacaccaagccaggcccagagugugcaggccuuggcuugcauacuagccucucuguaccacacugacucuccuaggggugucuuagguacacaccuggcaggcaccaauccuguccuauuacgaaaacaagggaauagcccaagacuugcuuauggugugauuauaaccuuggugaaccauuugacacuuuccaaaaguggggagcagauauugcuuuaaccuauaagggauuuagggucucuuggagauagacgcuuaugaauacuuuugguucuacagaacuuaccucaccaaaaacaugaauuuacgaugaggcauggagacaaccacucaaccuggaaaccaaaauuauggucuccaaucugccauuuaagcugccaugugagaucauggcaaaccaucuacuucuccaggccucuuuucuaggcuacaugggcccaguaaaacgacuggcuuugugagcuguuguggacauuguuggugcccuacccguauaccuucauuaggcccauucccagcugcugugaguguuggugaggacuugcaggaaggggucucugaagcccuaucugagguucugcuucuggguauccaaaccaaagacaucuccgucauagcugcaagagucaaguaagagucuauacauggcagcccucugaaaacuacaggaccaaagaguuuuuacuggcucuugaugaagauccugacuguaaaaaucccagcuaugacuucuugguggaaggccagugaugacagcagauaaggcaaccugggagggcagggcuguugucaugcaucccaaggaugugaacccaggcuuauuccuucaccacccagagguccaggguaguggcagacaguaaaaacggauugauuuuccauauugggagggcaaguauuaaaguuucaaaucauucagaccuuggaacugaacaaggucacaaaaauuccugccuuugcuucagguccaaugugcuauaaaaguaucauagugaacugcaacuuucuuaagugaugccaguuucagcauauuuucaaaucccuaaauauuuauuuuaagagggcauuucagagguaagcuugggguauguguagaaagugagaggaaaagagaaagagacagaaggauugugucccugaggucuggaacguuugcaauguccccaguuaaucauugaugccccagagcccagugagccaccagagcuggcccugcugcagggggccaguaugcuugcuaauggaaugccaggacgccuuuggcgcaguuaaugauuuaccuccuccuaguugcagugcuuggcacucccauucucugaagcugauagaagccuggguagaccagcccugccuaauggagugcaggagaagacaaugaugguuugcagauucacuguaugagcagaguccugaggggccaccuucuguaggaaaggguuucacacgagaagaauacuuuaacaguguaauuguugucugauguucccaugcaugaacguuucugccuuuagggccacaagaugacaugauuuuauaugggcgcaugacaucugucaccuuuaaacaugcauaacauuuauuugcauggcucuuuuauuuccgcuacuagauuuaaauuccuugaggcccucaacaaauuaaugaaugugcuauauacauucauuauacagcacacuaauauaaaagaaaugcauuuuuuaaguaaaauucuuuuuucuguuuugcaaaggccagguguacuauugcagaacucucagaaacuaauaguuaacuaaaaagaaaggaggagacucacaauccuaaccacccagagacaacagcuguuaacacaccauuuuauauuacaguggcugugagacccugugcaucccaauggaugcggucuccuucaacacugucagccuaaguucuggaacacuuguuuuggugaggcuacaauggcuucaggcauuguucacauggcuuuuggggaauccacuccagagucucagcauuuccuccaaaguacucaaucucugucaugaguauaguuuagauuuugauaggaaagggauauauuuuuguuuccagacauuguaaauaagauggaccauauugauuuggaguuuuauuguuguuucuuuuucacugaagcuugaccacaaauuaguggggacagaaaggcagucuugugagauucacaaacuggcacugaggggugacuauauggaauaaucaaagagggauuguucacuuugggaguuuucccuguuauucaaggcuuccuuccuuaggaagaaaucugcauccugguuacagagacucuggucuaagggugggcuaggggcugagcaccugggaagaaaacugagcacaguccaaagacaacgaccggcgcuuuuuagcauagcucuuuccucgcuuaguaugcuuagggaagagacuguauuuggaugcccaggccugugugcacaugcgccaauauagcaucacucugugaccuugcagggggugugaguaggauuauugcuacagaucagugaagccuuucuuuguaaaugcaauuugggggucauucagugaauuuugauuuugcuucauccguauccauucucucuuuccuugaagugaauacauggauaaaacuauugcuaccacuguuuuguaaugcaaacaacuuuguucucaggaagcuccuaugaugccuucuacuuuccagugcuaaaauccccaauucuggguccuuggcugugcauuagugagccauucugaacccuaauccuccaaagaugaguuaauucugaagagccuacugaguuucaaguguuugaaggcccuugggggacuuccuuucuuuaaaacucaaagugaauucuuuucuuugaauuuaucucugcauuuuccccucuuuugagagaugucuucucucugacuggguugcuaugaaacucagaugauugcaccacuguacuccagccugggcaacagagcaagacuccaucucaaaaaaaaaaaaaaaaaggaaacucagaugagccaaguacuuagagaagugcugaacccuuagcacucagcaaaugucagcugcuaacuacaguuagagaaaggcaaguggucuagagcagcacuaccccauaggacugucacaaggccuggauguaauuguaacuuuucuaguagccacauuaaaaaguagaaacaacugaaauuaaucugaauacauuuaauucaacauaucaaaaauacuacuuuucaacaucuaauccauauuuuuaauuauugagauauuuugcccuuuuuuguauugucuucgaaacccaguguguaaugcacacuuacagugcaacucagucucacuggccacauuuugagugcuccaucgcuaccuguggccaguggcuaccgugcugggcagugcagguccugaaccuugcuacucaaggugaguuccagggaccagcagcaucaguagcaucugugagcuugucccaacugcagaaucucaggccccagcccggaccuguagaagcaggauaugcauuuuaacaggaucaccaagugauuuauuagcauguuggagugagaagcacuggucuagaauccccguacucaguccuggcccccugggauucuaaucuaauuggucuaaggugggaccugggcacuaguguuuuuuuaaagcuccccuggaugauucuaaaaugcagccgggcuugagagucauuugcauaguggauucuggacccaggaugccugacuuugccaccuucuaccuuugagaccuugggaaauugccaaaacucucuguaccuugauuuccuuaucuguaaaaugaggaugaaaugggggcguuaugaggauuaaaugaguuaacacauguaaagcacuccaaacaauaccugacacagagagaguacucaugaaauacaggcucuuacccuuucuucuuuuucuugaagguccgggguuacccagagccccaggugacauggcacagaaacgggcaacccaucaccagcgggggccgcuuccugcuggauugcggcauccgggggacuuucagccuugugauucaugcuguccaugaggaggacaggggaaaguauaccugugaagccaccaauggcaguggugcucgccaggugacaguggaguugacaguagaaggugagucccaggaggcccgaguccaggagggagcugagcucucaguuaccccaaggccugcagcuccugccuuagcccucucuugaaggauggaggaacugacaagagaaaacacaccccauccuugaaccccggaccuuccaaucuaaugggagagauguggucccugcgaacaagggaggcauccaggagaugauguuugucaaacuagguaucaccugucuccugcuugagcccucccauggcuuccccucacacugcagcugaaaucagacuccuuaggauggucuuacagagccccacccaaucuggccccucccuagcucucagacccaucuucugccacucugcaccuguucagcccaccguggucacacccaccucuggcccuucuuugagcaaggcuacagggccuucacccuugcuguuccuucuguaaaagaagagcccuucccucagccucucaccugacgcuccuuucacauccuucaagucuguucucagaugucugcuccuuagaggcccuuucccaaccaucccagcccuaugacucuccaucuucucaccccacucgagguuuuucuuuuaggacguauuaccaucucacauugcagugucuucuccaucccccaccacuaaauggaagauuuaggaggagauggacuuucucugcucauugccuuaucuccaacaucuagaaagcuuccuggcacaugguagauacugaaauauuugaggaaugaaugaacaauguuuuuauccucauuaacaucaucuuuagcgucauuaugaaauaauacaugcucauuauuaaaaauuauguaacucagaaaaauauguaggaaguaaacacaucaauguguuaacauauuaguuaaaaguaauugcaaaaaccacaugacuuuugcaccaaccuaauauuuuugucuuuuuccccacucuguacuuuaaaaaauucuguuaacuuuaaaacuucuaggagaaaaauuggaccauaaguaaaauauuuuuugcuacuaguguguccuucugccaugcugaagccacuccacuggaaagaguaucucuaguucaggucccuggcugacacuuaaagccuugauaucaggaaggacauggggucugucagccccucagaaguaacacaagguucccuugacccuucccggucuuucuaagacuggaaguuuauaaaccaaggcucagacucacuucuccucuuucagaagacuguccucccaaucugguuuucaggggacacuagauggagaauuaagguagucagggaagguuccagaagggggcgaggugcaccugggccaauggccgcccuuugcccuguuuucccugucuccccacaccacagaagggccaacaggcuguuucacagaguggagcaugcauaguuuggaugcuuuccuuaaauucuuuaacugagugacucacuuacucuaaugaccuuugagugcuuuuggcuggggcauuccagauggaaaguggccccugcucagaaccucaggauggaccucagcucugccauccuggugcugugcuuuccccuacaugaacccccuuucaaugccugaacuuuguguugaugccuacaaauaaaaauuacccuguucccucuucugaguucuguuuagagcuggggaaauugagaaagcacugaguuaugaguuugugccaaugagaugugugacucuaaaccucugcaccugucuuucugcaggauaaaggguuugacuuugguggucucuacaaccuggacuagcccuuguuuucuaugauccacauuaagggaagacuggagucuguuaggaauacaggggaggcauauaaaaccuagauaauaugaaaacguuuucuucaaucccuacuguucaggaagugagaucugaugucaugaccaagcaggaaaauuuuuaguagcucaugguacucagggcaggggaaaggaaaucaggcugagggcuguagaggaaggagagcaggcuaaggcucucaaccccaccccuccccuuugguuuucauuuggggagacucaggcccucaaauuaaaauuaaaauacaguuaauuaaaauaaaauuaagacauaaaauguaagauacuuucugucuucuaacucuaggagauagagaacagccuaaaggaugcagcucuuuaaaugugugugaguccuaugcacauucugcuucugcagcaagaccgauuuuaagcuaaugugugguuuggggccaccccacagaccuaggccugaaagaguccacucugggcccuucugccauggaugaguugcuggcugugccaggcuagcccaacccuuuacaaaggaaaccuagcagcccaacugccuucccuccagcucucugugcuaugcuucuuacuuggagugagcagagguccaggaauucagaguguaauucauauguggaguuuuguaauccuuuaguggucaaguuuaggaggcaguguugugcaauggaaagaaagucaaauggucuuggauugaauuuuagcucuacuaauuucuaacuauggagaaauuaaccuuccuaagccuuacuuccuuuucugugacuuggaguucauggcugccccacagugugguacaaggauaagcacagcuaguaggaaguagcacccagaaagugguagcuucaucauuguuugaacuggcauuagcauccuuagagcuacuuaaaaagggaaaucugcaagagagaaagauuccucaucugacguuuaauguagugaucaggcccaagaaacauucagaaucccccaagagaaccagugccuuaaugagggccaugcaguuauucagggccuuacaugauggaaaucagccuuggucugagccccuggaaggcuaucugaagacagcucugacacuugcccaccuccagaggucaggucaugaggcuuggugcagagcaaggaagagacgugguaccugcccucugagaacuuccucucccguggaggaccacagaccuguccuguagagauuuaaugugagccacauauauaaucuuuuuuuuuuuuuuugaggcuaggucuugcucuguugcucagacgagagugcagugguguaaucacagcucacugcagccucgaccuccugggcucaagcgauccuccuaccucagccucccaaguagcugggacuauaggccugcaccacuacacugagcuaauuuauguauuuguauguauguauguauguauguauguauguauguauguauguauuuuucugagacagggucuugccgugucacccaggcuggagugcugugacaugaucuuggcucacugcaaccucugccuccuggguucaaacaauucuucugccucagccucccaaguagcugggauuacaggcgugugccaucacgcccggcuaauuuuuguacuuuuaguagagauggggccucaccauguuggccaagcuggucuugaacuccugaccuugugauccgccuaccucagccucccagaaugcugggguuacaggugugagccaccgugcccggccuuauguauuuauuuuuuuaaagaugggguuucaccguauugcccaggcuuguguaaucuuaaguuuaccaguagccacauuuuaagauaucagguaaaauucauuuuaauaaaauacuuauuuaaccuauuauauccaaaauauuaccauuucaauguauaagcgauauaaaaauuauuaaugagauauuuuacauucuucaacaucugggauguauuuuacacuuacagcacaccucacuucagaccagcuauaaugcugagugcucaauagccacaaguggcuaacagcuacucuuuugaacagugcaguucuagaagcugccaccugaauaggaauaaacaagguuuacacagaacaaaaagagaaagccacauggaugaacagguguugauaugguuuggauguuuguuccuuccaagucucauguugaaacgugauuuccaagguuggagguagggccuggugggaggugauuagaucauggggauggaucccucaugaauggcuuaauaccauccccuuggugaugugugaauucuugcucaguuaguucacaugagaucugguuguuuaaaagagucugggaccucucccuucucucucuuucucccucucgucaucugacauuucugcuccugcuucaccuuccuccaugauuguaagcuucccgaggcccucaccaagagcagauacuggugccaugcuucuuguacagccugcagaaccacaagccaaauaaaccucuuuuccauguaaauuaccaagccucagguauuuauaacaaugcgagaacagacuaacagguggugaguaguccugggucaucacacauccacacagugagcaucggacaugagguggagugagugcccaaacggugggugugccccagccccaguggucucagucugagaaggccuuugacuuuucaaggaccagagagucacuucagguaauaaaggguuaacuuuaaggacauaagcucaggagcccagggaaagccaaacuggcagcccccagaggagauccagaccucagauggaucacccaccuuacaggauugguuagugcaaaugcaugugcacagaaaucaccuggcgaaucugguugaaaugcagaugcugauuccauaggucuggagcagagccugggagucugcauuuccagccgccaguugaugccaugcugcugguccacagaccacucuuggaguagcaaggagggauuuaauuacaugugugauauauuccaccuaguacagugauucucaaacuugagcaugcaucagaaucacccggagggcugcugaaaacacugacugggcuggagccgucugccuggcucuccccucccagaugguccaagcacaccuccucccuacccccagccaccccucagugccgcagcuccugcuauccacacccgcaugaaacuacugcagugcagaccgaggcucugacuaugugagagagagagggccagccagcaggucaccuagacugugacagcagaagggagaaugacccccugucacaagauuuaagggagaagaguagcccuggugaccacuaaggcagcucugguggugccacugacaccaggauucucgggccaccuugaauucguaggaaaugcuccugugccaucuuuuguugccacugccguuuuucaggggcagaucucuuagacuccuuuuaucuucauguuggguuggauugaugacauuauacauuuuuaggccgugucuauuuauacuggcugaguuuuaaauuacuguguuccuccuggauguuugucaugguucuucuuuugguucuuuuugcucuuauuucuuuuggacugucuuccuuuaucuaacuuuucuacccaucugaaggaccuauaauuauauuucccauuuauguucuuuauaaaugcuuuucaaccucuaaaacuccccaaugacuucauuuucuagggguauauacccuauuuuuuaaaaucuaggcagaaucuuaaaaugcucugaguuuuuguccuuuucugucucauuaaaguuaacaauacaaaugugauagaaagggaaauuauucuuuuugccccaccagacucuuugcuguaaaauaguuguguguucaagacugccuuugcagaagcagccuuacucauuuaguauacaaaagaguuagcuggaaaguuacuuggucccauucuguucuugaaggaugacuuccaaauuuccuuuagcuggaaucucuucccuccuuuaucuucaccauccacuuugccuuugccucuuuuucccuccaaaauacacacagguugcccuugcuggccuaacuuagauuuuugcuacugaugcucccuccuuuuuccaucucguauuccuccaccuccuucucccaucuccaccccuggccuuugguagauuuaggcuuuucccaguugcuguuaguucuagccucuucuucauuccucagauuuuauugaacuuugugcuaggauauaaagaacaauaaagcucaaacuccuagccucaagcaauccuccugccucagccuccugagaagcuguggcuacaggcauguaccaccaugccuggcuucacaauucuuuauacuugaacuuauuugucuuuaaauuguaaauaaagccgggcaugguggcucacaccuguaaucccagcacuuugggaggccaaagugggcagaucacuugagguuaggacuucaagaccagccugacaacauggugaaacccgucucuacuaaaaacauaaaaauuagccauaugugguggugggugccuauaaucccagcuacucaggaggcugaggcaggagaaucacuugagucugacaugaggagguugcagugagccaagauugcaccacugcacuccacccugggcgacagagugagacuccaucucaaaaauacguaaaaaauaaaaauaaauaaauaaauuauaaauaaguauuuuaaauguuuuucuucuccacuagaacuguaagcuccaugaaggcaagacaugucucuuuuuaucaguuacugaauccccaguguaaggaaccuagcacagggccugagccaugauaggucuggccuguagaaagagcucaguaaauauuuguugacugccucuguagcugccuuugguacuucauccccuguacuaagaaagggauuccguuccuaguauauauaagcacuggucagagcuucaacaaguagacuaacauguacaacaaaaucuagaauaauaucugagccuuaaaagaaagagugcuucaaagaggagaauuuuggcaaaaauguuauucacauugagcaauuucagugaccuuuaguuuugacuuuuuucauuccuuuuuucuucaauaccaaguuuaauauucaaccagaaauucugguucuaggcacuucuccagagguuuucuuaagccacuggcccuaaacagagacaguaccacccucuagggggcacuuaggagauucaugggggcccuuuugguuucccagugauugggaguguugcuggauuuagggggcaagcacuagggguacaggaugggcuucacagcaagaaucuuuucccaguuccucacaguccuaccagaacagacaccacaaauauauaaaucggugguuccuuagucuucaauaauacaaaaaaaaagagcccaguaauugaagaaauggucaucauuuagagggaagauuaaaaggaaugaagcuauccuccaaaauuuuugaaaaauuuacucugcacaaauuuucuacuaaaugaaauauaacauuucuaucuauauauaauuaccucauauaauuguauauauagauagugcuguuacuacacuauugcucugaaaauguggaucagaggagacuuaaaacucuuaauauuagaagcaaauaguauuaaguuaauggagaugcauaaaauguaggcaucuuauugaguuuuauugccaucucacauuuuuuaaaacuuuggggaacaguaauaaaucuauauuguaaaaaaauuauguauuuccauuauuuuuuggagaugacugcuguuuucauccuagcacaugucuucucuauagucucuuguuauuaucacuguuccuuugucaaaaccauucacugaauguguauuucaagguaaggugagauuuuaccuugaaguccugugauaaauuuuacugugauaauuuucuuacuacucaaccccguaucauaaaacggagaauuguuuuaacaccacauuaauacauuaaucaucuuucuaaaaauguucucuacuucaguggucuguaacuugucuugcuauguuaucuucuuuuaaaguuauuuucuucuuucuuuuuuauauaauacaucuuuuuauuugaauauucuaguguccacuguagaccugugcucuuucacuuugcugugcuacuuguacagcaugauuuuucaucauucacuuuuaaaucuaaacaugcauuaggaguuaaugcaagaaucugccauuucauugucaucuaaugugccugagcacuuauguaaauugaaauggucaugcuugaacaguugcauauugaaauccauauuuuuauaauucacuuucgcucuauaucaccguaaugcuuuaguuaaggcuuuacauuuauuuucuuuuugaaauuaucacauacguguaugugugauuagaagggaauuuugaucagggucgcauggggauaucaguuaauacguguuauaaaaagcggauauuuguucugauagaguggagaaccacuauuuuaaguaauccucaaaaaacacuuugaaguuggcuacaaguagggugacugcuccccacuuuuccuggaacaguccuagcuuucuccugcuauccuggcaugauuauuaauugcaucucucucaguguugagagucucuguuuggaugauaaauuauaucaccgcacauuuuuagaagcauuucggcuccuuucaauuuugaucacauuauucacuuuuugagcaguauguucugacccgauucagucuuucuguaucaccugacaaacagagcuaggucuaccuuaucccuuccaccacugaacuuuccaauccuaagaccugccagcauucucuuuuacuugucuuugaaaaaucuaagaucaaauaccgucagugucuuggccucuccuuuuucucagcaacuugcuucuguccucaccaguucucuuaacucauucuucuauuuuuugcauuucuacuuuaauccccuuuccacuuauuuuucuacauaaccuuacuguucugccagauuuucauacuuuuacaaaauuaauuuugccuuaucuaacaauuugcaacuucaaauuuuuccuauaaauagacccuguuaguaauuuuagccuaaauucuuuuugucuugaugugaacucucuguuaacucauauuaaaauaagcauccaucaauuccauuuuuagcugacugcuuuaugugauauguuuucaucauacccucuuacccugacauagaaguaucucuccccagcauucuuuugcuauucuuugggaaagugccauguuuuugcuuuuauuuauuuuuuaaggaagaaaggaauuuaagccuuuuggauuaagauauuuagcucccaagacuuuuuaaaaugcucagucuaauuuuuuuuauugugguaaaauauacauaccuaacauaaaauuuaccauuuuaaccauuuuaaaguguacaauugucauuaaguacauucacaguguugugcagccaucacugcuaucucauuccaggacuuguuuauuaccccaaauggaaaccccauaccuauugagcauuaauuccccauccccuccucccccagcuccuggcaacuacuaaccaccaucuuucucuauggauuugccucuccuggacauuucauaugaacggaauccuaucauacauggccuuuugggucugagcuccuucacuuaaugcacuuuuucaauguccauccauguuguaccacguguuaguacuucauuccuuuuacagcugaauaauacuucauuguauggaugcaccacauuuucuuuauccauucaucaguuaaucagucuaauuuuuauaaaaucuuuauucccagaugaaaugagugauacaguaguguggguaguacaauggaugguacacggauauuuugugaugaaauguuagagacuggauaaugcuguuguauggagcguguuuagaaggcccuauccauccucuauuuggaugccagauuuuacuuucuuccucccugccccuuuuuuugcaacuagauuauguuuuucauguuuuauuucuucuuuaccauuguauuuauagguuuuagaaaauacagcugaauaaaauuacucagaguaccacaacccccaaaauaaucaguauuaauaacaugauaccuuuucuugucauuuuccugucuuuggguauuuuaguuuuaccuaauuaugaucacauuaaauagguaauuuuguaugcugcacaaaauguauuuaacaaauauuuaaauaccuacaaugugcugggauuuguuccggauacaucugaugagugaauaagaaguucuaguggggauauggguugggucuuuagcauauagaugauauuuaaagcuaugggacuaagaccuccugggagaaauuagauggagcuggggagaggcccaggacucagcccuagggugccccagcaugcaaagguugagcagagaaggagguugagagaagaugaauaaccugguaaaagcaggaaagucuagaagagaaagugcuuugaaggggagugggaccuugugucagauacuacugagcaucugagugagauggagacagagugucaaccauuggguuugacaagauuguggcugggauggagcccaguggagcggagaggaucauagcccauuuggagugugcugaggaacgaaugagauaauauccuaacauguaccugcacguuucagauauucuuaaacauaauuuaauggcagaauaagaugucuaauuguacauuuuaccugacuacuuauuuucuuccuacugagugacauuuauguugcuucuaacuuucacuauuacaaauaagauaaaagugaauagcuguguaaacuuucucuucuaacuuuagcgucguuuccuuugaauggagucacagaaacggaggugcugucccaagagcagagcaucuuuaaagcuuaugauuuuuccucacucaaguauuuccaggaggacuggacaguuggcucugccuccagcagcaucugagggcccagcaucuugacugucaguuggguccuuucaaaacaagucucuccuuuuaucaauuuagaaguucuuuuacuuuugaauagagaauggaaugacaaaaaccaaaacacuuucaggaaugaaaacuagacacagcucacuaaguaauguuaaacagaaaugccuguaucguaaucaccaauuauauggagccacagcuuaaaugugaugccaguguuuguuauuaaucccuuuucacuaaaguucugguggaaucuuaaaccggguguggcugaugaaaauagccaugauuuuucuccuccacaccuauguucuuacacagucauauaaaugugaucagagucaaaguuaaggaaguuuacucuuuugcaguaaacucccugcaaauuccccacagcaacugucugcugauaucagaggaugacucuacccucccugggauaggguuuuauaaacauccccagcuugcggcaaaagaagaacaacuuucagggugaucaucaucucaaaaaagaccucuuccucccaccccaccccucaaaauaaaacucccacuacuuuagaguuauuucauggugacauugugaauugucccucccagcugcaggagcuggaugaaaggagcuaaccccagcugccuugcuggcuuugcuauuuaauggccuccugccuagcacggcaacagcucacccaggaucagcagcgcccaguaggauagcgccuacuauggccucaucaucucaccuaggaccgacuggcagugcccagcauagcagcgccuugcccaggacuggcagugucuagcauagcagcgccuugcccaggacuggcaguguccagcauagcagcgccuugcccaggacuggcaguguccagcauagcagcaccuugcccaggacuggcaguguucaguguggcagcacugcagauucugcaggagcugcuggcuccgcuguagcucaucugcagugaccuguccugcucucuuucagcuugcugcuacuugccaggccuuaaguggaagaauggaguguugauugugucagucaagaguaggugugguaagagauaggcaugggccuuucccucccucccuuuaacugagaaaauguucuggagagguccugaaucacccccaaauaauccccaaaauggaagguagagcguacuacccuaacaacucagcagggugguugagaguuuuagaaucuggcagaccugggugaauuucugcacuguuacugacuuugugaccuuguauggaugacuuaacuucucugaaucuuauuucucucaucuguuuaaaaaauaggauaauguaguaucagcuucauaaaauuauugcaagaaauucacaugauaauguauguaaacaccuaccauaguauccauagugacacagcccaugcucagucaagauuaaugaucaccaucacuaucccacccaccccugcuguugaaucuuuuuacuuucauugcuccaaguugguggcucagaccugacucaucaacucuuuuucuugcaggaaguuuugcgaagcagcuuggucagccuguuguuuccaaaaccuuaggguaaguccuggauguucaagacagaguaaggguuggauugcuuuccugcugacuugagcaggauaggucuggggaguaagucuuggcucuccuagguuauaauaaccaaagggcgggagccuaguacaaugagaugugucauuuacacagcaccuccugaccuggcugccucugugauuggcuccuuugacuggcccagcugcuaaauguaaggaagugggagagguggccagagucugcaguggacucuaacaaucaaggcaauagucagaagauugaaauaagcaagccuagaagaggcggguaacaguagcugcuguaacagacaagccucaaaucacaguggcucaacccagggaaaguuuguuucuuacucagggaaaguucaguucagauauccuggaacauggggagagccuuccacauuaucuuccaggagcccaggcuucuuccauuuuauaguuucaucuccuaggcccuugagcccccacugggccuucugcaucucaccagcagaguggacgagagacugcagagccucacaggagguucuuaugagucggcccuggaaguggcauacagcucuucugcucauggucuccuggcuaaaacccaggcuuucagccagggcucaguggaauucaggcaugccuaacugcaaggaaggcuaguaaaugaagucuagcugcaugcccaagagguagaggaaauagguuuuggugccacacauuuuucuagagagagcaugagaaaguuucugaggcauaaaauugggaaggcuacacuuugauggcuucugaccuuaacuuagugccuuugagugagguggagagaggaugguugaauugcugccuugucugggacuggauucucugccaauuuccuuacagggauagauuuucagcuccagcaguggagacccguccuagcaucuggggggagugcccaccaaaguuugcuaccaagcugggccgaguuguggucaaagaaggacagaugggacgauucuccugcaagaucacuggccggccccaaccgcaggucaccuggcucaaggugagguuucugucugcccugacccugauccagccuguauuagucuguucucaugcugcuaauagacauacccgagacuggguaauuuaugaaggaaagagguuuaauggacucaccguuccacauggcuggggaggccucacaaucaugacagaaggugaaugaggagccaagucaugccuuauauggcggcaggcaagagagcaugugcaggggaacuccucuuuauaaaaccaucagaucacaugagacuuauucacugucaugagaauagcaugagaaaacccacccuaugauucaguuaccucccacugggucccucccacaacacgugggaauuaugggagcuacauuucaagaugagauuuggguggggacacagccaaaccauaucauagcccuagggacccugaaaauucaggguuagacccuucaacuaguaggagucuuuccauucuguuccuccuguuucaggcgguucucagggguucucuguauguuuguuagggaugcauguuccugucccuauuacaacucucccucuguuacucagaccacaguguucugacaauucucacacucacaaaauagcagaaaacuucugagucaagacaagccugacaaucucaagaguggacugugaaguuaggguucuagguguuaagccacagcucccugguuuauaaagccugugaagcuggauaagucauuugacuucuuggaauccugguuuccuuaucggugagauagaaauaauaccaccuaccucaaaauauugucaggagccuccauguagaagggauuuauaaaucauucagggcugggggaagugaagcuuaagggggagaggugggcgggcagggaggcaguggcaugggguuggggauggcuguuaaacagggcagugaggauccuaggggaacagguagagucauggccaggggaauagguuuuucagaguuggaaugccuggguaaaaguggguauugacaccuuuuaccugcuuccuaauucucuugaacuccccuaggaaaagaauaaaaggaauggggagguaaggaaaaacugaagugaggaauaugggauuuccuaccucaaacucaggcuccuuugaaacaguuuucaggcaacugcucuaagcaggacagagcaccacaccacauccacagaccucaagucagggccccugaacuguuuaaaguuggcucucugagcacauugacagggcccacagcagaggacgcugcugcccaggcccuggagucuaucccacuaggauuggcaggaggcaggaggacacagccagaaggugagcagauuuguaugaccaaguuaccccauugccauccacagggaaauguuccacugcagccgagugcccgugugucugugucugagaagaacggcaugcagguucuggaaauccauggagucaaccaagaugacgugggaguguacacgugccugguggugaacgggucggggaaggccucgaugucagcugaacuuuccauccaagguaucgaccaguggacggcuagugcagaacgaucccugccuggugccgcacccuccuagaggagcugcuuguucacugcgcaccuguguguguauacaccuggcccacucacacacccaggcacuccccaggggcaggucuuuuuuuuuuuuuucucuucagacagagucuugcucugucgcccaugcuggagugcagugacaugaccucagcucacugcaaccuccgccacccagguucaagcgauucuccugccucagccuccugaguggcugggacuacaggcacacaccaccacgcccggcugauuuuuguauuuuuuguagagacaggguuuuaccauguuggccaggcugaccucaagugaucugccugccuuggccucccaaagugcugggauuacaggugugagccaccacgcccggccacaaggggcaggucuuugacaagaagaaagggugaacagggcagcgcagaccuggccacgagggaagaugcccugugcuuggcugccaccuucccuuguguucccauagucucccccaccaugucuucaguccuuucuucucacccggacucccuuuuguaucugugguugccaacuggaagaaugaauguugcuaacgucuugccaucaccccaaauuuaaccugcccagaauuuacugauaauuuacucugucuuucaagucaggcgauccuucgacuugacccccucuaccaggguucccauguuccuucacacccagacuggacuuuccagcauccuuuugaccccugccucuuucuccuugagucgucagcccugucaguucuuccuuguaagucuuguugaacacgucuccuccuuacaguucuuugguuccucaaguccgggcugaggagggagugcagggauggggaaggggcugcaugucacuuuacuggagcaggaacucgggggucaggaagggaaguggcuuucaguccuuccuccuucuuugucccucucuuuucuucugauuuuucuguucugcaucuccuucuucuuagaaacgauucaucuuugcucuuguuacuuuuuuuggccuggguauuuuucacaaucuacagaaagaaauauauuucacaguacauugcaacccagaacauguauacauagguaaacaaguuucaggaaaccauccugaccguacuguguacagugcaugcugguauucucuauuucacuugacaucacuaaaacaagaaauccugguccugaccggaggaccugacuugguggcucacugcugaauaaggagaugccaccagacacccagagcaaugugugccugcccugacauucaguuaaauacuauucccuccugauggacuucaugacaaaauauguugccugauauuuguuuuaaaauacucaaaaacaaauaaacgaaagaaaacaaaaauggauauauaagacuggcaaaaugugguaucuccuuaaucguggugauggcuuucaggguuuguuaucucuuucuacuauuguauauuuuuaaguuuaccaugauaaaauuugagaaagaauauagcaggaaaaauauguauuuuauguuuuuucuuugaagaacuggauaacauuaaaaguaugcuuuucuguacacugguaaguuacagcauuuggguuuggaauuuucaguagauguuuguuugucccuggauugguuuuuuuuccuucuguuuagugaacagaaacagauuccaugcccucaggguaugguagcaccagccacuauuaagaagcccaaaggacagaaccugaagcuuugacaauguacucuagggcuggggggaguucaaaggccaaagacguucagcaccagggaagcuggaaggagccagcagggugggaccacggugaugaggaagugccuggggagggaaauuuugguguauacagcauucuacuaacagucuuuccacccuucccccuuuuuccagguuuggacagugccaauagguaugucuaggcuuugugacuuuuacguuuucccucuugaaaugcccugcaaggauguuaccgagaaaugcccugaauuucugaaucaucuuauggggcagaagaauuggccauuuggaggauguuguuuuauuuuggguguuuugucuuguucuccuauuguaauaugacacacggguucuaucucagguugcugucaguauugagacuggaaaacucaguguugccaccuuucacaguaucuacacagucucuucucugguuagcauccugaggaagaacacugcucugagaaggccgccuuccucauuccagggcggaaucuguucacucauccagcccagacccagcaggagccucuuuccugugugugaggcucggcgcuagaugcuggaugugcaggggugggcguagaggagggcuuaaaccacacgaacgcacauuaccaacugggaugcgucugugaggaaggacaacaggaaggcacugauuagaauagaggggcagggaagccauuucgggaacuugguauuugagcucagaccugugcaaaggaauguuagcuggugaagaaaagcucagggagugugcuccaaacagcagggauagcauguacaagcugugaaccaagagaugggcccauggggacccagaaggacgccaguguggccgcagccuggugaauggcaggccaaugucuguacgaucaggagcuggcauuccugugggcccucuuguggggcucaguuucauucuuaaaguaguggaaaagcuguuggaaaauccuugggcuugaaaugacauaauuugauuaauguuuuuaaaagaucgacuauggucgcuguauagaaaauagauuagagagggcagaguggacacgggacaccgguggcagagguugaacuacggaggcacuaguagagaagggaacuguagggaaagcagggcucugggcaggguugugggacaggcaagugucgggaauggcugcuugugcuguggcuugggaaacugggcaaacugcagagaaagaugcucuuacuugcccuuaacuugugggcuuuugugaucccuggaauccgugcuugugaugaguaauauuugugaguaaccagaugaucauucuauucuccccucuccucacccacccuacccccacccucaccaccacacaggucauuugugagagaaacaaaagccaccaauucagaugucaggaaagaggugaccaauguaaucucaaaggagucgaagcuggacagucuggaggcugcagccaaaagcaagaacugcuccagcccccagagagguggcuccccacccugggcugcaaacagccagccucagcccccaagggaguccaagcuggagucaugcaaggacucgcccagaacggccccgcagaccccgguccuucagaagacuuccagcuccaucacccugcaggccgcaagaguucagccggaaccaagagcaccaggccuggggguccuaucaccuucuggagaagagaggaagaggccagcuccuccccguccagccaccuuccccaccaggcagccuggccuggggagccaagauguugugagcaaggcugcuaacaggagaauccccauggagggccagagggauucagcauuccccaaauuugagagcaagccccaaagccaggaggucaaggaaaaucaaacugucaaguucagaugugaaggugaguagagguaauuagggucaccgauugccaaaauguagccccuugguggccacucccuuccuucagcacccagcuagucugcaucaccuauauccacucaucuucuuggacuagcuccccuagaaaaccaccuuacaagggccuuccccuuaggagugacucauuguagaaaugcccuuuauucuggagagaccccuaacaguagccuguuguuugcucuuggauagaguacuggcccuggcccuaguucuuaccacccuagaagaaacacccucauuaucgccaacaucgaaaagcaaaccucauggucuccuccgcccuuucuuccccuugccuggcuuuggccaaccuggagaccuugcccaucacgcuguauucauccuccucaaggccccugacucucucaagagguuucgucuuguggagugugguugagggugaggaagcagacucagaggugggagggcagcuccacaccaaacugagcccuuuccuccagcucacaccuuccccaccuaccucacaaucacagggugcucuccagggcauagggagcucacguucuuuaccuggcccuguaguuuccgggauuccaaagccugaaguggccugguuccuggaaggcacccccgugaggagacaggaaggcagcauugagguuuaugaagaugcuggcucccauuaccucugccugcugaaagcccggaccagggacagugggacauacagcugcacugcuuccaacgcccaaggccagcuguccuguagcuggacccuccaaguggaaagugaguacacuucuccaggucaccccgcauucucugugggacaaccauucauggggugcuucaccuucugcagaugguucaucuccuauagcccccugccuuggugcacagcccgacagaaaugucacccccaaucacaugccaaggccaaguguguugcucuaggccagugauucauaaucaggaguucacaucagaaucaccucaaaauaaacaugcauggccccacacccagcccaacugacagcuaccuuuccuaggucccucagcuguuugaauagugccgugacucacguuuguaaccacagagaacugaguguucauuaaauauacagguuuagaguaaugugagaugaugugggaucccacaucuuuuauguuuauuguacugucuguuuauaaaaguaaugcauguucauuguggggaauuuaaacaauauauaaccuuaugacucagaaauaaauuauauuuuaauguuuuuuauacaaacuuaccauugugguauuuguauacugcuuucuauccuaauuugcucaugugauauuaacaucuuuuuauacaauucuuggaaagcaugacuuuuaguagccauauaauauugcaugaaauggcuguaucuaauuuagguaugcuguuauuuguugaauaauuaaauuguuuccauuuuucacuauuauaacauaccuaugauaaauauucuuguaccugucuaucucuauaaaauuucccccuuacucuaaaugcauauguaagccccaggcccaugccauacccuugagaaaugcauuaacaaauaccacaagaguagaaucugcaaauugcaggcugcuggaaacuguggaacaaauaacuuucacccauuuuuuuuccacauacaaauugcaagcaaaaaaaaaaaaaaaaagacaaccuauagaaaacuuauauuagaagguauauaguaacaucaacaauuacaauaauuuuugauaaucuucugccaauccugacugagauaaucuuuaaaaaguuuuuaugggaacaucaagagaauuuggacacugauaagauuuaauauaaaggaauucgugguguuuuaagaugugaugguggucuuguuacuuuuuuuuuuauaaguucaucuguuugagagauauauccugaguuauuuacuggugaaaugauauggcuuuuuauauuugacuuagaaauaauucauguuuggggagcacuggcagggauaucaaugaaauaauauugauauaaaugaaaguugagagauggguacauaggaauucacuacacugcuuugucuacuuuuguguguguuugaaaauuuucaaaaugcacauuuccaaaagaaaaaaagaguuagugauguauccauauaguagaaugccagacaacauccuguagacugaugcuaaaacauguucaagaugcacuaggaagggagaggagcaaaguacaggcucauguguaaauggaagaaaagaucuguguacacacaugcaaaagaugccugugugugcacaaaucauuucuggaagagcacaaaagucccucuaggaaggggaaacuagggguucacaggaaggaauggggcaucuuacuuuucacuguauacuguugauucacugggauuuuaacuguuguuuaacugggauuuuuacuauccucgugaauuccuuuacaagaaauauuauccaugccauuugcaggugggagugcugguaggcagaguucacaggucuaggagaucaagccucaucauccaggccaggucucuaucccugcgcaggggacagaaauauggugucagguccaccacagauuaauggcguauccagagggccuagauucuccuguggcuucuucugcugugaauucaucuaagucucacagaagacuauuuuuagccuguucgcgucaugggguaauacaucucagguugauucccuaucuuguuguguuuugugugacagcuuuauugagauauaauucacauaacauaaaaagcacccuuuuaaaguacacaauucagugguuuuuaauauauucacagaguuguguggccaucaccaucaucugauuucagaacauuuucacuaccccucccaaaaaaauccuacccauuagcugucacucccuguucucccauccccacaaccccugauagccacuaauauacuuuuugucucuauggguuuuccucuucugaacauuugauguuaaauggaaucauucaauauguggccuuuugugucuggcuucuuucucuuagcuuaauguuuucaggguucaucuguguuguagcagguguuaguacuucauucauccauguggcugaaucauauugcauuguauggguauagcauacaguguuuuguuuauccacgcaucacuuaagguccaugugguuguuucuacuuuuuagcuauggugaaaaguguugcuaugcacauuuauguaugaguuguuuucaauaccuguuuucaauuuugauguuuagaccacauauauuguugggucauaagguaauucuggauuuaacccucugaggaacuaacaaacuguuuuucaccauuuuacauucuucuagcaauguacaaguguugcaguuuuuccacauucucaccaauacuuguuauuuucuugcuugcuugcuugguuucuugcuuuuuuuaaaaaaugaggucuugcuuugccaauggggcuagagugcaguggcaugauaauagcucacuguaaccuugaacuccugggcucaagcaauccuccugccucgccuccugaguaggugggacuaaaggugcuugccaccacacucggcuaauuuuuuuuauuauuuguagagauggaggucucacuauguugcccaggcuggucucaaaccccuagacuugagugauccucccacuucaaccucccaaagcacugggauuauaagcaugagccacugcacucagccuguuuucuauuuuuucauuauagccauucacaaucaucugacuaugauuuuuuuuuuuuuuuugaaacagggucucacucuguugcccaggcuggagugcaguggcgugauaauagcucauugcugccucaacaucccagccucaagugauccuucccaccucagccuccuggguagcugggaccacaggcauaugccacuauacccagcuaauuuuguuuauuuuuguagauaaaaggucuuacuauguugcccaggcuggacuugaacuccuugcucaaacaguccucccacuuuagccuccuaaagugcuggguuuacaggcaugagcugccacacccagccugacugcaauuuugauuugcauuucucugaugacuagugauuuugagcaucauuucauauacuuauuggacauuuguauaucuccuucagagaaaugccuauucaaauacuuuacccauguuuuaauugcaucauuuacuuuuuuauuguugaguugcaagaguucuuuauguauucuggauacaagucauuuaccagacaugauuuacaauaauccucucccauucuguaaaggcuggauuauuugucaugugcggccacagaagucccugcuuaguuaguuuagugaucaccuaauugauuggauggagaguuccuuaaaugccuugaacuaauacuuuucccagccuuugccaaggggcucuguguguguguuacgcccaucuucagugcuccggccagcaguuuacagcucugcuuuagccuuuacuuucugcuugcaccaaagcuccaagucagccagaggugagacaggagggccuucuuacaucuuuccugggcaggcucacagcccugcacaaccauuugggcuccucaguucucaggaaucugucagagcuuuucaaaguccuggacaucucauuccccaguuuuuccuuugaaguuuuuuggucaggcucuuguuagcuccgaaugauauugcugucucaaguagcuauaauguuaaacaauugcuacugauugauuuuaacaaacauccuggagacagggccauccacacagaguaaacuuugagucggauuaaacaaagacaacccggaaaauggagucguugaaggagcugccagacagggcaaauagugaccauucucuuacgcaugggguuuuucaggagcucugaacccauccugccccuugcuaaguggcugauuuucacaaguaccauagguacugucgguuuucagaguuaccccagagcuggggcaaggggcacaagagugaaaaagcacauagcuugcuguucuuaccaagauucagcuauguuuuauuguuguuguuguuguuguuguuguuguuuguuguuugggaggguggaggggcaggguauuguuguuugggguuuuuuguuguuguuuauuguuuuuacuuuuuagagacagagucucgcucugucacccagacuggagugcaauggcgugaucauagcuugcuacagccucaaacucuugggcucaagcaauccuccugccucagccuacuaagugagacuacaggcacaugccaucaugccuggcuaauauuuuaauuuuauuuuuuuugguagagacaagagucuugcuauguuucccaggcugguuucaaacuucuggcucaagcaguccuucugccuuggccuaccaaagugcugagauuaaagacuugagccaccacuccuggauguuuguuuguuuuuauugaaugcuccucagaauguugcaagccugugguuaauuucuggcauucugaaaccguugcuuuugacucuuuuugccaguauuguuguugcuuuuauggaggaguagaucuucagaggucuuuacuuugccauuccacauccuaucuucuugaugaagacacucgcuuuucuaaaacuucuccaguuccuaaacauccuagcuaauucuuggcagaugaguuuaccaugaagcaggucaucugauggguguucuuuuagcuccuccuacauacuucucucuuucuguuuuccuauacuacagaauaccugucuguuucccuucccaagacuucucuuucugucccuucccaucuucacaaggaucugaucuaacaaugauuuacucucucaccacuucuucaaucuuuccccuucccuuauugagagaccucuuuuuucucccuacaagcaugcuguaguugucccuaugcugaaaaaggaaagaaaaucuuccuuccacuugagagccccugcagcuccuacucuaucccuccacucucuuucaucccuagacuauauuugccucaaguagagucucuaugcacagcuucuacuugauaauaacagcuaacacucacugaggaugugcuaugcuggguuuugugcuaaaugcucuaccugaauuguuucauuuaguuaucccaacaaucuuacaagaaaaucauacccauuuccuagauaagaauacugaucuuuaguaagguuaaaugacuuguccaaguucacaugccuuguaaaagagagcauauuucuaacccaaacugaccuggcaugaaagccuauauccuuuuuugauaacucccaaaggcauuucucuaaugagggaguucaacacuggccaaggggagggauggagagggugccuccccacaccuucuggguggucugucugacccucccucagugccaggccuguccagguacaccaucacucugucuugucgcugcccucccaucgccuauccuccccuaggaucuggaggagaaagugcagcuguacagucagagcuggcuguaaaacuuggcuucagcaucgaguucaacuaugggaaauuaguaaccuugucuguaaaaugaacucaagagaacaaccucauaacauugucguaaucacaucuggaaaaguaccuggcacauaguaggcccucacaucuuauuagcuuucuugcccauaaaccccugcaguauaauaugacauuucuucucauuucuguauugaauaggcucucuugaaaagcaccagugauauaucuucuaagcaccaaauccaguuccaccuuuucucagcuaucagccaccuugacacauguacagcauguucugguugucauagaagagauuaucccuauugcucuuaauuaagguccccaaacuagaaaauguccccuaauucacugauguagaaggcuuuuggaaaguucagcucagcaguucucaaccagaaugugcauucaaaccacacaagggcaucauuacugcauauucccagguccccggcagcucugagcccuugaccuagaaugggguucaagcugugcuuagaaaacuggagcacaugugaguccuaugauucaguucuggaauuggaaaaaaaucauuguaauaauuuaaaauugaaauguccucaccugugagccuguggcuuauacaaguaaagagauacucacaagauuguguaaucacugaugggacauauuaaagaagauaagagacacuagaaaauagaguaggaccaacaagcaggaaggagcucuccagaggcucgagggcagcaaaagccaaggcaaagcaggaggcaccugagucacagaggagagaaggcaggcccagguucuaagcaccccagggcuaggguguuuugugacugugaaaaagccccugcgggugacucugcuucaggcuccaugucccuacaucacuggugcugccuguuucuuaagcaugaagagagagaagccaaaggcaggcugccgaggguacccagguguccaggacagugaggcgugccugggaggcuggggugacugcaggcaucaccagagugggcaagcugugaucugagcugaccuguccuuuucccucacagggcuugccgugauggagguggcccccuccuucuccaguguccugaaggacugcgcuguuauugagggccaggauuuugugcugcagugcuccguacgggggaccccagugccccggaucacuuggcugcugaauggugaguucccccugccccagcucucugcucccauccccugggcccuuuggcgcugccugaauucucacuuaucccucugagccauuuaugccuuggacauccuggugguaugagaaggaagcacagggcacaaagagagcacgggcacugggauccugcucccgacuggcugagcaaguuacuacuccugucugagccuugaguucuccaucuacauggcaggaaucaugcugccuaugugcaggguggugguugugaaauuaaauuagauuauuucuauaaagugguuaaugagaugccugacacauaggggcaugagcaguuggauuucuuuucuuauggccaaacucauaguaggcccucaauuaauauuuauugagucaauaaaugaacaaauaaaugaauaaacuaaugaaccacucucaaagucgcaugagggaucuuaccuuuuauuuaguggcaggugguucugggacucacagaccaguuauucuuuuuaaacugauaguccuauagagacucgccaacucuuuuuuuugucaaguaagguccuuuaaaaaauuauuugccguauauuaucacccuuuucuuuuuaaaggaccauuuaauuucaacagugugggagaacucugacuuuagaagacugagaacuguccauuaaacugauaagauggagcagggacuacuguggggauccccagggagggugaaagagccccugcugagagucaggagacacaggcacuuguccuucuccaccacugaguggucgggugaccuuggacacuucaccccucgggguaccagcuucuuuaucuaugagaagauaggguggaaaagaagguuugggaucucagcucacucucauaccuaauagaauacacuccuuaagacagcagugggccaggugugguggcucaugccuguaauccgcacuuugggaggcugagguggguggaucaccugaggucaggaguucgagaccagccuggccaacaugaugagacccccaucucuacuaaaaauacaaaacuuagccgaacauggugccaggugccuguaaucccagcuacuccggaggcuaggcaggagaaucgcuugaacccagaagccagagguugcagugagccgagauugcgccauugcacuccagccugggugacaagagcaaaacuccaauaaauaaauaaauaaauaaaugaaagagcgagcaagcgagcgagcagugguccccaacacuuaugcaccaaauaguccccauuugugucugcgucauugauguauugccugugaaccuuccuuguugguguaguuugcucaggcuuugcuagaagcugucuuuagugaguaagaggaagugccaucuagucuuccuacauguaguguucuuggguagguaagugagaauugaggucugccuucccucccagcccuuagcaaaggacagaaguccuauuggauccagugauugacuucaaggaggcagccuccuuguggcuggaaugcaauaugggcguuaaggacuaauaacggagucuagacuaaguaucaacaaacauuuucuauaaagggccagguaguagcuauuuucagcuuuucaggccauacagccucuuuaacaacucucaacucugcuguugugguauaaaagcagccauaggaggcugggcgcaguggcccacuccuguaaucccagcacucugggaggccaaggcagguggauugccugagcucaggaguucaagaccagccuggccaacacagugaaccugucucuacaaaaaaaaaaaaaaaaaaaaaaaaagcaaaacuuagccaggcuuagcaaaacuuagccacugcacuccaaccuggguaauaagagugagacccugucucaaaaaguaaaagaauagacaauacauaagccauagacaauaagugaaagaacgaguguggcuauguugcaguaaaacuuuaugaauacugaaaugugaguuucacauaauuuuuacauaucaugagauauauuaauuaccuuuauauuuuucggccauuuaaaauauguaaaaacuauucuuagcuugcaggcgcuacaaaaacaagcugcaauuagcauucugcccaggagccauagcuugcugucuccuaguuuauacaucacucaagacgguguuuucucagcgacucuuagcguuuccacacccauuccacuagagggcgaucaugcucaaguuggguuuccuuggcugcuaacuuuaguuuaacccagccuccgagcugggagagccuaaugucucccaauucugaugugcccugagccaacagcuccuuucuggggccuccaucccaucccauguuuguggggccacagugaguuacguuccaguuaaaggagagcucucaaaaggcuugucagcacauguuuggacagaagagacacauuggcggcagucagggaauacacugguauugucaaggaagagagguuuggaggguaccauugugacaaaaaguaaaaacaaagagcagugcucacuucucucaguggcaggauccaggccccugccuuucccagcccucggccccacuuuuaugaaaugcaauagguugagaggaaucuuccccucuaguccuaugaugugcuugcuggucucuuugccaaacugucauggagacaugaaguguugcuaugugcagaagaaaacacugcauugcagggagacgacuucuuucuguacugucucccuuccccacuggccgaccccaauuuuaugaagugcaaaccaggacccuggggccuggcaagggaagaaacugacaguugcuuccuauauggcagcuggacacauuccugcuccgaggacagacucuucaguaaugagauuuuuuuuuuccuggaaaugaaaagucacaucccagaaugauaaacucccaggaacauagagcauuaaggaaaccacugaagcucauugcaugcacuccugucuccaugcaggacuuuauguuaccuggaacaugucacauguaagggacucuggaaaaaaggagccgagucauuuuuaguucccuauauuuaucuuuucugugaacccuaaaauacaccuaauugcauagaagaaacgcaccuaacugcaacagugggugggggaugcagaauugcuuuuugauaaauaucuacaguggaaaauugaaucguuguuucuggagacaucuaaguggagcugggcaccccauguucagccugggaaagcuccguuuugccugaggcugggcuaugggccagaugaccguguaaaagucucuccaggcucagaauucugugaaguugaggauguggauuuggagacuguuuaacacagaaugcccaaaacucugucccuuucccuccugcauuuuuaauuccuccagauucucccucccccaucccucuaggccccgucuuccuccuccaccacacaauuacucccuuuccuucaucuccuuagccccuggcucuuucuccagcccauaagccucuguccagcuggcuggagaugugcaugguacaucauuagcccucaguggaucugagcaagcaugacaagucucagcgucaugacagcagcagcccugcugaggacagggcucccgucccuacugccagugcugccuggccugagccuuccugugcuuccuccacagggcagcccauccaguacgcucgcuccaccugcgaggccggcguggcugagcuccacauccaggaugcccugccggaggaccauggcaccuacaccugccuagcugagaaugccuuggggcagguguccugcagcgccugggucaccguccaugguaggagccucugggcaccuggguagaagcaccuuuccugcaggcacuucugcuuuggaggaagggcacauuuguagaaaaugguaucaugagcucaaauccagggagcagaggugcacauggcacuacuccacaccacuggcagcggcaggugccgugacagaggaguggcugcugcaaccucuuagggacagaggagaggguccuuaaaaagugcugcaccugcagguaggaagugagggagaugaccuccaggaguucacagcgacaagggugucaucagagguggccuuuuccucacccccucacuccacuggggccauggaaagguaugggggaaagagauagggcucccuuagcuccagaagcuccaggucuggucagaagaaaaccucgcacacuacaaaaggacuugggagagcacucacguauucccugaacagucaguggccucccagugaccccuuacaugcugggggacccugggucacagcgugcacacugaggcuuccagagggucacagguuguccccuuucugccccccuucuacucacgggcccaggcuuguuuuuacacaucagcagccuggucuccaguaaucugauuaucauggucauccauucaucagccaagcacuuaguccccgggaacugcagggagccucagacucaagacagaucugucugggcugugguaucagcaggccuggugacaguucccguggaagugcuucuuggguccagggcuuucagguaagccugaucccaccaucacccugagccuaugcccccggcuccugugcaugacuggguccucuggugcuagcacugagugcagcgugacuggucucccaucagacaagcaggaggauacaucucuccauuccccggggcucaggccugucaggaacaucuccguguuguaugaguagccacugucugggaggcugcaggaggaaguuucgcagaaaaggaaaggggaagaaacauuuguggcuuacuguguuaaauacuuucaccucacccguauucucucacugagaccucaguagccuaggggacaaggaugcuguccugauuucagacagaaggcucuggaagucucgggaauugaauguaacuugccuaagcgcaucacguuagucugcaaagcugcacccuggagcccacagccugugacuuucaagucugugcucauuccuaugcccugaccuuuuucagaggacacauccccuggcucaaaggggaagacuggccacugugggcugggcagugucagucccuuagggaugaaggaacuggcacugauggagaaugugacugacgcuggcucugugaagcucucugccgggagugagcacgagaaacugguccaccccuuccuuccaggaaacccaccacacuggguucagagcccagcucuggccucugggaauuugcagccagauucugguuuacaaacuuacucauuuauccucauaguucuaacuucaugacucccugggagccagguggggagcucaggaaauugugauaaugagauuucagaggaaaccugaacugcugagaaccuugucucugagguccaggaagcaggacucaccugggggcucuucuuggaggccagcguggccaaccccagagucaaguaaggggcagcaagagucagaaugcuacacguagagccgccguggcucagcccucuguuuucugauacucccuccacagccacagccaaggacuaauccaaugucuguccuggcuugccuguguuuagauuggauuagagugacccagcugagcuaagaguccccuggaggugggagucccaggcaaaggaucaagaauucuuuagggccauccuccugacucccgggccugugggggcugggaccugaaggaucaccacccauccaaaggaaaacaaaaagcacagagaggucccaggcaaaaacucugccaaggaaguuuggauuugcucggagaagaggccugcaugacagaacccccucccagugugggggauguacugggcuauaaagaccagacaggcucagauaccauaaauggugaacaaggcugaagacgcagccgcacgcucaggcccggcagcauuugggcucuuggcauaggauuggagcagggugagccuggcacagcgacacccccuggcacggugcccugagacacucaggaggcucggggcugcucccugcgcuguccucugcuguggaguuuuucugacuugauuggcagccccguuggcucuggauccucgggacaagccugggcugggggagaugaucacaguggagguguuuguucccuacugcacugauggcugcuucaccccucccuuagcuguccagguccagcccucucuugcccuuaguguggcaccaggccacgguggggagcauggauguggagccagcggccugggugugaguccugcucugccacuuacuagcccugcacccuggcguuuuagcauuccagaccucagcuuccucuugugugaaauggagaugcugacagucgcgguacugugaggauuaagugaaugaaugugcaaaguauccccagagcauaggauagcacacacccuccauagguaugugcugugauuaugauuguccagcagagcccaccuuuaaacaagauacaauccuuacaaaugccaagacugaggagggguuuucccaaaggauccacuuugcuacaguauuguguguuuguuuggccaucagagaaucagaggagggagguguccagccagacacaagccaugaacacucgugccugcuuccaagggcucuggccacaagguggcaccaugcagcaacgcgugucccuccaguugucuucucucgggggugguugaggggcagcucugcugcaagcaagcuuauucugagagcucagcagauaccgugccaaaggccagaugcaggggcucuuucucaccucucgccuuuugccgagauuuugcaaucaucgagauugcuggugcagcccucagacgcgauuucugcagccagcccuucaugcuuucucugccuucccuccucagugacucucuucuucuccaaauccuggaaacucccacaaaugucacuuucucugggaagccuacccuaaucaccccagaaugcguucccugaacaccgugugcuucuaguauuacacuuacuuaucaacaagucuuuacugcgcgccuauauugaucagugccaggcauuguucuggggaaacugcaguagacaggacagcugagggcccugccugcagggugcuuacguucugaugaggaugccagcagcagucagcaccuggccucauuucaaaugcuggcacgugcuguuaagaacaugagcaggucacaaaggaauaauuauaaagagaaaaagccagugaguggggugugugaaucgaggagggugagaggguguaucuuuagugcugugaggaagccucagagguguccauggccuggggaaagagagcucuaggugggcagcacagcaagugcaaggcccugagucaggagcaagguugacccauucgaggaguagcaagacagcagccucuguggcugcagcaaaguagacggggcagugugauagaaagugaguucagaaugcgggggcucaccauuccaggccucuggaggagaggagaaaacaauuuacuccgugaaaauucacuuucauuuuacucuacuugcuuaauuaucuuccucuccacacuguaagcucccugcagggagggaucacgucauacuguguguagagccaggccugccaugggagcaugcauucccugaauggaugagagcacagagguugccgaaccuccccugcagugcagggaggcauucccuagaauuccucgcuuuucugggggcucagugcccauuagggugugcaggaaaucugcaaauuaccuucaagagucccucaacagggcuaggcacagugucucaugccuguaaucccagcacuuugggaggccaaggcagguggaucucuugagccgaggaguucgagaccaccuugggcaacacggcaacacaccgucuccacaaaaaacacaaaaauuagccgggagugguggcccaugccucuagucccagcuacucaggaggcugaggcaggaggauugcuugagccugcgaggucgagacugcaguugcagugagccguaaucacaccacuggacuccagccuggaugacagagcaagacccugucucaaaaaaaaaaaaaaaaaaaaaaaaaaaaaaaaaagagucccucaacaaauauuccuucuuuccccaacacaggcuagggaaaaaaaauuccccaauaguuaaccaagcaaugaaugucuuuccuccugacccaggaugaguccugauccaggaugauuaauucaaauuccugcagagcccaggaauaucugaaauacaguauauauuucacagcguuuggacugagucauugcugggggcuuccuugggcuagaauauuuaaaauuuuuucccccuggaguaucuccaucaaggcuaaaauucuuaagugucuagauuuauuaauagccugccaguugugcccauuugacauaguuucucagccuaacgguuuguuuauuuaacugaaggccuagugggccuguuuaaggcaucuaaggacauaaaauguggguagguuaaaaagaugaaaagaucaucucuagaauagauaauaaaauauaacaagcauauuuauuagaguauuuguuuugaugcagagcuucuaaugaagacaacaggcaucagugaagucagcguuugcuuggcaaugaguagaggcacaguuuguuuucagauuaauaccaggcacucugcggggcagccuggagccaccuccuuugucuucccugguuaugcacagguacuuuggacacuauacaaucuauccaguuaacauaacguauggauccugaccuccucaagcuuaaaaacacugacaacuucuuaaauacuuacauuggcuacagaaaaauauauugaagaagaauaaauaccaguuuuaacuugccuuuuuuauauauauuaagaagcuuaguuuauucaaaacaucuguccacaagccuuuaaacuguaagaaggcaagcaauuaauuacauguuaaaauuuauaaccaauauuuucauuuuauguagguugaguacagaauuggguuuguguaccacauggguucuuuguguuacagaaagacuucugagcauauacauguacguuugugcccaugccauagaauuugagccucauuuuacuaauagggccauuauagagcuuuauaacucuccaccucuacagcccauagucagucauaauuacauagagacccagaucaagaaugcuauccagaaucgcaggauugagcuccuaguggcaaaaugugacccaugugaugacaguguaacugagaguguggcuuccaggcccgcacugggagggaacagugggugguuuggaugccauaccuuuauguuuagagugugauuauagcuucuaagacaguggaaaggcugugguuucagugauccuugcuucccagcuagcaacccuaucauuacuggucagagaucuuuuuugggauauuauacgucauuguuccuuucauucuuuuccucgcacacuucucuucccauuugcuucuuaaguucugggaggaagggaggccaaaagaaaacaaggcuaugggaggaaaaauccuuuuaaugccacaaaguagccauuuugcugacuucaagaagguucuguuugguuaggagacagacuuuuguuuaaggggaauucagaugccccggggauuuacagcuugcacaaacccccuggaaaugggaaggggcuguguggcgugucagcagggagaauguaacucuucuuugaugaauccuccagaguuaacaauccuggaauuuagggaaaggaggaggcugguggugaucccuggaccaugcuggauuuugaacuccaaauaaagaaagaugggggcacugugcuuccauggugcccccucaauuggugaucuguugaauuuccauaguauaacaggguuuggagugaaucagaauugcuguuggaauggcauuuugcauuguaauaacuaaggaauacagcucauguucaaagccuaaggaaaauauuugguagauccaagauuaaggcaaacauguguugaaugcaaauuuggauccaggaccuuggggcuucagaaaguagcaaguugaccagcaaauguuggcagguagaaaaacacacuuauaaggagaaauucagaauuuaguuguuuuuccuacuaaaacaacggaaagaaaaggaagggcugugaagggaagacaggagaauuauuguagugcagaaggagauggcagauccuggucagccaccaggacaaaggcaacaguggguuccuagugucagguccuagaggagguaaaggccucacuccuggugcuggguuugaagaagaggcuuuacugguuauuuuauaagaagaauuagugcaagagguagcaaacugcuccuaacucuuccucuaaauaaaagcuuuccaaaacgccauguuggguaucaauuuauauuagguuuuuaaaguaaaaccacuaucaauuuguuuuuaagaaggaauuguuugauaggaaagucuaauuggcuagaaaagcuggcuuguuuuauuuaauucucacaacaacuccacuugacacuuccgaauucacuuuacagaugaagaaagugaugcucaggaggugaugucagcugcccacaguaguccaggugaucagcagcagcaccaggccaccaccugcuucagcccaugggcuuucugcauggcugcucuuggauccugauaggucauuuguuugaugcuuuugcuucaccagagcgaucauuucauguuuaguuucaugacuaggaacuggcuucaaaaacaacuucuagugagucaaaaacagccaaaauggcaaggacggaaaaacuccaugggucaguagaaucauaaaggggagagugcguauaucugucugucucucauucucucccccuuccuuugcuucccuuuucccccucucucuuccucacauugccucuuuuucuuucucuucucucuguucuucccuuucuccauucuugcucuuucuuaaguccuauuaacagcuucgucuacauggcaucguuuuuacuugucagcaaucugcuugggcuuauucuuagucauugugcuugucuuucccauuggacgacagcccgaucaauccuuuuccauucugucaaaaugggacaguggcaguuuaaugacugaguccaggagugaauuggcuaauaccaaguaacagagcaacagauaaaugcacuuuagauccuuaauccuaggcaaggaaagcaaggagacucagcccuuucugcacuccagaaagaaggcccucucugggcucagucucagcagagcagcaggaagcacagcuguggggaaacccgggguauauuuaguuuggccccauuugagcugggcaagucugucacugggucucagcaaagcaucccuugcuauuugugugccauggccaguggguguccucccaagacgaagaagucuugggcucucugagacaaccuugucacugggggccucuugccucagacccugguccuuaaaccaggaugaugcuagaaggaggccaaggacaagcagagaggagugacucccaggguaauggguagcucuggacaugaauauggaugaugacagaaagcuccucacagaauugagaccugccucugcucccaggacagucaagggaaagcacccagaccaggaccccaccagcagcaucucccuccucauggggcaucgcagccccaggaccuuaggacaggcgagcuucuuucucugagucucagcucccuccacuguaaaacagacacaaucugcccaauacuuccgagauguugaggguaacacugaauuagcuaugaacaucuuuuggaauccuggagcgcugggcuuuauaaggaaucaucguuacaugaaaguucugguuugggggguuuuucucauuggaguuauuaucagguugaauuuccacaaccaaaggaguuaguuggguugggaaagucagaaaacauugauuuuuauacugcuugugugccauguauuguucuagcuguuuuauauguuacuuucuaaucaucuaaaacccugcaauauuaccaugcauuagacugaugaugcagacaucauacuucucaguauuauguugccauaaguuuggaggagagaacaccgaggcuugcuuugggaagguugcuucagaucacacagccagggccacgaguuaagaaugccaguuuccaucuguccuuucguauuuuacuuaaguccacagaagagugagcagaaacugauagaggcuagaggccagagaugagccagaauaauuuguuuggcuuuggaaugaauugcaauacacacacacacacacacacacacacacacacacacacacacacacacacauuguguugcucuuuucaccuggcuugucucuguucugcuuuaguuuuucucaguugucaaggaucuaggaugugggucagcugacaguguguuuguccuggagcggucaccaugggcaccguuggaggagacugguucccuuugaagggacgccuacguaacaucccggccuugucaucagaaggccugggcaugagcucugggucugcccacacuggccccaugauguuagccaagucacuucccguuaguuaagucucuccuggucucuacaccaguacaguggaauggugaguugggacugggucccaccuugccggucugagaacaggcucguucugaacauucacucccaaucauuuccaucuucccuucuuucuugcuguagggcuuuggggaacaaaacacaggaccgggggcaaugagugacaccgaacuaaaugucugccgaucggccgguuucccccaaguucacucacucaucuccuggagggggugcaaugaaagcuuguccucaauuuacuuugagauauaucccaugauauuuuuaagcaacgcauuuguauuccuaauaguauuugccucagguccuauaaaaaugaguccauaauccuugggugaagcccagacuccauugguucuuugacugcugauaaacccauugaguaauugagcccaaguggauagaugugagucaguucucaugcuaggcucguacaaauguucucauugauaaugaaugguuguacaaaguauuuuuaccuauuaucucuuuaaaacuacccaaaguccugugaugauaccacgacuccccguagagaccgaugaggaaguggggcuucagacggaggcagacuugccugaggccaggauccccuccacagcugcagguggaaccagugagcugccaggugggaggcagcucccaggccacccuuucaugcauacuucugagcucccaggggagggagaggcagauaggcuuuuaguccccaauggcugagacccacagggugacuuggcuuugccaaacccccaggaaacaggggcugugggaagaacccagagaaggugggguugaagaggagacugccacaggcuuaaaggggagugcgcuggaguuggugacguucccguagcaucuaggaauuugagcccaucugcaugaagcucuguaaggcuggggacucgcugagauugcagagaggcaggaacagggaaugcuauagaaagacaaaaacauuuuguccuugagccuucucagucugugcaagacaggaaauuccucaacucucccgaggcagccagcucuccugacugcugcagccuagugagagaaacgagauagaucaaugcauuuccaauccugugcccccaagcccacucccagagcuucugccaaggccccuggcggcccuccaucgaaggcugcggugcugagucagcagcaccagagagcagcaggggccugagagccccaucuuccaaggggaccgugggggguuaccugcucucacacucaggcuccaugcccuucaacugcaccugcuuugggggaaguuuuccuccagccuccuggaccuucccagccucuccccauccagguucccagaggcugggcuaggagaguucuacaguaggccugcuuucauuuucaguggcaguggauaaaaauucgguggcaacuuuggaggugacaccugcccagauacauuacauacccuggaaaccuccccauggcuccacuuccugaagaaggucuaguauuugugguccuguguugagaagaacccaaaaugccuguggcccuuuccccagaaacuuaggguuuaaguuagagauauccuaacccucccuuucucaacaguugaaccugccaaaaacaaaaacaaaaauugcuaaaauggcauuacugaaagucaagcugccuggcucacagaaccaagggagagaccagaggcugggcagccauggcuuguccugcaccaggauuguucccugugagacguggauggcagggccagccacucugcaguccccuccccuucagcuccugugaggcagggauucuaagcaugaggaaaggcuguucacccaccuccacaagaaacugaaugugagugaggcgccaggccucucacccuccuccuugacuugccgacacacucccugucucagagaaauugauuuuuucucccaguuuuuauugagguauuauugauguacaauaaacuauggagacuuaagguguucaguuugauaaguuuugacauaugcacacacaugaaaccuuugccaugauuuuuaaaagugaaauucucauuguccccaaauguuuccucaugccccuuuauaauccaaccccccguccccugccccacaccacuacugaccugcuuucugucacuggacuuugcauuuucuagaauuuuauauaaauggagucauccaacaugcacucucucuuuggcaucuuccuuuuuuuuuuugagacagaaucuugcucugucucccaggcuggagugcaguggugugaucauggcuuacugcagccucaaccucccaggcucaagugauccucccaccucagccucccaaguagcugggacuacagcuuggugucuuucauucaacauaauuauugugagauucaucccuguugcgguacccucaguaguucauucuuuuguguugcugaguaauauuccauuguguggauauaucacaauuuguuuuacucaccuguuaauggacauuugggucauuucuaguuugcagcuauugugaaugaagcugcucugaauguuuguguacaagacuuuguauggauaugugcuugcguuucucucagggacauacccaggaguagcaugacuagauccuaagggaaguauauguuuaacuuuuuaagaaacugccaaaauguuuucagaagguucuguaccaccugccauguaugagagaugcaaguuuuuccacauccuugucaagaccaauuccugggaugugaugucuuuuuauuuuuagccauucuaaugaguguagugucuuuggcuuuugugaggugcuuaaaaccuccuaggaugggaauggagcaccauauaauuaucgaaaaugacaaagaagcucuucaguucugucuuaugagagacaccaagauguauuguuaaagggaugccaagcauuuuguguaacgugcuuucauuuacuuuuuuaagaagaaaauaaaugccuguuugcuucuauauguuacacacguagaucauuucuggcaagaugaacaagaaacugaaaacucguugccucugaggagagaucacugguggcugggggauggggugggagggagacuugccauacucuuugguaccuuuugaauuuugugccaugugaguguaucauuuaucugaaaaauaaauaaaauauuuuuuaaaacucacaaacuuauaagaacucauuguucauuccuggcuaucaggcaagaacaucgucauugccaagcagagaaaugggaggcaucuuguuccuaaugaucucuagaaacuccaaacacucuuuaucuguuagcugccaguuucuggugggaacugagcaucaacacagucauguaccaaguggucauuuagucuguguuuguugaaugaaugcaugaauguucaccccacguucuguuuucuaccacacagaaaagaagaguagcaggaagagugaguaccuucugccuguggcucccagcaagcccacugcacccaucuuccugcagggccucucugaucucaaagucauggauggaagccaggucacuaugacuguccaagugucaggucugucucugcagcucucucuuggggauuaacaugaaaauggucuugguugcaauggguauugcucuccgaggacccgcucagauccuugauccaccagaaaaucagaugggaccaucaggugauggacccaaagaaauggagacucuuguccucucuuuucugccuucucuggguaggauuuucuggauucaugauuaaaugguccagaggaagaagauggccauagagcuagagcagugaaagauuaauuugaaaauauaguguggccaguguagcuggaagguuuugaagacugguacaaaaccagauuaugggccgggcacgguggcucacgccuguaaucccagcacuuugugaggccgaggcagcagaucacaaggucaggagaucgagaccauccuggcuaacacggugaaacccugucucuacuaaaaaauacaaaaaauuagcugggugugguggccggugccuguagucccagcuacucgggaggcugaggcaggagaauggcgugaaccugggagguggagcuugcagugagccgagaucgcaccacugcacugcagccugggcgacagagcaaagacucugucucaaaaaaaaaaaaaaaaaaaaaaauuaugugagaacuucccaaaucucagaagauguucucaguugcacuauucaaauuuuaagguccucccaacaaacccaugagguagauccuguuugaauuccuauuuuacugauggggaagugaaagcauagagaguuguuggaguguuucauccaauaucacugcauucagcgcagaguugcugcauggccggggaggaccucccuaaccaaucccccuuccccuccuccugguucagggaauccacccccugaagucaucuggcugcacaaugggaaugagauccaagagucagaggacuuccacuuugaacagagaggaacucagcacagccuuuguauccaggaaguguucccggaggacacgggcacguacaccugcgaggccuggaacagcgcuggagagguccgcacccaggccgugcucacgguacaaggugaggcugacccacucagagcgagugggaaggagaugcugcugcagccccuccaaaagugauuuggaggcaaggaaaccacaugaggcuacuuuguucccacugagggcccucucgucccucagucccaccccagccccagaggccagcucccuguccaacaucacaagcucugacugaguggggcugccuuucccagcuuucugaagucccugcccucucuggguuacuggugccaaggugcauagaguacuaagagggaaaucuguaauacacuuaacaauuuggcagcgauagauuuugaggugaguuauaggcuuaacaggguccuugccauuagauaacauauuuaagaggagaggcaaguuaagcacacauaaagugagugacaacucuuaaucacacgcauuggauacagaucauuagcaccuggcucggugccccgugccuucugggcuaccuccccuuacauuggauauacagucauguuaauauuauccucugagaauguauccgagauggaugugcaaugagaagggugugcugcauuuguguauccaaucacagugauuucuggacaaucuguuacuugggugacaugcuaucuucccauccuucaccuccauggagaauugaguggacacugccugcugagggacaucccuguuuagcucugcccuuugccaauuuccagagccucacgauggcacccagcccugguucaucaguaagccucgcucagugacagccucccugggccagaguguccucaucuccugcgccauagcuggugaccccuuuccuaccgugcacuggcucagagauggcaaagcccucugcaaagacacuggccacuucgaggugcuucagaaugaggacguguucacccugguucuaaagaaggugcagcccuggcaugccggccaguaugagauccugcucaagugagucugcauguccagccagccucccuuaacccuucccuccaaauuccuagcuccccuaaccugggucugggcagccagaagaagcacaaacugauguggggcuuggacuuccagguaaagcaagugcgggcucagugcugcucacaagcuuuugcuucuuccacuucaguauagcaaauguucauuagaacuuucccuuuugagcucaguuccccagaauccugucuuguuacauccuuguucccccauuaugugguguauggugaguaugaaggaaggaggaauggaucaaaguuggaaaagcagggggauagggggaaugcauuuguuaucuguugcuguguaacaaauuacccugaaacuuagcagcuugaaacauuuaucaucucccagcugggaauuuggaagcagcuuagcuggaugauuuugaaguuucagucaagaugucagcaggggcugcaguuucugaaggccugacggacacuggaggaucugcuuccaaggcucacucccgugacuguggcaggaggccucagcuccucacugguuguaggugggaggccucggcuccucacuggcuguuggugggaggacucagcuccuugcguuguggaccucuccguggggcugcuugagugucuuuuuuagcauggcagcuggcuuccccagagcuagugaucgaagagggagcccaggucagagcuugcagugucuuuuaagaccuacccuuggaagccacacgccaucacuuccgacuuuguuagaagugagucacuaaguacagcccguacucaaggggagguaaauucaguuccaccucuuggagagaagaauuugcagacauuuuaaaacuaccacagggaggcuaccuuuccccauuacuuuuuucucuccuuuucaagggcuugcuagguuacaugggaaggucagcuccaugaggcacacugcuacauuuccaugaggcacacugcuacauuuccaugaggcacacugcuacauuuccaugaggcacacugcuacauuuccaggccuggaacaguggagagcccauagucgacauuggguagcuauuuauuagaugaaugugauucagaaaugcucuuuuaccuugaaaaugcccugucucuuaaaauccuaugccagcccuggauugauggagacagaaugccuucuguggguccugggguugguguaagcaucgaagaagagcauuuguuugcaccuaaccuacaaauaggaggucgugccacauccugaggaugguuagaccuguccuggcccgggugccugaccacuuugcaaggggcuuucucgccuguacuuuaucaucuccccaugcugagcccaucauguucacagcucugagcuacaaauaagcucuagagcuaaaugccaaggcuacugcaaaacccaauauguaccccauccccuuagguccuuugugaccaugugcuuuauaccugaaucaguuaucuuuugcugcauaacgaaccaccccaauacuuaauaacuauuaaaaauagcucguuuauuuuuaaagcaguuucauuauuucuuaggagucuuugggucuccuauaaaguucugcugauuuaggcaaggcuaaucucagcugagcucaaugacaugucuguuguggucaagugaugggaugcuugugagcugcuggucccccuacuauuauuagcgguacacucagaaugcaucaacugccuuugcauuaugcuugaacuaguuauuaccaggaaggccacucugccuccaaaauggggagaagguacacgcuuacccccuaggucaguacaaagaauggaaaccgaugauguguaaaaauaccugcugaugaucucgucaguauagaaggaguagcacuuugagauaauacuuacauuacucaagccagacauccuagaggagaugagcuuguuuggggauuuugauggaaaaggaaggcugaaucuuggcaaaugugauaaggcuuagcuguugaguaggccgagcaagaaaggguggggugggggcagagccaagcaaagggcugugggaaguuugccaggccagagaggaggcgugcaccaggaggucggcaggcagacugucuggggccagcuggggacagucauaaaauuuagacugucccagcaggaaggggcuucagaaguuauccagccucaucgucauuuaauaacgggggacacugaggucucagggucguggacuugcuuguggccauccaaaggcaaguaacagagcccaaguucaagcccucaucuuuugacuuaaaucagaugcucuuccauuccuuauggcucugcuuggggaguuucucccaagugcacagggaacuggaaggaccugggaaaccacacuggagccuccagccugcagccuuugccucuuuuucuuccccaaaguccagccucuucauuccuuucggaggccacugcccuggccuuggcuuuuuccccaccugagaagaagcaagucaguggagaguuuccugaggguacguggcaggccugccagagaccucacuccuccagcaaccuagacguagagcagggugccuuucgaggggaaugacuggauggcugggaggaagccggggguccggugugcaggggguagaggggugggcagauccugccugucccugcuaggauugugaggcagguauggguggguaguuucugccucucuucccuuccuagcucuugucuacuguaccaaaaggggaaaugacaaaaagucagcucaaaauuccagcuggaauacuugaaacacuugacacuugccaggaaauuaguucuuuuuuauuuauuuuuuauuuuuugacagaaucucacucugucgcccaggcuggagugcaguggcacgaucuuggcucacugcaagcuccaccucccggguucacgccauucuccugccucagccuccugaguagcugggacuacaggugccuaccaccacgcccggcuaauuuuuuuuuuuuuuuuuuuuuuuguauuuuuaguagagacgggguuucacuguguuagccaggauggucucaaucuccugaccucaugauucgcccaccucagccucccaaagugcugggauuacaggugugagccaccaugcccggccgaaauuaguucuuuaaaguaauuuuuccauauagaacccauccaagagguagaugauucagggugggacaggauccaaggcuuuguaaccagaguggaacucuuauucagagcuuaguaagccaaggcaaaaggacucuuugugaaagguucaguuuauaggaugauagccccauaugcucuguggcagcuccugggauggggccucaucuucagccccggcccugauuuuguaacugguuaugugcagaugucaaagauggccccaagacccuguuccagcagcuuaggugaucugacaugugggucccaggcaggaggccacuaugaacuuuauaggcugcaaaugaacccaugguuugcuuuaaaggcccagcagagauuuaaggguauggcuguaggaauaguuacugcuauugcccugccaccaggugauccacuuaaugcgucagccuuuguaucccaaguccuccaccuuucucugaccccuuagacugcugggggccacaggguaaggccuggggcuggauuggacaggagcccuugagaggcuugucugagucugugcuccccaccuugagcacaggucauggaaagugacagaagcccuuaccugcuucccccauggggagaaucggcuuacuccagcuugcggcacagggcuguccaccaccaaagccucagaggaguccagcugggguaaagccgccaucugggcagugucugcuccugauguuugcaucugggcuguguucuacuggugacaggaggaaacucugcugaggagaugcugaaagggcugccaggcaaacacagcccuugggcaucucaucuuccugcuccaugucaacccaggcaccacaaggcugugcuuaaagguaggaaaagaguggccugacacuggccagcagccuggcagaagcagggugaccucacacaguuauucuacaagcucacccaaaguccauaagccuuuuuaaguguugagaacucggggcacacugaggaccucuucguucucccagggccuggcacccaugagguuucuaauugcuguuuguugagcaaaggaacaaccugaacucaaaauucuccagacuugagacucccugcaccuugaaucugugcccucugacagucugagcauugaggaggguggcugggaggggacaggcuaugggauacauggccagggaggagagaggagugaaagagcuaaggcagucaggaaggcaccugcaccagcacagccugggacagcacgagggcacuggagagaaggacaaaggagaggagcccagcaggcgggaggagggcuggaggacagcaacgauuggcuucuccuugcuucaaaugggugccagcacccaagggugagcagcgccccagagccccugagaauccugggccaggccaugggcuaccagugucuguccacugggagggaggccaggcagagugagguggagacccacacacgccagcagaauacacaagaacgcaugcucagaugccuguccagguggauguaacucauaugugcacauauucccaaacacagaccuccaggugcaggugccugccagcuagaccaguauauguguacaucauguguaugguugauaacuacauaugugcaugaacacacacaugucccagaccagauuuguacugauaagcacaguaggguagagugcaaaggucauagggucacaggucccaaccccucccuccacuagcaagcucuguguguuuaggcaaauuacuuaaccuugaccuucaguauuauauuuuuuaauagagguaaggucuugcuauguugcccaagcuggugucaaacgugcgagcucaagcaauccucccacuucagccucccaaagugcugggauuacaggcaugaaccacugcgccuggacuacuuuaccuuuauaagccucauauuucuuaccuuauaaaaacaguggugacucuaaucucacagagcuguucuaagauuaaaugagauggcucauguaaagaaucugucacagagcuuggcacaucugcuauugggucugagugcuagugagacggccacauccaggggcaugagugggagcacuguugucagagacccugagggucccaccccagagcccccuuuccuuaucuuuaaauugggcauggcaguacucuauaccucucuggcaugcuguggauaucaagaaagaacugcgugugggugucaugaaagcuggagggugcuguaugaaaugcaguuguuacaaccaucacuagucaccucuggcucgcagaccugcccccaccccuuccccuagccugagcagaaccuucuugucuggucagagcucagaaaugccagcagguggcagccuuaugggguuggagggacaaucugcugcaaauccacugcacuguagccagacaggguacagccccuccccugagcagagggccugagccucugugcaccagcaggagacugaccagguuuauggacaugaagaauccagagcccuccccaccugaaggaagaagagaaagggccacucauguaggaaaacacuuguuggguuuuuaacacaaaaaguucugaucugagagcauuaucaaugaguggggguuaagggugcuuccauucccgagcaagagagggaaaggaacuacuucuguguuaagggaucauggagucagagucaaggucacugggcaggcccaccaccagggccuaucugucuagaccaaccugcuacaucacaguucccagcaggguuagccuuucuccuuccccuuuuauugguugagugagugagugauugauugaaugauuauauuauauacuuacagaaaaguguuccuauuucuggaugccugccuuagcuguuguccagacauucuuuuuuucuucuucuuuuuaaauaagagcugagaaaauaaagggugaccacacagugagaggguccugcccuaaaucuaaggcuggggugaaugucucagucaagccggcgacuuccaucuuccccgcuggccagcagccugugaucaaguccacacugaacaggcccuuugcccagagggccucuugaucuuuauugaucuuuggaauucuucaggaaccggguuggcgaaugcaguugccaggugucacugaugcuacagaacagcucugccagagcccuuccacggugagugcccccaggagcugccccuccaggccaugcccccauccccaccuuccuccuggccccggcagcuccagcccagcagcccuagauuguuuguguccugcagcugaggcugccaaagccagaagggagagccuggaaggggaaugagggagggagagcaggggaaggagggggugauuuuuuuuuuuuuuuuuuuugcacacacccuuauaaggcuacugaagucauuaccgauguaauaaaccaacuaagcaagcgagcgccucucaccaauguucccaucuauaaacacagccuggccggccucccccauccccucccgcuccccucuacccucccacccucagggauuugcucuccccugaaguuucuuucuuacccagccccuuuuccuccugcuacuuuccuuuuucccuacacugguugcagggggagggagccugccagcugcgaggaccucugugguggaggaguuggugcugaugguggugguagugaccgcuaugggucccugaggccuggcuggccagcaagagggcaggguuggcuagaggaggaagacggcgaggacgugcgaggggugcugaagaggcgcguggagacgaggcagcacacugaggaggcgauccgccagcaggagguggagcagcuggacuuccgagaccuccuggggaagaaggugaguacaaagacccuaucggaagacgaccugaaggagaucccagccgagcagauggauuuccgugccaaccugcagcggcaagugaagccaaagacugugucugaggaagagaggaaggugcacagcccccagcaggucgauuuucgcucuguccuggccaagaaggggacuuccaagacccccgugccugagaaggugccaccgccaaaaccugccaccccggauuuucgcucagugcuggguggcaagaagaaauuaccagcagagaauggcagcagcagugccgagacccugaaugccaaggcaguggagaguuccaagccccugagcaaugcacagccuucagggcccuugaaacccgugggcaacgccaagccugcugagacccugaagccaaugggcaacgccaagccugccgagacccugaagcccaugggcaaugccaagccugaugagaaccugaaauccgcuagcaaagaagaacucaagaaagacguuaagaaugaugugaacugcaagagaggccaugcagggaccacagauaaugaaaagagaucagagagccaggggacagccccagccuucaagcagaagcugcaagauguucauguggcagagggcaagaagcugcugcuccagugccaggugucuucugaccccccagccaccaucaucuggacgcugaacggaaagacccucaagaccaccaaguucaucauccucucccaggaagguaaaugagcauggggguuggggaagaaggggccucuguaccagggccacuccuagcucauggagcguuggucucgcugaccccuguuagcagcccauagguaggcugcuaaccugguuuagcagguaggagggccugcuggguaggagggccgcgucccuguuuccugcuaacucaaggauaggucccggcucaggggccuuggguacaugcaccaaggcuggggcuaagggcugggauccugguccuuguggcacaugcccacaucucggcacccaucuggcagagcccucucauggcaccgccaccuguggcuccccagaggagaccugagccugaguuaauuccaagcuccggcauggagagggcucugucuacaggcuuggaggugggggacacagaggcuggagccagggagaagcucugaguaaagagcuguuuagagaagcaucuuagguuuggggaacggugugcagugaccagauggcacggagcucugaguuggggucaacaauaacuucagucuugauagcacuguggguuugaagggaucugucgggaaacccaaaaucccaaaacagccccuacagcacacacucacgggcagacagagcuacucgcuuccuaauuuggaugagacuuuuguuugcugguauuucacauucuuggaugguggggagaggaggggggccccaaauccuuccaucuguguggacuuuuggggucuggaguuuucagaggagccaguuuauacuuggagaagagaugggggugacacaggaguauuuucucuggacccucaauuugguuugaagugcuuuuguaaaucccaagucugggugggagcucugaggccggccgaccuccacaccccauucuggcagccagcggagggauagguugccagcacagaacagaguccugccugagcugaugcugguggcuccagacaggguaggguacaaagaagcucccaggaagugacauuucacccuugaggggcagagggcagccacagaagaagccggaguggacagguccugucaaaucugagucagcugaggugucagagugcucuuccugugggcugcuccccucccuggccccuggcagcacccuccccacucccucccucaccuuuuaucgugccugccuuccccucacaagcagaauggagcauuugaagaucacagaaucccucucagcccccgguaagggucugucuucccucuacaucugggacagcacaccuggagcagcugaguauauugaaucucagcgcugaaagagugaaggggacacuggcuggcagagagaaacauguuauuuucugcuaauguguugacgcaguaacuuuuccauguggauguccucagauuggcaggguccuccagaagucgucuccuccaucccccaccucugcuggcucagccccccuccccugaggcaugggggauuauugggcuggggugagacuucagaggagcagacgccacaaccuguccugccgccccuguggggcucucccacuuggaaaguccuugguaaaacugauuggaaacccugacugggaacauuucccaggucacccuacggugaucucuccaggcaggaugcaggguggcauccaccauccucaggacaagguuggggcuguccccuggcucucugaucucuuuucauuaucuguggucccugcauggccucucuugcaguucgcaucauucuuaauaucuuucuugaguucuucuuugcuaguggauuucagguucucaucaggcuuggcgcugcccaugggcuucagggucucagcagguuuggcguugggaggucuguggcugcuccagccucagggaaacugagguuaagucaguugggggcagcuguucuugggcuugcaugggguuuaaacccagagccaucaacagccacuuacaaacaauucacucaacuaagcgauguaaggcagaccccaggccuggucucagaaacucuucugagccauuagccacugucuucucgugcccugagugccugcaguauguuuucccugcuggucccuuagugguaaagagccuagagauccuagccacuccagccucccuucccauggaaaccgucccagagggaacaguucagauccagagcagcagcagaagaaaugauccaaggaaggcugcacacgaaggggagagagagaccaggagagguggaaagggauuccagagagagccccaaaucaaacuguaagacaucuucuaaauauuuuuaaauuguguuuaaagaauagcugacauauguugaacacuauguguuagacacuaucuuaggccucuuacacuuuucacccauuuaauccucccaacaaugacuguacuguccaccuaacagagaaguuaaguaccuugccaaaugcaaggugcuggggguaacagagcugggauuugaacucagguggcugaguucccgugccuagaccaccgugcuauaugaccucuuaguuaauuccuauuauuuuaucaggguacugguggcagcugagaauuugucuaucaacagaaaacacuaaugacuauuuacuccucgauuuuguuaagaguuguccaaagguugaaacacugauggugccccuagccuugccagguuucugguauuuucccugcagugguggaagcagaccuugcaaugggccugucuugcuucaguacaggagagugcguugucucaaaaaaucggccccaccuucugucccuucacucgccaagacuucaagagcccaguguuuuguuaaggaaaaaacuuaucuuaaggcuucaucuaucagucaccauuuaagcaggucccuccucaggcaguagggcauucugagagguggagggagucuuuucucaauagauguggaaggagaagacacacucacagugauaaaauuguuacagccaagugcugacaagugcuaugagugugucgggaggagcugcuggaagugggaagagagggagcugagugcuggacuuugaucuaagccccgaagacaggccagaggggacgggcuuccaggcgggggccccgcagcagcagaggcguccugcuaacagcuuguucugggcuggagaggaugacauggccccaguuucauccuauauucugccaaggaauuccagucuaaaggcaguagggaaucaugcaagauuuugggaugaagaacacuguacaugaagcucaguuuagggguuuugguggacucugugcccaaaagacaaauacagagccuacugaagaggucgagaggaagauggugaggccuagacuagcguaguagccacaaccacagucagggaaugaccaguucaagaagcaaggauagaaguaauggcaccuguugccuggcuuggaagggcaggauggggguggggguagguaaagaagaugaaggaauggaagaccacuaagugugggugccugaguggcuggggucucaguggucgugucagugggaauaaggaagccggugguuggaggaggcuucuaggggaaggugagggaauggcuccgcuggccucccguccugcauccuucacacucagcucagcacuggcccugcccccggcuuccugacuuggagcccuuuuugcuccacugcacugauccccacccugucagcucugcuacaaacaagauucacuuccuccaggaugccuuccuguugucacccaccuuuggccacgagagacucuugcacuguccccuccccaucaaccuguguaucugcgugcaccaacugcuaguggacgugcuguuuauagguuucaggggacuucucugaugucuguagcuuagauagggcucauagcccacagacccccacccaaacaggauuacaucaccccauuuaguucacccccuuucgugcugaggaaagcagaagagguuugacagccaugggcuagaguucaccacuaguugauuuguggcaggacacagacacguggagguguccuuccucuuccuguaccccuagagcugcagggcugaugggauucagaguuaccaccaacugggccugcccucugcccccaagucuuuuccuagcccuuccgggaccugccucugcugagggguggugggaggccgauggucccgugagcugaggggagcucugugguggccugagaagagcuuuaucuuuaugcuuuguuuccugucuccaggccaggcuccuccuccuggcaaaacacuuuuccgagucuaacaaugaggauucauuuuuguugcuguugugaauagguaauucauuuuuaauugccuucaggguagaauuuugcaaaggcuuuuuaaaaacccauguaaguucauccuacgaaaaauggauuuaugcagcaucuacuaugagcaaggcauuauucuaaugcccuuuguugugugcauaauccacucaaagaacucugaauuuucuuuuuucagaaacuauauauuaucuuuuucaauaguaaguuauauuuaacuguuugugaccuuuucuuacauagauccuaccagaucaccugcuacagaaauaugccuucauccuucucagaaugacaaauauguuuuacugugacugcauuccaggcuuaggaaaaacagugguguuagacagggucacugcccucugagagcuggugugggagacaggcaugcaggucagcaauggccuugugagccgugcuuugacaugggugagcucagaguugggagcacagaagagguccgccuaggccugggggauuagggggaacaaggaggacaccaugccugcaggggugaccuggagaugagucuuacugucugggcuugccaggugggcuggguaggcugacugaggcagcccuauagcagagccuccaggaagcucccucccuccauccacauccccuuccuccccucugcccccaacucagaaaaggagagagcugggggagcuucagacccaggagcgcuuacuccaccacagcccugaggggcucucccaggcggagcucugcagugaugcugaccucucccaucccccucaucucccucucagaauuccccaccaggcugaggcuucucaaaaaaaaaccucugggaaacagcuuuucuucuagaggucaagaaugaacugucccacaggaaauaccagauucuucaucugggguagccaagccugcaagccugcuaggggggccuccccaagcccaugcacauggccagggguccaggcucugggcagguuggaaaagcugccugccccaugccuugcccugggagaggaggcaggggccggguccacaugccccucuacucucuguguacugucuuugcagcuuguaucauuuugacuuaagacucaaggcagcugagggacugaaacugaaagaaaaucaaggauuugaacaggaugugcguugggggugggauaucuguucccaaagccuuagccccacccugacuugagggaaaauuuccagaugggauuggucucugcuaagccucugagccccucuaguuggggccagaggucaucuuggcauccucccgcccacccagaugaauggaaaguucucucuccaggacaugguuauccucauuccccacuccugugccucacgauucuuacucuuaugacagacuuccuaaaauuccagccuaaauccucuccauuacaguuucuacaaauucugacuccuaacuacaaagggaagagaacagagugaagccuucccgagguuuggggucuguauaaggguauaggaaguggggaguggggugcagaucagcccucuugccccaggugguuuauaggaugaagguuucucuguuuaaaacaguacccugguggcaaggaguaaaggggaauauuacacccuuccuuccucuuccagccuuagugagguuuucugggcagaacugauauccuuacucuuucuaaucuccuuguauuugcuggucaaggcugugcauuuguguaauggggggcagggacaguaguugguguccacucagaaugcacccagcucuucccucccaaugccaguggcuugugggacaugagaugggagcuccaggcagcaaagugcauguggcccuggcucuguccuccugugugacgguugcuucccugacaacaggggcagcuuugagcaggaugcccugcuauuuacuuguuugugcaucugaaagcaagaauaaggaacugcugcccuucugccuggcccagcaggccucuuuccacacccugagggaaccuccccaagggguggcccagaggagaaguaaccaguucugggaugagagagcuggcaggggccaggacgagacccuagauuccugugugugccuagcugacaccuccuuccccaaaccaggccagaagauggugcugggagugaaggcaggcccaggggagaguccauggagaagaaaggccauccccacuucucucuggggcaaccagaagacccaacuccgaagggaggcagccccagagggccccucugcagguccagucccccucauuggccgugguucuccagcucagacaccuuuccuaaaaagucagcuccuggguguagucaccaccucccaacagaucuucccacaggccggugccccuccuggacaagggcuccuagccuccuccacccacuucuuugcucaaagcuucaaagcucccuuuuccagaaugcagucacagcaucacugcuguaaacaaagugggaccuccucaccugucacuguuccuaacacaggucuguaacccugugucggacuccuuuucucucuuggugacguccagggggcagggccugugugcaucuccuuguauuguauuggauggucuccaaaggcagaggcuauuucucucccuucuuuugcagcuuucuauuauguccccacaagaggacucuuuggagugggggaggagguaucaggaaggaacguauuuagggaucaguuauuuuggacauggguuauaagcagaaaguucccuggcuuuggugaggagugggggauugguucccacaaggccucuggcuucugggcucccagaggcugcccgugcgaguaacacucaccugcugcgcuccagaugccagggcagguacuacgaccacaccugguucacuccacaauucuuccuccccaggcucacucugcuccgucuccaucgagaaggcacugccugaggacagaggcuuauacaaguguguagccaagaaugacgcuggccaggcggagugcuccugccaagucaccguggaugguaggucgugcccacccaucgccgccacccauacacaggggucccauuucucagccccucccuuccuuaccauaccuugccugucagacagaacugccuccaacacugcccucccuacccaaaggcauucauuuuggaugaaugaauaucuuuugccaaaagaaaaagagacaggaaggaaaguggcagcucuacuugaucaccuacauggcuucaccccuccccuggcuguccugucccccucccaguccugauccccacacccagaaccuucugagcugggaagcuggggcacugggcaguagaaaagacacacccacaggaaaaugacuacagaguauuuuacaaaagccacaacaaacaaguguccgagcuggcaggacgacccagcagggucagccgugaggaggagggagcagagcgagguccgugugggagacuuccuagaggaggugagucggggcugagucucuggacagagaggacagggcagccucugccaaaacaaaaugguaguaguaauaauaauacugcagagggaggugggaggacacaucggggagaaagcaggccugccaggucuuagcggaguuucuguguuaggaagaggcagugccaagcugcgaggaacugggcuuuguccuaaggaaaugcaggaagugcauucaugacucuuuuuucucuccuuccuggggaguauagaauuggaaccugagaaguaggaugaaccucgugaugauuuagaugaacacccucauuuuacagauaagaaacugagggcauccagagaggaaaugcauuuuggaggggggcucucuggcccauuuagggccaagcuggggccagaaccccaucccaggacucacaacccaggaucauuucuuuguauuuggcacuuaccuggaaaugucucaaaagguaguuuuggggaaauaguuucuugcccuugaaaugucugguuaauaaccaucagagacacaucaaaaacuaguguccaaauaaggcaucuugaagcccagcuugguuguucuucucccuccugugugugaucaguugaguucugaaguccuagcccgucucacugccauuccacaccauguagagcccguguccucauucuggacuuuacaauugguuuccugaucacagagcugagcucuauggaacaugaugaaugggagagagguggaaaagaaagucuuuuuuauaaaaacacaauggcagcacgaauuaauuguuaauagccgaaagguaagcugaacucaucuaauacuguguacuucuccuuggagaucgugcguauaugugcuauaggggcucugagucuaaggaagcggacuugauguguccaaguuuaugcucaauucagagggggcaugggacacauuuugagguucugcacaguggaugcuguggcugaugacuccugugugggagucucuccucacccaggcugucacccacccagaucacaguccugcuucuuucuauacaggugcugcacuguaaaguauagcguuucugaaaacaugauccuugaagcccacgucuaacaccccucugcucguuugggacucacacugguucccgagcuagugaaggagguuaucggcuuucggagccucuuuagguccuguuuacauggcuagcugaaggcaggagagcaauucauucucccuaucuguaaaaugucagcaccuuuucuagauuuguuuucaagaugaaauuuccuuuuccccuacugaauacacuuggggauuuuuuuuuuaagguuuggggaauucauucugcaacuuaaaaggcuuuguuugcccagagucugcuggcagauucccuuguccucuccacuaaucuugaugaccaucauuauuuaucccuaauuccuucaaaugcagaguuaggccuccagcugcaaauugggagcugggucuuggaagaagagcuagaaaagugauaggagggagcccagcugagauaacaggacugacucucaguccauuggguuugguuuuguugacagaaaggauaaggguggccucuucccccugcuuuucuuucccuguugcuauacuuacagauauauuagcauccuguuugcccacauuuagcuuuauuuuuucaucaagagccucucuaggaaaguaguaaaggacuguugucacuuugacagcuccccugucgccuuucuaucgucuggugcuccaccccacuggcuaggcuacaucuccugcccucauucuguccccucauccccucagcucucccuacuccccaaggcaucauacuugacuuggggaucccaguggguuugugccuccccugaaauuacaggcaaaauguugcauuauguggguuggagcaucuuucugaagagagggguccauaguuuuuagucaaauucucaaaaggagucaugaaucagaauacguugaagaacuacuugccguaagcagcaacaaugacugaauuuucaagcccagccauugugugggcucuuccagccugucuccagcugcaacugcccacccaaccucugcauagaaccaggccuucaucccucuuauggggcaaugagguccaucuccacuaggcgaugggacuacagcuggugcugacuucagacuggcuuccccagccacucagcagggcuggccuggccccugaaagucgcuaucauucacucauccugugccaaacaccaucgagaccauacaucugaggccaacauaucuuucaaaaucucauaaaaaugaggcaaauggggcuaaaauagcauuacccacacuacugauucccucauaucauaaagauaagggauguaaccuuuauaacacagcacagcuggcuauuuuaaucauguguuugggucuuuuuccuaagaaaagggguguuuaugaacuugcuugauuauggucauaucacccuuccuucugaacucagcagaagacaaggguuaacuugugccacauagaagggagcuaaaaccuagaguaaacguggacuugcccgaaaacucacccaggaggagaacaagcugaccuucaaugccuguccuggccagagacucuugugcacuuugcauuuucagucuaugcaacaguugggcagggugucuuucucagugagcaaacugaggcucaccaagggucagcugccuuccaggccccacagacaguagguguagaucugguguuggggcuccacccugcacagugaauuacaacaugaaauauccuggcaggacucaguggucuggcucugaaaccuguuccuuuccacagccugacacagccuccccgggcagugaauuaccaugguggggcccgcucccagagugauccagaccucccugaguaacaguccucccuguggggagguccuucugcacgugggacucaguaaccccuuuccucucauuccaacccagaugagcagugaggaaacuaaguccuuccuaggccagaaucccaugagaggacucaaaaaacaccuuagccccucacuggcucauccagucauucucaacucaggccuccuguccccagccacccuggccagggcauccagcuuuugguaccagugagaccagggcuuugugaccacagagggucaugcaugauugugaugggaagggacacuccaguggguacucaugccaucacucagucauucaacuaauaucugagugcccacucugugccaggcacugccauaggagcugguuuuaaaacaguaaaugaaguaggaaaaguuccagcuuuugggacuuuucuagugggaaagaggcaguaaugcaggugaacagcugugucauauccucagguaaugucaccagcuaugaagaaagcaaagcaggguaaugggggagagaauaccauuuuuggaggggguggucacugaggccccucugaggaaggaacauuugaacagagacugaaggaagcagggaaggaagagggacaaggugacaacaagagcauagcccugagcugaggacacugugcuuaaggcguuucaggaggcaggaggccagggugguggagccaugagcaaggggcaggaugguaggaagugagguugaggaggaccguggaccagauccaggcaguguuggcuaggacaaaaaaaaugagauuuuauucuaaguguuaugggccaacacuggacauuuaugaaggaucacucauguccaugugaugaccagacccaggaugagucagagggaaagcagggagcacaaugggggguugccacaauagggacaggaagugaucagauucauaaccucuuuggcuguagagcugauaugaguugcuggugagcuggguauggagagagagagaaguuaaagaugacucaguuuucaugggggagugaagaccaaugguggggcuggggggcacgaucaagaguuuagugcaugugaaguuuaagauugcuauuugaccucucaagcgguccugucacauaggcagguguuuaggugaaccuggaguugagggggaggucagaguuggaggugggauacagggagccauccacacacagaggccauucacugcccugggguugaaugaggucccuggagaguacagagguggcuauaagaagagggagagagagagaggcaggggcaggacaggggccugcgaagaagacuaagaaggaaguacuccagugagaugggaagaaacccaggagaugggggugucccagaaaccaaaugcuaagaacuucaaaaaggaaggaaugaucaagauuagugugccaggccaggugugguggcucacaccuguaauaccaacacuuugagaagcaggugaauugcuugagccaggaguucaauaucagccugggcuacauggugaaacccugucucuacaaaaaauacaaaaguugccuggaugcuguggggcaugccuguagucccagcuacucaggaggaugagccaggaggacagcuugagcaugggagguugaggcuacagugagccaagauuguaccacgguacuccagccugugggacagagggagacccugucaaaaaaaaagaagaaaggaagaaaaggaagaaagggaaggaaggaaggagggaaggaaggaaaggaaggaaggaaugaagguaggaaggaaggaaggaaggaagaaaggaaggaaggaagggucaggugcugcugccaaauaaagaugagccugagcacuggcuauuggguuugccaacauugaggucauuggugaccuugcaagagggcuucaggggagugauaguaacaauagccucaucucaggcaaacagagacugagucaccugcucaaggucacccuaacuagcagagugggaaguuaaacccaagccuuggugccuaaccacugugauccacuguuaucuuggccccugggcacuucugauuauugcugagcugauuuugauccaccccuccuuucuuggccucagcccugccauauuacuaagucugcucccacccccacauuuauuuauuuauuuauuuugagacagaguuucacucuuuuugcccaggcuggagugcaguggcaugaucucggcucacugcaaccucugucuccuggauucaagccauucugcugccucagccucccaaguagcugagguuacaggcacccgccaacacgcccagcuaauuuuuguauuuuuaguagagaagggguuucaccauguuggccagucuggucucaaacuccugaccucaggugauccacccgccucagccucccaaagugcugggauuacaggcgugagcuaccgcgccuggcccacauuuauucuuuaaaucaucacagacaacuaacggguauuaugugaaacuaaauaaaauugcuguuuuuguaggucaaaaacacuucaauacuggcgaaugguguaguucaaccugaucugagcauacaaaguacuuagcaccgugcauacauggagucaauacccaguaaaugucagccaucaccuuacgacuuggccacaccucccucacucuucuauugaggugauguuauuucgguuuuccuugugaggaagcucagacucagaaaaguucaggaacuugcccagggacucacaacuccuaagcagcagagccagaaagcgcaagcauccugaucucucuuccuuacuacgcuagcacacugcuugcacucagucagagagagaggccagcaaggagggaugagccaacccagggagaggcuggagcccagccccucugcccugccccacugggggccccuagaagcuggaccccucccagaagcuucccaagaccucaugcccccugcguggggucagaguucagggaaccagccucuugggggagauuaaaaaaaaaaaaacgcugcccagagagcuugaguccagagcccaggagugggaggggugaggcauugucuauauaaggacacauuuuccucucaauguagaggccccccacuuccucacaccuccaucuuccucccccacacuucuuuggggacacaagcaaaggacuucagccuugggggccuagaucuagaaauggaguuuaauuucaucacaaaaugauuaaaauagaaaauacaagcugcucuuaaacuuauauuacuauuauuuuuauccccugggcagccaugugagcacaaagcugguuuugauuaggcacauggcccuucgagcccacuccuugcugcaguucgcauggaggucugcuggcuccgcaucccuggcagggccccguggugcaugcacagccccaccgugcugacacuucaaguggagcgcggccacccccuggggcuccgagucuggggugugccuaguuugaaagggggacuucagccccuuuccucauggccagauggaaagauaaagugcugcagaaacuucuaaaaauaagacucaaagcacauuacaggguaguguacugacacguccagugaaaacccagcacccuagggccgaggacggaggcagaggcagauggggcagggcagggaguguuuucugaagguggaaaauuuuaaagcugauucagaaggagguaagggaauguggcuaucaagaggaauuaauucauaagugaucauuuucauuuucuuuuuuuuuuuuuuuuuuucauuuuuuggagacagggucucacucugucauccaugcuggaguuaaguggcaugaucacugcagcggcacgaucauugcagccucaagcucugugggcucaggugauccucccaccucagccuccaaagcagcugggacuacaagcacaugccacagugccuggcuaauuuuuguaaauuuuguagagacgggguuucaccauguugcccacgcuggucuugaacuucuggguccaagugauccaacugccuuggccucccaaaguccugggauuacaggcgugagccaccacgcugggcugauaaaugaucauuuccugcuuuccaaaacaccguugcauguguucucuccuuugggcgucaaaacaccaugagguagagaaaauaagugauucccuuguacagauguggaaacagagaugggacaguuuaaauuauuugcccaaguucccaagguugcugaugacaaagccaaagcuagagcuguacucucuuggccucuacuguggugaugcuuggaaguaaagcccaacacaaccccaugaggacgaaaggagucucaguaccugcugcccuucuuucaggagcccaggaaaacugggccucucauacuuugcuuucuugugccucagcuuacucaucaguuaaaaaagcaaaccugauccuucuucuucucccuccucuaugcuccaagacucaccaggagaaugagugcugaagccaaggagugcagaacugcauacauagucugcccuguacuccucuuccuuaagaagggccgggugccguggcucacgccaguaaucccaguacuuugggaggcugacgcaggcagaucaccugaggccaggaauucaagaccagccuggccaacauggcgaaaccccaucucuacugaaaauacgaaaaauuagucaggcguguacucaggaggcuacucaggaggcugaggcaugagaaucacuugaaccugggaggcagagguugcagugagccgagaucaugucacugcaguccagccugggugacagagugagauuccauuucaaaaaaaaaaaggggccaaacaaaacaauuacuggguacaccuuucuuuacauugucauuggugacuguuagaaaugcuggucuucaaggaagggaagaagggagaggcccggacaagggaagcuuagacugacuccaugccccugguuuauggcacccucauccccagauaucaaggggaggcucugcuagguuuuucugccucuuggaauaguccuggagccacucccugcgcacucccugugcuugaggagagacgaggaguuuucuguuggccaaauaucagucauccauggagcuucuggaucauaucgugcccagaccccaacccagaccaaugaaaccaggaccuguggggugugauacccuggcacacgugcuucuaacauacagcugaggcugagauccaccgaggcugacaaauaacuauguccagaggauuuuucuguagcugagaaugaccacgauccuuggggaaaauguccaguguaagaaaaugaaaucaucccugccccauggcuuucugcuucucuguguccucauggaacuggcaugcuggguuacaggcagccuccugaggagcuuaagaguguccacuccagauagcagggaccccugaugugccaucuggggcuccuuugcccguaugggagguggcaggaguucagcuugcaguggggaguggaggcaagggagcguuuuggugucaagugcuacuugaaaggguugcuuuggcugucugcuccccccaacaccccgucacauacugcuaaguaguccuacuuaaggcccacaauggugcaugcagggcuuucggcugucuuuggugggggauugcccccacagcccccggaggccugucugcuucugagcugccaugagccugcaacacccgcacagggccuccucccuggauuacccauagcagagaggaggcaggcacuagguugggaagaaagccuaucggggugaugaugagcagagggacucaugcaggcagauccauguucuggagaaggcgaggggccuaaaugccucccagaaggagaaaugcauccagaggcagcucagaguccacuugcugggagaaguauguucccagcccccaguucugcucccugcgcccaccccucagagccccaggagcccagucuaggcaagaucagcccugacugccaguccuggaggcggaccaugagagggcacuuccuccccagccaagccucaggaauguggcggagccucugcuggaaaguccccccacccacccccacccccacuuagcuuccucuccucaggagcaggaaaaggaugcccagggagggggcuucaagggggagacucucucagcgccguccccaaagagugcuccuuguggggaaaggaaggccagugaaagugcuggggcccagugauagccacucaaccagcuccuccuuaucccaguuccuggaugguuuccccauaguguccugggggccagugagggccuuuccacccagcccagcccagcccagccaagugaugucgcccugcuugcccuccaugaggaaggguuuccucuggcagagggaguguggaacagagccugagggcaggcaccgcccagcaucuuuagguccgcccagcaggcagcugugcccagcuucacugggccuguugggggaggucuagcagaagccccacaguggggccuagaccccgucucagaggugggaggcaugcuggcugugugcucagaggccuccguuugguuugucacugcaaaguuuggucugcagaagaaagucagagaaaucagaagcugugcgccaccucuaguccaugaucccaagggcggggacccuguccccucccgccccuguuggagaggagacccaagauuucuagcaugagggagacaaggccugauggaggagaaagccagggaaggugagcaaggggugacucugccagcaauggcauuccgggggagcaucccaagcucccugggcagccugugcgcucaucuugccaaggugacggugcuguccccacuggauuaaucaggcccaggguaguggacgguccuucuuugaugcucucauggagagugaaauagguugccuggacacaggcgcuguucugcccagcgggcacaaagggcccucagaguuggggaggaguuuggcugaggugggauuuugacugagagacccccuuugcucauuuccucagcagcugcuaacauuuauuguuaccuguuucauuccagaugcuccagccagugagaacaccaaggccccagagaugaaaucccggaggcccaagagcucucuuccucccgugcuaggaacugagagugaguacucgcccagcuucaccaggcagaggcagaggcaggggcaggcaccccggggacugagggcagccucagagcccccacuuucuggucacucacucuugccugaaucccuggaagucugaugucugcccacacccugaagugcccagugaacucccaauaacagagccaguggccuuuucucaccccaucccagugcucucuccagccugucuccagccugggugguguugcacaucucaucugagcuccuaucuaccuccccugcccaaccuccuucaugcccuuucacuucccaccaagacucuaggagagcuccuccuaauuucuccccaguugauccugcccucccaggggcucuuucuggauuguaacucugaucucaucacuccugguugaaauaugcaguggcccccagagccugcaaaacccacaagcaaagcuccacauguuagugccgaggacauaccuagcucgcaugugcacacguggucccacauguggccugccccccgccugucuuucccggugcugcccccagcuccuuuacuucuauuuuauacucaggccaaacugagcucuucacugcacacuacacagcccccaaguuccuuccuucaugccuucucuggcaccucucuccaugggacaccuuucugccaaacuccucugaaaagucucucaucccugaguucuuccucaccucagcucccacagugucagcaccuggcuccuccacuaccuccuucccaaugucacggagaugugucugggucucauccucccuccuccauuguacagggucuguucaagcaauuaccuuucagaaugacacaugcugcgccuugcucguggaaggcccuucccaguuucucuuagagucaaaucgcagugugguauaaaaagccaagagagaaaggagccucuccgugaccauaggcagcuaccucccucuuuuuggaucucagcuuccccguagcccacacauccauuaggcaccaugcguaggguccacagugcuuuuacaggccugccaaaugcuguaauaucuuauaaaauuagaagaaaaaagggaacucuuaagucaaagaaaagguuuuaauucaugacaugaauauauucaucuuuauacccaugcaguuaaaaguguaguuuacauaauucaaauauaauacuugauauguaauuaaaucuauuuacuuuuuuuugguggaggagggggcuauaaaggcagaagugccucagaagucacaaugucacccuggcuucccuuauaauuuuuaaucuaacuuugacagcagaacuacccuuugaaaacuacaauuucaacagagggugcagaguugcuugaacauccccagcacaugcuguguuuuaaaacaaacaaacaaaaaacaagaugagcuccuaauugcccguacugauaggggaaaauaauugagccggguuaacucagacuacaaucuuuuuccauuacaaugcaguguuuugugacuuuauuuuauucuuaccuuccuaaugaugaacuuggguuccucaaacauaccccagccaggcuguugggggaacucagccuucaguauguuggggcagagaaauuggaauuaauuucucauugauacuuaaccaagguagauagccugagaauaucaagaauggacauuuaauaaguuguuggaaaugcauacauaauaccaagaaaaaucuggugagaauggguuaauaauuuuaucuuccaaaaauauuccuuggaccugugcuauacuugguauggaaaaccgugagcagaagagauagagaauguaggaagggcaccaggggcugugaauuggggcuauggcauggcuguccccgacuccugggugcagaagcuacagggcagguauugaucuggugggcagccuccagcccucagcuccagcacacccacuccagugagccccugaggaggugagauggggucagagccgagcuguggaggaggaaaacaagcuugagaugaugagcagagcaggagcugggcucucugcccugagaacagaaggcuguggaaaccccaugcaagcugucacuguccgagucuggagcagcagcucgcaccccuggcuguguguuauauucaccuggggagcauuuaaaccacugccgcacaggcuuccccugcccccagaccaauuacaucagaaucucaggggugggugccaggccucaguauuuguucaagcuccaggucacgucaugugcagucaagcuggaaaccagcuguuccagggagaaaccuggugcccacacugugggucuugagaagcagaagggggucuccccugcugccucuguuaaguguggaacugccucggggacccucacaucaacauccuuaggguaucauguugcccagagagccgaacaaggcaccuugugguggagaagcuggaagcagggaaugaagcucagucugaguuagugggggagcagcaggcuaguagcaagugcuucaucuuuacagaaaacacacauucaugacuggauuaacuccaguagaccccacuuggauuucacucugugugcagagcccccauguuggaauuucagacaucuugcuccugaaagaaugggagugugugucucuacacacuccaaagucauggccacuuuguacccuuuugcuggcccacccuccaaucucuguuacuccaaaccugcuaccccaacacugagagcggugccaggcuggcucuagcugcccuccaccugcuugcaccccugcacucuuguccuucagaagccuguacccugggggccugagagauacccugggauuuguuucuggagccuccugagaagcuccugagaaggcagcugcccagagaugggaagugaaggagaugucuuguuuuguuuuuuuuuuuuuuuuugagacagagucucgcucugucaccaggcuggagugcaguggcgcgaucuccgcucacuacaaccuccgccuccugguuucaagcgauucuccugccucagccugccuaguagcugggacuacagcugcgcaccaccacgcccaacuaauuuuuguauuuuuaguagagaugggguuucgccaugugggccaggauggucucgaucucuugaccucgugauccgcccgccucagccucccaaagugcugggauuacaggcgugagccaccgcgcccggccgaagaugucuuuuagauuugcacccauucuuuucucccuuuggaggauaauuguuaguuuauugauuauauacauuauauaugcacacauucuuauuuaaccauuuuaaacaauauagaaauauacuauguacaacaugaaaguccucuuucaucucaccccaauucuacucacgccccaaaaauacucagugacuuuuuucuaugcauuuuuauauacaggcacaaguacaucaauuggauuuuugucccacagagauggaauugcacagucuguauaccucugcaacuugccuuuuuuucuuagcuuugccauccccagucccagacaccucugauuccaugagugaucuggcuguguguguguguguguuuguguguguguuccucugugucaagggcugagaaguaccuagucuaagagggaaauccaucuuuccugaggugagccugagugauuuuuucaucaaauagaucaugaccaguucccucuucugcacaccccccucccugcugagcacugacaagcaugagggaaaagccaagggcauccaccccaacccaagcaaggacggggugagagaaagcggacagaaguacaaguuaaccggccagacacugacucacaagugcaggagggaggugggagcagcuugggaagauuucgggaugaggaaaacggggucagguuauggaggaggagaggaaugugguuuaugugguuuggcuggagagaaaaugauaacaucaguuggggagaaggcagacagggaggagccacacagaugcuggagugaagauugugagggcaccugucucaggacagcugcaggcugaacaaaaucagagucuaccgagugccugugcacugggagcaccuuaggagcucgaucuaugucacuucagccgagucucacucaacugcgcuauaaauagcuguucccauuuuagggaugaacaaaacagagccucagagaacuaaacugcccuguccagggucucacagcuaguaagauguggaacuguggugccaacccugaccugcauucuggccacuacacccuggccuggcugcagucucaggauguacucuguguguguguguguguauauauauauauauauauauauauauauauauauucauuuauuuauucauuuagauagagauagguaccuaccauuuuaggccaaauuggagauaucaugcccuugaauucuaacuaugcuguuguccuaagaacauaacuacaaugcaauuauugaaaucaaaaucaaagaguaaauuugacauugaaccaauacuguugucuaauugauucauagucuacauuuauugucaauuguucuaauaauguucuuuguggcuaucuuuuucuccuguugaugaauauuuaauaauaacacuccuaaaacacuucgugcacuccuccagcccagaguggguccucuccucccuuuggagauggaacaggaaagaaguucacaggcccaggggagaaacaccccacacucuuccaccuaagcugaguagggcauggggagacagaaauacuccugucggacuccaggugccaacuuacuaugaucaguucuggggcagcacucaggcacaagacacagcaagaaagccaaugagcaggagacgaaggucuugguucucccaguaguuaaauauguggccuuggucaaagcccuucauuccucuggacuugggcuuccuugccagucagauggggaguuucuccagcugaccucaggccuuucccaacucugacaucagcaucagcccguuggauggaaagcuuuugagugacacaguucaguugagauuaauaacucuccuucauaucaucugaagugugaaggaguccaaagcuacagcaaguauaguuuaggucacacagcagcaaaaguguccugagggaaagaggccuuaagcauacagguuuaggggagucccagcuggagggggcccaaauggccaggggaguucuugggaauuuugcgugaggggagacaagcaugcuggcuguguaaaggaggcauugauggggcuuaagaaguggccuuaggaaaugcacaugaggugaugccaguuugauaccagacucugggaguuccuccuagcagucuauauaagcugauggucuuucagaagagauauaaacggacauccauguggggcuuuuacaccuugaagacagaaaccagguccuguccaucuccaaaacuucauuagcuggucucucaguagguuuauaauaaauauuugauuuuucaaaccaguucauaaguucccaugcuccaagggucccugccuccacugugguucugccacuggggaugaugccaauggaacaucccuuugcaguccaugccuggccuuggccugagcuucaccucugacaucagucacuuuggaacaucccagauuaugagacucucagauaucuuugccuagaccucccauaugugucugccucuaaaauggaaaguugugucaauuugaaagcaucucuggauauuaaaaacugucccuuuuccaugcaagauuuccccaggaucaaaucuuuuuuuuaaacauuccuccucaggucaugaggaauguucaauccugaugggauucaaaaggcuggaagagagguugggauuuggcaucaagacuugccugacagugaaagauguggggcccugggagagaggcugggcuauuuccaugaauguuucugaaagcuggcaccaacucccaguuacucccaaccaaaaugugggucugggaggaggaauagugccuaccuggcacacucccacccacaggcaugugacccuaugacuuccacccacuacuccucccaacucacccagugucucccauaagccagugaacuggccagaggggagaccuggaagguacccaccaagcaaugcuggcaccccuggcccagcacaccucuuucacaaccauccugaugcucuguguccuggggguuugggaauggauguaaucagaggagcaguguuucuuugcaaucuccuuaugugacagcccuugcuuugaggaaggugagcaagaaauuugcccagagauguuaauucugggaaaaugaccaauauuccuccacguaucuguaagcauguacuggaugagaccagcguauacaguaggggagugggucaggucacccagggccagugugguaggacucagccuuccauccucagguacccccaccuccuuccugcuccgauacagccucauggggugggugcucacuccaugcucaacccagcuggaguccuuuucaggagccuuuggcagaaaguucaugcugauuuugggaauuuugaaggauuugaugucuauuuuuaacuaccuaccuaaaaagggaaauguccccagagaggcagacauccagggaccucccuguacccaaggcugguaaggcuaguucccuaauucuccuuugcuuuccauuaucucagaccuuuugacuccgugagacccaccuucaggcucugcaccuaucuugcaaauguuuacucuggucucucugcccugcugauuuuccauguuucagagcgaggcauucaggugccuucagacugagcaucuggaaacuucuguggguuacugaccuccuuuuuuuuccccaggacuagguuagggcuugggucagcuggaacagauuaccugaacaauuaggaggcuggccuccccaccccugccccagguuucccaggaggcuuccagauccaaugcuuugauucauguuuuuauugggcuauuucacuuccucuaauaucaaucuccuaucuagaguggaaggcucagcaccuggcagcuuugaucccagaggggacagcagagacugauccuuuucauagaaaguuauauaaaaauucaagccccagggcuauauuucucagcaucagugcccagggcugggggagaauguuccuugggaauucccggguuaacagaaauccuugaggguuucacucauuccuuuaauggccauuuaucaggcaugugccagguacuaugcuaggcacugcagauacagaagguagacccuauccuuguccccagaagcuugccgugguguguccauguuggggacagguuucugaaauagcggugccugaugaaugcugugauggagcuaccucagagggccaugaaccccguggggcauuaguggugcaugagcuggggcgaccugcccaaagaauaugcaagagccauccaagagaagagggcccagcaugugcaaaggagcgaaggcaagagccugguguugcagaaacugaaagacauuccauguagauuacagagcaguacuucccaaaggaaggugcagggaccagcagcaguagcagcaccagcaccuggaagccaagaaucuauguuuuuauuaagucuuccaggcaaucauaauguaggcuaaauuuugagaaccacugauauugaguauugagguugugaugaaaguuguucccucuugggaaagcaagcaagaaaguuggggaugaaagccagggacagagcucaaagaccucguaagaugaguugaauuugauccugaguggcaaugggcagccacugaacagguucaggcagugaagugacaucauauuugcauuugagaaagaucacuuuggccacagagugacaaaugugacgggggacaggggaccagaagccuaggaggugaugcaguugggacuacaaugcugauggugggaagguagaaauuggcagacugaggagguacuuaguugguguagacaacaggcauuugucaguggauaugggcagggagggggccuugggagaaauggggacagggagcagguuuggggaaaaggucuuggauuugguuuugcacguuuggcuggcaguacguguuuggcaucucccugggagaugauggucagguaguuggauguauugguaugggcucaggagagaggucuggcuucaggggaaauggaggaaagagaauaggggauagaaagaggagcucaaagggcagcgaugagcacaguaccccggggcagugcucuaccaggaaggaugugcugccugggcugacugccuaaaggagguggcugagccccucuucagaggagcagccugaguagggcgugcucugcccucccugccugucccauggccagcagccaucauggaguuugcaaagguggauggguuuuauuuuccuucuaggauguuccucucugacuggcugguacacaaaguuuagggugucagagaagaggaugagagacacagggcugacaggaauaauaagauaauaagagugacuccagaggagaggaaacuaguuagugagccagggaguacugugaguuuguuugggcaucuggaccugcagaauguccccucuucugaggaccuggacuggggagaagaagcacaggugccacaugagagcucucagguuaguguaaggcugaacugaccaacaggguaccacauagaugaaagggccaaacuugucccaaaggacagagaaguccucuggggaucuguuuguuucagagagcgggggaguggggggaggggcugauguuagaacaugcacugaggcugagcaugguggcucacgucuguaaucccagcacuuugggaggccaaagugggagcucacuugagcucaggaguuugagaccagccugcgcaacauagugagucucuacaaaaaauuagcugagugggugcugagaugaggaucacuuuagcccagcaggucgaggcuacagugagcugugaucaugccacuguacucaucuuggaugacacagcaaggccuugugucaaaaaaaaaaaaaaaaaaaagaaaagaaaaaaagaacaugcugcacuauaugcuauacuucccuuacaauguagcuuaacucuuuacaacaaauuuuauuuauuccauacccuggguggcaggaggcucagaucccauuuccagcuccagaacaucagguuuuaugaaccuagcaagucaccagacuuuuaugagaugccaucuccuuuuucauaaaauggaaacauuaugauacucccugcuguguuugauugggaugagaaccaagugaaaugcucccucugagaaaccggguuuuagaaccaggugcuuuccccuauaagcccagcacacaauuaguggauuucagcagauggucauauaaaauauguauagaauaggauauaaaacauuguuaacgcuuaaauuguuuuuacugauaggaaccaagccaguuucaaaugcuaaccaauucaaacaaugguagcuccaaauuuacagaacaaacauaaaaauuugaccuucaauccuauuuaaccaugacacugaaagauuaguuagggcuucucuuccagucaaauggguuuacccagagccaccaaguauggggcaggacuuuggaguccccugauuucaugcugugcuccuagcucaucaccccagggauugucagccuccuucucacaccuggugcccaccccacuggugcccaccccacuaaugaugcccauccacagcuauauuagucuucuagggcugacuuaacaaaguacggcagacuggguagcuuaaccacagaaauugauucucacagcucuggaggcuagaaguccaagaucgagguuucugcuugaaaauggcagucuuuccccuguguccucacauguucuuuucucugugugugcauuugucuggucucucucgcucuccucccuccuucucccuuccucccucuuucucucucgcuccuuucucucucucucucucucucucuccucccccugccccugucucucuucuuccuaaucucuucuuauaaggacaccaaauuggacuauggcccacccuaauggccucguuuuaauuuaauuaccucuuugaaggcccuauuucuaaauacggucacauucugagguaccaaggguuagagcuucaacaugugaauuuggggagacacaguucagcccaugacaacagcccuccacguagcuccucugaacagauggccuccucucuccagagaucauaucugggcuccgguagaagcccucucuucuucccuggagagcuucucucuucccaacaguccuggacaaagaggggcagggccuuuguggcucagccagucacaggcgucccauaucccaucuggucucccccaccaaaggauuuggcuccccgugcucuucccucuagugucuuugggcucucucucuccacugugcccuagccauugccuuccaccuugucaucuucucucuucucucaccucagaagaaaccugagcuucauauucccucuuguuuccuugcuucucuuuguccuuucaccuccaggauccuugacuauuuuacuccccacuguuugcucaagaaucuccucuggggugacuuuggaccaugcugucccauggaaccuggccucuccagcaucaccgucucucacuccaugcugggcacaccuggugcucuucccagcaucuguccucuacccuugcuuguggcgacacuccuccugcucucaggguccuuccacagcccucuccugugucucggcuucuuuacuguggacacaccugggaucaaacccuggccuccgccccucuuucauugcauucucuuuccccaaagaauugacccaucuucaagguuuccauucuaauggcuucuuuaauucuggaaucuuucacuuccagucuccacaaacuucccucuggaauucugauccugggcuucuaaccuacaaacagauucaagcugaaauauuaaucuuguacuccuaauucuauauuccuucaauaugacuuuccacguguaucuaugcaagaaaucucaaaguaaucuguguaccuccuucuuguuuagccccuuaaauuauuuuaacuuuccucugccucucauuugcaucuucuuuucugcauggaucuugaucagugccuuccaagguauggcaauagccuccuaauuggaucugucccgcaagagcuggaaagaccuaucagggaccucuagcccagccugacugcuguuugagugaggacaugcuguucaaucaggacaaagccuuagcucgugagcuuagcauuugaggccagcacugucuaacagaacccucugugaugaaagaaauguccuacgucaacacaaugugauagcuacuaaccaccuauggcuauugagaaccugaaaugugacuagugcaaccaaggaaucaaauuuuuaauuuucuuucuuuuuuuucugagauaaggucucucucugucacccaggcuggaguguaguggcaaaaucauagcuacuguaaccucgaacuccugggcucaagcaaucccucccaaguaacugagacuacagacaggcaccaccauaccuggcuguuuuuauuauuuuuuacagagacagggucuugccguguugcccagguuagucucgaacuccuggccucaagugaucuugccaccucugccucccaaagcgcugggauuacaggcugagccacuaugccucaccuuaauuuuauuuaauuuagagugcccacuauccucauaccacugcuguccaauaucagcccugugcucugccagccuccaccaaacaucacccugauucucaccucugagccacugucuauuccugaccuguggguucuccucuuucuccaguucagaccuucccuagccuucagguccaucuuacauccugucuuuuagccuucuaacuaaccaucuccuccaccaacaguguuccuuuuccauucaaacagccacaucacguugacugaauaacaucuuuuuuuauaacuuucuauuuaacuuuuaucuugaaauaauuugagacucacagaaaaaauuguaaaaauagcaugaaaaauuauuguauauacccuucaucuagauuccucaaagguuaacauuuuacuauguuugcuuuuuuuuuuuuuuuuuuuuuugagauggagucucgcucugucacccaggcuggagugcgguggcacgaucucagcucauugcagccucuaccuccuggguucaugcaauucuucugccucagccgccugaguagcugggauuacaggcgcacaccaccacaccuggcuaauuuuucuauuuuucguagagaugggguuuugccauguuggucaggcuggucucaaacuuccgacuucuggugauccacccgccucagccucccaaagugcugggauuacaggugugagccaaugcaccuggccuugcuuuuucauauauucuuucucucccucucuuuuuccauuucucuguuccuucuacuucuccacacauauauacauguauauauacacacacauauauauguauauaccaugaacaguuugaaaguugcacacaggauacccucuacaccuaaauacuucaguguguauuuccuaaaaacaagaacaaucucuuauaaagccacaguuugaugaucaaaacaugaaauuaacacuaauccaauacuauccucuaauuuauugaccuuauucagauguugccaguuauccuauaaauguccuuuauggcaaaagaaaaaaaaaaaaaagccuuuccucuuuccuguggaccacgucuugauauuuaagaccuugaggccugauuucuuacauuguuugguuuccuccucaguacccagguuagucguguguacugacuagcauuugccuggcacacaguaggcccugaguaacuuuuuggagauggacggauggaucaaugaugacaaugagccagagggaaccugguggaagcccucauccugggcuuaaccacacagccggcagccaucagcucggugaucucagugugccccugccagggaucacugccucacgcaguccuccuggggcauucacugggcagcagcacguguccugucguggaaaugcacaaguuccacaaguuacuaauuugccuguggucacagggcaacccauauccaagccaaugacaccgcuuccccuucaucugcagaggugaaguuaucuggaugaauaauuguuaauauuagcccacucauucauucaacaaaucguuauugugugccaggcccauugauauacagcagugaaccaaaaaagucccuggccucaaaaagcucacaguuuaggaggaggagaagggcagacaguaaauaaauaagugaagauauaguuuuucacauggugauaagugcuauggggugggaggaccauaaagcgagaugagaaggaugaggggugcugggggcagggcugcuguuuguauggggugguuagggaagaucucacuggugaaguggcuuuuccucauuuuuuauguuaagguauaauuucccugcagugaacuucacccucuuuggugcacaguuccgugagucuugauaaauuaaugucaucauggacucccagcauggucaagaucugguucugucaccacagaacauuucccugugccccuuugcagcccaccccucccccacccuaccucuggcaaccauucauuaaucuguucuccauuccuauaguucugccuuuucuagaaugucguauaaauggaaucauacaguaugugaccuuuugaauuuggcuucucugagcagaagaaaaagagaaaucauugagauucauccauguucuguguaucaguaguuucuuccuuuuuauugguggcaucaaagugccacaguucauccauuuggauaccuucuaguuuuuggcaauuaugaauaaggccacugcaaauauucgcauacagauauuugugugccuguagguuuucauuuuauuuggauagauagguuagauggcuuuugagcaaagaccuggaagggauuugaaacaagccgugaagacagcucaagauguuuucgcacgugcacuauauugugauuuagccaagugaauagguuugugcugcaugacuguucuguuugagucauuuuucucauuugaguuauuuggaggaaguaagaguaagaagggaggagaccauuuauucauucauccauucauccauccaacaaacuuuaaaaaaaugaaagccaccagucaacagucugugacccaaaggaagcuugcgacccuuggauccacaccaaaggcuaauuuuaguugguuuaucugacaugacauaauuuccuuucugaguuuccugaaaguuagggugagagagugguuaaugaguguggcauuaucgucuucgaaaagggcuaugggagcacgagcauuuuagagaguuuuuaaucucauuggaggcuucagagacccuuucauaggucccugagaacugauauucuuuuuugucugugagguugucugugugaaagggcaaagugaucucucaaaagacauauucauuuacuuucuuuuuucuuuuuuuuuuuuugagacagagucucacucugucacccaggcuggagugcaguggugcaaucucugcucacugcagccuccaccucccagguuaaagcgauucuccugccucagcuuccuggguagcugggauuacaggugcacaccaccaugcccagcuaauuuuuuuguauuuuuaguagagaugggguuucaccacgcuggccaggcuggucucaaacuccugaccucuagugguccaccugccucggccucccaaagugcugagauuacaggugugagccaccgugcucagccugaaaagacauguucaaauaagaguccucccuggaugaggggccaguggacaagacugcaucuuccuaggaucaggagcuuugugaaaaaaacagaacuacaggaaauaacuugugaacuucuuuguuucaggugaugcgacugugaaaaagaaaccugcccccaagacaccuccgaaggcagguaauuggccacggcacuaucuggggucaaagaagucaucuaccauggggguuuugccuuuaccuugcuagacugacaccuggguaugugaucccaggagacaccccacugcaaccccacccccacccucaguuccagcucugcauuuuucaggcugaguuugcucauggagagccucugcacagccuggcuccugguccccuuccacagcuuugucuuuccaucugccucccauguugacagcaucauacaggacuagcagcucuccugccugccccuucuacgaauucugcccugcuguccauccucugcccuacccuuguguacaugacccucuuggggcuauuuuugugcccagcucuguguguccuuguuauauggaacccuugucuguuuuccauuggaugacacuugaggacuugaaucaagccugccagccagggugaccuggaguuuagaaggcaaggugaugcuuaauucauaagugaguuaggaccucaauucaaaaaauuaggguaagucacaaauuccaguacaacccauaaauggagaaucaugccauguaaguagugugggucacuucugagggaaucagaaagaagaggugaacaaaccuagcagguccaugaacuuggauguccugcagcaggaucacugccccucagucuuacccugaagguuccggaagccaagagagaagccaacagaccacuguggacaauggcgucgaaugugaucagaaugccugagacccuucugccucgcucacuuucucccuguccucccucagcaaugcccccucagaucauccaguucccugaggaccagaagguacgcgcaggagagucaguggagcuguuuggcaaagugacaggcacucagcccaucaccuguaccuggaugaaguuccgaaagcaggucagugacgguauggggugggcacugggggugcugggaauaauccguacagccuuuggaccgaaagggaugagaaaugccgugcuggagauggccucacucuucguagcuuuagaaaugggagaggccacuccccuacccaucgcucaccugccaaaccugaguucuuguuaaccuuugcuucugaaucuaccaauaauccccgccuuuguagacaauuuguguaauagaagugugaggggaaaaguagaaaccauccaugucccucaucugguuugauagcacagucuagaauccuauucagagucaggaaagucgagccugugacccaagaugacccuuagacuccaugagcuugcugugauucugugccagcccacugauuccugucuguuauaaccacuuaaacuugccacaugcugaagggacaaaagcaaaugugaguauuuggauagaagaauuguaugauaaauagaauugugucugacugacccagaaaucuagcuacaauuuaucauaaugguuccuauggaacaauguuugaauuucuagacaaccagcauugaaaggacuuggggagcccagcagcuccaccaauccacggugguagugugugccuguaugcaugaucagcagagacccuggaaugauggguuggcacaggagugggaaguugugaagauuuauucugagcccucuguuacucuguuuuaaaaucacucaaauucuccuagccccagagaugaacacuuaguacuaacagggaggaaaguaggguuggucucaaaagauggaaaugagaaguuugccuuuagcaucccagagcauguuugcccugagcgacaucuggacuacuguugucugaaauaagauggaaucucaucacuuuucagagacauuuagccaagucccagcucuguccuucagaacuuucugcccugaugaaaguguuaucucugugcuauccaauauggcagccaccagccauauacauggggcuauugagcacuugaaauguggcuagugcaacugaggaacugaauauuuaauuuuaauuaauuaaaaauuguuauagcagcuuuguuaagauauaauucauaugccauaaaauucacccucuugaaguguacacuucagugguuuucaguagauucacaagguugugcaagcaucaccauuaucuaauucuagaauacuuucaucaucccaguaagaaaccccagacccauuagcagacauuccucuccuucccccaggcccugacaaccacucaucuacucucaguauuuauggauuugcauauucuggacauuucauaucaauggaaucauacaguaugucauucucucuguguagcuuucucuuuuuuugacuuagcauacucuuuucagggcucauucuuauuguaacaugaaucaguacuucauuccuuucaaugaauuaauaauaaauauuccauugucaggauagaccauauuuuguuuauuuguucaucaguugauggacaucuggguuguuuccacuuaacuaauuaaaauuuaaauagccacaugugacuaguggcuacagcauuggacagcacagaagaggcuagaacccacuggaguggaucuugugaaugacuuugcugagauguguucuccuaucaucccauuccagagagguagagggagaccaggauauuucugggagcagugagugcucagcuaguucauccauccauccugccccugcuccacacccucccugcccaccccagaccuggcacccucagggaagcuggacucuggauguaggagagaaggggccucagggagaagggcagaguccagaccagacugagcccccccacagcuuguccagcugcauccuucaggaaguagggaauggggaggagcccccuuccuuuccuagcccaggggcccaaggcuccagcaccugcuccauccuccgccccuagauccaggaaagcgagcacaugaagguggagaacagcgagaauggcagcaagcucaccauccuggccgcgcgccaggagcacugcggcugcuacacacugcugguggagaacaagcugggcagcaggcaggcccaggucaaccucacugucgugggugagucugguggcuggguggcauggagcuuggggcaaggggaaggcagggagcccccaggcaagauacgugggccucaggacuucaucacccauuaucucucaccacuccugugccugauuuauaaggcaccacagaaagaagaucacggcaacccacagacucccugcuagacccugcugaccuccaggcucagcagaggggccaaggcugggcagaaauccuuuucccugucucuaucaacaccucucugugauagcuguuccuggaguuccccgcccucaggccuuggcaucuagcuuauuugagaaauaagagacaugaggcauaaacuuggucaacuucuuggccccuacgccacaggugucuguaucuguccccauccugacuccacccuccaggcucuggggauggcccaccuuggucccaccaaaggcugcucccuucuccugugcucuggaccccagguccuugggggcuccaccaucccuacuucucucuucaaccucuuccucucuccuggcuccucccagcagcccguaagugucgccaucuuagccagaugcacaggcauuaauaacuccugcaauguucucucucacucuagccacccuaccuucucucucugacaggggugagucucuacugcacuuccgcuucuucaccccccagcacccuccagcugccuauggccucacccccacgccccauuagucugcagggacuguucuucugaggucaccaugaccucccaauccugacuccacucgauuuuccuuaccuucauaccaggauuuccuucaucccaggauugaguggggucugucuccagacugauucucaaguucacuuuuccucuccucccuuaacacugucuucgugcccuggucagcucucuccuggagcaucaagagaguuuucuaaccagucucccgcuguugucauguucugcuccaguuguuccccguguggcaggugcuugggacagcagaagaaugagcaggcagaggagcagacagagagagagaguagacucuaugccucaugcauuugugggccuucauauguugugcaugugaaagccuuugaccuggcauuuauugauaugugcacgagacccgagcggguuuuccauuuguccuuggcuuucaagcuuauaggguacauuugugaaaauuagaaaaaggggccuugcugggcagagugaaaaggguacagcacccccagccucaccccagaacucaugaccuggccuuggggaggacagguuggcccagaugcccccacuagaccccuuuuaugcagugcacaaaacucucagcugugugugcugaucccaaccuuaacuuccugcaaacuagccuuuccuguguguuccuggugcacacacacgugggcacacagaacaaaaggaucuguugguaacagggcuuguguggcuaccgugguuagaagucuuccacuggaaucucucuuauggaaguaucuagauaugaaguuagaaguuguagacauugacucuuaaggucucuuguagcucugacauucuaugauuccccaacucuauucucugacauucugauuccucgacucuauucucugacauucuaugguuccucaccucuguucucugguggucugugauuccuugacuuuguucucugacauucugugauucccugacuuaguucucaagcaguuuuucuccccuaucuucaucucguaucaucaccuuaggacuaggauggacaggacugauguuuccagccuuaugcaggagaaacugaggccuaaucugaacaaaguaacauagugcaucagaggcuaagugggaacuagcucuaaacuuucaaacacuuguccuccagugccacucaugggagugugaaguagguacagaaugucccaaaagguaaaggaacacucuggcugcaaaacucaucuugaggggagacaugcaagccuuuuggggagcuguccacaugccagagaguuguugaugucugugccuccauuuuucucaugcugagccuuaggaagcccuguagcacuucccuucagccccuaagcagcuggggaagaagaaguccuuguccaaccaggugaauaaggaagacacgaggauaaaggucaaaguaauacagagcugggaagacaaaugagguggccagugagcuaugcccaugccagcuaccagaacagaccacagguuccacacccuggcccgacuccccagagaggaaguacugcaaagcccccuggaagauugucccuggacacaggggacccgggagagggaauucacagaggacugagcuccagcauccacuccccacccccaguuguccauauuucuguuuaccuucucucuugcucuguuccucucccuggccuuguuucuuuacccuguguucuguuucagccauuucucaguguccgucacccugucccauguccccucuuuucccuuugucuuccuuccucugacccuguucuuuuguuucuuuugguuagaaguuucagaucggggaagacugguguacaaaggggucagggaauggguuuuucauuucuaaaggagaagaacaacccuuuucucacucugucucuuuuuggugacuccagguguuuauuugaauaauuuccucccaaggagucaggaaccuguggaggcuuggugcuagugauccacuuuacugguacauuuagaucuguucugaagcacugauuuggcccuguacucccguccuaucagcaagcaucaguuuaaacuuuucuuugauguucucucucaucugcuccuccuuaagcaacuuuggggucagcuucuuugaacugcuuuucuacagaaaagcucucccuccccccagcccccacgaugcccagcuccugcgcagugccacgcacuccccuccuccgaucaccacuacgcgggcugcaguucuggccuuuuaugguuuaguuucuuauucucugcagccagugcugacagggccauuggcguggcugucugccagcuggcaggagcagcauguuaaaugccguccugggaggggaauggaauggaggagaaccgaggcuuucugucugccucccccucaaagaacuaagaauagaauugcucaauaaaauaggacucacauugauggauacagcaaagccacauucauucagagccuguacacuuagaauuaguucaaaguaaaccuggaugaagcucagauuuaccugugcaucuucagggacaucucuguauucccugaucaggguuuauuaagcagauguaaaauguacaugagguaaaacaggaaucacuuggucugcuccggacaguuuucaugcauuuacagaccagcuaaauaaggccaguuuaauacaacuccuccuuguuagcagcaaacuucucuuauuguauauucuuuaaagggccacuuucuuuucagauccucucuggcuccuauuuuucaaacaauaauaaaaacuagccuuucccucuguuagcuuaaaugagugauauuuagcuauuuuggagacuuauuauuauuauauuuuaaaaggcagcccaggaauuugcaaugcucagagccucuuccugcacaugcgccccuggucuuggccuguggggaauaagggaggggacagugagcagcauacccagauggauuccuuaaggucacucacccagcacgagaaaagcaggucucuuuucauaucuuuaaaggagaaaaacaaaguagagagaaccccaaauacccaauaauccccaaauacuaacugaguuuggagcuugcaugauuucccaucuuaaugcucagcucaggcuuaagcaagaugccuucuugagcucauucugccugauagccuggaaagucuugagcccuggagcgaggguccagaggcuuuuuggaaucuccuuuuggcucugccacugacuacuggguuuucuugauaagcaaaaugccuuagcugcugaggacccauuucccaagggcuaggauuauccagguagaugacaugugggggcccuuccagcagcugcugaagucccagggaagggacauccagguggggcuaggcauagccacuggucaucuucaaauaagcgaggaccaagagaccucaagagcaguuacucuagugggaagcuguaggacaggauccuccauuuuccuggaaauuagaacauuugcugaggagaaaauccuggagcuggugccacuggagacucuugucuuagacugagcugaguuuccuauucuguuagucaagccuccagggagcccugggagaauucagaggaaauguggagucuccuuugcccagagaugcccagggucucccucccagucugagugugucgccguggaggacaagcucacaggagcucccuguucuaaggacaucuguucuuuucugagaguuuucaucccuuuacuaguucagccacugcauggggcucauagcuuagaaagaacagaaagcauuaggugcagcccacagcucuaaaggcagguggaggagugggaggccuccaaucuccuaggacuucugacuugggucuuuucugaacuccuuaauuugguagcaaauuccuuaaaaauguuggaguuuuacuuggaauuaaagucccucgccccaaauuuugcaucuucucuugugugacaagucuuacguaucacauaugucauguauagguucucauuuucagccaagagacauguguaacaggguaggguacaaauggcaccucuucugcaacacccauuucucaguuuucuuuucuugaccaaagcagaaggaagaucaguuggcagagugcauucguuuauaagcccacacaacuccaacuguggccaaucacauggucuccaggcagucuucucugggaggaauagugggucugucuuccaucccucuucagguuuuuuuacuuccuuagcugggucuugagaggacuugaaccacuugucuuuaagagaguuuagaguaauaaacaucuuagccaaaaccagaaauguuucaaaaaaggccaauauaucucucagaacaaacaguuuuucuaagagaacauauuaaacagccagugaaagugcuuccaucacaggaggccucuggcaugacugccagcacugggaaguggcucugucacaaucccagaaucauucccagggcuuugguuauugggguagacaguuucugggcagugcauucugggcuggaauguggaucggcagggcugggagaggggacaagaaugaauaugaguaugaguauauauacucauauacacauguauauacaugcagauuuuucuucuccauauacacagggucauuugcagccauugccuuuggccuuccugccuugcuggaggugggagaguagcggucaaguacuuuaucuauguuugcuuacuugaugcuugcaaaaacccuaagagguaggaacauauuagcaccauucucugaaugagaaagccaggcaaacaaaccaguuucaaauuugcugggguugacauagcuuaaaagcaugguuucaauugcuaguuugugaggcuucaugaaaucaaacagcauugggggagaugaaggguuaaugaacacaacacagauaucuguaacuaaccaaccaucugcaaaaacuaaaucugaaaaauaggagaguuuugcucagauaagcaacuaauaaaaucagcaaaacucaagagccucauuaaaguauuggcuaccaugauuugacuugaaguuggcaguacugcuaguucugaggccaggucaucugaaugagaaggcagccagccaaaagggccacuucuuauuuguguccucagcucauuuucuguccauuagucagggauggcugugauuugcuauugugguuugcuuuugaaauuauuuauaucucaacagcccucugagaauaaaagagguaggguaggaguaauuuuuaaguauauaaaguuagaaauaaacuccuacaauaaucuugauaguaaugacuagucaagccagccacucuucuaagaauuucuuacaaccaccugugauacaagugcuguuguuauucacauuuuacagaugaggaaacugaggcucagggcaauuaacagcuacuguguggggacagaucuguguucaaacuugaaucugucugacuucagagcacaaacacugugcuauaccaccccuugguggggcaggcauuucucaagacccagagaaaguggaggcagaccccuaguuaugucacaggucauuggccaagggccugaaggacagacacacacacucaugcugaacucucucucucaaaacauguuuucgauaggaaauaguccacgccuucugggcagcuuccuagaucuguuuacucugacaaauauguuuaugacuugggcaaaguacaggaaaucgugacuugcauguagacuggaaaacuagcaaaaaaaagcgagggggccuuuuuuggagcaaauaauuauacauggggcuuuccguacagguggguuuguacauagcucuaacugugaugugcggaugagggaaagagacgcaggaccagggacuuuggauuggguucucuaggcugccuuccccccaugacacagguaauucaaaaacuuccuuugccugcaauucuggaaagugugggugauguugugcuucuuuauccccagauaagccagaccccccagcuggcacaccuugugccucugacauucggagcuccucacugacccuguccugguauggcuccucauaugaugggggcagugcuguacaguccuacagcaucgagaucugggacucagccaacaagacguggaaggaacuagccacaugccgcagcaccucuuucaacguccaggaccugcugccugaccacgaauauaaguuccguguacgugcaaucaacguguauggaaccagugagccaagccaggagucugaacucacaacgguaggagagaaaccugaagguaggcugccaucacuucaucaguggcuugaaacaaaugugcgugacugaccuuguguauguaaagacuguacugaaaggggugaaaaggaacugaggaaacauuaaugaugacuggcagggucuuuuggggucuugguuuccaagacagugauguugagccauucuucaaaaaaaguauuaauacuuaggacauuucaaaaaacauugaaccagcaauuuuggcaugcugccaccagggggugaugguauguuacucaggagcauaggaguucaagcggccucauguuccucuuccacccuccaccccuucucuucuccucuuguauccauauuugagugucuacuuggugucagauucuuggaacacaaagauaagacauggagcuuaaaaucuagaggaagagagguguguauggcuaacuauaaugagaagggaugcauccuauuauagcuggguaaaaaaagaaccaaggggacauaacaaaaugcauggagcauuuuuccauggagaccaaggaaggcuuucuggagaaggugacacuuagucugagucuuggaaaaagggauaggauucuaaaaggcagggaagauaaggaaaggcacucuacaagaggaaacagcaugagcaaagguuacaaagccauggcagugugugacauuuucagaugcucguguguggccaaggcauauguugugugagacagaacaggaggaaguaagacuaaaagggcauuuuagguaaaguugugaaguucaucaaagauucucaggcaggggaucgagacgauuagagcugguuuucagagaacuagggaaaaagcagggauuugcuauucacagugcaguuguggaccagcagccuuggcauccugggagcuucuuagcaagcagacucccccaggcccuucugggccuugacugaaaaugauccacuccuuggggauucagaugcacacgaacauuugagaagcacuggaguggugggugggucagaggagaugagacugcagucagccauaucagaugggccucugggaugacaguccaggggagggauggaaagggcacgaacuucaagccucaggagguagaagugaccauacuugaugacuuuuugcauagugaguugaggaagagaacuggaagauucuaagaugacuuacaguuccuggcugggguaacugaacacaaauucaagagccagcuagagguuuauuguuauaauucaccauggcuaacauguauugagcacuuacucuaagcuuacgauguguuaaucacuuuauaugcaucauuucauccaaucccaauagcccaaugaagcagauacuguuauuacccucauuuuacagauaggagaaaugagauuuagaggggagaagcuacuugcccaaagucacagagcuuguaauuggugaacugaugcuugaacucagagcugucuggccugaagcuugugcuccuuugguuagacugagggaagaggucaggcugucuuccagguuccugacuugaguaacuuggagguuacauaacagucugggaggagaggggagcugcgguuucagcccugcugaguugaggcaucuaagggcuagccgagggaagguauccuaagacuguugggucuagagcccaggagaaagguuuaagcuaguguggcaggcuuggaagucuucacuauuuaauuaauaauugcaaccaugggcauugauaagguuacagagagugugguagagaaagucaauaccaacaccauaaagaaggaacuugcaguaccaggagaaaggacugagaggggagagaaccaagaggaggcuggagucucaaagaaacaggggagggagaaggugcaaagagggcuucauaaacugcauccaaugcuaaauaaaaaugaaggagaugaggacucagagggucuuuggauuuaguccuuugguugguagugaucuuugugauccaagucuguagaguuuccacugagugaaaagaugguugcccugguuaaggaauaaauggaagaaagagaggccagaagcauggaauauuauuucaagaaguuuuaugugaagaacaggaaaaggacauuguaaauuuaggauaagaggccgggcgugguggcucacaccuguaaucccagcaauuugggaggcugaagcggguggaucgccugagcucaggaguucaagaguagccugggcaacauggcaaaaccccaucucuacuaaaaguacaaaaaauuagcugggcaugguggcaugcgccuguggucccagcuacucaggagguugaggcaggaggaucgcuugaacccaggaggcagagguuguagugagccaagauugcaccacugaacuccagccugggugacacagugagacuccgucucaaaaaaaaaaaaaaaaaaaaagaauuaaagaauauaggauaagaaaaaguuggggguuaggagaagguggagggacaucaagggaagagagcucuuggagacaggagaauguagaguugugaggcagaugguagaagacucaaguaucaaaggagacugagcuccacaugcagaaugucacuugaaaaccaaaacugaucaguaggugagaauguauuugacuucuucuaauuacaaggaauuagaaaucaagugaggcaaauagugaaccugagcaaagcucagaaagcgagaaagcgagcaggccuggcaucaccagggagcuagagccaucgugaguauggaaacugucaucugauucaaugacccuguuuaguuuugaaaaaaaaauugaaaauuagguacaaaauagguauuaaaauuuuacuuucaauuaaacaagggcuccagaaagaaagaaaguuaggguaccaaugggaaacauaccaacuuuacaauuuuaugcuagcagcugugugucaggcggccuuuacccguugagccaugucaauaugcauagagcaggucuccuugagagcuauggugcaagucacggagacgugaugccugcuccugggacagcuuucgcagggaucccaaccacuagccacucccaaaugucugucaggggacacugaguaacaaaacugccaucacugucuucuuacacacacacacacacacacacacacacacacacacacacacaacaucccucugaaaugagcagagugggggcugcauagagugugggucccaggggggcaaucaaguuccagucugugguguuaggauguuacuuggaaaagugacaggaaaaggaguaagauugcagugugaagauguucauuggcuggaaaggaaaucauccaggucugugcuaugguguaaagagggagagacuggagaauccccgacuaaccccaggcagcaggaccagaggccacgggagcuacaagguguggcccccaggggucuaggacagcugcucccagggcuguguggagacucugccaggaggaagagcugugacugccugucuggggcaaguggccucucccuuguucccugccaucagcccgcugaacccucucugggccuucagacuccccuccccugcugccaccccucccagcugggaauagacaaagggcaauguugaaaucacuugaaauccagaggaggaguccaguccacccagggcuuccagacaggaagcuacuccccagcugaggcuggcuggauuaccaagggggaggaggaagagggcagaacaguuggcaaguguuaggccucagggcagaggacucugguugaggggauuccaggcaaaaguccuccacggucugcucagaugcuuguuaguuauaaagcuucauaggccaucccucugcugaagagggaaauggcucucagggaaguggcguguguguucacgcacguguguguguguguguuggcagagaggugggaucaagugacaggucauuguaggucauuucuguggagcagauggggugggaucauauuaaaaaggcagugcugauuaacccacacuccaugaagcccggcuaauguuggcucugaccuucaccacuaccaccacagccacugccacuccugccucucgcucuucuacuucauucucaugccucauuugcaucccuguugguacccuagcccucaucccacauccacucaccauguguucugugccccuccuguguucuaggcacugccaugggcacuggggauacacugggggacaaagcauggguuccccguggagcuccaguggcuucucuaugccagagccacuccuaagacuagggucccugaacugacaauguacucccaaacccaagugcacagagccagaaccuuaccacagccccgcucccucccagcccagccaggucuugaacuguacuccuccucaaauccugcugucacucaaauccacuccaucccugcuccuuacccuaauuuguucuagucuguauaauuguuagcaaaacagcuacugugacugaggcuucuugcagaacuggagccuccuugcaacccccaggacaguucgagauauaaagccuguaccgcucccaucccaggcugcagcuacgcccuggccucagaggccgucuccggggcgggggugcccucuaguguucucugggugugcaacaguccuuggcugcaggaagggacaauucucuguccaggggacugacuggacuugugccaugugaggguccugagcacucagcugauccucucccaaacacuccaggguaacgagacucucaucuguuugcagaaauaucucagaaccaucuuccaaauagccuuccacuuagcucauggaucucauagcucauucugaacagauuuuuuuuuuuuuuaaguucaguggaagacccuucccuaguggaaagauggaaaccaguucaccuuucucaacaacccuuuaugcaccaagagcucugcuaauugaacuguggucuuuccucuacuucucucucacuccuccccuuguggucaaauagaagagaggcaggacaagaagggaaaagcagaaggggauguagcagccuggaaucuuucucuuuuuuaaagagaucgggucucacucuguugcacaggcuggauuugaacuccuagacgcaagcauuccucccgccucagccucccgaauagcugggacuacaggcacuugccacugcucccugcuuaguccggacucuugauccgaguuuccugcagcauaaaggaacacagugcacuagaaagaggggcuggaauuccuugagaaugaucuagguccuucccccagagcauuagcaugagaaucagaucugccacagaccucuggggugagaggcgaaggugaggcauggaugugggcucaugagugaggccagaggcuggcccuguggcugucuaccuggacucacagugacaggcaggggccagcucuaggacuggaugcccccuucaaggcacgcagggaaagccuccugcugccgggccauuggcaagacugcuucuccugacaccaggccaggaaagcugcccucuccuuucccucucacucugcugcuuggaauacacuggucuccaugccacgccgggaaaauguggcacaggaacaagaaauaaaggaugacucaacuggugaaccacuauaucaggcagcagcaccacaggucaagacaggggccucccugacaguaaauaggaugauucugugucgaagaccuaguccagugacugguccaccuggugucccaucacucauugacuccaauauuguugcuucucuuaaaacccuguuuauaauaucaucacugaacuaaccuaaaugucuauugaacauacuuauuauucuagugguacuucucaugugugaguuccauaucccuccagccuuccuccuacgugagguagaacacuaaaugguucccccaagaugcaguagucaugaguugaugaaaagucugaaacucucaucucauccuuggcgauugugugauucucuuuaaagucauguccauuuuagacuucuuucccaaccucagaggccucaccuuuucugauuaagacauagcccuucccuucaguggucuugcuugccaccuccagcuccauuguggcuuuuggacugccgacagccagagcuccagggcaggcacccagggcgcucucaacagcuacccaguacucaccccuguuuggggcccaugcacacuuugcccugugacagcaucugacagcccaagcaguagauugaggagcugcuguuucugucuuggguauuaacuauggacuuuaggguucaccacccuaaaagguagaaugaucagauucuccugaacacuaacuccauuccuggcuucuaguugcauugcucucaggucauccuuuccaccugugaauuggacaaugccacucuuaacucuccaacauguggauuuaggaauauugaccaguuaggcccacaucccgacaguaaccgugaaacccaccucugauacuucagcuagacuaucugggugucccugucuaucucauccuuuuuuauuuuuccauggcagcuuccuuucugugauaaaauauacuuuccaaucccauucauguuuaguuuuagucuuuuuuuaaaaaaacuaagcuuugucagcagcauuuuaagaacucuaaacacacucacacucacacucacaccgguacacccgcacucacacucauaugcccacucucucucacacacacacacauacacacacacucacacuuuaaaaauccuuuuccucccucuaugcuuucucuccugucuuuguuuugcuuccuugggaaaccucccauucauuguccagcugucagccaggacgcagcccagacgauggcugaggaacacacagcacaugacgaagcguggcauccagagcuagccagggccagagacaucaggugcaacccuuccucuuacagauggggaaaccaaggcccaggaagggaaaggcaaucagccaaggucaggaagccagaguggcucgauugucaacaaacaaaccuguaucgaggcaaaggaaggccuggagcucugaagugggcgugcugugcuggaugccccccuguuccggggaaccccuccuguuccccggacccuguucacuccugacacggccaugggagcagcuggcaugacugugucccucccugcccugccucacaaauaccuauugguuucauuugugugacaucacucacgccuucauuguauuccaucauuuccuguaagacgcaacucaaaggcuauuucuucuaagaauaauugcucucacuuacaauugcaccauuuugugucacccuccucuguuguguauucacuuugaaccauggugauaugugcgugauuaugguacacuuuguaaauuguuacuucaaguauauauguuuuugccucuugaacuaaauuauaagcuauaagaaaggagagaccaugccuucuguguaauauguuuugaaugcccacaauaacuggcauucaagaugcuugguccagugcugggaugccgucaacaauguucaaugaauggcuacauggauuugacacuagaagcaguuauaaguugcugacuuuugagccagggcagaaagagacugucacaguuguguguagguucugaaagucagaaaggguuggaugagauguggagaaggguauaucuggggaccaugaggcuagagaggaugggacagaggggagaccugguggagaaguggagcugaguggagggaggaggcuggcaccugccagucugcacugggcccuauuugcuauauggacugaccagccccaggggaugcccagagcucuggaccugguagucgucugccuggggaggcugaggccuggcagggcccccagcacaucuugcucucagugggccuucaguacuaaucaccuguguccucucuguccuuccuugugccccccccagagccgaaggaugaaguggaggugucagaugauggugagugcagccccugucuucgggucaggcucuugggguggagggggcugagugggggcaucugagacucacaccaacccugaccugugccccacagaugagaaggagcccgagguugauuaccggacagugacaaucaauacugaacaaaaaguaucugacuucuacgacauugaggagagauuaggaucguaaguggagugggaaguugccucugggcucccagggugaggguggugcgggucucacaguuagauucagugccucagcuuccuguugcucccuggggccugccuccuccccagacugagaguccugcaggauccaaaggacugacccacgaaagcaucacucacucacccaggacucucugcagaguugcccaugcgguccuacacugccccaacucugcaaaggcugugggcaaguccuuccuuuucugugccucuguucagagcccaggaccaaaaugagacacagggaggggaauaacacucacuggggccugucaggggagagcagggggugcggggagcagaacauuagggagaagagcuaaugcaugcugagcuuaauaccuagauggugggguguuaggugcagcaaaccaccauggcacacguuuaccuacguaacguacacauccugcacauguacccuggaacuuaaaaacaauaaaauaaaauaauuuuuaaaauaaaauaaaaugagaggacuggaucagauuaucuuuggcaccccuuccauuugauccacagaagucaguguagccugaucagugcucacuguaaagcaaugccugcguuagugcuccauuaaacgcgcagcagucaucaagcucccucaugaacuuggcucgcacugcuuacucuggcuucucccuagggcauggaggauagagugggcucagaccccaacccugagccaagcuguucaucugcccuuacgcugucccuggaggaauagaagaggugggagagaaaggagugggacuccacuuguauuuccagugguuucugggaaaugaaggagugaugcaaacuggguaacagugucagaaagaagucagugccaucacagaggagccccacucuccccucucucagcaguaggaagcaggacccugccugggccaucaccagggggucagugguagggaguggaaggaaggaaggcaacugcucaguaauacucugcauuugggaagggcugucuccacccaucuucauggguuccacugcagggaggggaagagaugccaucagccaaaguugacaguaggcuugucaacauuagaaaugugcuucaaaggccaggugugguggcucacgcuuguaaucucagcacuuugggaggccgaggugggaggauugcuugaggccaggaguucaagaccagccugggcaacauagcgagaccccaucucuaaaaaaaaaaaaauguuuaaagauaagaaaaaacaaaugugccucauugcucuagagcaggagucugggccuuucauaaaggcugauaucuuagauuuuaugggcgauaugccuuuagcucugccacuguagcacaaaagcugccauagacaacaugcaaacagccaggcagggcugugcuccaguaacaccuuacuuauaaaaggaggugggccagaucugucccaugggccauaauuugccaaccccaaguuagcggaaagcuuggcuaaauguggcuuuucucuccucccccuuucauuugcagugggaaauuuggacaggucuuucgacuuguagaaaagaaaacucgaaaagucugggcagggaaguucuucaaggcauauucagcaaaagagaaagagaauauccggcaggagauuagcaucaugaacugccuccaccacccuaagcugguccaguguguggaugccuuugaagaaaaggccaacaucgucaugguccuggagaugugaguggcccacugccagcagcgugggcaccacagggagcccccaaacgugucuccccuacugcccuaccccagccaccucugccccaagauggaaagcacugcagacaggagugugauauguaagaugcucaccagccauacagccaggccugaccaaacagaaccgaaggucugugcacagugcuggcccugagccucugagcaccagcccagcugcagccuugugcuuauuuccaaaacaaaccaguagaucuuugaggacccuggugucuuucucgcccucaucuccccaugaaagggccaaagcuaucccuaggcuccuugguuucauuuggggcauucacaccugaaggugguuuaggggagggacagggcagcuuccugacuucccugugaaagauaagggggccccuggcugggggcuugaaauccaggauggaagccucucucugguccucagucccauccugugucuccacaugccccuggucuacucuuguuuguacucuuuggacuucucacucacuaaagaguggugcuuucccuaugggguuguacaaaggcagggggauuaucagaugaccuccagccaagccuuucgcagaauucauuguuucuucugcaccugaauccuccaccucccuuaccucugagcuguuggugcaugcguguacacacgcacacacacacaugcacacacacacacauacagucaagcaugcacacuggcaucagcaagccaggcaucccccacagcaucugcauucuuaacaguuuccuuuuuuaucugaauuuuuagaauauaugcuacaaucaccucaaaaaauauuaggaaauacacagugaaaagucuaauuuccaccauuauuccugucuauccuuuccuaaacacuacaaccaucaccaacacaaacaauuuuauuggcuuuuaucuguauccuuccaaaguuucuuuaugaaaauauaaguguauacagacacacacacacauauauauauucuuauuuucuugccuuuuaacacaaaaaguaacuucuuauacucacugucauauacuuugcuuuuuuaguuugguuuguuuguuguuguuguuguuugagacagagucucacucugucgccgaggcuggagggcaguggugccaucucggcuuauugcaaccuccgccucccagguucaagcgauccucccaccucaccacaggcucacgccaccucacccagcuaauuuuuguauuuuuguacagauaggauuucaccauguugcccaggcuggucucgaacuccugggcucaagcgauccaucugccucagccucccaaagugcugggauuacaggcgugagccaccgcacccaaccuacuuugcuuuuucagcaaauugcuaugggaguuagucccaucucacuaccuagugagcuuccucauucucacagcucugugggguuuuguuguauagaaaaucacaauucauuuaagcagccuucuuuugauagagauugagugguuuccagccuuuugcuuuuacaaacaagcaucguuuguaaccuuguacacacaucuuuucacucaugccugugaauaucuauaggauaaacucccagaagugaaggagagcuggguuaaaggguaugcacauuugaaaucuuuagagauauugugaaauugcuuucaacauccuugaaaugcucauccugaacuuggggggucucuguccuuuggugagggcucuguuagcaucuuggaauucucucccaggaaaguugaguccaguaagacauccccaagcuguagauaugaguggaauauuagucuuuucucuccccucaugccauuaacauucuggcacacaaguauuuccuuuccguauguguuccuuaggaaaggcaauaguaguuccgaguguaggcuugagucagaugaaccuuacuucaaaucccagcucugcuucuaacuuguuauuugaccuugaguaaguuauucuauuguaccaaucccuaguuuuauuauccauaaauguagauacgacacccaccucaugaacgcugugggauucaaugcaauaaugcauauagggcacagugcucuauaauggggaguuauuguuaguaguaugauacauugacuuuuuuuguauccugguuuuuuuccacuuaaaaauacuuuuugagcauuuaacuuccaacaagguguuguggaacaaauccucccuaguauucaggaagccuggcuucaguuucugcuacuauugagucaugauuuugcaauugucaaauccuaucagcacgaagaaguacuuggauuagaacagucaaucucaagaugccccuuuugguuauaaaauucuacuauuucauggaaccauaaaagacgcggugaagaauuuccauucguaucuuacaaucuacauucagccccaaauucaaauguuccuccccauuuucaggaaauacguagcccacaucugugaccucauucuuuacacccucacaauagccccgugggcugcaucuuuucacauuuauucuagaacagguugcuuaguccaggcggugugggcaugugaggacauguggagaaaugucuuaucuuuagaaguuaaaccuugagcaaguugagagggugcagggagggcaggagucacagggccuggggaaggcuaggcagcagcaccagugggcagaauaccauacuuagcuuggaauugggaguuggcaagcuggauggaaaaagcaaagagaaaauguaagaaagcuucagcuagucuggcuuucaucccuccaccccaugccuccccuguggacagcagcaggucuuccaugcccagauaccagaaaauuugccugcacuugggaccuuggccaggucgccaagaguaggaacuugguaagaacucagucaaccaaagaagaagggaacagguucauacuccaucuauacaucccuuccagcuuaaacacucuaagacuugaccacugagaagggaaagaaugauuuucaccagugcaaugugcuaaccuuguuggauggagaaacugagauuaaaagaaggaugaugccuggggauagaauaauggaaauguauuccagggucccugccuuaaguccaguugcuucagaucuagugggaaauaguaaugaaugugucuucauccuuucugacuucugauuacuggaugagcccccaccauauaguaguuggucugacacagcaguuccuucaggccccuggccuacuugggcuuguccuuuuggaagugcuugggacauuccaggugguugugggacccugagcauugaagacaaugugaaguuuaagcugugucauccauggcucaucucauguuugugcuacuauuagcaaaauuuaucaaagaacguuccagcuggcugccauagggcaaggagcggagggucucgaguccagugauagcaccauuccuucuugcuuccuaugagagcuagccaaggucuaggguuugggggaugaaucugauuccuuaggauagggaucacuuauuuauuuagucauucacucacucaccauuaauuuaagccuaaucuuggcccuuggcauuaucccauuacuguggguggcaguuucugucuaucaaaccaauauuuuccacccauagcauuaaguauuuugaagauaaacccacagaaccauuaauccugccucuuuaaccccuuccaucuuagaaaguugaaccauaggaacaguuuucaaaauauaauaaguauaucugaauaggauugaaccuauuugaauuuauauugaauagguuuccuccagaaaugcagcaggaauuaucuccauggcucagauucccaccacucacugccucagacauucccaagggcauugaaaacaaugguugcuugcuuuuucagaauauuuaaaauuuaaauguaaacauuuuggagcaccuugucugugccaaauauagucggaggcaaauaagggucuagagaugagccugccaccugugauguguucagaacuucaaggcaaagccaacuugauacacaaagugcggagacgaggccauggacauaaggccauggaaagugcagagacaaggcuauggacauaaggccauggaugcccagugagggaaagaucauuccaugugaagaaauggggagugacuuuuucagagggcgugaauuucagcuggccucccaggagugguaguugaguaagccaguauuucucaaacuugucugaucauaaggaugaccuggaguaauuauuacaaauauagauccucagaucucucccaagacuuucuaaaucaaaaucuccagaggaggagcuugggaauuuguauuuuuaauaagagccccaagugauucuuuacauagaaaauugaucauuaauauugagcauugacugugugccagacacuuccaagcacuuuaccuguguugacucauuuagucuuugaagccacccugugaggugaggcuguuuuuaaucugcaucuuacagaugaggaaaaugaagcacagagauguuaauaacuggcugagaccuaagaauacuuguagaugagaguuugucuuggagccuuggcagagagcaauagaaauggagggcauaaggacaagagcgccaccugcaggccauuuggggaccuucuucucagauggguuuuaaaguaugaguucuagcucccuccagcugucacuggcacagacugaccuucuccaguucagcccuuccagaagugagugugugugucacguggcagaggcugugguaugcugggccccacagugcaucccugucucucuccugcaggggucagugacaagauccaccuagcccaccacagcuuaucaaacgauaaguaauaaguguugagcaccuucuguguguuaggcaugauacuuuacaaagccuccuacauuccuaaaaacucuaugaggcagggauagauaaggaaacugggacucagaaagguuaagcaacuugcccaaugucacacagcucauaaaaggcagaagcaggauucaaacucagcuccuuuccucuucgugaggacucucuguaggagaggaaauacccuugcaagaggacaggcccagaacccacccggccuuguucaacugguggaccuacaggccacugcagaaacaugagcuuaugacugggugacagagagagacccugucucuacaaaacauuaaaaaaauuagccaggugcgguggcacauaccuguaguccuagcuacuugggaggcugaggcaagaggaucgcuugagcccaggaguucaaaguuauguugaacuaugaucacagaacugcauucaagccuggaagacagagcaagacccugucucaaaagcgaaagaaaggaaaggaaggaggaggggaggggaggggagaaggaggaaaggagggaggcaagggagggaagggaggaagggagggagggaagagagggagggagggaagagagggacggagggaggaaggcaggcaggacagaaggaaggacggaaggaaggaaggaaggaagauagguagguugguugguuauaggccaggcaugauggcuuaugccuguaaucccagcacuuugggaggcugaggugggauaaucgcuggagaccaggaguuccagaccagcuugggcuccccuccccuccuccuuccuuuccuuucuuucacuuuugagacagggucuugcucugucacccaggcuugagugcaguugugugaucauagcucaacauaacuuugaacuccuugucucuaccaaaaaaaaaaaauugaagaagaaaaaaagaaaagcaagcuuacugauaucugggugcugcauaaguuaccagagagaugcuuuaaacuugcuaagcagagaccaagaaaggugggucagagggcuaggacaggggaacagagaggacucaugcaacucaggcgguggggccaugcauuugcacugaagggcaauaugcugauggcugagaccccggggcagucccuagcagaggaugcaugccuguggcugcagaagcaaaguucacuagaaauagccaggauccaaagccuauccaguuagaaaggauuacacagcugggguaaggaagggguccaagggagaccaguuaauuaugacugcagggaguaaaccaauacuauaggccuggccagaguaagcaaaucugucacagcuguagguauaaugaguuacagccaacuaauuuuagaaaauuugcugaggcucauuauugaugauugaagauauuuuuccguuccuggcuaugcagaacaaaugcuugugggaacugugaguauuuugaacuugaguucccugugacuaaaagacacggcuagaguacaagaauguucccuuaggcauguguggucauuugagggaaagagacuguuuagaggucacucuuuuugcuaagaagaucaugucuggaucucuguguucacacccaccucugaaacugccuaguguagaugcuucccugaguccccagcagcuuagaaggugcagggcaggguucccugaugggaaaccaggaggcccugacccuucucccaugucggaggguggggauucaggaauugcccaucacccccauucccugggcuuuccugccaauuucuccuacccccagccuacccuggccagacucccugccagccuggccuccaugagccuguggccugaccaccccgugcacguguucccgcagcgugucaggaggggagcuguuugagcgcaucauugacgaggacuuugagcugacggagcgugagugcaucaaguacaugcggcagaucucggagggaguggaguacauccacaagcagggcaucgugcaccuggaccucaagccggagaacaucaugugugucaacaagacgggcaccaggaucaagcucaucgacuuuggucuggccaggaggcuggguaaggcucaucugccucucccauggacaccaguguguauugcacuggccguuuccucucacacugagugugagaggaaacauacaguauugggguuaaauccgagaccaugaagacuucccagguuugaauccugccccuaccacauacuagacgugacaguaagccucaaauuccccaucagaaaagugggaucauaguaggaccuaacucacagauuuguuaggaggaucaaauguguuaauauagguaaagggaugggaagagugcuuugcacauaguaagacugcuuagguguuagcuguauauaugaugaugauuauccccuuuuguuuuucacucuggugccauuagcagcaaaagucauuuuggugaugguggcucugcacaucugcaucauacuguacaguuucuagagcacuuucacauaaaaaauaaacccuaugauucucaccaugaggugagcaggguagauuuuaugagccccaacuuguagacuaggaaacaaagguucacaauagcuuugcccaggaggucccacugugagccaggggaugugcugggauuggaacaaggaccccagaccuugcucagggugcucugcagcaccucugauucuuaugcuagccaggagagaggucacagggguaggcggucagggucucaaggccgcccugaaagcacuuugguagaugccugccuggcucacauucugccugcauccagccugccucugcagcccuuugaugucccggugauugaggaaacagcuucauccucccuucuuagccacugcccugcuagcaaggagcccgagggcuggggugagcuggcuuuauuucaccacccugcagguaguagaaaggaggggccaaaugaaugccacccaauaaaugucucccacgauguucagugcuggcugaggcuguguuggucauaaagaggaaagggguaagcaggggcgagguuccgauagacuaugaccggucugguggucagcgcagucaggugagaaacaugccucggcgcugggcgcaugugccugcucugcucugcucacuccugcuaagaggacaggguaggggcaguggcuggcauacagggccugccuuugaacagugaccaccaauaaauuaaacaaauaggccacuguccucaggagucggcagugucagagcccagggaacacaauguccagcuuccacuggugagggauacugugggaacaaccguguccaccaaggaccagauaacugagaaguggcuaaaauguagcagaaagggcugagaggcaggaauuggagcagagcuuucacaucugagggcuguuaaaugcuuuguuuuagaacauuugcugugagcucugcgaaguuaagcaagaccaggcauagcccacagguaccugccuuuugcacauauuaacagacaucucugguccuuuauggccaagagguaccacccugggguugaagccucucccgacuacccuaccaguagcuccugaaggacagccaugaagcugugugaggaguaggagaggcaggagggaggaacggugguaagcauggcucaggaguuggacuaccugggcuugagucccgaccaccacuuguuaaccggguggggaaaucacugcacuucccugggccucacucauguucucaguagcacgggcauuauaccuaccccuuggggugggugagaacccuuguaaagcugccggugggguacauaggacauagugaaugcuagagauuauuauuaagcauaagucacagucccugccuaggggaacuaacucaugagacagacucacaaaaagaccauucaggggcgggugauuuagcggccucuucucccccugcccacccugcacaggacauuugaggugagugugagguuuguugguuucacugguguguugacgcaccuguuuaacaaggaggucagaugucucugugccuguucucugugccaaagccugugucuggccccucccagguuggggucaacacacagauucgggcagcugcuggucucaagcuggcuccgugaugugcuggcaauuuaucccucuccauccugguuucagagaaugcggggucucugaagguccucuuuggcaccccagaauuuguggcuccugaagugaucaacuaugagcccaucggcuacgccacagacauguggagcaucggggucaucugcuacauccugugaguccuggggcacuugguggacugguggaccacuugguggaccagugggugggggcugaggguuccacaggaggguccccaggcugcccugccauugucaugauggggagccccccccagagucaggaggguggcaggcuccccuccuaucccuggcagcccacccugcuccugggcucccagggagucaguagcaugcauauucuauagcaucauguagcuacacaugcuaagauccccauucugggugcucacuguccccaaggcuggccagccuggggccuuuggucaggagggugggaaauguggcuggcaccaaguaauaaaaccucacuuguguggguccacaaagaaggagggcaggaggccaggggcgaaucucugggcauccucauugucuucagggcauagcacuccauccccaaggcacggggaccccaacuacuagccucaucuuugagucuaguauauggaugaauuaauaaacacuauugaugaucgagccuucaaugggacuaacagauaaaagaaaguaacacaguaauuagaacugaaaaaucaggugggaaauccaaagccauuucaaugaacaauaaugcaggagaggggaggccagccaucuaggccggcacuucacaaacauuagcaugccugacucaccuaggcggcuccuuacauugcaggguuuuuguucaggucugggugaccuggaaugccacauuucuaacaggcucuagguuugugaaugugcugguucaacgacugcgcucugaguaacaaggcuugagaacacucugucgguggggucuggcugcuuuagucccugaagccccagggugcggacggucauuagccccugaaccuguguggccacaugcaguuaugggaugguguccccaaagaugcagauguguaugcuuucauucaauaauguuuuuacugucagaacaaaaggaaaaauuuaacauuuucauagaaaaugaggaagaccucuaugaauacuuucuuagaccccuggggccuucagacuccagugugagagaagguucugggcgauucugaugcauagccagguuuagaaaccaguguuauaaaagcuuuagcagaaguggugugaauuuugugcaaugugacuuuuucacaugcucaggaacuuuacucacuauagccuguuaggacaguccccucaguggaaccugcaccacaggcauuguaguccagacaguuauccucuuuccugccugggauuagccccaccaccacagccuuccccagaucagcagaaaaaccccgggccaggugugcauuucccugccuguuucccugccccgcccccucuuggagaaggggcgcugacaagugaagacagcagcuggacuggagcuugacucccuggcucccuagauaaguaaggaacagcaggguagggggcggggccagccugccccuuucagggcggccccaggccugggcagugcuaaccucuggcccugggaaaaacaccagacccuugagaagcaguccuuggucagcucucacuguucagccccagcugcgcuguggucucgcuuggucccagggucccccuccagccgucauggagacuugccuuacuguuuauucuucaguggguuuucccacugccguggcaucaggaucuucugcagcuacagauuuucacauaggaccuuguuugaugcucacaacaaacccaagaguggaucauggcagggauuccaucuucauguggcguugaggugacaggggccaaggaagcccacguggcugcccacuucccacagucgggccaggggaccagucgucccagucugccaggauacaggacuuuuggugcuaacaugggaacagucccaggcaaaccaggacaauuggucucucuacuggucagugacagagcagugacuagacugcucacuaaguuuucaccuguguaaccucuacccggaucaagaaaccaagcacugccaggcccccacagcccucuggcaccccucccuguuaccaacccccagaggucaccauuacccucaaggcuaaugucaaugaaaucauacagaaagaagugucuggcuuuuuuugcuugacaucguuugugagacucauucauaguacuaugugucauuguagacuguuuauucucaguguuauguaguaucccauugugugaauauaauccaguuaauuuauccguucugcuuugauaggcuuuugaguggguuccaguuuggccauuggaagcauucugguucacguguuucagugaauauauuuguacauuucuguuggauauauaaucuagaacuagaauaauugggucauagggcacuuuauugucaaaugagaguucuuuucgguggaggaacauaguaauuugggcacuauguuaccuuguuuaccagauuacuuuuaaagcaaagaccaagaacuagggcagaguuuuggaaauggggagaagauaguuuugaugcugccagugcuugggcagaggguugucaggagggaggagggguguguguguggcaaggacccaggccagguggcacugacucaggcuggaucaauccugugccacaucuuagcuccuggacccccacugugagccacugcccucuggggcuuuuccagccuggcucucucagcauggauggaagucagggaguucccccggcaagccagggcucucaacagagagcggugcugaaaacaaacauuggcgccaaggagaugguuuccuuuaagcgccugcuaugcagaacucuggagccacugcugggagcacccaaaagaggcucucugguggcccucauggcauccucuggcccacucuaucccucucuuuggagccuagucaucugucgggcagucccugucagggcgacuuccaccuuuguaccacagagccccuccuguucuccuuucuggggccagugagagauggagaggccagggaguuggaagggaaggcaacagaccgugucaccauaggacgaugugacuuuacucucucccacccagcccagccaucagggcaguuucuggcccuauagggaaggagcagaauggggucguggagcccccacacucuuaccccggauccugaaaggagauaguagguugugugaguaccuagagaccuucugaaguuagcaauacccaugugguuucuggcaggaagugagaauaccagagagcuggaggccacacuuccauacgggagaaauccuaaguccaccuccguuuaagagcccuccucccccugcugucucccuccccuacuuccuggacuugguacuuccuugcugccuguggggaggccacaacagcucuucuccgagcccuucccucacccuacuccacaaugccuucucucccagccucccucaagccagagcgaaccagcaauggcugcucugcuuccuccuccugccucuuccugaccaggcccagcagcacagccuucccauucaugcuuguuuguuuguccaacacccaccguggugcagacagcugucagcugucccuccccacccugguguguggucgggagaugccaggagggaggagagguguguaugguggggaggcaggucagcucuucuggugacagcugcccagucagcugaggaggggucacagugccggggcaucgggggccuccucagaccagggucugacugcagggcuccucagccagauccaguaaccucugccuuccccaccuggggcugccgcugcccucucugcugcugagccuggaaauacgcucugauuccagcccuaggaucccuguucccucuccaagcccggccaccaccuucaacuuuuacuaacacaacuaaaccccaggucgcugcuuccucggccaguccacaaaaugaugcacagcucuuccuguggaccuacucagcccucucagcucucccaccagaguaucagauggcuaauauggauaaaagacuaaccccuuccuagcagucaguaguuccaucagcagaugugugguccccuuagcuggccacugguacagucggggcaucugucugcugcuugaaacacaacacagaagccaggugcaguagugugcaccuguggucccagcuacucaggaggcuaugaugggaggaucacuugagaucaggaguucaagaccagccuggcugauauagcgagacccccauuucuuaaaacccacacacauacacgcacacacacacacagaaaguguaguccaagaggcauuucugcacccucugcucuccuaaccuucugcccccacagccaaacaggcuuccacaucagauucccugggggaauuucuuuggcaaugagcugagaauuaagaaauuagaaugcccugcauucaugaccauuguguuucaucagcacaaagacuaauauuugaccacuaaaaaucaacauguagagucuggcuguacuugauacauccagugaagaaaaaguaaagcauccaaggacuugcccagacugauuauaguuuugugaaaaacagaucaauccauuaguuaaaaacuagauaagaccagggagauaaagagguguuuuaaugcuaacauuauuuguugaccgguugauuuuuuuaacaaauaaugacuguuaucuagcugggcgcaguggcucaugcuuauacucccagcccuuugggaggccaaggugaguggauggccugagcccaggaguuugagaccagccugggcaacauggcaaaaccccaucucugcaagaaauacauaagguagcugggcaugguggcgugcgccuguggucccugcuacuuggguggcuuaggugggagggucaccuaagccuggggagguugaggcugcaaugagccaugaucacgccacuguauuccagccugggugacagagcgagacucugucucaaaaaaauaaaaagaaauaauaauaaugacuauuuuauaaauaaaaagacaaggcugggcacaguggcucaugccuguaaugcacuuugggaggcagaggugggaggauugcuuaagcucaggaauuugagacuagccugggcaacauggugaaaccccaucucuaccaaaauacaaaaaauuagccagguguguuggcgcgcaccugugguuccagcuacucaggagacugagguggaaggaucgcuugagccagagguucagugagcugagaucgcacuacugcacuccaaccugggcaauagaacaagaccgcaucucaaaaaaaaaaaaaaaaauuaaaagacaugaucccuuaugcaaauucugccacaaagaaaaaguuccccaaaaagguuuuuaaaaauccuguaaaaccccaccacccagcaacagcauuacugaaaauucaaacacccucuuugucaacaugcuguguauguauuauauuuuuuauuccagacacaugcucuuuaauaggaagaaugcugggggaacuugggcaggcaaggagccaggcagggugaggagaguauuucagauggauaggcugccaggaaggaggagugccagaggccagaggcgaggaggcucucccugacugugcccagaguugcagagauuaagaccuaucuuugcaggauuauaguuccuaauaaggaagggagguuugcagaaggggaacuuucugcauuccacagcaggguuguuugcuuuuccugccaucuuuuggaguacugccggacuuccccccucucuguuuccaguggaaaauguaaagaagcagcagguggcugacaggcaagagacaggcugcuuccugauggggcuugcaugggccacgugggggucggggucacagagacagagagagcugggaggccccuaggaaaucuagccuaguccccuugauguauaaaaggagaagcuggcuaggcgcgguggcucaugccuguaaucccagcacuuugggaggccgaggcaggcagaucacgacacgaggucaggagaucgagaccauccugacgaacacugugaaaccccgucucuacuaaaaauacaaaaaaaauagcugggugugguggugggcaccuguagucccagcuacucgggaggcugaggcaggagaauggcaugaacccagggggcagagcuugcagugagcagagaucgcaccacugcacuccagccugggcaacagagcaacacucugucucaaaaaaaaaaaaaagaaaaaggagaaacugaggcccagagaggggaaaggagcagcagauaacagugcagacucggggacagguaaaugcccacccuucccucauggggacaugaccgagaaugauucucuuugccuucuuaaaacauaaaucagggucuugcuuuaaaaaaaaaucccauccacaaagaucuauuauucagaaacacaaauauguugauuaggaugagacaauucacauuguaaaagcuuucuucucuuuacaaaagguuucaccagaggguuccucccauggcaagcuuuuucucccaauauuucaagugggguuuguucugucaaacucaaccaaagccuuacuccugaagcugucagugcuuggcuuaugaugauggauucauaagcauuugggagaagggacauugguaaagcccuaacuugacagguugauggcaggagggccccagacccaucucucuuuuuuuuuuuuuuuuugagauugaguuucgcuuguugcccagguuggagugcaauggugcgauauuggcucacugcaaccuccaccuccaggguucaagcaauucuccugccucagccucccgaguagcugggauuacaggugcuugccaccaugcccagcuaauuuuuguauuuuuaguagagacaggacuucaccguguuggccaggcuagccucaaacuccugaccucaggugauccauccauuuuggccucccaaagugcugggauuacaggcaugagccaccacgccuggcccccagacccaucucauggggcucagcugagaucagggcaggaacagcuacacaauuugcaacaugaaagguggggccacuuguucaaaccuuauugagaaucuugagacgacagcagcagagcauuaaaccaagcacagggccugucuaagggugggacugugggcaacugugcuggucuaacacccaugaggcugacucacaaggcccucaugaacaguggggugaguuguugcuaugaaggugaggugcacagaggugagagguaaggucaguaagccacaaaucugcucuauuuuguuuugaaauucuuuaccuuauaaaguuuauuuggcuuaagcugcuggucacaaagucauuccugcacucacagcuugguaaggcaguggagggaacccagcagaacugcaugagaucuccgggcauggaccgccuccuuacuguggaccaggccuggugccagugcugaacacugcaauuuacuucaucuuuacagaaauguuaggauaguauagcauuuaagaggacaggcucuagaggcagauaccuggcuuccaaucucacuggcugugaaucuuugggcaggugacuugagccugggcugugccucaauucccucaucuguaaaacaaaguuauaagaauuacuugcaucauagggcaguguuaagauuaagugaguucacuuguuuuaggcacuugacccagugccuggcacauagaaaaaccucaaugaaugucugcugccaucaugaugaugaugaggaugaagaagugaccacccuauaguuaaauggcagcuucuccauuuuagaggagaaaacugacacagaucagggaauuguccaaggccauacagcaagcggagaggcugcacucuguccucugccauggcaccucauagggaaguuuucuaguuuggcauaaaugccucaaguuccccgaaccuacauugcugauucaaaguccaucuauccauugggcacacacuucacuugcugagccucucuuauuugccgggcccucuucuuggagcugaagguguguggagagaggugggaaggaggggacagaagggugcaguggugaucacuaccaugugcccaguccacagagagggggcaggagcacgggaggaaggggcuuggagaaggcucuagccugggcuuuggggaauaauagaaaaccaggacagagggacuuaucagcccugccgcguacccugcagaagcccguaaucuaaagccaaccugcugcaccucagccucacagguagguggugucaagaggcaggugaccaagaaaagacagggcugugaaccacacccucuuuucuuuccacaaguggaagaaaggcaggugcaaggcccacagagcaugaguuuggggguggggaggcuggccgacccucgccuuugaccucaguuaccacucaccuggucgucgcgcccucuccuagccacaccugcuguccugcucuugucucuccagagucaguggccuuucccccuucaugggagacaacgauaacgaaaccuuggccaacguuaccucagccaccugggacuucgacgacgaggcauucgaugagaucuccgacgaugccaaggauuucaucagcaaucugcugaagaaagauaugaaguaaugaguugggauuucagucuuugcuucccuacucccugcccuguguugggaagcaaagggggauuccuuugccuguuggggugcccuccuugccaccccgccuugggucguuccuagcauucccugaggaagggagggugggcaugguaagagacccgaaugcauguggguuggggaggcgacuuccuaggcccugcccccuggagcuagacaugggauucaccuucagaggcucagacaccugacuugaaaagcgacacuugaccacguuacagagcaaggggcagcuguucugugugaauaaugaccacccuucuuauuuucuggguacaguuguggccagccacagcccucuucaggggcugcaggggaaggacccucucaacaagcaagagcagaggacacgggcaucuuagaacuucucugugggucccgaucauauccccagauuauuauuauuauucuggcuuaguguuuuuuuauaucucaguuauuuaauaacugccugcuugaauacagccagguacguucuaacaucuggccaaagggaggcuaugaucccagaccacugggcuuagcccucucccagcuccuccucuguugagguuccccaccugugccugcugcagcugugaacauaggaaagugaacagugggaggucagcaugcaugggcuguggggaaaggucaggcacucaagcccucuggguuucaguagaagauuggagcuuggaguuguagaggagaccagagugggagguuggcugaaggugggcagugggugugccuagacagaaucuccuggaaggaacuguccugggcucugcauguguagggagagcugcccagggaaagggagcagugggacucaggugagaacagcuggccuauugggcagcucacccacucugcaaauaggugacuagaugaggcagggccugacuguaggggugccgaggagcuuggagcuauacuuggcaaucccagggagcaguuguagccuugccaagaagggugguguugacauggguggcgugcuagagagaaggggaggggccuggcuccagggcgggcaggaggcucugcacucccaggugacuuugcagccuugcggggcugccgauggcuccccugaggaagaauggcuguucggggcaggaaggcacaguuaguugcugaaggagcaauauuggagugucucagauggcucugucaggcuuuccugugaugcaccccacucucaguccuuuuuagccaguucagggccaaacucccccagaggccacauucuacacuccuugacaaugagaucuuuuuagccuuuugcugucacagucuguaucagaaaugggcaugacccaaggagaacugagauacugugggaagucuaaauucucuuccaauaugagggacccccacacccaaggugccucaggagauggaaaccuccucaguaacucugguacaaggauggcuuuugucauccaagcuuuauucacugaagauuugguaaacaagguauuguguguguauauaucuuauuuucucaucugaccuugaauuaagucaguaacaggcuguacuggaucccucugugcucauaaaauggauucaccaaagaacugaucuuauucaaauagaucaagacacuaaauucccauaaacucuuauacccagccucucuucaaccagaaaucaccaccuaucagcacuuaaaaaaaaaauuccuuccuacuauaaaaauaaugcaugaaaauuauagaggauuugaagaauauaauaaaauuuaaaucaucuauaaucccuuuaucuaaaguucacuacauuuugcuauacuucuuuccagucauuuuucuauguauguuagcauuugguucuuuaggcuuuccuaguccuguuacaguuaaggcaauggcucuaaaauguuucuagauccccagagcuuucagaaagaugaagugaguuucagcgcaguucuaaaguagucauaauucauagguuauaggcaggaccuacuucuuugaguuguaauggaaaaaccugauauucaacaacaccguaagacauuaaacaugaaaguucagugauugucggagauuuuauccuaggauuuaacucuccccuccuccagacaggguggcaggaggauuaggcuuugugggccccagcccucaugagaggagcagaaugacgccacccuggaauagggugccagccaaucccagaaacgucugcccugcagcacuuacucuuccucgaucccaagagcaggccauggagcccagucacuuccuuggugcuugggcuuucauuaacaccaacccaugcugguucugguuagugugacccagaccaagugaggagaaaggugaagagcacagugauccugaucacgguggaugguccgggagcaggggcccugggcucugcccucaugaccagggacagguggccucccauuucugaacuaaccaguggucucugaggucuccuccugcucaaaaaucuccugaucucugccucugucagaaaccgccuggacugcacgcagugccuucagcauccauggcuaaugaaagauaccaagaacauggaggccaagaaacucuccaaggaccggaugaagaaguacauggcaagaaggaaauggcagguaaugagagggucacuuuggacugggauguugccccucauauuuguguuguucaagccacuuucauucccagcuugcccuggccucacaccaagaaaguuuaaauuuauuucugaaguagucugggaccaauuuaggcagcugauuaagguacagugguuugcuuaguccugagugcagagucccuuucucaaggagaugggauggauucuuagcuuagcugucucucuguuccugcucaccuuugccccaggggaccguaaacccuuauucagauuaagccaaugacauuuugugucuucauggcuugggaugagcaacaucacuuuaagguccauuugucaacccugagaauggggugguaguauggugguuucacauuucuuuaugaugaaggagggcacaugaucuaaagagagagacauggucccaccaucuaggaagguuguauguuaauagccauguguccuuagcaaaugauguaaccuugcuguggauuuuucucaucuauaaagcggggauaauagugguaccaacuucacagcauuguugugauaauuaugagaauuacacgagaucauccucauguggccuuuaguaguacaaugccuggcacauggugaguguccagaagcgaucccagucgcuaauagguaugaagguaggccaucugucagggaccauuuaaagcacuaucuaugcacuaaaucuuuuaacccuaggaggcagguacuauuauuauccccacuuuacagacaaaauugaggcagagaaaagguuaggaaagccauccaggaucacacagcuaauaagcagaagggucaggauucaaacccagagcuugacugcaaaacacauagucuuaaccccaagacugccucugauaaaaggcauggguggauaaaauuauuauccaaaaccacaggauguuuuucaguuuaucaccaucaucaccuauuuuaucauuuuuauuaccacaauuagaauuacaauucuuuuuuuuuuuuuuuugagauggagucucgcucuguugcccaggcuggaguacaguggcacgaucucggcucacugcaagcuccaccucccgggucacaccauucuccugccucagccucccaaguagcugggauuacaggcgcccaccaccacgccuggcuaauuuuuuguauuuuuaguggagacaggguuucaccguguuagccaggauggucucaaucuccugaccucgugauccacccgccucggccucccaaaguguuggaauuacaggcgugagccaccacucccgaccuagaauuacaauucuuaggcugcuggagaagacaugguuucuuuuuuuuuuuuuuccucgagacaaagucucacuccauuacccaggcuggagugcaguggcacgaucucggcucacugcagccucugcuucccagguucaagcaauugagaggacaugguuuccuuacucagggacuacguagugcaauggggaacugaagcaacuagacaugaaaggauguaacacgcaccaagauguauaaacuauccggauaguucuccauagccauggguguguauggauagaacggaccuggucgcaaccagaguuggaugugauuaugaggaaaugcucccaggugcaggaguuugaauuagguguggaaccucagucagaauacagagaagaggacugcacagguggaggagaaggcacagaggugggagccggacccauuccggcugggcuuggcuggacaggagcagagucuuuuagcuggauacucaagggacccaggggcauugagacuuugccuggguggcaaagaaaagggaaaucacuguguuggaggcaacuggaacacuggucauuuaccacaccaggugacuaaaucacaguugccucagaaaguagagugucacucagagguugaaagagggagcaaaggcgaaugggggccacaaguguggaguuuaagugaccaccauccugagcacauaucagcugugcuccuccaccauggaagucaguuccuggcuacaccccucaugggaaggugggucuccaggccucccucaagugcaaggugaguugaaacaucuguagcugcuuaccuuuuggugccacuaggaucugaguagcaaauauucuuuuuaaaaaugugggggaggaucuacaaagucaaagucagcuguauuaauaauccuguagccagcaggucucaaagaaauauuucuggaaaggauagggaagcugaugucagggcggggcaguccucagagcagugagucuaaguggauauugcuuggcugaggcuauagguuaaggggcagccuuaucaccugggaacaucugcagaugaacuaaagccaggaggaugccuaaacccaggggcuaggagcagagaagagaugaggaaacaggagaggaggcaaagggaauuuuucaguuaaaucagucagggaaucauaguggugcugauuuuuuuuuuuuuuuuuaaagagacagggucucaugcugucacccaggcuggagggcaaugguacaaucauagcuuacugcagucucaaccucgugggcucaagcaaucuucucgacucggccuccugaguagcugggacuacaggcauaugccaccagaccggcuaauauuuuuuuuucuccuuugguagaaacagggucucacuauguugccuagacuagucuugaacuccuggccucaagcgaugcugcugcguuggcugcccgaaguguugagugcccagccuaugcugauauuuuaaucaauuuuuuuuucuucuuguuuacggcauuauuagccauaggguuuucuggaagggcgggggaagaaaaggguagaauucagagaaugaaccuuaauuuuauauuuuaguauagauggcgacauuuggaaaugauuuuuccacaaaauugcacacaaaaguuguccacaaaaauuccauucaacaaguaguuucccugaagaguagcuucccugguaacagcucuaaccauuucauguuacguugcucccucaggaaaacguuuucugcauuuuaacugcaaucaccagggccuuagcuccccuuggaauaugaggguucccucuugcagcagccaagguucugugcagugggguggagugggcugugggcgggggcagagggagaggggaagaucaggcucagguggcccagaacucucugcagcugugccagagaaggcaccuucuuguuauucuggugugguuuucauaaaaagcccuagaaggaaugaagugacaugggaacaaaucccuacaagcaaagcuaggcuggguauagaugacuaaucauauuacucaucuuggaaucaaguuauuccgaaagaagguauauuuuaaauuuauauuaaaagaauuuuacaaagauauguuggaaagguguagcaaugggggcagguagguugagcagauuaacaggguuuccgcaugcacacuggaagcaaaagacuagacaucagaggcccuuagguagccaucuuuauuuucugggaaccauaaagaccccagcaguauggaccaagggcauuaggggagaaaacacuggacucaguauagcacggaguauucuuggccaucccauuuggaugguaugcacugcucaggggaaacuguagucuuggggcuacugguauauauggggggcuuugauggguaaccagcuugcuguauguaugucagggaaugucuuaguauuggugccaaaagacccuaauccugggaaacuccacaagccugccugggcaagccaggauggcuggccccacaagcucuccaaggggcagggaauuugugcugcaugaaggaggcuggugcagauacugcucaccagcgacacaggaacccagccugggcaauugcccucaagcaagaaaaagggagaaauuacaaaaucaaaacuuggcgaucuugauguuccaaaaauuuccaaaggucuuuggucaguaaagcaacaaccaauugucagcucaaaggcauaaaacuggaagacuagaacauacugauauauucauuucuaguucugacaaauaacuuccucggcaauuuuuuuucacaaaucaauucccaaauauuuuucuauguuuuagaaauuauaugcuggauaucuccaucuuuuagaaaaguucucccuaugugagacauauuuauuuguuaauauauuuacuacuuccucugaaauacuauaacucuuuuguuuccucauucugauagcuucauuuuagucauuuuguuaugaaauaaaaucuggaagaaaaaagacaucgucucgccacaccacacaggugaagacaguccucaucagucccaauccugaugucuggaauuggggagcccaugggcucaaggcggguguuccuugcuacacauuuauggauauaaaccagagucguucuguagaggucuggaacugcaggaagauuagaaucuucugcucccaggcuacugaggcccagagaggggaacugacuugcacaaggucucccagcaauuaggguuagagaacuaaccugucccuuguugggaaugaacccucuggguuuagaggcuccuagcccaggacaaaccaaucuguguuggauaaagggaauggagagcagagaagggccgagucugagaaucggguugauuaggaagcaggcuggucugacauugacuacguagggagggcugccauggcugguaccaccucuuaccuguuccugagggcaggguaaccucccaugggaagagcugggucucucucucucuacacuuugucuagcacaacaaacagguugaaccaguaacaucucccagaagagcaugaaagguugccacguggccugagccugcagaggcauucuccgcagggccacacggugguucugcgcacaguuaaguuguucaguuuucaucucucaccaucuuccccuccucaucaccuccaccuggggcugcguggauucuguucagcgacccagccucacugugguggcagaggccagaaacauacccacaccauacagugugaugugugugagaagggauggccaggggacagagcaaggugaaaugucuguccaaagugcaugagagcagucugcagcaaggauggcaggaggcaugacaguaaggucaucccgcucacugcaguaggucuccucuuuaaccauacacacacgcacacaauuuucuguauguuuccuuagcacccagaaguuauucacuuucaaaaugaucagucuuuuuacugaagcuuacuggcuuuccaacuaguccuaaauugugaggcuuuacugaaguacuugagcaugugaagugaacugaggaggaaaauggcuuugccggcagaguuugagaugcaacgaguacaagccauuugccuaugaagaggcuguuuccucccucucucagggaggacaaguagccagucuguggugacaucuguugucuagaugcacagcuuuucgaugccuaaaaaagaugcuuugggugcagggguggaaagacuugguugugccuuaguuuucuuaucuuagucauuccuguuaaccuuagaaaaaaggugaaaaacuuacugaaagauaagaaacaauaagacacaauuguacauuauuagggauccuaugcuugguagaauuuucgcaauguaaauaaauuacaucucaaguucugauccuuuucagcagaaauucuuuccucucccaagucuagucacugagaagcaaagugccguugccuuuuauuucuucaaugcuucuuuuuggugccugaaugcacaccaaggaagagcuccucuccagagcuucacugcaucauagacuugugcaggggccagccagaguguuucucaaaaucuuuuaagucucugaauuauaaacagagcuaaaugggaccuuggagaucaucuuguccagcccccuccuagagaaggagacugaagcucagagugguuaagugacuugcccaaggucaacaggaugcuguguuauuauuauuaugauuauuuuugcaucaggacuugugggaucuguaguaacuauucucuuggccaauuauaaucacaucacuggcauuguuuuacgagaaauagccccgcuaggcccagucagcaauaagucuuuggagcugucucagccugcaguugcuuuauauaaaccaucccuuuuaugggaguugaagcacuguaugaaaaggguuuuugucucauguugaccuuguuuagucacauuaacgcacacaucaguuccaggccccauuccauucucugaacaucuucugacacacugacagugcugagcagagcaagguuggguucgcuccucuggcagaaccucggcucucaggagguccuuguuccagggaacagcugcuucucuggggcugggcucuacucccugcagccccucgcacuacccagcuggaaccagggacaacgccugaguccaacccucgugucuauuuuccagaaaacgggcaaugcugugagagccauuggaagacuguccucuauggcaaugaucucagggcucaguggcaggaaauccucaacagggucaccaaccagcccgcucaaugcagaaaaacuagaaucugaagguaaggaggaguuucuccagccagcuggugagaaagaaagggcuggggaacaaaggggcauuuugagguuuugguugguuuuguucuuuuuuuuuuuauuuuaauauucccugcaaggauaaauucagaaguaauuuuggguugcccugacaauuacuaagucuaauaauuauucuuaaucguuuaacuuuaagcuuaaccauuuucggagggaaaguuguuauuugucuaauagaacuagaugaccucagcuaugcuuuuucauauauuuuguguuaaaauuaacaaagauuguauuaaaaucuucuuuuguucuuauggcaaaagugauauucuauauuaauaggcaaaaauaacauuaaaauuacauguaguuguguaagauuuauaaaauauucuauuuucuaccaucuuugugguuuuguuuuaaauaaaaauuaacucauaugguccacauucuuuggcauuguucaugaugcugaaucgugucauuugaacugggcagacugggacuggcaggucuccuccuggagacuaauagggucaguuacuugcucaccaucuuagaugcugucccguccaucuccucagugaaaaccccagccuuuuccugcuucaggugcaugcagggccagacccuuaucucauuuggccagagacacccucugucccucccugccuggugcuuuuuguauccacaggugagaaucugaguuuagauucccuuggugagcaaagguaggguuauuggugaggccagcaacugccugcucuggagcuuccucacagccagggauagagacugcagcacacaggccuggucccuccugagccacuucugccccuccucagaugacccagacauagccugaagggaagggaggagauacaggugucccuccaaguuacagcuuuucccugaaccaaucccacauccugguccacagucacacagcaugaaggcagugugagcauggagaaagagccacuggaagcuaaagaugcggcuaggaccugacuccucccuuguaaaaagcagguggaacaccugcugcagaaggaaggcagagggauaccaagacuaggaaggcugaugagguccugcccugcucagauacccucagcugaauccuaaagcagcaugaaaugcagccagaaauccuuuuuaaagaugauuuccucuuucaacaugucagcauaaggggaagggggagucugauccuuccucagcuugggcacaguuccuucuucugccaaaaaccauuuggcagcaggccaaccuguccccaggagaaaggcgugcuuaugauucaguucucaaagcugccuucuuugcuaaaucauagcaacuuuuuuaaaaguuaguuucuuuaagcuagaggcgaggcgagaacaacgagugaagaaaugaccuggucuucuucucugucuucuagaagaugugucccaagcuuuccuugaggcuguugcugaggaaaagccucauguaaaacccuauuucucuaagaccauucgcgauuuagaaguuguggagggaagugcugcuagauuugacugcaagauugaagguaaguuguagcugugcuucucuucaccaugaauaggguguggcuggaugguagagucccuaccaugcaccgugggcaagaagucaguucugugcagcuggggacaaugaggaacugccaagcuuugggggaaacugggucagcaggagcugcucauaaagggcuaugcccugcacucccaccuccugaagguguguccuucagucacuuccccagggggcacauuugaaauuucaccuacuuacaucagccacuagaccuaaguuuagaaauggccuugcauggacuuaccuggcuuuggaacaugcuuagugaaaugagcuuugcaaacugcugaaaagcaugugacuugcccauaugaggcccucaaaggaaggcuggcacaaaggcauaggauguggaaucggcaggcucugcuacucguccacaggcugugugaccuuggauggugguccaacuccccugaguuacggucccucugcuguaagaugauagcuaagucacggaguggcucuggggauucugugaggggacauaugugagaagggggaaccuuuuagaucuuguaaagaugucacagagcaaagggaaaaguugugggacuggcagguacagagagagugcaugcauugugacuucagacugaggccaguugggagccaggcacccgggacaaagcacucagccggcaccaucuuccccaggcugcuuaucugccugcugggaauaaugcagccacagaccugucaguggucagagcucaagggaccuuaaggggucauggcauagcaccugagaaaugagcaaaguugaugacacaaagcguuuccauuuucauauagauugcaaccgucuagaaagagaagggacaagauaagacaggcucuuugcuucaagucugugacuuucaccugccaaccagggugguggguuaucacccauuuuggucugaccaaauaaagcacagaaguuuauuaggcaacuuucccgaggccgcauagcacaguacagcagucaaaacaaacugugccucccacuuucuuugauucuccagcaaugugacuagacaaugccuuuugaguaaaauaacccaaaguuaggaauggaaaaaauaguuuuucuucugcaucuuuauauuaucaaagugccuuaucaaugcuucgccuaccauagucauuuuccuuuccucacucaauuaaaagaaaguggaugugcugccuuugauaaugugaaaauucucggacuggggauucugcugaaggcucuggagccacugcuugcaauucucaccauuaccauugcauuugggucuucugaaguuucuuuuccuuuuugaauguuuuaaaauaacauaaugauuaucauuuuguacuuaauuuucucuuugggauuguuucguacuuaauuuucucuuuggaauuguuucauugauauuuauguaacuuuugccuggggcucugaugagaaauuaaagcauauggaugcuguuuugauaaaaacaaaauugaaacuuuugcacugagggugcagggcaugggaguggaggguacuuuaugaccagcucuuccugacccaauuuuccucauggucuggguguuccuaauuacuucgaaaaaacaauuucuaaaauuauuuugaaaaaacaacauugaaaagaacauuagaauucuugauuucuuauguauaauuuuuauucugguuagggcucauauuagccuguuugcauugcuauaaaggaauaccugaggcuggaaaauuuauaaagaaaagaagcuuauuuggcuuggugccaguaucugcauccagugaggccucaggaugcuuuuaaucauagcagaagcaggcaugucacauggcaagugagagagcgagagagaaggacgugccacguuuuaacaaccagauccgcaugaaaugacagagcaauaacucacccauuaccucgggaagggcaccaagacauucaugagggaucggccuccaugacccaaacaccucccaccaggccccaccuccaacacuggggaucacauuucaacaugagauucaaggggcacaaauauccaaaccguaucagggcuacaauuuuuuuccuauaaaaauacuucaccaacauuuaagagaaagucagguggaauauauuguauauuuuuaaauguauguauauauaugacuuuaaaagcgggguacauguauauacuauguaccugcaaacaaaaugcauaauguugguaaugcuucuguacauauauauguacacauacacauuaaauacauauaauauauauuuuauaugcauguguauuuuauuuuuuaaugcugaacuuugcagagauaugacuaaugcauaaaggcucauuggugagguccauuuccaauuguccauaggcaaauuaccugcuuuggaucagacuaagacaaauauugcuuucuucuucuuagcaauauuaucagcucuuuuaaauuauguuuuauauagcuguuauuagcuuuauucaguuauaauuuauauacuauaaaauucaccuauuuuaaaugcacaauucaauuauuuuuaaugaauuuauaccacaauccaauuuuagaacauuuucaucacuccaaaaagaucccuuguucccauuuuguuuugacucuuauuuuucauuuaaauuauuucacuuaaacuauuauacaaaauugaaaauuuaggcugggcauaguggcucacgccuguaaucccaacacuuuggaaggccaaggcaggcagaucacuugaguccaggagaucaagaccagccugggcaacauggugaaacccuaucucuacaaaaaauacgaaaauuagcuggguguggugguguguaccuguagucugagcuaugcaguaggcugagguggaaggaucacuugagccuggacauuggaaguugcagugacccgagaucaugcugcugcacuccugccuaggcaacauagugagacucugucucaaaaaaaaaaaaagauagaaaauuguauuuucggccgagcacagguagcucacaccuguaaucccagcacuuugggaggccaaggcaggcagauuaccugaggucaggagauacagaccagccuggucaacaugcugaaacccugucucuacuaaaaauacaaaaauuagccgggugucguggcgugcaccuguaaucccagcuacucagaaggcugaggcacaagaaucacuugaaccaaggaggcggagguuacagugagccaagaucacgcuacugcacuccagccugggcgacagagugagacucugucucaaaaaaaaaaggaaaaagaaaauuguauuuucaaucuaagaagguauucagaucuagguguagaguuggaauuggagcaguauuucagguaguacucuauuuuuaauuuuuauuuuuuugccauguuggccaagcuggucuugaacuccugcccaccuuggccucccaaagugcugggauuacagguaugagccaccaugccuagccucagguaguacucuaugucuguuuaaagaugggugggugugguggcucacaccuguaaucccagcacuuugggaggucaaggucagaggaucacuugagcccaggaguuugagaccagccugggcaacauagggagacccugucuuuacaaaaaaaaaacuuuuuaaaaaauuagccaggcaugguggcauguaccuauagcuccagcuacuugggaggcugagggaggaggaucacuugagcccaggaaguugaggcugcagugagccauguucaugccacugcacuccagccuaggugauagaaugagacccugccccccuaccccccaaaaagugaaaggugugauguuuaacugagcacggucgcucaugccuauagucucacuacucaggaggcugagaagggaggaucguuugagcccaggaauuugagcaacaguaagcuacgaucaugccacuacacuccagccuaggcaacagagugagacucaucacuuuaaaaaaauaaaaaaacuauuaaauaaguuuuuuaauaggugggauguggugcuaguccaacaugugugggaaauggaacaacuuuaaaauauucuauuugggguuucagauauugguauuuacaagacauguccauauucuaauguagauaucaaaacagucgauaaaggccaacaucaaaauuuucuccuuaaccaccuuaaucaauagugguagcuuacaaguugcuugcaugaguugauaagaaauuuugaauaacaguuccugcaacuuguguucucucccugugaugcaggauacccagaccccgagguugucugguucaaagaugaccagucaaucagggagucccgccacuuccagauagacuacgaugaggacgggaacugcucuuuaauuauuagugauguuugcggggaugacgaugccaaguacaccugcaaggcugucaacagucuuggagaagccaccugcacagcagagcucauuguggaaacgauggaggaaggugaaggggaaggggaagaggaagaagagugaaacaaagccagagaaaagcaguuucuaagucauauuaaaaggacuauuucucuaaaacucaaaaaaaaaaaaaaaacucaagauaguaaaagcaccuagugugauagauuaucgguuaggucauuuguggguugauucuucagaaacagcaguugauaccuagcagcguuauugaugggcauuaaucuauguuaguuggcaccuuaagauacuagugcagcuagauuucauuuagggaaaucaccaguaacuugacugaccaauugauuuuagagagaaaguaaccaaaccaaauauuuaucugggcaaagucauaaauucuccacuugaaugcgcucaugaaaaauaaggccaaaacaagaguucugggccacagcucagcccagaggguuccuggggaugggaggccucucucuccccacccccugacucuagagaacuggguuuucucccaguacuccagcaauucauuucugaaagcaguugagccacuuuauuccaaaguacacugcagauguucaaacucuccauuucucuuuccccuuccaccugccaguuuugcugacucucaacuugucaugaguguaagcauuaaggacauuaugcuucuucgauucugaagacaggucccugcucauggaugacucuggcuuccuuaggaaaauauuuuucuuccaaaaucaguaggaaaucuaaacuuauccccucuuugcagaugucuagcagcuucagacauuugguuaagaacccaugggaaaaaaaaaauccuugcuaaugugguuuccuuuguaaaccaggauucuuauuugugcuguuauagaauaucagcucugaacgugugguaaagauuuuuguguuugaauauaggagaaaucaguuugcugaaaaguuagucuuaauuaucuauuggccacgaugaaacagauuucaacugauaaagagcuggagaacuccauguacuuuggaaucuccuccaagauagccagaguuuaauacaucuucauucucaacacucuccaaagaacuugaccuaccuuauggguuccauauuuuucuucuuaaaugugcaucaaucaugccuugcccccaaccuuuaaauauauucuuagaccugguaaaugcacucagacuugcgucuuuaggaauuuuuaacuuucuuucacuacauuggcacuuaaauuuuuucuuuauaaagcuuuuugaaggucauaaacaaagaccauaauugaugauagaccuaauacauuuccucuguguguguguguaacauuccaaauacuuuuuuuuucuuuuccacuguuuguaaggugcaacaauuuaauauuuuuaagggacuuuuuaagaguuccuuaagaaccaauuuaaaauuacuucagugcaauccuacacaguaucaacauuagaauuuugauauuagucuuauguuaucuuccauucuauuuuuaucugcuuuuugcugcuaguuucaaacugccaguauuuuuccuuuugcuuuuaaaauaguuacaauauuuuucaugauagccacaguauugccacaguuuauuauaauaaaggguuuuuauuugauuuagcgcauucaaagcuuuuuucuaucacuuuuguguucagaauauaaccuuugugugcguguauguugugugugugcauguguggcguauauguguguuacagguuaaugccuucuuggaauuguguuaauguucucuugguuuauuaugccaucagaaugguaaaugagaacacuacaacuguagucagcucacaauuuuuaaauaaaggauaccacagugcaugcuguuuguucaa
